United States Patent 10,706,955 (BIOINFORMATIC PROCESSES FOR DETERMINATION OF PEPTIDE BINDING) - sequence listing, part 40

SEQ ID NO: 1537023 - protein, 13 aa, Mycobacterium tuberculosis
AAVPPTDPITVPV

SEQ ID NO: 1537024 - protein, 13 aa, Mycobacterium tuberculosis
ADAENDDEHGSAL

SEQ ID NO: 1537025 - protein, 10 aa, Mycobacterium tuberculosis
ADTTRDTDGQ

SEQ ID NO: 1537026 - protein, 13 aa, Mycobacterium tuberculosis
AEEEPSGRAPVGA

SEQ ID NO: 1537027 - protein, 5 aa, Mycobacterium tuberculosis
AETDP

SEQ ID NO: 1537028 - protein, 16 aa, Mycobacterium tuberculosis
AGAAGPEGADAASAIA

SEQ ID NO: 1537029 - protein, 5 aa, Mycobacterium tuberculosis
AGGHP

SEQ ID NO: 1537030 - protein, 24 aa, Mycobacterium tuberculosis
AGGLGGGCSTRSGPTPTPEPASRG

SEQ ID NO: 1537031 - protein, 11 aa, Mycobacterium tuberculosis
AGGLPSAAIGG

SEQ ID NO: 1537032 - protein, 15 aa, Mycobacterium tuberculosis
AGGPDGGWNKPPTPL

SEQ ID NO: 1537033 - protein, 13 aa, Mycobacterium tuberculosis
AGNRPKGEVSEGW

SEQ ID NO: 1537034 - protein, 14 aa, Mycobacterium tuberculosis
AGPAGGAWVHYLLP

SEQ ID NO: 1537035 - protein, 8 aa, Mycobacterium tuberculosis
AGRSAHGW

SEQ ID NO: 1537036 - protein, 9 aa, Mycobacterium tuberculosis
AGTPPGERP

SEQ ID NO: 1537037 - protein, 6 aa, Mycobacterium tuberculosis
AHPDNR

SEQ ID NO: 1537038 - protein, 14 aa, Mycobacterium tuberculosis
ANDRAYQGGVGPTL

SEQ ID NO: 1537039 - protein, 7 aa, Mycobacterium tuberculosis
ANPKVAS

SEQ ID NO: 1537040 - protein, 5 aa, Mycobacterium tuberculosis
ANPLA

SEQ ID NO: 1537041 - protein, 14 aa, Mycobacterium tuberculosis
APADDSPGCSPSDY

SEQ ID NO: 1537042 - protein, 35 aa, Mycobacterium tuberculosis; identical to SEQ ID NO: 229079

SEQ ID NO: 1537043 - protein, 12 aa, Mycobacterium tuberculosis
APGKADPTGDDA

SEQ ID NO: 1537044 - protein, 9 aa, Mycobacterium tuberculosis
APNAPTRQV

SEQ ID NO: 1537045 - protein, 66 aa, Mycobacterium tuberculosis; identical to SEQ ID NO: 229109

SEQ ID NO: 1537046 - protein, 13 aa, Mycobacterium tuberculosis
APTAYDGDSPDEV

SEQ ID NO: 1537047 - protein, 5 aa, Mycobacterium tuberculosis
AQAPK

SEQ ID NO: 1537048 - protein, 4 aa, Mycobacterium tuberculosis
AQPI

SEQ ID NO: 1537049 - protein, 11 aa, Mycobacterium tuberculosis
ARGDVRSATDV

SEQ ID NO: 1537050 - protein, 8 aa, Mycobacterium tuberculosis
ARNSAMKG

SEQ ID NO: 1537051 - protein, 14 aa, Mycobacterium tuberculosis
ASAARNSAGFGAPR

SEQ ID NO: 1537052 - protein, 5 aa, Mycobacterium tuberculosis
ASLAP

SEQ ID NO: 1537053 - protein, 8 aa, Mycobacterium tuberculosis
ASNNPELT

SEQ ID NO: 1537054 - protein, 7 aa, Mycobacterium tuberculosis
ASTQSFK

SEQ ID NO: 1537055 - protein, 8 aa, Mycobacterium tuberculosis
ASVSTSAD

SEQ ID NO: 1537056 - protein, 8 aa, Mycobacterium tuberculosis
ATDGDGEA

SEQ ID NO: 1537057 - protein, 6 aa, Mycobacterium tuberculosis
ATDSRA

SEQ ID NO: 1537058 - protein, 10 aa, Mycobacterium tuberculosis
ATGAGNTGED

SEQ ID NO: 1537059 - protein, 6 aa, Mycobacterium tuberculosis
ATRGAG

SEQ ID NO: 1537060 - protein, 6 aa, Mycobacterium tuberculosis
ATSAEQ

SEQ ID NO: 1537061 - protein, 13 aa, Mycobacterium tuberculosis
AWPPSARAQPHTH

SEQ ID NO: 1537062 - protein, 8 aa, Mycobacterium tuberculosis
CGDPHPAA

SEQ ID NO: 1537063 - protein, 6 aa, Mycobacterium tuberculosis
DAQPHE

SEQ ID NO: 1537064 - protein, 6 aa, Mycobacterium tuberculosis
DAVRDG

SEQ ID NO: 1537065 - protein, 14 aa, Mycobacterium tuberculosis
DEQAMGGTLGANTD

SEQ ID NO: 1537066 - protein, 6 aa, Mycobacterium tuberculosis
DGASGG

SEQ ID NO: 1537067 - protein, 12 aa, Mycobacterium tuberculosis
DGITPPSAARAI

SEQ ID NO: 1537068 - protein, 4 aa, Mycobacterium tuberculosis
DGTT

SEQ ID NO: 1537069 - protein, 4 aa, Mycobacterium tuberculosis
DIND

SEQ ID NO: 1537070 - protein, 7 aa, Mycobacterium tuberculosis
DKAAARA

SEQ ID NO: 1537071 - protein, 9 aa, Mycobacterium tuberculosis
DNNGNGARV

SEQ ID NO: 1537072 - protein, 9 aa, Mycobacterium tuberculosis
DNNRQAPQD

SEQ ID NO: 1537073 - protein, 10 aa, Mycobacterium tuberculosis
DPGAKSARPA

SEQ ID NO: 1537074 - protein, 7 aa, Mycobacterium tuberculosis
DPSAPMP

SEQ ID NO: 1537075 - protein, 9 aa, Mycobacterium tuberculosis
DPSGRSAPL

SEQ ID NO: 1537076 - protein, 21 aa, Mycobacterium tuberculosis
DQSLPLDARGQPVVPEGSAGI

SEQ ID NO: 1537077 - protein, 4 aa, Mycobacterium tuberculosis
DRTQ

SEQ ID NO: 1537078 - protein, 9 aa, Mycobacterium tuberculosis
DSPPRPTPL

SEQ ID NO: 1537079 - protein, 11 aa, Mycobacterium tuberculosis
DTVTGTASDAQ

SEQ ID NO: 1537080 - protein, 21 aa, Mycobacterium tuberculosis
EAGDEQFGRATAQQLADTATA

SEQ ID NO: 1537081 - protein, 7 aa, Mycobacterium tuberculosis
EAGGDWN

SEQ ID NO: 1537082 - protein, 4 aa, Mycobacterium tuberculosis
EDGR

SEQ ID NO: 1537083 - protein, 8 aa, Mycobacterium tuberculosis
EEIRASGA

SEQ ID NO: 1537084 - protein, 30 aa, Mycobacterium tuberculosis; identical to SEQ ID NO: 229607

SEQ ID NO: 1537085 - protein, 11 aa, Mycobacterium tuberculosis
EPDVDCPSTNL

SEQ ID NO: 1537086 - protein, 8 aa, Mycobacterium tuberculosis
EQDGSKQW

SEQ ID NO: 1537087 - protein, 15 aa, Mycobacterium tuberculosis
ERLRPPPGYKDTTVP

SEQ ID NO: 1537088 - protein, 8 aa, Mycobacterium tuberculosis
ESARSRLT

SEQ ID NO: 1537089 - protein, 8 aa, Mycobacterium tuberculosis
ETQAPSIA

SEQ ID NO: 1537090 - protein, 13 aa, Mycobacterium tuberculosis
FPDSGRVDSTTKL

SEQ ID NO: 1537091 - protein, 8 aa, Mycobacterium tuberculosis
FPRPDDPL

SEQ ID NO: 1537092 - protein, 4 aa, Mycobacterium tuberculosis
GADG

SEQ ID NO: 1537093 - protein, 15 aa, Mycobacterium tuberculosis
GADRLSATGGALAAP

SEQ ID NO: 1537094 - protein, 10 aa, Mycobacterium tuberculosis
GAGGTAVASE

SEQ ID NO: 1537095 - protein, 6 aa, Mycobacterium tuberculosis
GAGSGI

SEQ ID NO: 1537096 - protein, 14 aa, Mycobacterium tuberculosis
GAQAAGRDPTTLGK

SEQ ID NO: 1537097 - protein, 7 aa, Mycobacterium tuberculosis
GAQQKQI

SEQ ID NO: 1537098 - protein, 16 aa, Mycobacterium tuberculosis
GCQGDPSAAELPDVGD

SEQ ID NO: 1537099 - protein, 20 aa, Mycobacterium tuberculosis
GDAATRKDGPVPHYPAPDGV

SEQ ID NO: 1537100 - protein, 14 aa, Mycobacterium tuberculosis
GDISNTPQTVATGS

SEQ ID NO: 1537101 - protein, 15 aa, Mycobacterium tuberculosis
GGSADGSADSTGRVP

SEQ ID NO: 1537102 - protein, 7 aa, Mycobacterium tuberculosis
GGSVTTA

SEQ ID NO: 1537103 - protein, 16 aa, Mycobacterium tuberculosis
GGTGPSARELAQTRTV

SEQ ID NO: 1537104 - protein, 6 aa, Mycobacterium tuberculosis
GIGGAA

SEQ ID NO: 1537105 - protein, 11 aa, Mycobacterium tuberculosis
GKDAPTTAASS

SEQ ID NO: 1537106 - protein, 10 aa, Mycobacterium tuberculosis
GKPEPPPVDS

SEQ ID NO: 1537107 - protein, 7 aa, Mycobacterium tuberculosis
GKPQLGD

SEQ ID NO: 1537108 - protein, 14 aa, Mycobacterium tuberculosis
GKQSPANPAPSRPL

SEQ ID NO: 1537109 - protein, 9 aa, Mycobacterium tuberculosis
GLAPGGHAA

SEQ ID NO: 1537110 - protein, 12 aa, Mycobacterium tuberculosis
GLTGSEPASLSK

SEQ ID NO: 1537111 - protein, 14 aa, Mycobacterium tuberculosis
GNSGGQGGTPRAVP

SEQ ID NO: 1537112 - protein, 7 aa, Mycobacterium tuberculosis
GNSPHVS

SEQ ID NO: 1537113 - protein, 5 aa, Mycobacterium tuberculosis
GNSTS

SEQ ID NO: 1537114 - protein, 6 aa, Mycobacterium tuberculosis
GPKNQT

SEQ ID NO: 1537115 - protein, 7 aa, Mycobacterium tuberculosis
GPPEAPD

SEQ ID NO: 1537116 - protein, 8 aa, Mycobacterium tuberculosis
GQSGPTTV

SEQ ID NO: 1537117 - protein, 9 aa, Mycobacterium tuberculosis
GQTSPANVV

SEQ ID NO: 1537118 - protein, 9 aa, Mycobacterium tuberculosis
GRQSEEGSG

SEQ ID NO: 1537119 - protein, 9 aa, Mycobacterium tuberculosis
GRVPNPALP

SEQ ID NO: 1537120 - protein, 9 aa, Mycobacterium tuberculosis
GSAGGLTKP

SEQ ID NO: 1537121 - protein, 7 aa, Mycobacterium tuberculosis
GSGAGGA

SEQ ID NO: 1537122 - protein, 15 aa, Mycobacterium tuberculosis
GSGAGVQVIEHAAGT

SEQ ID NO: 1537123 - protein, 6 aa, Mycobacterium tuberculosis
GSGQTY

SEQ ID NO: 1537124 - protein, 9 aa, Mycobacterium tuberculosis
GSRLGYQES

SEQ ID NO: 1537125 - protein, 6 aa, Mycobacterium tuberculosis
GTDPGV

SEQ ID NO: 1537126 - protein, 4 aa, Mycobacterium tuberculosis
GTGA

SEQ ID NO: 1537127 - protein, 10 aa, Mycobacterium tuberculosis
GVHPNDAGHE

SEQ ID NO: 1537128 - protein, 11 aa, Mycobacterium tuberculosis
HDDAGNPVDSW

SEQ ID NO: 1537129 - protein, 14 aa, Mycobacterium tuberculosis
HGAPVRRSAGAEAA

SEQ ID NO: 1537130 - protein, 19 aa, Mycobacterium tuberculosis
HGPPVGAPPFPPTAPPPPF

SEQ ID NO: 1537131 - protein, 11 aa, Mycobacterium tuberculosis
HGTGTPVGDPV

SEQ ID NO: 1537132 - protein, 13 aa, Mycobacterium tuberculosis
HSGNGNNLSGYAN

SEQ ID NO: 1537133 - protein, 11 aa, Mycobacterium tuberculosis
IQPGDSGGPVV

SEQ ID NO: 1537134 - protein, 11 aa, Mycobacterium tuberculosis
IRSGGGSPTVH

SEQ ID NO: 1537135 - protein, 10 aa, Mycobacterium tuberculosis
ISNTATTDCT

SEQ ID NO: 1537136 - protein, 8 aa, Mycobacterium tuberculosis
KARQAGHS

SEQ ID NO: 1537137 - protein, 7 aa, Mycobacterium tuberculosis
KATFAGD

SEQ ID NO: 1537138 - protein, 9 aa, Mycobacterium tuberculosis
KEDAAAQRG

SEQ ID NO: 1537139 - protein, 6 aa, Mycobacterium tuberculosis
KGPDLA

SEQ ID NO: 1537140 - protein, 11 aa, Mycobacterium tuberculosis
KVAQQKGAIPG

SEQ ID NO: 1537141 - protein, 6 aa, Mycobacterium tuberculosis
KYPTSV

SEQ ID NO: 1537142 - protein, 11 aa, Mycobacterium tuberculosis
LAPPASAGCPD

SEQ ID NO: 1537143 - protein, 8 aa, Mycobacterium tuberculosis
LDATKGLT

SEQ ID NO: 1537144 - protein, 9 aa, Mycobacterium tuberculosis
LDSDPGNPA

SEQ ID NO: 1537145 - protein, 12 aa, Mycobacterium tuberculosis
LESGSNSGYRPY

SEQ ID NO: 1537146 - protein, 6 aa, Mycobacterium tuberculosis
LGSGSI

SEQ ID NO: 1537147 - protein, 10 aa, Mycobacterium tuberculosis
LGTPPDGVTG

SEQ ID NO: 1537148 - protein, 9 aa, Mycobacterium tuberculosis
LNRATAKTT

SEQ ID NO: 1537149 - protein, 6 aa, Mycobacterium tuberculosis
LPAAGD

SEQ ID NO: 1537150 - protein, 11 aa, Mycobacterium tuberculosis
LPPQAGRPRGW

SEQ ID NO: 1537151 - protein, 5 aa, Mycobacterium tuberculosis
NATQV

SEQ ID NO: 1537152 - protein, 7 aa, Mycobacterium tuberculosis
NAVGAGT

SEQ ID NO: 1537153 - protein, 4 aa, Mycobacterium tuberculosis
NDTL

SEQ ID NO: 1537154 - protein, 46 aa, Mycobacterium tuberculosis; identical to SEQ ID NO: 228690

SEQ ID NO: 1537155 - protein, 17 aa, Mycobacterium tuberculosis
NMPTGNQDVQASNPVFG

SEQ ID NO: 1537156 - protein, 15 aa, Mycobacterium tuberculosis
NPAVDPASGAATVAS

SEQ ID NO: 1537157 - protein, 4 aa, Mycobacterium tuberculosis
PAAG

SEQ ID NO: 1537158 - protein, 7 aa, Mycobacterium tuberculosis
PAATPGA

SEQ ID NO: 1537159 - protein, 12 aa, Mycobacterium tuberculosis
PANATAKIGQTS

SEQ ID NO: 1537160 - protein, 11 aa, Mycobacterium tuberculosis
PARPNRPEADR

SEQ ID NO: 1537161 - protein, 10 aa, Mycobacterium tuberculosis
PASGDNGWGS

SEQ ID NO: 1537162 - protein, 9 aa, Mycobacterium tuberculosis
PDEPRAGAG

SEQ ID NO: 1537163 - protein, 4 aa, Mycobacterium tuberculosis
PDTV

SEQ ID NO: 1537164 - protein, 7 aa, Mycobacterium tuberculosis
PELGGPL

SEQ ID NO: 1537165 - protein, 7 aa, Mycobacterium tuberculosis
PHTRTQD

SEQ ID NO: 1537166 - protein, 25 aa, Mycobacterium tuberculosis
PIPGITPAAPALPVTAPAAAPTIPG

SEQ ID NO: 1537167 - protein, 8 aa, Mycobacterium tuberculosis
PIPRNAPG

SEQ ID NO: 1537168 - protein, 4 aa, Mycobacterium tuberculosis
PNKG

SEQ ID NO: 1537169 - protein, 10 aa, Mycobacterium tuberculosis
PNPARRATNG

SEQ ID NO: 1537170 - protein, 23 aa, Mycobacterium tuberculosis
PPASRGRPGPLSGPELADPARSV

SEQ ID NO: 1537171 - protein, 9 aa, Mycobacterium tuberculosis
PRKSVSGSL

SEQ ID NO: 1537172 - protein, 11 aa, Mycobacterium tuberculosis
PSAPGNPGRWG

SEQ ID NO: 1537173 - protein, 4 aa, Mycobacterium tuberculosis
PSGG

SEQ ID NO: 1537174 - protein, 9 aa, Mycobacterium tuberculosis
PTSLGAAPV

SEQ ID NO: 1537175 - protein, 8 aa, Mycobacterium tuberculosis
PTVQQPNS

SEQ ID NO: 1537176 - protein, 17 aa, Mycobacterium tuberculosis
PVSEPAASGPELTPEAG

SEQ ID NO: 1537177 - protein, 6 aa, Mycobacterium tuberculosis
QAAEQA

SEQ ID NO: 1537178 - protein, 7 aa, Mycobacterium tuberculosis
QARPEAR

SEQ ID NO: 1537179 - protein, 6 aa, Mycobacterium tuberculosis
QARQRA

SEQ ID NO: 1537180 - protein, 7 aa, Mycobacterium tuberculosis
QDGGNAV

SEQ ID NO: 1537181 - protein, 18 aa, Mycobacterium tuberculosis
QDPSGGSRTVQVTLGKAE

SEQ ID NO: 1537182 - protein, 11 aa, Mycobacterium tuberculosis
QEHDAARPDAE

SEQ ID NO: 1537183 - protein, 9 aa, Mycobacterium tuberculosis
QHAPDTGNL

SEQ ID NO: 1537184 - protein, 6 aa, Mycobacterium tuberculosis
QNAPEA

SEQ ID NO: 1537185 - protein, 18 aa, Mycobacterium tuberculosis
QNGGAAAPAASPPVPPIP

SEQ ID NO: 1537186 - protein, 13 aa, Mycobacterium tuberculosis
QQAGLPDRGPQSW

SEQ ID NO: 1537187 - protein, 9 aa, Mycobacterium tuberculosis
QTKTGSSAN

SEQ ID NO: 1537188 - protein, 15 aa, Mycobacterium tuberculosis
RDSDGPDHSRDYPGP

SEQ ID NO: 1537189 - protein, 7 aa, Mycobacterium tuberculosis
RDYPTDK

SEQ ID NO: 1537190 - protein, 8 aa, Mycobacterium tuberculosis
RGPDESGT

SEQ ID NO: 1537191 - protein, 6 aa, Mycobacterium tuberculosis
RNPTRW

SEQ ID NO: 1537192 - protein, 7 aa, Mycobacterium tuberculosis
RPGTYNE

SEQ ID NO: 1537193 - protein, 8 aa, Mycobacterium tuberculosis
RPPTDDEP

SEQ ID NO: 1537194 - protein, 7 aa, Mycobacterium tuberculosis
RPTAADE

SEQ ID NO: 1537195 - protein, 12 aa, Mycobacterium tuberculosis
RSFGSDPATVTA

SEQ ID NO: 1537196 - protein, 10 aa, Mycobacterium tuberculosis
RSNQTPSDAG

SEQ ID NO: 1537197 - protein, 13 aa, Mycobacterium tuberculosis
RSPYTSARLGQPV

SEQ ID NO: 1537198 - protein, 4 aa, Mycobacterium tuberculosis
RTAG

SEQ ID NO: 1537199 - protein, 27 aa, Mycobacterium tuberculosis
RTNNPWDAARTSGGSAGGGAAATAAGL

SEQ ID NO: 1537200 - protein, 8 aa, Mycobacterium tuberculosis
SADPAERA

SEQ ID NO: 1537201 - protein, 10 aa, Mycobacterium tuberculosis
SAPAASLGIS

SEQ ID NO: 1537202 - protein, 6 aa, Mycobacterium tuberculosis
SASGPL

SEQ ID NO: 1537203 - protein, 23 aa, Mycobacterium tuberculosis
SASSTISQRPAPREHRDGDTPEA

SEQ ID NO: 1537204 - protein, 9 aa, Mycobacterium tuberculosis
SAVDDASER

SEQ ID NO: 1537205 - protein, 6 aa, Mycobacterium tuberculosis
SCAAGT

SEQ ID NO: 1537206 - protein, 4 aa, Mycobacterium tuberculosis
SDSV

SEQ ID NO: 1537207 - protein, 12 aa, Mycobacterium tuberculosis
SGPQSATLAGRY

SEQ ID NO: 1537208 - protein, 6 aa, Mycobacterium tuberculosis
SGQLNP

SEQ ID NO: 1537209 - protein, 10 aa, Mycobacterium tuberculosis
SGRDAVAQGG

SEQ ID NO: 1537210 - protein, 5 aa, Mycobacterium tuberculosis
SGTGI

SEQ ID NO: 1537211 - protein, 18 aa, Mycobacterium tuberculosis
SKDAVGSGTAAGSAGAAG

SEQ ID NO: 1537212 - protein, 10 aa, Mycobacterium tuberculosis
SLGSSSDLRV

SEQ ID NO: 1537213 - protein, 13 aa, Mycobacterium tuberculosis
SNPFSSAATLPKE

SEQ ID NO: 1537214 - protein, 6 aa, Mycobacterium tuberculosis
SPGGKT

SEQ ID NO: 1537215 - protein, 13 aa, Mycobacterium tuberculosis
SPITNDNDQARYD

SEQ ID NO: 1537216 - protein, 6 aa, Mycobacterium tuberculosis
SPNPGY

SEQ ID NO: 1537217 - protein, 9 aa, Mycobacterium tuberculosis
SPPAAAGDL

SEQ ID NO: 1537218 - protein, 6 aa, Mycobacterium tuberculosis
SPSMGR

SEQ ID NO: 1537219 - protein, 12 aa, Mycobacterium tuberculosis
SRLTSEDVKTVP

SEQ ID NO: 1537220 - protein, 22 aa, Mycobacterium tuberculosis
SSPKPDAEEQGVPVSPTASDPA

SEQ ID NO: 1537221 - protein, 10 aa, Mycobacterium tuberculosis
SSSPPQPPKD

SEQ ID NO: 1537222 - protein, 5 aa, Mycobacterium tuberculosis
STGNM

SEQ ID NO: 1537223 - protein, 15 aa, Mycobacterium tuberculosis
SVPEGPGINDNGSGV

SEQ ID NO: 1537224 - protein, 7 aa, Mycobacterium tuberculosis
TAASDNF

SEQ ID NO: 1537225 - protein, 8 aa, Mycobacterium tuberculosis
TADPQTDT

SEQ ID NO: 1537226 - protein, 7 aa, Mycobacterium tuberculosis
TAHPHPT

SEQ ID NO: 1537227 - protein, 13 aa, Mycobacterium tuberculosis
TAPAQAAPPALSQ

SEQ ID NO: 1537228 - protein, 5 aa, Mycobacterium tuberculosis
TASNT

SEQ ID NO: 1537229 - protein, 7 aa, Mycobacterium tuberculosis
TDSTGWT

SEQ ID NO: 1537230 - protein, 10 aa, Mycobacterium tuberculosis
TEDGSPRGAR

SEQ ID NO: 1537231 - protein, 5 aa, Mycobacterium tuberculosis
TESLG

SEQ ID NO: 1537232 - protein, 12 aa, Mycobacterium tuberculosis
TGKLPDTDTYCP

SEQ ID NO: 1537233 - protein, 9 aa, Mycobacterium tuberculosis
TGPASGKSL

SEQ ID NO: 1537234 - protein, 6 aa, Mycobacterium tuberculosis
TGPSPT

SEQ ID NO: 1537235 - protein, 10 aa, Mycobacterium tuberculosis
TGVKNPDYSD

SEQ ID NO: 1537236 - protein, 4 aa, Mycobacterium tuberculosis
TNSR

SEQ ID NO: 1537237 - protein, 6 aa, Mycobacterium tuberculosis
TPAMPP

SEQ ID NO: 1537238 - protein, 10 aa, Mycobacterium tuberculosis
TPFSHGNHEP

SEQ ID NO: 1537239 - protein, 5 aa, Mycobacterium tuberculosis
TQGNT

SEQ ID NO: 1537240 - protein, 4 aa, Mycobacterium tuberculosis
TRGG

SEQ ID NO: 1537241 - protein, 6 aa, Mycobacterium tuberculosis
TSGGGW

SEQ ID NO: 1537242 - protein, 5 aa, Mycobacterium tuberculosis
TTCGR

SEQ ID NO: 1537243 - protein, 5 aa, Mycobacterium tuberculosis
TTGKV

SEQ ID NO: 1537244 - protein, 14 aa, Mycobacterium tuberculosis
TVQASDSLTGAEET

SEQ ID NO: 1537245 - protein, 9 aa, Mycobacterium tuberculosis
TYADPGHAI

SEQ ID NO: 1537246 - protein, 6 aa, Mycobacterium tuberculosis
TYSPPY

SEQ ID NO: 1537247 - protein, 6 aa, Mycobacterium tuberculosis
VAADTR

SEQ ID NO: 1537248 - protein, 11 aa, Mycobacterium tuberculosis
VASTGSLAGIT

SEQ ID NO: 1537249 - protein, 7 aa, Mycobacterium tuberculosis
VDQPNPV

SEQ ID NO: 1537250 - protein, 6 aa, Mycobacterium tuberculosis
VGGSTA

SEQ ID NO: 1537251 - protein, 4 aa, Mycobacterium tuberculosis
VPGA

SEQ ID NO: 1537252 - protein, 6 aa, Mycobacterium tuberculosis
VPPAPI

SEQ ID NO: 1537253 - protein, 6 aa, Mycobacterium tuberculosis
VSTANA

SEQ ID NO: 1537254 - protein, 8 aa, Mycobacterium tuberculosis
WGRDPDTM

SEQ ID NO: 1537255 - protein, 15 aa, Mycobacterium tuberculosis
YATDGDDDGVADPQN

SEQ ID NO: 1537256 - protein, 13 aa, Mycobacterium tuberculosis
YGTGHGAMSVTVS

SEQ ID NO: 1537257 - protein, 7 aa, Mycobacterium tuberculosis
YNDEQGV

SEQ ID NO: 1537258 - protein, 6 aa, Mycobacterium tuberculosis
YNPGLT

SEQ ID NO: 1537259 - protein, 4 aa, Mycobacterium tuberculosis
YQRA

SEQ ID NO: 1537260 - protein, 18 aa, Mycobacterium tuberculosis
YQRDPDAQSPAGGVSSSL

SEQ ID NO: 1537261 - protein, 17 aa, Mycobacterium tuberculosis
YTPNPNDAPGGPLVERA

SEQ ID NO: 1537262 - protein, 6 aa, Mycobacterium tuberculosis
AADNAD

SEQ ID NO: 1537263 - protein, 11 aa, Mycobacterium tuberculosis
AAERARNDRRA

SEQ ID NO: 1537264 - protein, 9 aa, Mycobacterium tuberculosis
AAGADPAAV

SEQ ID NO: 1537265 - protein, 9 aa, Mycobacterium tuberculosis
AAGRSDAAA

SEQ ID NO: 1537266 - protein, 23 aa, Mycobacterium tuberculosis
AANAAAAASTTALAAAGADEVSA

SEQ ID NO: 1537267 - protein, 26 aa, Mycobacterium tuberculosis
AAPPPPDPLAGPPGDAGLAPPAPAPA

SEQ ID NO: 1537268 - protein, 11 aa, Mycobacterium tuberculosis
AAQARQTATQI

SEQ ID NO: 1537269 - protein, 9 aa, Mycobacterium tuberculosis
ADGKKMENA

SEQ ID NO: 1537270 - protein, 5 aa, Mycobacterium tuberculosis
AEADR

SEQ ID NO: 1537271 - protein, 4 aa, Mycobacterium tuberculosis
AEAI

SEQ ID NO: 1537272 - protein, 9 aa, Mycobacterium tuberculosis
AERADMPRT

SEQ ID NO: 1537273 - protein, 11 aa, Mycobacterium tuberculosis
AETAADPVAKL

SEQ ID NO: 1537274 - protein, 7 aa, Mycobacterium tuberculosis
AETANAT

SEQ ID NO: 1537275 - protein, 4 aa, Mycobacterium tuberculosis
AGAE

SEQ ID NO: 1537276 - protein, 5 aa, Mycobacterium tuberculosis
AGGDE

SEQ ID NO: 1537277 - protein, 20 aa, Mycobacterium tuberculosis
AGPDTISGATIPQGEQSTGK

SEQ ID NO: 1537278 - protein, 7 aa, Mycobacterium tuberculosis
AGPIGVP

SEQ ID NO: 1537279 - protein, 10 aa, Mycobacterium tuberculosis
AGRQSSQSVP

SEQ ID NO: 1537280 - protein, 10 aa, Mycobacterium tuberculosis
AGRSGRRGQG

SEQ ID NO: 1537281 - protein, 6 aa, Mycobacterium tuberculosis
AGTSAG

SEQ ID NO: 1537282 - protein, 13 aa, Mycobacterium tuberculosis
AIPTTTSGKLKRR

SEQ ID NO: 1537283 - protein, 15 aa, Mycobacterium tuberculosis
AKNAGCPLGADPAKA

SEQ ID NO: 1537284 - protein, 4 aa, Mycobacterium tuberculosis
ALPG

SEQ ID NO: 1537285 - protein, 19 aa, Mycobacterium tuberculosis
ANAKTGTSMAANRPEYPHK

SEQ ID NO: 1537286 - protein, 17 aa, Mycobacterium tuberculosis
ANLPPCPAAGNGPGAAA

SEQ ID NO: 1537287 - protein, 5 aa, Mycobacterium tuberculosis
APGMT

SEQ ID NO: 1537288 - protein, 9 aa, Mycobacterium tuberculosis
APPAEIAPG

SEQ ID NO: 1537289 - protein, 7 aa, Mycobacterium tuberculosis
APPRAGA

SEQ ID NO: 1537290 - protein, 5 aa, Mycobacterium tuberculosis
APTPI

SEQ ID NO: 1537291 - protein, 8 aa, Mycobacterium tuberculosis
ARRPDGTT

SEQ ID NO: 1537292 - protein, 9 aa, Mycobacterium tuberculosis
ASNDEADEL

SEQ ID NO: 1537293 - protein, 4 aa, Mycobacterium tuberculosis
ASQA

SEQ ID NO: 1537294 - protein, 17 aa, Mycobacterium tuberculosis
ATAANSDLKRLPTEDEV

SEQ ID NO: 1537295 - protein, 10 aa, Mycobacterium tuberculosis
ATSAAARTLT

SEQ ID NO: 1537296 - protein, 17 aa, Mycobacterium tuberculosis
ATSPPNPDGPPPAPGLP

SEQ ID NO: 1537297 - protein, 7 aa, Mycobacterium tuberculosis
ATTRTGV

SEQ ID NO: 1537298 - protein, 14 aa, Mycobacterium tuberculosis
AVGGPDDPEFHPPR

SEQ ID NO: 1537299 - protein, 4 aa, Mycobacterium tuberculosis
CATY

SEQ ID NO: 1537300 - protein, 22 aa, Mycobacterium tuberculosis
CRNTTDHHHDDETTNITNQLVQ

SEQ ID NO: 1537301 - protein, 18 aa, Mycobacterium tuberculosis
CTTTTTGKAGLAPNAVPR

SEQ ID NO: 1537302 - protein, 6 aa, Mycobacterium tuberculosis
DAAART

SEQ ID NO: 1537303 - protein, 15 aa, Mycobacterium tuberculosis
DAKAEGRDTINGQNT

SEQ ID NO: 1537304 - protein, 6 aa, Mycobacterium tuberculosis
DAQPIT

SEQ ID NO: 1537305 - protein, 6 aa, Mycobacterium tuberculosis
DDAEQT

SEQ ID NO: 1537306 - protein, 7 aa, Mycobacterium tuberculosis
DGPPPGQ

SEQ ID NO: 1537307 - protein, 5 aa, Mycobacterium tuberculosis
DGSSH

SEQ ID NO: 1537308 - protein, 7 aa, Mycobacterium tuberculosis
DGTSEPF

SEQ ID NO: 1537309 - protein, 4 aa, Mycobacterium tuberculosis
DHGP

SEQ ID NO: 1537310 - protein, 13 aa, Mycobacterium tuberculosis
DKARSRATGGSGL

SEQ ID NO: 1537311 - protein, 7 aa, Mycobacterium tuberculosis
DKDNLGR

SEQ ID NO: 1537312 - protein, 21 aa, Mycobacterium tuberculosis
DPDNPRISRPARTKDPRGLSY

SEQ ID NO: 1537313 - protein, 8 aa, Mycobacterium tuberculosis
DPDQLGRR

SEQ ID NO: 1537314 - protein, 4 aa, Mycobacterium tuberculosis
DPRV

SEQ ID NO: 1537315 - protein, 17 aa, Mycobacterium tuberculosis
DRNDAPGGHNGCDTRDD

SEQ ID NO: 1537316 - protein, 7 aa, Mycobacterium tuberculosis
DRYATGT

SEQ ID NO: 1537317 - protein, 11 aa, Mycobacterium tuberculosis
DSGTPTGRDEQ

SEQ ID NO: 1537318 - protein, 8 aa, Mycobacterium tuberculosis
DSNPQAAR

SEQ ID NO: 1537319 - protein, 4 aa, Mycobacterium tuberculosis
DSSV

SEQ ID NO: 1537320 - protein, 8 aa, Mycobacterium tuberculosis
DVAGGSAD

SEQ ID NO: 1537321 - protein, 4 aa, Mycobacterium tuberculosis
EGRA

SEQ ID NO: 1537322 - protein, 5 aa, Mycobacterium tuberculosis
EKRAK

SEQ ID NO: 1537323 - protein, 9 aa, Mycobacterium tuberculosis
ELQSAAETY

SEQ ID NO: 1537324 - protein, 11 aa, Mycobacterium tuberculosis
ENAAPAGTPVR

SEQ ID NO: 1537325 - protein, 4 aa, Mycobacterium tuberculosis
EPEH

SEQ ID NO: 1537326 - protein, 7 aa, Mycobacterium tuberculosis
ESEQHRT

SEQ ID NO: 1537327 - protein, 15 aa, Mycobacterium tuberculosis
EWPEPAESLPPPYDN

SEQ ID NO: 1537328 - protein, 6 aa, Mycobacterium tuberculosis
FDETSD

SEQ ID NO: 1537329 - protein, 9 aa, Mycobacterium tuberculosis
GAGGVGKTR

SEQ ID NO: 1537330 - protein, 9 aa, Mycobacterium tuberculosis
GARTAAHRQ

SEQ ID NO: 1537331 - protein, 8 aa, Mycobacterium tuberculosis
GATETPGL

SEQ ID NO: 1537332 - protein, 14 aa, Mycobacterium tuberculosis
GDHATSGPAAINQT

SEQ ID NO: 1537333 - protein, 13 aa, Mycobacterium tuberculosis
GDRADPTDDSGTD

SEQ ID NO: 1537334 - protein, 9 aa, Mycobacterium tuberculosis
GDSEFDPQR

SEQ ID NO: 1537335 - protein, 5 aa, Mycobacterium tuberculosis
GEEGR

SEQ ID NO: 1537336 - protein, 14 aa, Mycobacterium tuberculosis
GGAATAGAFSRPGL

SEQ ID NO: 1537337 - protein, 5 aa, Mycobacterium tuberculosis
GGGPL

SEQ ID NO: 1537338 - protein, 4 aa, Mycobacterium tuberculosis
GGHG

SEQ ID NO: 1537339 - protein, 10 aa, Mycobacterium tuberculosis
GHAKREYREN

SEQ ID NO: 1537340 - protein, 5 aa, Mycobacterium tuberculosis
GHHPG

SEQ ID NO: 1537341 - protein, 37 aa, Mycobacterium tuberculosis; identical to SEQ ID NO: 229912

SEQ ID NO: 1537342 - protein, 13 aa, Mycobacterium tuberculosis
GKGYPDAGAAPCR

SEQ ID NO: 1537343 - protein, 24 aa, Mycobacterium tuberculosis
GKVPNKAVSYEKGTGGNRSEYRVG

SEQ ID NO: 1537344 - protein, 24 aa, Mycobacterium tuberculosis
GLTGDGIPTAQPLTAEAAAGLPGQ

SEQ ID NO: 1537345 - protein, 9 aa, Mycobacterium tuberculosis
GNTDCPGNA

SEQ ID NO: 1537346 - protein, 15 aa, Mycobacterium tuberculosis
GPETTPAAPARTAEL

SEQ ID NO: 1537347 - protein, 5 aa, Mycobacterium tuberculosis
GPEVG

SEQ ID NO: 1537348 - protein, 6 aa, Mycobacterium tuberculosis
GQAGVA

SEQ ID NO: 1537349 - protein, 9 aa, Mycobacterium tuberculosis
GQPASGPRR

SEQ ID NO: 1537350 - protein, 8 aa, Mycobacterium tuberculosis
GRRITSPE

SEQ ID NO: 1537351 - protein, 16 aa, Mycobacterium tuberculosis
GSQVSAANAAAAMPTT

SEQ ID NO: 1537352 - protein, 7 aa, Mycobacterium tuberculosis
GSQWPGM

SEQ ID NO: 1537353 - protein, 6 aa, Mycobacterium tuberculosis
GSSGHL

SEQ ID NO: 1537354 - protein, 5 aa, Mycobacterium tuberculosis
GVPGV

SEQ ID NO: 1537355 - protein, 8 aa, Mycobacterium tuberculosis
GWDSDPPD

SEQ ID NO: 1537356 - protein, 11 aa, Mycobacterium tuberculosis
GYDYDNPHSTG

SEQ ID NO: 1537357 - protein, 7 aa, Mycobacterium tuberculosis
GYPGDRA

SEQ ID NO: 1537358 - protein, 6 aa, Mycobacterium tuberculosis
GYTPGD

SEQ ID NO: 1537359 - protein, 10 aa, Mycobacterium tuberculosis
HQRTPARAEQ

SEQ ID NO: 1537360 - protein, 7 aa, Mycobacterium tuberculosis
IAPEDQE

SEQ ID NO: 1537361 - protein, 7 aa, Mycobacterium tuberculosis
ISPGSTI

SEQ ID NO: 1537362 - protein, 5 aa, Mycobacterium tuberculosis
KAGCQ

SEQ ID NO: 1537363 - protein, 17 aa, Mycobacterium tuberculosis
KATDEALERAQKSNHVF

SEQ ID NO: 1537364 - protein, 5 aa, Mycobacterium tuberculosis
LAADP

SEQ ID NO: 1537365 - protein, 6 aa, Mycobacterium tuberculosis
LETADG

SEQ ID NO: 1537366 - protein, 31 aa, Mycobacterium tuberculosis; identical to SEQ ID NO: 230428

SEQ ID NO: 1537367 - protein, 4 aa, Mycobacterium tuberculosis
LQPG

SEQ ID NO: 1537368 - protein, 4 aa, Mycobacterium tuberculosis
LRRG

SEQ ID NO: 1537369 - protein, 7 aa, Mycobacterium tuberculosis
LSAPGSR

SEQ ID NO: 1537370 - protein, 7 aa, Mycobacterium tuberculosis
LSGAGPT

SEQ ID NO: 1537371 - protein, 5 aa, Mycobacterium tuberculosis
LSQRY

SEQ ID NO: 1537372 - protein, 5 aa, Mycobacterium tuberculosis
MPPCP

SEQ ID NO: 1537373 - protein, 9 aa, Mycobacterium tuberculosis
MYSGPGAGS

SEQ ID NO: 1537374 - protein, 14 aa, Mycobacterium tuberculosis
NGADGLPGQNGGAG

SEQ ID NO: 1537375 - protein, 7 aa, Mycobacterium tuberculosis
NGKPLPK

SEQ ID NO: 1537376 - protein, 8 aa, Mycobacterium tuberculosis
NGRPDLET

SEQ ID NO: 1537377 - protein, 9 aa, Mycobacterium tuberculosis
NRGGATAED

SEQ ID NO: 1537378 - protein, 6 aa, Mycobacterium tuberculosis
NSLPES

SEQ ID NO: 1537379 - protein, 6 aa, Mycobacterium tuberculosis
NVDTSE

SEQ ID NO: 1537380 - protein, 13 aa, Mycobacterium tuberculosis
PARNSDGAPGHSA

SEQ ID NO: 1537381 - protein, 7 aa, Mycobacterium tuberculosis
PDASTVR

SEQ ID NO: 1537382 - protein, 4 aa, Mycobacterium tuberculosis
PDDM

SEQ ID NO: 1537383 - protein, 30 aa, Mycobacterium tuberculosis; identical to SEQ ID NO: 1436836

SEQ ID NO: 1537384 - protein, 4 aa, Mycobacterium tuberculosis
PDPL

SEQ ID NO: 1537385 - protein, 4 aa, Mycobacterium tuberculosis
PERD

SEQ ID NO: 1537386 - protein, 34 aa, Mycobacterium tuberculosis; identical to SEQ ID NO: 230747

SEQ ID NO: 1537387 - protein, 18 aa, Mycobacterium tuberculosis
PGQRVDPTGPMRLHPWWR

SEQ ID NO: 1537388 - protein, 25 aa, Mycobacterium tuberculosis
PIAPTPPAPGAPALPPGPPSLLAAL

SEQ ID NO: 1537389 - protein, 25 aa, Mycobacterium tuberculosis
PIPGITAPAPAAAAVPASVPGVPSA

SEQ ID NO: 1537390 - protein, 8 aa, Mycobacterium tuberculosis
PKNARTQD

SEQ ID NO: 1537391 - protein, 18 aa, Mycobacterium tuberculosis
PQPASLPAAGATGQPGPG

SEQ ID NO: 1537392 - protein, 5 aa, Mycobacterium tuberculosis
PREFR

SEQ ID NO: 1537393 - protein, 7 aa, Mycobacterium tuberculosis
PTKDTSV

SEQ ID NO: 1537394 - protein, 4 aa, Mycobacterium tuberculosis
PTQA

SEQ ID NO: 1537395 - protein, 8 aa, Mycobacterium tuberculosis
PTRPGGVS

SEQ ID NO: 1537396 - protein, 7 aa, Mycobacterium tuberculosis
QALGGED

SEQ ID NO: 1537397 - protein, 9 aa, Mycobacterium tuberculosis
QNGNAGSRV

SEQ ID NO: 1537398 - protein, 10 aa, Mycobacterium tuberculosis
QPDASVRSDA

SEQ ID NO: 1537399 - protein, 4 aa, Mycobacterium tuberculosis
QRSQ

SEQ ID NO: 1537400 - protein, 7 aa, Mycobacterium tuberculosis
QSTPSVV

SEQ ID NO: 1537401 - protein, 17 aa, Mycobacterium tuberculosis
QSYERGPLGLPTSAEIQ

SEQ ID NO: 1537402 - protein, 6 aa, Mycobacterium tuberculosis
QTTTPY

SEQ ID NO: 1537403 - protein, 6 aa, Mycobacterium tuberculosis
RAGPPE

SEQ ID NO: 1537404 - protein, 8 aa, Mycobacterium tuberculosis
RAGQVDEV

SEQ ID NO: 1537405 - protein, 7 aa, Mycobacterium tuberculosis
RAPRGDE

SEQ ID NO: 1537406 - protein, 7 aa, Mycobacterium tuberculosis
RAVSPQV

SEQ ID NO: 1537407 - protein, 13 aa, Mycobacterium tuberculosis
RDEGNYAGPTINR

SEQ ID NO: 1537408 - protein, 4 aa, Mycobacterium tuberculosis
RPEL

SEQ ID NO: 1537409 - protein, 23 aa, Mycobacterium tuberculosis
RQRYRTSGVPKAADLRSALKPLL

SEQ ID NO: 1537410 - protein, 7 aa, Mycobacterium tuberculosis
RRREAAA

SEQ ID NO: 1537411 - protein, 7 aa, Mycobacterium tuberculosis
RTSQPAL

SEQ ID NO: 1537412 - protein, 6 aa, Mycobacterium tuberculosis
RVTDRY

SEQ ID NO: 1537413 - protein, 4 aa, Mycobacterium tuberculosis
SAAD

SEQ ID NO: 1537414 - protein, 9 aa, Mycobacterium tuberculosis
SADDSETVR

SEQ ID NO: 1537415 - protein, 11 aa, Mycobacterium tuberculosis
SAGSSYTTFPG

SEQ ID NO: 1537416 - protein, 4 aa, Mycobacterium tuberculosis
SARR

SEQ ID NO: 1537417 - protein, 10 aa, Mycobacterium tuberculosis
SASNAWDDAG

SEQ ID NO: 1537418 - protein, 13 aa, Mycobacterium tuberculosis
SDLGAEPATERRT

SEQ ID NO: 1537419 - protein, 9 aa, Mycobacterium tuberculosis
SDRDSVREA

SEQ ID NO: 1537420 - protein, 7 aa, Mycobacterium tuberculosis
SGEGADE

SEQ ID NO: 1537421 - protein, 12 aa, Mycobacterium tuberculosis
SGKTGTTEAHRS

SEQ ID NO: 1537422 - protein, 13 aa, Mycobacterium tuberculosis
SHSHSVSKAEVAR

SEQ ID NO: 1537423 - protein, 7 aa, Mycobacterium tuberculosis
SKAPGAT

SEQ ID NO: 1537424 - protein, 9 aa, Mycobacterium tuberculosis
SKPLPEGMR

SEQ ID NO: 1537425 - protein, 6 aa, Mycobacterium tuberculosis
SKSVGA

SEQ ID NO: 1537426 - protein, 7 aa, Mycobacterium tuberculosis
SKTGARY

SEQ ID NO: 1537427 - protein, 13 aa, Mycobacterium tuberculosis
SLQATAQATQTTL

SEQ ID NO: 1537428 - protein, 7 aa, Mycobacterium tuberculosis
SPDLSGA

SEQ ID NO: 1537429 - protein, 15 aa, Mycobacterium tuberculosis
SPKCGNGNDPLDKAG

SEQ ID NO: 1537430 - protein, 13 aa, Mycobacterium tuberculosis
SPRKRSATGRSGL

SEQ ID NO: 1537431 - protein, 7 aa, Mycobacterium tuberculosis
SQQNSIR

SEQ ID NO: 1537432 - protein, 5 aa, Mycobacterium tuberculosis
SRAGD

SEQ ID NO: 1537433 - protein, 9 aa, Mycobacterium tuberculosis
SRGDDDTLR

SEQ ID NO: 1537434 - protein, 15 aa, Mycobacterium tuberculosis
SRITEANTDRFPTTE

SEQ ID NO: 1537435 - protein, 4 aa, Mycobacterium tuberculosis
SRPE

SEQ ID NO: 1537436 - protein, 7 aa, Mycobacterium tuberculosis
SRSRCTP

SEQ ID NO: 1537437 - protein, 13 aa, Mycobacterium tuberculosis
SRTDAHGNPLSAE

SEQ ID NO: 1537438 - protein, 29 aa, Mycobacterium tuberculosis
SSGSKGGAGSGHAGKARSAVTTTDADWKP

SEQ ID NO: 1537439 - protein, 8 aa, Mycobacterium tuberculosis
SSPTTSAA

SEQ ID NO: 1537440 - protein, 22 aa, Mycobacterium tuberculosis
STHQALGPPSGLPDASPNERSA

SEQ ID NO: 1537441 - protein, 7 aa, Mycobacterium tuberculosis
STQDRRV

SEQ ID NO: 1537442 - protein, 17 aa, Mycobacterium tuberculosis
SVGSYAAAEAANASPLQ

SEQ ID NO: 1537443 - protein, 6 aa, Mycobacterium tuberculosis
TADNPR

SEQ ID NO: 1537444 - protein, 18 aa, Mycobacterium tuberculosis
TADPDSAPKTTRSSLEGA

SEQ ID NO: 1537445 - protein, 10 aa, Mycobacterium tuberculosis
TAKAWGGGDL

SEQ ID NO: 1537446 - protein, 8 aa, Mycobacterium tuberculosis
TDAPDDTV

SEQ ID NO: 1537447 - protein, 5 aa, Mycobacterium tuberculosis
TPEQA

SEQ ID NO: 1537448 - protein, 25 aa, Mycobacterium tuberculosis
TPLATRPPSGPTVPPEHFTLPTHPI

SEQ ID NO: 1537449 - protein, 12 aa, Mycobacterium tuberculosis
TPPYAGGPTMAD

SEQ ID NO: 1537450 - protein, 4 aa, Mycobacterium tuberculosis
TQGE

SEQ ID NO: 1537451 - protein, 61 aa, Mycobacterium tuberculosis; identical to SEQ ID NO: 231601

SEQ ID NO: 1537452 - protein, 9 aa, Mycobacterium tuberculosis
TRARQNGPY

SEQ ID NO: 1537453 - protein, 8 aa, Mycobacterium tuberculosis
TTADPDIP

SEQ ID NO: 1537454 - protein, 5 aa, Mycobacterium tuberculosis
TVTAT

SEQ ID NO: 1537455 - protein, 5 aa, Mycobacterium tuberculosis
VAATT

SEQ ID NO: 1537456 - protein, 4 aa, Mycobacterium tuberculosis
VADK

SEQ ID NO: 1537457 - protein, 16 aa, Mycobacterium tuberculosis
VAPPASDTNDNGDFSR

SEQ ID NO: 1537458 - protein, 7 aa, Mycobacterium tuberculosis
VASADPV

SEQ ID NO: 1537459 - protein, 4 aa, Mycobacterium tuberculosis
VDPR

SEQ ID NO: 1537460 - protein, 11 aa, Mycobacterium tuberculosis
VGQAPAAAHPG

SEQ ID NO: 1537461 - protein, 4 aa, Mycobacterium tuberculosis
VPAD

SEQ ID NO: 1537462 - protein, 9 aa, Mycobacterium tuberculosis
VRPTAASLP

SEQ ID NO: 1537463 - protein, 11 aa, Mycobacterium tuberculosis
VRQATDEAAAM

SEQ ID NO: 1537464 - protein, 7 aa, Mycobacterium tuberculosis
VRRGDQR

SEQ ID NO: 1537465 - protein, 6 aa, Mycobacterium tuberculosis
VSAQAV

SEQ ID NO: 1537466 - protein, 5 aa, Mycobacterium tuberculosis
VSDTF

SEQ ID NO: 1537467 - protein, 7 aa, Mycobacterium tuberculosis
VTDSGSG

SEQ ID NO: 1537468 - protein, 5 aa, Mycobacterium tuberculosis
VTGTG

SEQ ID NO: 1537469 - protein, 6 aa, Mycobacterium tuberculosis
AAAAEL

SEQ ID NO: 1537470 - protein, 8 aa, Mycobacterium tuberculosis
AAAEPSWN

SEQ ID NO: 1537471 - protein, 11 aa, Mycobacterium tuberculosis
AAAGGPTSAPI

SEQ ID NO: 1537472 - protein, 6 aa, Mycobacterium tuberculosis
AAEGNA

SEQ ID NO: 1537473 - protein, 6 aa, Mycobacterium tuberculosis
AAGEPS

SEQ ID NO: 1537474 - protein, 23 aa, Mycobacterium tuberculosis
AAIGGAPVAGADPQRYDGDVPGM

SEQ ID NO: 1537475 - protein, 8 aa, Mycobacterium tuberculosis
AAKATGVL

SEQ ID NO: 1537476 - protein, 6 aa, Mycobacterium tuberculosis
AANPST

SEQ ID NO: 1537477 - protein, 5 aa, Mycobacterium tuberculosis
AAQGR

SEQ ID NO: 1537478 - protein, 10 aa, Mycobacterium tuberculosis
AARELAEETG

SEQ ID NO: 1537479 - protein, 11 aa, Mycobacterium tuberculosis
AATSSTPREAP

SEQ ID NO: 1537480 - protein, 9 aa, Mycobacterium tuberculosis
ADAKSPYEY

SEQ ID NO: 1537481 - protein, 10 aa, Mycobacterium tuberculosis
ADGGPASGRG

SEQ ID NO: 1537482 - protein, 13 aa, Mycobacterium tuberculosis
ADGPDKIGQAAED

SEQ ID NO: 1537483 - protein, 5 aa, Mycobacterium tuberculosis
ADPVG

SEQ ID NO: 1537484 - protein, 17 aa, Mycobacterium tuberculosis
ADTAGPDENISRGPDPL

SEQ ID NO: 1537485 - protein, 5 aa, Mycobacterium tuberculosis
ADTAT

SEQ ID NO: 1537486 - protein, 10 aa, Mycobacterium tuberculosis
ADTPPDPAAA

SEQ ID NO: 1537487 - protein, 7 aa, Mycobacterium tuberculosis
AEDTRRV

SEQ ID NO: 1537488 - protein, 29 aa, Mycobacterium tuberculosis
AEGPPLGRNPQGAPAPVGGTVIVAPMHSG

SEQ ID NO: 1537489 - protein, 16 aa, Mycobacterium tuberculosis
AEIPATAKSAALGRQL

SEQ ID NO: 1537490 - protein, 7 aa, Mycobacterium tuberculosis
AENRDTA

SEQ ID NO: 1537491 - protein, 8 aa, Mycobacterium tuberculosis
AEQTGKRI

SEQ ID NO: 1537492 - protein, 6 aa, Mycobacterium tuberculosis
AETEID

SEQ ID NO: 1537493 - protein, 9 aa, Mycobacterium tuberculosis
AGAGSNDVG

SEQ ID NO: 1537494 - protein, 8 aa, Mycobacterium tuberculosis
AGAPGDGV

SEQ ID NO: 1537495 - protein, 6 aa, Mycobacterium tuberculosis
AGDDTV

SEQ ID NO: 1537496 - protein, 10 aa, Mycobacterium tuberculosis
AGDEEATNTD

SEQ ID NO: 1537497 - protein, 9 aa, Mycobacterium tuberculosis
AGGQNPQGP

SEQ ID NO: 1537498 - protein, 8 aa, Mycobacterium tuberculosis
AGGSGTLG

SEQ ID NO: 1537499 - protein, 15 aa, Mycobacterium tuberculosis
AGLSVKGAQPGNASN

SEQ ID NO: 1537500 - protein, 29 aa, Mycobacterium tuberculosis
AGRPGEVPPNVPGTPVPIPQEAPPGARTL

SEQ ID NO: 1537501 - protein, 26 aa, Mycobacterium tuberculosis
AGTYGVTESLNSSAAASPLSGITGEA

SEQ ID NO: 1537502 - protein, 8 aa, Mycobacterium tuberculosis
AGWSDDGM

SEQ ID NO: 1537503 - protein, 11 aa, Mycobacterium tuberculosis
AHPEFQPRAGS

SEQ ID NO: 1537504 - protein, 8 aa, Mycobacterium tuberculosis
AHQTGPAA

SEQ ID NO: 1537505 - protein, 18 aa, Mycobacterium tuberculosis
AKGGPGGRPGCGPLPDAT

SEQ ID NO: 1537506 - protein, 7 aa, Mycobacterium tuberculosis
AKPNVEL

SEQ ID NO: 1537507 - protein, 8 aa, Mycobacterium tuberculosis
ALNGTKNI

SEQ ID NO: 1537508 - protein, 9 aa, Mycobacterium tuberculosis
ANGALTGAL

SEQ ID NO: 1537509 - protein, 7 aa, Mycobacterium tuberculosis
ANKGSLV

SEQ ID NO: 1537510 - protein, 7 aa, Mycobacterium tuberculosis
ANKPDSH

SEQ ID NO: 1537511 - protein, 6 aa, Mycobacterium tuberculosis
ANLRPS

SEQ ID NO: 1537512 - protein, 5 aa, Mycobacterium tuberculosis
ANPRS

SEQ ID NO: 1537513 - protein, 8 aa, Mycobacterium tuberculosis
ANSAEKLR

SEQ ID NO: 1537514 - protein, 7 aa, Mycobacterium tuberculosis
APAGGAY

SEQ ID NO: 1537515 - protein, 5 aa, Mycobacterium tuberculosis
APHAE

SEQ ID NO: 1537516 - protein, 5 aa, Mycobacterium tuberculosis
APPLN

SEQ ID NO: 1537517 - protein, 8 aa, Mycobacterium tuberculosis
APPPQRAA

SEQ ID NO: 1537518 - protein, 29 aa, Mycobacterium tuberculosis
APTAGAEPTGALPPMTSSGSGPVIGDGDA

SEQ ID NO: 1537519 - protein, 9 aa, Mycobacterium tuberculosis
AQSQANADG

SEQ ID NO: 1537520 - protein, 7 aa, Mycobacterium tuberculosis
ARGADVD

SEQ ID NO: 1537521 - protein, 9 aa, Mycobacterium tuberculosis
ARGDTIGGN

SEQ ID NO: 1537522 - protein, 5 aa, Mycobacterium tuberculosis
ARLKT

SEQ ID NO: 1537523 - protein, 14 aa, Mycobacterium tuberculosis
ASAGVQHARRGSEL

SEQ ID NO: 1537524 - protein, 7 aa, Mycobacterium tuberculosis
ASTTSAT

SEQ ID NO: 1537525 - protein, 7 aa, Mycobacterium tuberculosis
ASVTDGA

SEQ ID NO: 1537526 - protein, 9 aa, Mycobacterium tuberculosis
ATDPRETSR

SEQ ID NO: 1537527 - protein, 4 aa, Mycobacterium tuberculosis
ATGR

SEQ ID NO: 1537528 - protein, 8 aa, Mycobacterium tuberculosis
ATLAPNAV

SEQ ID NO: 1537529 - protein, 6 aa, Mycobacterium tuberculosis
ATNNDK

SEQ ID NO: 1537530 - protein, 7 aa, Mycobacterium tuberculosis
ATTAPVD

SEQ ID NO: 1537531 - protein, 12 aa, Mycobacterium tuberculosis
AVGRLSQSADQY

SEQ ID NO: 1537532 - protein, 21 aa, Mycobacterium tuberculosis
AVNGEPAPLAPPPADPAPPVE

SEQ ID NO: 1537533 - protein, 16 aa, Mycobacterium tuberculosis
AVRGQGERIGQATTDL

SEQ ID NO: 1537534 - protein, 8 aa, Mycobacterium tuberculosis
AVRPATPV

SEQ ID NO: 1537535 - protein, 6 aa, Mycobacterium tuberculosis
AVSAQA

SEQ ID NO: 1537536 - protein, 8 aa, Mycobacterium tuberculosis
CGSSDHSR

SEQ ID NO: 1537537 - protein, 5 aa, Mycobacterium tuberculosis
CNDPF

SEQ ID NO: 1537538 - protein, 25 aa, Mycobacterium tuberculosis
CSDSGDNKPGATIPSTPANAEGRHG

SEQ ID NO: 1537539 - protein, 25 aa, Mycobacterium tuberculosis
DDERPEQAREPELRSNRSQREEELS

SEQ ID NO: 1537540 - protein, 7 aa, Mycobacterium tuberculosis
DDNSGRT

SEQ ID NO: 1537541 - protein, 7 aa, Mycobacterium tuberculosis
DGSKTYG

SEQ ID NO: 1537542 - protein, 10 aa, Mycobacterium tuberculosis
DHSGDRPNYS

SEQ ID NO: 1537543 - protein, 6 aa, Mycobacterium tuberculosis
DKGTPF

SEQ ID NO: 1537544 - protein, 34 aa, Mycobacterium tuberculosis; identical to SEQ ID NO: 232019

SEQ ID NO: 1537545 - protein, 18 aa, Mycobacterium tuberculosis
DMPGSGLSADGKAEAQQV

SEQ ID NO: 1537546 - protein, 14 aa, Mycobacterium tuberculosis
DNGRPVAGRLSPDG

SEQ ID NO: 1537547 - protein, 14 aa, Mycobacterium tuberculosis
DPGPSVDKLQAGDA

SEQ ID NO: 1537548 - protein, 7 aa, Mycobacterium tuberculosis
DPNDPTP

SEQ ID NO: 1537549 - protein, 6 aa, Mycobacterium tuberculosis
DQIPYQ

SEQ ID NO: 1537550 - protein, 15 aa, Mycobacterium tuberculosis
DQTNSVNSSAKYGEV

SEQ ID NO: 1537551 - protein, 6 aa, Mycobacterium tuberculosis
DRDQLA

SEQ ID NO: 1537552 - protein, 15 aa, Mycobacterium tuberculosis
DRRAEQVRAGGPDIL

SEQ ID NO: 1537553 - protein, 7 aa, Mycobacterium tuberculosis
DSELPTD

SEQ ID NO: 1537554 - protein, 7 aa, Mycobacterium tuberculosis
DSRPSRY

SEQ ID NO: 1537555 - protein, 12 aa, Mycobacterium tuberculosis
DTAATPSAAGVT

SEQ ID NO: 1537556 - protein, 4 aa, Mycobacterium tuberculosis
DTDP

SEQ ID NO: 1537557 - protein, 5 aa, Mycobacterium tuberculosis
DVGGG

SEQ ID NO: 1537558 - protein, 7 aa, Mycobacterium tuberculosis
EAEASQE

SEQ ID NO: 1537559 - protein, 6 aa, Mycobacterium tuberculosis
EDIGPE

SEQ ID NO: 1537560 - protein, 10 aa, Mycobacterium tuberculosis
EGGIGGTEAR

SEQ ID NO: 1537561 - protein, 9 aa, Mycobacterium tuberculosis
EKRPPSGSA

SEQ ID NO: 1537562 - protein, 9 aa, Mycobacterium tuberculosis
ELNQQRDDI

SEQ ID NO: 1537563 - protein, 8 aa, Mycobacterium tuberculosis
ENSDTEGA

SEQ ID NO: 1537564 - protein, 7 aa, Mycobacterium tuberculosis
ENSPDRT

SEQ ID NO: 1537565 - protein, 15 aa, Mycobacterium tuberculosis
EPSATGASDPCAASE

SEQ ID NO: 1537566 - protein, 9 aa, Mycobacterium tuberculosis
EQRSSTAET

SEQ ID NO: 1537567 - protein, 5 aa, Mycobacterium tuberculosis
ESIGN

SEQ ID NO: 1537568 - protein, 25 aa, Mycobacterium tuberculosis
FADQAKKQNLAADVGATQQVGTQQV

SEQ ID NO: 1537569 - protein, 9 aa, Mycobacterium tuberculosis
FPAPGVKPH

SEQ ID NO: 1537570 - protein, 26 aa, Mycobacterium tuberculosis
FRPNNSVPGDPPQPLGAPNYSQIRDD

SEQ ID NO: 1537571 - protein, 8 aa, Mycobacterium tuberculosis
GAAPSGPV

SEQ ID NO: 1537572 - protein, 5 aa, Mycobacterium tuberculosis
GAHAR

SEQ ID NO: 1537573 - protein, 17 aa, Mycobacterium tuberculosis
GAPAALADSVRNGDTQV

SEQ ID NO: 1537574 - protein, 17 aa, Mycobacterium tuberculosis
GAPCPKPQAAAQSPDGL

SEQ ID NO: 1537575 - protein, 5 aa, Mycobacterium tuberculosis
GCPDA

SEQ ID NO: 1537576 - protein, 9 aa, Mycobacterium tuberculosis
GGHDVPETK

SEQ ID NO: 1537577 - protein, 26 aa, Mycobacterium tuberculosis
GGIGGPGGASSIPGMSGGAGGTGGAA

SEQ ID NO: 1537578 - protein, 7 aa, Mycobacterium tuberculosis
GGLTTAD

SEQ ID NO: 1537579 - protein, 8 aa, Mycobacterium tuberculosis
GGPTQPRS

SEQ ID NO: 1537580 - protein, 20 aa, Mycobacterium tuberculosis
GHGRGSGDSHNGGVTTPPLD

SEQ ID NO: 1537581 - protein, 8 aa, Mycobacterium tuberculosis
GKPESMAN

SEQ ID NO: 1537582 - protein, 12 aa, Mycobacterium tuberculosis
GLDNGDLDRTHR

SEQ ID NO: 1537583 - protein, 5 aa, Mycobacterium tuberculosis
GMEQA

SEQ ID NO: 1537584 - protein, 6 aa, Mycobacterium tuberculosis
GMTPRA

SEQ ID NO: 1537585 - protein, 4 aa, Mycobacterium tuberculosis
GNNM

SEQ ID NO: 1537586 - protein, 13 aa, Mycobacterium tuberculosis
GPAIGPNPAAGEQ

SEQ ID NO: 1537587 - protein, 6 aa, Mycobacterium tuberculosis
GQGMSS

SEQ ID NO: 1537588 - protein, 5 aa, Mycobacterium tuberculosis
GQNTP

SEQ ID NO: 1537589 - protein, 8 aa, Mycobacterium tuberculosis
GQNTPAIA

SEQ ID NO: 1537590 - protein, 8 aa, Mycobacterium tuberculosis
GQSTTPYQ

SEQ ID NO: 1537591 - protein, 7 aa, Mycobacterium tuberculosis
GRAGLGA

SEQ ID NO: 1537592 - protein, 9 aa, Mycobacterium tuberculosis
GRGAPDEAA

SEQ ID NO: 1537593 - protein, 7 aa, Mycobacterium tuberculosis
GRGRAAI

SEQ ID NO: 1537594 - protein, 4 aa, Mycobacterium tuberculosis
GRLR

SEQ ID NO: 1537595 - protein, 5 aa, Mycobacterium tuberculosis
GRSVD

SEQ ID NO: 1537596 - protein, 24 aa, Mycobacterium tuberculosis
GSADDTTPPPSPILTAGSDAPECI

SEQ ID NO: 1537597 - protein, 16 aa, Mycobacterium tuberculosis
GSDSLGDSDVSARPAD

SEQ ID NO: 1537598 - protein, 8 aa, Mycobacterium tuberculosis
GSPKQVAT

SEQ ID NO: 1537599 - protein, 7 aa, Mycobacterium tuberculosis
GSVTPAV

SEQ ID NO: 1537600 - protein, 11 aa, Mycobacterium tuberculosis
GTRALGRGPAI

SEQ ID NO: 1537601 - protein, 4 aa, Mycobacterium tuberculosis
GVSA

SEQ ID NO: 1537602 - protein, 11 aa, Mycobacterium tuberculosis
GVSGPGGDGRT

SEQ ID NO: 1537603 - protein, 16 aa, Mycobacterium tuberculosis
HIGGNAYSEAEPQTGI

SEQ ID NO: 1537604 - protein, 6 aa, Mycobacterium tuberculosis
HPGGPK

SEQ ID NO: 1537605 - protein, 13 aa, Mycobacterium tuberculosis
HPSDQGSADISTS

SEQ ID NO: 1537606 - protein, 10 aa, Mycobacterium tuberculosis
HSRGLGSSAA

SEQ ID NO: 1537607 - protein, 5 aa, Mycobacterium tuberculosis
IAGGQ

SEQ ID NO: 1537608 - protein, 11 aa, Mycobacterium tuberculosis
IAGPGPNGRPR

SEQ ID NO: 1537609 - protein, 10 aa, Mycobacterium tuberculosis
IERTTSPYQL

SEQ ID NO: 1537610 - protein, 17 aa, Mycobacterium tuberculosis
IGDTPKRQIRAEAARRG

SEQ ID NO: 1537611 - protein, 7 aa, Mycobacterium tuberculosis
IVEPGGD

SEQ ID NO: 1537612 - protein, 10 aa, Mycobacterium tuberculosis
KGEYTGGEDP

SEQ ID NO: 1537613 - protein, 7 aa, Mycobacterium tuberculosis
KNASAYE

SEQ ID NO: 1537614 - protein, 4 aa, Mycobacterium tuberculosis
KQFT

SEQ ID NO: 1537615 - protein, 6 aa, Mycobacterium tuberculosis
KQPAVA

SEQ ID NO: 1537616 - protein, 6 aa, Mycobacterium tuberculosis
KRGRRI

SEQ ID NO: 1537617 - protein, 5 aa, Mycobacterium tuberculosis
KTIGM

SEQ ID NO: 1537618 - protein, 8 aa, Mycobacterium tuberculosis
KTTRHRAE

SEQ ID NO: 1537619 - protein, 4 aa, Mycobacterium tuberculosis
LAAA

SEQ ID NO: 1537620 - protein, 6 aa, Mycobacterium tuberculosis
LAGAKA

SEQ ID NO: 1537621 - protein, 5 aa, Mycobacterium tuberculosis
LANPS

SEQ ID NO: 1537622 - protein, 5 aa, Mycobacterium tuberculosis
LDRSA

SEQ ID NO: 1537623 - protein, 6 aa, Mycobacterium tuberculosis
LGGSDI

SEQ ID NO: 1537624 - protein, 7 aa, Mycobacterium tuberculosis
LNPDTGL

SEQ ID NO: 1537625 - protein, 5 aa, Mycobacterium tuberculosis
LPKVT

SEQ ID NO: 1537626 - protein, 10 aa, Mycobacterium tuberculosis
LPQPATGATV

SEQ ID NO: 1537627 - protein, 9 aa, Mycobacterium tuberculosis
LPRGTTQGQ

SEQ ID NO: 1537628 - protein, 8 aa, Mycobacterium tuberculosis
LPRSSGQM

SEQ ID NO: 1537629 - protein, 12 aa, Mycobacterium tuberculosis
LQPTGGASGLSA

SEQ ID NO: 1537630 - protein, 8 aa, Mycobacterium tuberculosis
LRSEKRDL

SEQ ID NO: 1537631 - protein, 9 aa, Mycobacterium tuberculosis
LSNATPREV

SEQ ID NO: 1537632 - protein, 12 aa, Mycobacterium tuberculosis
LSRQAEQTTEAL

SEQ ID NO: 1537633 - protein, 9 aa, Mycobacterium tuberculosis
LSTTDPHSR

SEQ ID NO: 1537634 - protein, 15 aa, Mycobacterium tuberculosis
LTDPPTGQPGTPPLP

SEQ ID NO: 1537635 - protein, 7 aa, Mycobacterium tuberculosis
LTGNDRT

SEQ ID NO: 1537636 - protein, 10 aa, Mycobacterium tuberculosis
LTPPADQPAA

SEQ ID NO: 1537637 - protein, 5 aa, Mycobacterium tuberculosis
MDAPL

SEQ ID NO: 1537638 - protein, 8 aa, Mycobacterium tuberculosis
MKNPADSA

SEQ ID NO: 1537639 - protein, 5 aa, Mycobacterium tuberculosis
MNGPS

SEQ ID NO: 1537640 - protein, 14 aa, Mycobacterium tuberculosis
MPTSMGKDSTPTAN

SEQ ID NO: 1537641 - protein, 12 aa, Mycobacterium tuberculosis
MWGPKEDPAWQR

SEQ ID NO: 1537642 - protein, 10 aa, Mycobacterium tuberculosis
NAGGTHPTTT

SEQ ID NO: 1537643 - protein, 6 aa, Mycobacterium tuberculosis
NAPTEA

SEQ ID NO: 1537644 - protein, 6 aa, Mycobacterium tuberculosis
NDPPEE

SEQ ID NO: 1537645 - protein, 10 aa, Mycobacterium tuberculosis
NEGAPGRGPL

SEQ ID NO: 1537646 - protein, 9 aa, Mycobacterium tuberculosis
NFGAGSSGW

SEQ ID NO: 1537647 - protein, 16 aa, Mycobacterium tuberculosis
NGADGTAANPNGGAGG

SEQ ID NO: 1537648 - protein, 15 aa, Mycobacterium tuberculosis
NGADGTAPGQPGAAG

SEQ ID NO: 1537649 - protein, 10 aa, Mycobacterium tuberculosis
NGGHTWPGGR

SEQ ID NO: 1537650 - protein, 12 aa, Mycobacterium tuberculosis
NGKPSDLGGNNL

SEQ ID NO: 1537651 - protein, 11 aa, Mycobacterium tuberculosis
NNGKSATAISI

SEQ ID NO: 1537652 - protein, 11 aa, Mycobacterium tuberculosis
NPGGPGESGIE

SEQ ID NO: 1537653 - protein, 7 aa, Mycobacterium tuberculosis
NRISPDA

SEQ ID NO: 1537654 - protein, 15 aa, Mycobacterium tuberculosis
NTRGQGRANQAVTGT

SEQ ID NO: 1537655 - protein, 7 aa, Mycobacterium tuberculosis
NWASATS

SEQ ID NO: 1537656 - protein, 8 aa, Mycobacterium tuberculosis
NYRTGSVG

SEQ ID NO: 1537657 - protein, 4 aa, Mycobacterium tuberculosis
PAEP

SEQ ID NO: 1537658 - protein, 5 aa, Mycobacterium tuberculosis
PAEVA

SEQ ID NO: 1537659 - protein, 7 aa, Mycobacterium tuberculosis
PAGLTQA

SEQ ID NO: 1537660 - protein, 5 aa, Mycobacterium tuberculosis
PAKTA

SEQ ID NO: 1537661 - protein, 5 aa, Mycobacterium tuberculosis
PAWAG

SEQ ID NO: 1537662 - protein, 5 aa, Mycobacterium tuberculosis
PDGQI

SEQ ID NO: 1537663 - protein, 8 aa, Mycobacterium tuberculosis
PDPAGDEV

SEQ ID NO: 1537664 - protein, 13 aa, Mycobacterium tuberculosis
PDRYRDDSAARGG

SEQ ID NO: 1537665 - protein, 8 aa, Mycobacterium tuberculosis
PEAAGPTQ

SEQ ID NO: 1537666 - protein, 39 aa, Mycobacterium tuberculosis
PGAGSTADGETPGGGISLPNSSGQPAYTGPCPPAGTGTH

SEQ ID NO: 1537667 - protein, 7 aa, Mycobacterium tuberculosis
PGAPPMR

SEQ ID NO: 1537668 - protein, 6 aa, Mycobacterium tuberculosis
PGPSAV

SEQ ID NO: 1537669 - protein, 6 aa, Mycobacterium tuberculosis
PGPTFD

SEQ ID NO: 1537670 - protein, 7 aa, Mycobacterium tuberculosis
PGTRFDY

SEQ ID NO: 1537671 - protein, 10 aa, Mycobacterium tuberculosis
PHRYSQSEIT

SEQ ID NO: 1537672 - protein, 12 aa, Mycobacterium tuberculosis
PLGQPSDASPRL

SEQ ID NO: 1537673 - protein, 4 aa, Mycobacterium tuberculosis
PPPP

SEQ ID NO: 1537674 - protein, 7 aa, Mycobacterium tuberculosis
PRKGAAR

SEQ ID NO: 1537675 - protein, 7 aa, Mycobacterium tuberculosis
PSAPSVT

SEQ ID NO: 1537676 - protein, 12 aa, Mycobacterium tuberculosis
PTGTAAAGADEQ

SEQ ID NO: 1537677 - protein, 14 aa, Mycobacterium tuberculosis
PVGDQFGEAGEGVR

SEQ ID NO: 1537678 - protein, 7 aa, Mycobacterium tuberculosis
PYDRPPL

SEQ ID NO: 1537679 - protein, 5 aa, Mycobacterium tuberculosis
QAGPS

SEQ ID NO: 1537680 - protein, 12 aa, Mycobacterium tuberculosis
QALGRKGTQDGG

SEQ ID NO: 1537681 - protein, 6 aa, Mycobacterium tuberculosis
QAPGID

SEQ ID NO: 1537682 - protein, 8 aa, Mycobacterium tuberculosis
QARPNEVT

SEQ ID NO: 1537683 - protein, 7 aa, Mycobacterium tuberculosis
QDSGTFT

SEQ ID NO: 1537684 - protein, 6 aa, Mycobacterium tuberculosis
QECCPT

SEQ ID NO: 1537685 - protein, 6 aa, Mycobacterium tuberculosis
QGGTAG

SEQ ID NO: 1537686 - protein, 7 aa, Mycobacterium tuberculosis
QLGGARP

SEQ ID NO: 1537687 - protein, 9 aa, Mycobacterium tuberculosis
QNPSRARLS

SEQ ID NO: 1537688 - protein, 4 aa, Mycobacterium tuberculosis
QPKL

SEQ ID NO: 1537689 - protein, 5 aa, Mycobacterium tuberculosis
QQLRP

SEQ ID NO: 1537690 - protein, 4 aa, Mycobacterium tuberculosis
QRGS

SEQ ID NO: 1537691 - protein, 8 aa, Mycobacterium tuberculosis
RAAKAEPL

SEQ ID NO: 1537692 - protein, 11 aa, Mycobacterium tuberculosis
RAAPASAGSLG

SEQ ID NO: 1537693 - protein, 25 aa, Mycobacterium tuberculosis
RAELATRDARAKDTYEKIGVHVVVA

SEQ ID NO: 1537694 - protein, 19 aa, Mycobacterium tuberculosis
REVPQSRSVDVSDDPSGFR

SEQ ID NO: 1537695 - protein, 6 aa, Mycobacterium tuberculosis
RGAPDD

SEQ ID NO: 1537696 - protein, 6 aa, Mycobacterium tuberculosis
RGMGPD

SEQ ID NO: 1537697 - protein, 22 aa, Mycobacterium tuberculosis
RIQPTTVNSRRSRTPALDAGRE

SEQ ID NO: 1537698 - protein, 5 aa, Mycobacterium tuberculosis
RKERV

SEQ ID NO: 1537699 - protein, 5 aa, Mycobacterium tuberculosis
RKKSS

SEQ ID NO: 1537700 - protein, 4 aa, Mycobacterium tuberculosis
RLAQ

SEQ ID NO: 1537701 - protein, 9 aa, Mycobacterium tuberculosis
RLDPSSDRM

SEQ ID NO: 1537702 - protein, 12 aa, Mycobacterium tuberculosis
RLGTSPEKDVGF

SEQ ID NO: 1537703 - protein, 13 aa, Mycobacterium tuberculosis
RNATVADGEDQQT

SEQ ID NO: 1537704 - protein, 8 aa, Mycobacterium tuberculosis
RPANDPDV

SEQ ID NO: 1537705 - protein, 6 aa, Mycobacterium tuberculosis
RPNPGI

SEQ ID NO: 1537706 - protein, 9 aa, Mycobacterium tuberculosis
RQAALNPPP

SEQ ID NO: 1537707 - protein, 10 aa, Mycobacterium tuberculosis
RQESRDVNGT

SEQ ID NO: 1537708 - protein, 4 aa, Mycobacterium tuberculosis
RRFR

SEQ ID NO: 1537709 - protein, 6 aa, Mycobacterium tuberculosis
RRRRGA

SEQ ID NO: 1537710 - protein, 8 aa, Mycobacterium tuberculosis
RSDGSGDT

SEQ ID NO: 1537711 - protein, 6 aa, Mycobacterium tuberculosis
RWSANS

SEQ ID NO: 1537712 - protein, 13 aa, Mycobacterium tuberculosis
SAAAAAAPPPADI

SEQ ID NO: 1537713 - protein, 12 aa, Mycobacterium tuberculosis
SAGQGGPSRTLP

SEQ ID NO: 1537714 - protein, 5 aa, Mycobacterium tuberculosis
SAGWD

SEQ ID NO: 1537715 - protein, 4 aa, Mycobacterium tuberculosis
SAQV

SEQ ID NO: 1537716 - protein, 5 aa, Mycobacterium tuberculosis
SATTM

SEQ ID NO: 1537717 - protein, 24 aa, Mycobacterium tuberculosis
SDDPAGLAENDAVADTLPGPLATA

SEQ ID NO: 1537718 - protein, 6 aa, Mycobacterium tuberculosis
SEAGEV

SEQ ID NO: 1537719 - protein, 12 aa, Mycobacterium tuberculosis
SGRGPRRYTAGG

SEQ ID NO: 1537720 - protein, 7 aa, Mycobacterium tuberculosis
SIESADN

SEQ ID NO: 1537721 - protein, 12 aa, Mycobacterium tuberculosis
SKPTASGAAGMT

SEQ ID NO: 1537722 - protein, 5 aa, Mycobacterium tuberculosis
SLGDP

SEQ ID NO: 1537723 - protein, 6 aa, Mycobacterium tuberculosis
SLPTIG

SEQ ID NO: 1537724 - protein, 15 aa, Mycobacterium tuberculosis
SNAGTNLLGSSRDNL

SEQ ID NO: 1537725 - protein, 20 aa, Mycobacterium tuberculosis
SPAGVTTRVDAPAESTEEEY

SEQ ID NO: 1537726 - protein, 5 aa, Mycobacterium tuberculosis
SQRLS

SEQ ID NO: 1537727 - protein, 5 aa, Mycobacterium tuberculosis
SRFPG

SEQ ID NO: 1537728 - protein, 8 aa, Mycobacterium tuberculosis
SRLGGEQA

SEQ ID NO: 1537729 - protein, 7 aa, Mycobacterium tuberculosis
SSGHTAR

SEQ ID NO: 1537730 - protein, 7 aa, Mycobacterium tuberculosis
SSGLGAG

SEQ ID NO: 1537731 - protein, 5 aa, Mycobacterium tuberculosis
SSLYP

SEQ ID NO: 1537732 - protein, 4 aa, Mycobacterium tuberculosis
SVRQ

SEQ ID NO: 1537733 - protein, 9 aa, Mycobacterium tuberculosis
SYYPDQKSL

SEQ ID NO: 1537734 - protein, 24 aa, Mycobacterium tuberculosis
TAPGTLRTGSRGCCSKEDAADARR

SEQ ID NO: 1537735 - protein, 22 aa, Mycobacterium tuberculosis
TAQGTGSGAGIAQAAAGTVNIG

SEQ ID NO: 1537736 - protein, 10 aa, Mycobacterium tuberculosis
TDSSPSSDAE

SEQ ID NO: 1537737 - protein, 4 aa, Mycobacterium tuberculosis
TEAD

SEQ ID NO: 1537738 - protein, 13 aa, Mycobacterium tuberculosis
TEPSLSGPGRDDL

SEQ ID NO: 1537739 - protein, 15 aa, Mycobacterium tuberculosis
TFPQSAAADSTEDFP

SEQ ID NO: 1537740 - protein, 13 aa, Mycobacterium tuberculosis
TGDHQAAKGDGDF

SEQ ID NO: 1537741 - protein, 4 aa, Mycobacterium tuberculosis
TGDM

SEQ ID NO: 1537742 - protein, 6 aa, Mycobacterium tuberculosis
TGEGRA

SEQ ID NO: 1537743 - protein, 9 aa, Mycobacterium tuberculosis
TGPWTGPAS

SEQ ID NO: 1537744 - protein, 17 aa, Mycobacterium tuberculosis
TGQHTTRTAASTTYTPH

SEQ ID NO: 1537745 - protein, 12 aa, Mycobacterium tuberculosis
TGRADDVVRPTD

SEQ ID NO: 1537746 - protein, 4 aa, Mycobacterium tuberculosis
TGSA

SEQ ID NO: 1537747 - protein, 4 aa, Mycobacterium tuberculosis
TGWG

SEQ ID NO: 1537748 - protein, 4 aa, Mycobacterium tuberculosis
TIET

SEQ ID NO: 1537749 - protein, 12 aa, Mycobacterium tuberculosis
TIPGSISGTEFN

SEQ ID NO: 1537750 - protein, 18 aa, Mycobacterium tuberculosis
TKSGGTRTGNVTLAEGPP

SEQ ID NO: 1537751 - protein, 10 aa, Mycobacterium tuberculosis
TNDKDTPGAK

SEQ ID NO: 1537752 - protein, 7 aa, Mycobacterium tuberculosis
TNLTTKQ

SEQ ID NO: 1537753 - protein, 12 aa, Mycobacterium tuberculosis
TPRGDGRLDSPI

SEQ ID NO: 1537754 - protein, 5 aa, Mycobacterium tuberculosis
TPRPP

SEQ ID NO: 1537755 - protein, 6 aa, Mycobacterium tuberculosis
TQAARD

SEQ ID NO: 1537756 - protein, 4 aa, Mycobacterium tuberculosis
TQSA

SEQ ID NO: 1537757 - protein, 8 aa, Mycobacterium tuberculosis
TQSRVGDS

SEQ ID NO: 1537758 - protein, 6 aa, Mycobacterium tuberculosis
TRAFDG

SEQ ID NO: 1537759 - protein, 32 aa, Mycobacterium tuberculosis
TSSGGSIYGTPPEYPTPETAPTDPASPYAAGK

SEQ ID NO: 1537760 - protein, 7 aa, Mycobacterium tuberculosis
TTNPPVE

SEQ ID NO: 1537761 - protein, 4 aa, Mycobacterium tuberculosis
TTTS

SEQ ID NO: 1537762 - protein, 5 aa, Mycobacterium tuberculosis
TTYAA

SEQ ID NO: 1537763 - protein, 11 aa, Mycobacterium tuberculosis
TVQEVDGSDAA

SEQ ID NO: 1537764 - protein, 6 aa, Mycobacterium tuberculosis
VAANGS

SEQ ID NO: 1537765 - protein, 12 aa, Mycobacterium tuberculosis
VDGEGGDQVPLG

SEQ ID NO: 1537766 - protein, 6 aa, Mycobacterium tuberculosis
VDPATG

SEQ ID NO: 1537767 - protein, 8 aa, Mycobacterium tuberculosis
VDRDKDQS

SEQ ID NO: 1537768 - protein, 5 aa, Mycobacterium tuberculosis
VDTEN

SEQ ID NO: 1537769 - protein, 12 aa, Mycobacterium tuberculosis
VGAQSAAQTAPV

SEQ ID NO: 1537770 - protein, 14 aa, Mycobacterium tuberculosis
VGKGGGPDNKVDAD

SEQ ID NO: 1537771 - protein, 7 aa, Mycobacterium tuberculosis
VGSSQAG

SEQ ID NO: 1537772 - protein, 6 aa, Mycobacterium tuberculosis
VPEPPS

SEQ ID NO: 1537773 - protein, 13 aa, Mycobacterium tuberculosis
VSQRAVKDANAAI

SEQ ID NO: 1537774 - protein, 4 aa, Mycobacterium tuberculosis
WDDP

SEQ ID NO: 1537775 - protein, 12 aa, Mycobacterium tuberculosis
YAAWGGADGRTL

SEQ ID NO: 1537776 - protein, 11 aa, Mycobacterium tuberculosis
YAPSGASGKAW

SEQ ID NO: 1537777 - protein, 9 aa, Mycobacterium tuberculosis
YARGETPNP

SEQ ID NO: 1537778 - protein, 13 aa, Mycobacterium tuberculosis
YGVPVNSPNGYRT

SEQ ID NO: 1537779 - protein, 22 aa, Mycobacterium tuberculosis
YPASDDYRASASNGSDDASAHI

SEQ ID NO: 1537780 - protein, 10 aa, Mycobacterium tuberculosis
YPEGIPPTDS

SEQ ID NO: 1537781 - protein, 12 aa, Mycobacterium tuberculosis
YPRTGQGGEPRL

SEQ ID NO: 1537782 - protein, 33 aa, Mycobacterium tuberculosis
AAADPALDAKHRDAARASDRLPHNDRNGEWWHS

SEQ ID NO: 1537783 - protein, 13 aa, Mycobacterium tuberculosis
AAAITSGAAITND

SEQ ID NO: 1537784 - protein, 11 aa, Mycobacterium tuberculosis
AAALTSDDHGT

SEQ ID NO: 1537785 - protein, 6 aa, Mycobacterium tuberculosis
AADDDD

SEQ ID NO: 1537786 - protein, 39 aa, Mycobacterium tuberculosis; identical to SEQ ID NO: 1439854

SEQ ID NO: 1537787 - protein, 12 aa, Mycobacterium tuberculosis
AAGRYASTEAAV

SEQ ID NO: 1537788 - protein, 11 aa, Mycobacterium tuberculosis
AAHESSMSGEE

SEQ ID NO: 1537789 - protein, 6 aa, Mycobacterium tuberculosis
AARQRL

SEQ ID NO: 1537790 - protein, 7 aa, Mycobacterium tuberculosis
AARQTGV

SEQ ID NO: 1537791 - protein, 17 aa, Mycobacterium tuberculosis
AASTRSAVNSGSDLRAS

SEQ ID NO: 1537792 - protein, 12 aa, Mycobacterium tuberculosis
AAYRDAGTARRA

SEQ ID NO: 1537793 - protein, 8 aa, Mycobacterium tuberculosis
ADESPAAA

SEQ ID NO: 1537794 - protein, 4 aa, Mycobacterium tuberculosis
ADQG

SEQ ID NO: 1537795 - protein, 10 aa, Mycobacterium tuberculosis
ADVNPEEGKT

SEQ ID NO: 1537796 - protein, 8 aa, Mycobacterium tuberculosis
AEQGKATA

SEQ ID NO: 1537797 - protein, 33 aa, Mycobacterium tuberculosis; identical to SEQ ID NO: 228901

SEQ ID NO: 1537798 - protein, 6 aa, Mycobacterium tuberculosis
AEVQSI

SEQ ID NO: 1537799 - protein, 8 aa, Mycobacterium tuberculosis
AGETMRPQ

SEQ ID NO: 1537800 - protein, 8 aa, Mycobacterium tuberculosis
AGIPAAPG

SEQ ID NO: 1537801 - protein, 5 aa, Mycobacterium tuberculosis
AGPER

SEQ ID NO: 1537802 - protein, 7 aa, Mycobacterium tuberculosis
AGPQEGW

SEQ ID NO: 1537803 - protein, 14 aa, Mycobacterium tuberculosis
AGPVPSASSVLPAG

SEQ ID NO: 1537804 - protein, 13 aa, Mycobacterium tuberculosis
AGRPGEPAPAVPG

SEQ ID NO: 1537805 - protein, 7 aa, Mycobacterium tuberculosis
AGVEAST

SEQ ID NO: 1537806 - protein, 11 aa, Mycobacterium tuberculosis
AHQPPTPASGC

SEQ ID NO: 1537807 - protein, 5 aa, Mycobacterium tuberculosis
ALPNL

SEQ ID NO: 1537808 - protein, 9 aa, Mycobacterium tuberculosis
ALSGKLNPD

SEQ ID NO: 1537809 - protein, 13 aa, Mycobacterium tuberculosis
ALTKQGRSGRDRQ

SEQ ID NO: 1537810 - protein, 21 aa, Mycobacterium tuberculosis
AMRATDRSSGLPTSAKPARAR

SEQ ID NO: 1537811 - protein, 10 aa, Mycobacterium tuberculosis
ANGVSGSASY

SEQ ID NO: 1537812 - protein, 6 aa, Mycobacterium tuberculosis
ANIPPE

SEQ ID NO: 1537813 - protein, 14 aa, Mycobacterium tuberculosis
ANNPVDKGAAKALA

SEQ ID NO: 1537814 - protein, 25 aa, Mycobacterium tuberculosis
ANSPHTNLGGENPEINTSDDGDHDP

SEQ ID NO: 1537815 - protein, 6 aa, Mycobacterium tuberculosis
APGHTE

SEQ ID NO: 1537816 - protein, 16 aa, Mycobacterium tuberculosis
APGPIDTEATRTVTPA

SEQ ID NO: 1537817 - protein, 4 aa, Mycobacterium tuberculosis
APGT

SEQ ID NO: 1537818 - protein, 20 aa, Mycobacterium tuberculosis
APLAQEREEDDEDDWDEEDD

SEQ ID NO: 1537819 - protein, 11 aa, Mycobacterium tuberculosis
APPDPSPPNLD

SEQ ID NO: 1537820 - protein, 37 aa, Mycobacterium tuberculosis; identical to SEQ ID NO: 229107

SEQ ID NO: 1537821 - protein, 9 aa, Mycobacterium tuberculosis
APPSGQPRV

SEQ ID NO: 1537822 - protein, 7 aa, Mycobacterium tuberculosis
AQGIGQA

SEQ ID NO: 1537823 - protein, 6 aa, Mycobacterium tuberculosis
AQVGTQ

SEQ ID NO: 1537824 - protein, 9 aa, Mycobacterium tuberculosis
AQVKSDRLD

SEQ ID NO: 1537825 - protein, 10 aa, Mycobacterium tuberculosis
ARGASTSKEV

SEQ ID NO: 1537826 - protein, 5 aa, Mycobacterium tuberculosis
ARGDV

SEQ ID NO: 1537827 - protein, 7 aa, Mycobacterium tuberculosis
ARSFSGA

SEQ ID NO: 1537828 - protein, 16 aa, Mycobacterium tuberculosis
ASAEATDSKAAARLGS

SEQ ID NO: 1537829 - protein, 8 aa, Mycobacterium tuberculosis
ASDAGTHH

SEQ ID NO: 1537830 - protein, 6 aa, Mycobacterium tuberculosis
ASDDRA

SEQ ID NO: 1537831 - protein, 11 aa, Mycobacterium tuberculosis
ASDTSNGRTPG

SEQ ID NO: 1537832 - protein, 4 aa, Mycobacterium tuberculosis
ASPY

SEQ ID NO: 1537833 - protein, 69 aa, Mycobacterium tuberculosis; identical to SEQ ID NO: 229220

SEQ ID NO: 1537834 - protein, 4 aa, Mycobacterium tuberculosis
ATFR

SEQ ID NO: 1537835 - protein, 5 aa, Mycobacterium tuberculosis
ATIAA

SEQ ID NO: 1537836 - protein, 8 aa, Mycobacterium tuberculosis
ATSRRKDQ

SEQ ID NO: 1537837 - protein, 11 aa, Mycobacterium tuberculosis
AVSEQSPNYRD

SEQ ID NO: 1537838 - protein, 14 aa, Mycobacterium tuberculosis
CNGYPAGDMSVWNW

SEQ ID NO: 1537839 - protein, 6 aa, Mycobacterium tuberculosis
CNPSRP

SEQ ID NO: 1537840 - protein, 5 aa, Mycobacterium tuberculosis
DAGGE

SEQ ID NO: 1537841 - protein, 16 aa, Mycobacterium tuberculosis
DAPPGTCRASRSMPNS

SEQ ID NO: 1537842 - protein, 5 aa, Mycobacterium tuberculosis
DCGRD

SEQ ID NO: 1537843 - protein, 7 aa, Mycobacterium tuberculosis
DEGHSAK

SEQ ID NO: 1537844 - protein, 4 aa, Mycobacterium tuberculosis
DEHR

SEQ ID NO: 1537845 - protein, 17 aa, Mycobacterium tuberculosis
DENGRMTGYDLKYPDGG

SEQ ID NO: 1537846 - protein, 12 aa, Mycobacterium tuberculosis
DGPAAADPNQDD

SEQ ID NO: 1537847 - protein, 6 aa, Mycobacterium tuberculosis
DGTGGT

SEQ ID NO: 1537848 - protein, 5 aa, Mycobacterium tuberculosis
DGVTP

SEQ ID NO: 1537849 - protein, 6 aa, Mycobacterium tuberculosis
DHDRLG

SEQ ID NO: 1537850 - protein, 19 aa, Mycobacterium tuberculosis
DLAGTSARVRAKRPDGDWG

SEQ ID NO: 1537851 - protein, 11 aa, Mycobacterium tuberculosis
DLYGGNEPSRT

SEQ ID NO: 1537852 - protein, 4 aa, Mycobacterium tuberculosis
DNGS

SEQ ID NO: 1537853 - protein, 15 aa, Mycobacterium tuberculosis
DNTTITGSATSGGFC

SEQ ID NO: 1537854 - protein, 4 aa, Mycobacterium tuberculosis
DPAV

SEQ ID NO: 1537855 - protein, 6 aa, Mycobacterium tuberculosis
DPFRRP

SEQ ID NO: 1537856 - protein, 8 aa, Mycobacterium tuberculosis
DPSANPYL

SEQ ID NO: 1537857 - protein, 8 aa, Mycobacterium tuberculosis
DPTAPEIP

SEQ ID NO: 1537858 - protein, 31 aa, Mycobacterium tuberculosis; identical to SEQ ID NO: 1370469

SEQ ID NO: 1537859 - protein, 4 aa, Mycobacterium tuberculosis
DPVP

SEQ ID NO: 1537860 - protein, 5 aa, Mycobacterium tuberculosis
DQTYP

SEQ ID NO: 1537861 - protein, 17 aa, Mycobacterium tuberculosis
DRSAPRPNARASGRSIG

SEQ ID NO: 1537862 - protein, 9 aa, Mycobacterium tuberculosis
DSGAHARSA

SEQ ID NO: 1537863 - protein, 6 aa, Mycobacterium tuberculosis
DSGHNT

SEQ ID NO: 1537864 - protein, 8 aa, Mycobacterium tuberculosis
DSHPETNQ

SEQ ID NO: 1537865 - protein, 5 aa, Mycobacterium tuberculosis
DTPWR

SEQ ID NO: 1537866 - protein, 5 aa, Mycobacterium tuberculosis
DTSPV

SEQ ID NO: 1537867 - protein, 10 aa, Mycobacterium tuberculosis
DVDDVRDGAV

SEQ ID NO: 1537868 - protein, 7 aa, Mycobacterium tuberculosis
EDEVSAA

SEQ ID NO: 1537869 - protein, 10 aa, Mycobacterium tuberculosis
EDSHRSHTGA

SEQ ID NO: 1537870 - protein, 6 aa, Mycobacterium tuberculosis
EGFETG

SEQ ID NO: 1537871 - protein, 12 aa, Mycobacterium tuberculosis
EGKREEAERDAH

SEQ ID NO: 1537872 - protein, 10 aa, Mycobacterium tuberculosis
EIERDGRPAA

SEQ ID NO: 1537873 - protein, 4 aa, Mycobacterium tuberculosis
EIPA

SEQ ID NO: 1537874 - protein, 7 aa, Mycobacterium tuberculosis
ELPGEPP

SEQ ID NO: 1537875 - protein, 9 aa, Mycobacterium tuberculosis
ELSGPPADG

SEQ ID NO: 1537876 - protein, 9 aa, Mycobacterium tuberculosis
ENALPGSIS

SEQ ID NO: 1537877 - protein, 7 aa, Mycobacterium tuberculosis
ENRSQAA

SEQ ID NO: 1537878 - protein, 7 aa, Mycobacterium tuberculosis
EPGGSFN

SEQ ID NO: 1537879 - protein, 17 aa, Mycobacterium tuberculosis
ERPVPSNLPKPSPGMDP

SEQ ID NO: 1537880 - protein, 8 aa, Mycobacterium tuberculosis
ETANATPL

SEQ ID NO: 1537881 - protein, 4 aa, Mycobacterium tuberculosis
EVEN

SEQ ID NO: 1537882 - protein, 18 aa, Mycobacterium tuberculosis
FDGEDEVTGPDADRARAA

SEQ ID NO: 1537883 - protein, 10 aa, Mycobacterium tuberculosis
FQDRPDGSLI

SEQ ID NO: 1537884 - protein, 5 aa, Mycobacterium tuberculosis
GAARR

SEQ ID NO: 1537885 - protein, 7 aa, Mycobacterium tuberculosis
GAEVSDT

SEQ ID NO: 1537886 - protein, 9 aa, Mycobacterium tuberculosis
GAGAGMPGG

SEQ ID NO: 1537887 - protein, 8 aa, Mycobacterium tuberculosis
GAHTPAAV

SEQ ID NO: 1537888 - protein, 4 aa, Mycobacterium tuberculosis
GALT

SEQ ID NO: 1537889 - protein, 21 aa, Mycobacterium tuberculosis
GCGAGQISQTANQKPAVNGNR

SEQ ID NO: 1537890 - protein, 6 aa, Mycobacterium tuberculosis
GDNPQT

SEQ ID NO: 1537891 - protein, 9 aa, Mycobacterium tuberculosis
GDPICSDGN

SEQ ID NO: 1537892 - protein, 18 aa, Mycobacterium tuberculosis
GDQYNAGRHVPPAEAKRG

SEQ ID NO: 1537893 - protein, 6 aa, Mycobacterium tuberculosis
GEGTGL

SEQ ID NO: 1537894 - protein, 13 aa, Mycobacterium tuberculosis
GGTASATFGGDRQ

SEQ ID NO: 1537895 - protein, 4 aa, Mycobacterium tuberculosis
GHDA

SEQ ID NO: 1537896 - protein, 11 aa, Mycobacterium tuberculosis
GHGNSTTIGAE

SEQ ID NO: 1537897 - protein, 4 aa, Mycobacterium tuberculosis
GIDL

SEQ ID NO: 1537898 - protein, 8 aa, Mycobacterium tuberculosis
GIGPSAQR

SEQ ID NO: 1537899 - protein, 8 aa, Mycobacterium tuberculosis
GKKSLSDF

SEQ ID NO: 1537900 - protein, 11 aa, Mycobacterium tuberculosis
GKLNNKPDAAA

SEQ ID NO: 1537901 - protein, 22 aa, Mycobacterium tuberculosis
GLTPAAPAAAAAPALTPSIPGV

SEQ ID NO: 1537902 - protein, 9 aa, Mycobacterium tuberculosis
GNAGDRSMR

SEQ ID NO: 1537903 - protein, 47 aa, Mycobacterium tuberculosis
GNGGNGYSATASGVGGGAGGSAGLIGNGGAGGAGGPNAPGGAGGNGG

SEQ ID NO: 1537904 - protein, 5 aa, Mycobacterium tuberculosis
GNSTF

SEQ ID NO: 1537905 - protein, 9 aa, Mycobacterium tuberculosis
GPAGGDRTT

SEQ ID NO: 1537906 - protein, 5 aa, Mycobacterium tuberculosis
GPNLA

SEQ ID NO: 1537907 - protein, 15 aa, Mycobacterium tuberculosis
GQRTGVGLPGESAGL

SEQ ID NO: 1537908 - protein, 8 aa, Mycobacterium tuberculosis
GQSDVDPA

SEQ ID NO: 1537909 - protein, 16 aa, Mycobacterium tuberculosis
GRDPRGGNVDTTINPR

SEQ ID NO: 1537910 - protein, 6 aa, Mycobacterium tuberculosis
GSDDIV

SEQ ID NO: 1537911 - protein, 4 aa, Mycobacterium tuberculosis
GSGA

SEQ ID NO: 1537912 - protein, 5 aa, Mycobacterium tuberculosis
GSPGG

SEQ ID NO: 1537913 - protein, 10 aa, Mycobacterium tuberculosis
GSRPATSLTG

SEQ ID NO: 1537914 - protein, 7 aa, Mycobacterium tuberculosis
GSTPDSE

SEQ ID NO: 1537915 - protein, 13 aa, Mycobacterium tuberculosis
GTPAALGADAASI

SEQ ID NO: 1537916 - protein, 18 aa, Mycobacterium tuberculosis
GTWPSGTTVHANPDGTAF

SEQ ID NO: 1537917 - protein, 8 aa, Mycobacterium tuberculosis
GVETRTGV

SEQ ID NO: 1537918 - protein, 8 aa, Mycobacterium tuberculosis
GVNKPSMP

SEQ ID NO: 1537919 - protein, 7 aa, Mycobacterium tuberculosis
GVNPADL

SEQ ID NO: 1537920 - protein, 4 aa, Mycobacterium tuberculosis
GVTA

SEQ ID NO: 1537921 - protein, 4 aa, Mycobacterium tuberculosis
GWAP

SEQ ID NO: 1537922 - protein, 13 aa, Mycobacterium tuberculosis
GWNPETQALDPTG

SEQ ID NO: 1537923 - protein, 20 aa, Mycobacterium tuberculosis
GWTTSDVAATDPGVADGAAA

SEQ ID NO: 1537924 - protein, 9 aa, Mycobacterium tuberculosis
HAAAASTVQ

SEQ ID NO: 1537925 - protein, 5 aa, Mycobacterium tuberculosis
HGRTP

SEQ ID NO: 1537926 - protein, 5 aa, Mycobacterium tuberculosis
HGTAD

SEQ ID NO: 1537927 - protein, 6 aa, Mycobacterium tuberculosis
HHGTYR

SEQ ID NO: 1537928 - protein, 14 aa, Mycobacterium tuberculosis
HKVAPSAAEQQSMS

SEQ ID NO: 1537929 - protein, 24 aa, Mycobacterium tuberculosis
HPAWQSAANDVNAKDARMKAICGG

SEQ ID NO: 1537930 - protein, 4 aa, Mycobacterium tuberculosis
HPHL

SEQ ID NO: 1537931 - protein, 26 aa, Mycobacterium tuberculosis
HPRPSSAGDGYDAAASSGSNLGPTNE

SEQ ID NO: 1537932 - protein, 6 aa, Mycobacterium tuberculosis
HSGVPG

SEQ ID NO: 1537933 - protein, 4 aa, Mycobacterium tuberculosis
HSTR

SEQ ID NO: 1537934 - protein, 9 aa, Mycobacterium tuberculosis
IASAGANAF

SEQ ID NO: 1537935 - protein, 13 aa, Mycobacterium tuberculosis
IEPRGAQALPPGG

SEQ ID NO: 1537936 - protein, 8 aa, Mycobacterium tuberculosis
INTGNGYY

SEQ ID NO: 1537937 - protein, 5 aa, Mycobacterium tuberculosis
ISGYS

SEQ ID NO: 1537938 - protein, 8 aa, Mycobacterium tuberculosis
ITDARSST

SEQ ID NO: 1537939 - protein, 4 aa, Mycobacterium tuberculosis
KATV

SEQ ID NO: 1537940 - protein, 5 aa, Mycobacterium tuberculosis
KFRTG

SEQ ID NO: 1537941 - protein, 13 aa, Mycobacterium tuberculosis
KGLGSGGAKGCPK

SEQ ID NO: 1537942 - protein, 8 aa, Mycobacterium tuberculosis
KGTDTGQA

SEQ ID NO: 1537943 - protein, 4 aa, Mycobacterium tuberculosis
KIAN

SEQ ID NO: 1537944 - protein, 6 aa, Mycobacterium tuberculosis
KLADTQ

SEQ ID NO: 1537945 - protein, 14 aa, Mycobacterium tuberculosis
KRGGGAIVNQSSTA

SEQ ID NO: 1537946 - protein, 11 aa, Mycobacterium tuberculosis
KVDGSGGIRGP

SEQ ID NO: 1537947 - protein, 5 aa, Mycobacterium tuberculosis
KVNKN

SEQ ID NO: 1537948 - protein, 6 aa, Mycobacterium tuberculosis
KVSQTS

SEQ ID NO: 1537949 - protein, 9 aa, Mycobacterium tuberculosis
LAQADREHA

SEQ ID NO: 1537950 - protein, 11 aa, Mycobacterium tuberculosis
LAQSGPPAEAV

SEQ ID NO: 1537951 - protein, 6 aa, Mycobacterium tuberculosis
LAQTGY

SEQ ID NO: 1537952 - protein, 6 aa, Mycobacterium tuberculosis
LAREGA

SEQ ID NO: 1537953 - protein, 5 aa, Mycobacterium tuberculosis
LATPR

SEQ ID NO: 1537954 - protein, 10 aa, Mycobacterium tuberculosis
LDPGADGTYP

SEQ ID NO: 1537955 - protein, 8 aa, Mycobacterium tuberculosis
LGANGATL

SEQ ID NO: 1537956 - protein, 5 aa, Mycobacterium tuberculosis
LGDGE

SEQ ID NO: 1537957 - protein, 9 aa, Mycobacterium tuberculosis
LGGRELGAG

SEQ ID NO: 1537958 - protein, 27 aa, Mycobacterium tuberculosis
LGPAPGPAPPPAAPGPPAPPGPGPQLP

SEQ ID NO: 1537959 - protein, 6 aa, Mycobacterium tuberculosis
LGRNSA

SEQ ID NO: 1537960 - protein, 11 aa, Mycobacterium tuberculosis
LGSSAGRHADE

SEQ ID NO: 1537961 - protein, 9 aa, Mycobacterium tuberculosis
LLGGDGGDI

SEQ ID NO: 1537962 - protein, 22 aa, Mycobacterium tuberculosis
LPATNGPSGARPDAPAASGTVI

SEQ ID NO: 1537963 - protein, 5 aa, Mycobacterium tuberculosis
LPGGS

SEQ ID NO: 1537964 - protein, 9 aa, Mycobacterium tuberculosis
LSKSSLHPA

SEQ ID NO: 1537965 - protein, 7 aa, Mycobacterium tuberculosis
LTSRDQI

SEQ ID NO: 1537966 - protein, 5 aa, Mycobacterium tuberculosis
LTTGR

SEQ ID NO: 1537967 - protein, 5 aa, Mycobacterium tuberculosis
MADPA

SEQ ID NO: 1537968 - protein, 18 aa, Mycobacterium tuberculosis
MDATSEQHSSGQPPQATR

SEQ ID NO: 1537969 - protein, 5 aa, Mycobacterium tuberculosis
MGEKD

SEQ ID NO: 1537970 - protein, 5 aa, Mycobacterium tuberculosis
NAGAK

SEQ ID NO: 1537971 - protein, 6 aa, Mycobacterium tuberculosis
NALPRR

SEQ ID NO: 1537972 - protein, 18 aa, Mycobacterium tuberculosis
NATDPGAAAQFNASPVAQ

SEQ ID NO: 1537973 - protein, 10 aa, Mycobacterium tuberculosis
NDTSLSRNGY

SEQ ID NO: 1537974 - protein, 17 aa, Mycobacterium tuberculosis
NGANGLPNTGQDGGPGG

SEQ ID NO: 1537975 - protein, 8 aa, Mycobacterium tuberculosis
NGGANDGW

SEQ ID NO: 1537976 - protein, 4 aa, Mycobacterium tuberculosis
NGGE

SEQ ID NO: 1537977 - protein, 23 aa, Mycobacterium tuberculosis
NGGNGGAGDAAHPNGGNGGDAGM

SEQ ID NO: 1537978 - protein, 25 aa, Mycobacterium tuberculosis
NGGPGGAGGIGTTGDGGPGGAGGNA

SEQ ID NO: 1537979 - protein, 5 aa, Mycobacterium tuberculosis
NGRFT

SEQ ID NO: 1537980 - protein, 8 aa, Mycobacterium tuberculosis
NGTSGPLR

SEQ ID NO: 1537981 - protein, 14 aa, Mycobacterium tuberculosis
NGVYGQTRETKRAG

SEQ ID NO: 1537982 - protein, 5 aa, Mycobacterium tuberculosis
NNNVD

SEQ ID NO: 1537983 - protein, 8 aa, Mycobacterium tuberculosis
NNQRGDLT

SEQ ID NO: 1537984 - protein, 21 aa, Mycobacterium tuberculosis
NPASAPPEPPDLSASRSAIDS

SEQ ID NO: 1537985 - protein, 24 aa, Mycobacterium tuberculosis
NPDGSKQPVLRNDGTPIPDQVDSV

SEQ ID NO: 1537986 - protein, 15 aa, Mycobacterium tuberculosis
NPGGTGGSGVTGGSE

SEQ ID NO: 1537987 - protein, 6 aa, Mycobacterium tuberculosis
NSDPFY

SEQ ID NO: 1537988 - protein, 11 aa, Mycobacterium tuberculosis
NTGGLPPGTPA

SEQ ID NO: 1537989 - protein, 6 aa, Mycobacterium tuberculosis
NYRGSM

SEQ ID NO: 1537990 - protein, 24 aa, Mycobacterium tuberculosis
PAAIPTGPDSAPANAPRIASPTEA

SEQ ID NO: 1537991 - protein, 7 aa, Mycobacterium tuberculosis
PAERRDY

SEQ ID NO: 1537992 - protein, 5 aa, Mycobacterium tuberculosis
PDELR

SEQ ID NO: 1537993 - protein, 20 aa, Mycobacterium tuberculosis
PDGSPKPAGTRLTNPAYSKT

SEQ ID NO: 1537994 - protein, 7 aa, Mycobacterium tuberculosis
PDSGTHS

SEQ ID NO: 1537995 - protein, 4 aa, Mycobacterium tuberculosis
PDVN

SEQ ID NO: 1537996 - protein, 4 aa, Mycobacterium tuberculosis
PDWQ

SEQ ID NO: 1537997 - protein, 13 aa, Mycobacterium tuberculosis
PEAFDDQGNYRNQ

SEQ ID NO: 1537998 - protein, 6 aa, Mycobacterium tuberculosis
PELSGG

SEQ ID NO: 1537999 - protein, 6 aa, Mycobacterium tuberculosis
PGFHGQ

SEQ ID NO: 1538000 - protein, 12 aa, Mycobacterium tuberculosis
PGPVPAAAPVPI

SEQ ID NO: 1538001 - protein, 4 aa, Mycobacterium tuberculosis
PLPG

SEQ ID NO: 1538002 - protein, 14 aa, Mycobacterium tuberculosis
PLSPDPGPPLVLQA

SEQ ID NO: 1538003 - protein, 8 aa, Mycobacterium tuberculosis
PNAPQPVR

SEQ ID NO: 1538004 - protein, 18 aa, Mycobacterium tuberculosis
PNLSGPVNLTGPAPVTNA

SEQ ID NO: 1538005 - protein, 25 aa, Mycobacterium tuberculosis
PPVEPVSPTNPRSSASPGSPDRSGL

SEQ ID NO: 1538006 - protein, 4 aa, Mycobacterium tuberculosis
PQAF

SEQ ID NO: 1538007 - protein, 9 aa, Mycobacterium tuberculosis
PQSSGIGGG

SEQ ID NO: 1538008 - protein, 8 aa, Mycobacterium tuberculosis
PRERPSFT

SEQ ID NO: 1538009 - protein, 7 aa, Mycobacterium tuberculosis
PSAAAAD

SEQ ID NO: 1538010 - protein, 21 aa, Mycobacterium tuberculosis
PSPGSSTPVGQLPPAATQTLG

SEQ ID NO: 1538011 - protein, 7 aa, Mycobacterium tuberculosis
PSQAMGP

SEQ ID NO: 1538012 - protein, 19 aa, Mycobacterium tuberculosis
PVPIPGGPVPIPGAPVPVP

SEQ ID NO: 1538013 - protein, 9 aa, Mycobacterium tuberculosis
QAADPRSDL

SEQ ID NO: 1538014 - protein, 12 aa, Mycobacterium tuberculosis
QANPAPPVGPAL

SEQ ID NO: 1538015 - protein, 9 aa, Mycobacterium tuberculosis
QAQGQAKAI

SEQ ID NO: 1538016 - protein, 9 aa, Mycobacterium tuberculosis
QARTRSVAN

SEQ ID NO: 1538017 - protein, 15 aa, Mycobacterium tuberculosis
QASPSRIDGTHQTLQ

SEQ ID NO: 1538018 - protein, 14 aa, Mycobacterium tuberculosis
QDGTPVPACSRGTL

SEQ ID NO: 1538019 - protein, 13 aa, Mycobacterium tuberculosis
QDPVATAASNNPM

SEQ ID NO: 1538020 - protein, 21 aa, Mycobacterium tuberculosis
QLDNAAPDDVEITDSSAAAEY

SEQ ID NO: 1538021 - protein, 4 aa, Mycobacterium tuberculosis
QQAT

SEQ ID NO: 1538022 - protein, 12 aa, Mycobacterium tuberculosis
QQNTAGSGAGFG

SEQ ID NO: 1538023 - protein, 5 aa, Mycobacterium tuberculosis
QRPPA

SEQ ID NO: 1538024 - protein, 6 aa, Mycobacterium tuberculosis
QSIQAA

SEQ ID NO: 1538025 - protein, 4 aa, Mycobacterium tuberculosis
RAKR

SEQ ID NO: 1538026 - protein, 18 aa, Mycobacterium tuberculosis
RANGGSGSAANASREEQI

SEQ ID NO: 1538027 - protein, 34 aa, Mycobacterium tuberculosis
RARTERVNTESAARLAKQKADKAAADAKASQDAA

SEQ ID NO: 1538028 - protein, 6 aa, Mycobacterium tuberculosis
RAVQPD

SEQ ID NO: 1538029 - protein, 11 aa, Mycobacterium tuberculosis
RDADARQARNQ

SEQ ID NO: 1538030 - protein, 11 aa, Mycobacterium tuberculosis
RDGGGLDGDAA

SEQ ID NO: 1538031 - protein, 6 aa, Mycobacterium tuberculosis
RDPDDF

SEQ ID NO: 1538032 - protein, 8 aa, Mycobacterium tuberculosis
RDRIGTAN

SEQ ID NO: 1538033 - protein, 9 aa, Mycobacterium tuberculosis
RDSRITPTE

SEQ ID NO: 1538034 - protein, 12 aa, Mycobacterium tuberculosis
RNGNEVAVTTET

SEQ ID NO: 1538035 - protein, 6 aa, Mycobacterium tuberculosis
RNSRDS

SEQ ID NO: 1538036 - protein, 11 aa, Mycobacterium tuberculosis
RPGPLRPAERR

SEQ ID NO: 1538037 - protein, 6 aa, Mycobacterium tuberculosis
RPPTSF

SEQ ID NO: 1538038 - protein, 4 aa, Mycobacterium tuberculosis
RRGP

SEQ ID NO: 1538039 - protein, 12 aa, Mycobacterium tuberculosis
RRPRPARAVPTG

SEQ ID NO: 1538040 - protein, 8 aa, Mycobacterium tuberculosis
RSGLPDHA

SEQ ID NO: 1538041 - protein, 4 aa, Mycobacterium tuberculosis
RTGG

SEQ ID NO: 1538042 - protein, 9 aa, Mycobacterium tuberculosis
RTGKLNDGS

SEQ ID NO: 1538043 - protein, 5 aa, Mycobacterium tuberculosis
RTTLG

SEQ ID NO: 1538044 - protein, 19 aa, Mycobacterium tuberculosis
RYGDLDPAQLADKFRMAWS

SEQ ID NO: 1538045 - protein, 13 aa, Mycobacterium tuberculosis
SAANGAAAPTTAG

SEQ ID NO: 1538046 - protein, 23 aa, Mycobacterium tuberculosis
SAEPDGANRPPPPIAGPRTPVAG

SEQ ID NO: 1538047 - protein, 7 aa, Mycobacterium tuberculosis
SAPAGVT

SEQ ID NO: 1538048 - protein, 6 aa, Mycobacterium tuberculosis
SAPVAA

SEQ ID NO: 1538049 - protein, 9 aa, Mycobacterium tuberculosis
SDADGVSVP

SEQ ID NO: 1538050 - protein, 9 aa, Mycobacterium tuberculosis
SDPSKPNGQ

SEQ ID NO: 1538051 - protein, 6 aa, Mycobacterium tuberculosis
SDSGRA

SEQ ID NO: 1538052 - protein, 8 aa, Mycobacterium tuberculosis
SEADPLTA

SEQ ID NO: 1538053 - protein, 6 aa, Mycobacterium tuberculosis
SEHERA

SEQ ID NO: 1538054 - protein, 4 aa, Mycobacterium tuberculosis
SERR

SEQ ID NO: 1538055 - protein, 18 aa, Mycobacterium tuberculosis
SGDPARALGPPPDGSYSF

SEQ ID NO: 1538056 - protein, 29 aa, Mycobacterium tuberculosis
SGGTGGMGGVGGMGGVGNGGNAGNGGTAG

SEQ ID NO: 1538057 - protein, 5 aa, Mycobacterium tuberculosis
SGLGI

SEQ ID NO: 1538058 - protein, 5 aa, Mycobacterium tuberculosis
SHPEF

SEQ ID NO: 1538059 - protein, 11 aa, Mycobacterium tuberculosis
SHQEGEPARRA

SEQ ID NO: 1538060 - protein, 6 aa, Mycobacterium tuberculosis
SHTPQV

SEQ ID NO: 1538061 - protein, 13 aa, Mycobacterium tuberculosis
SPAANAPDAGPPQ

SEQ ID NO: 1538062 - protein, 16 aa, Mycobacterium tuberculosis
SPIGRERKTEELSRAS

SEQ ID NO: 1538063 - protein, 11 aa, Mycobacterium tuberculosis
SPPAEEAPPVP

SEQ ID NO: 1538064 - protein, 14 aa, Mycobacterium tuberculosis
SPTSTVVGGATQSI

SEQ ID NO: 1538065 - protein, 18 aa, Mycobacterium tuberculosis
SPVEDQPKHAADGDDAEV

SEQ ID NO: 1538066 - protein, 7 aa, Mycobacterium tuberculosis
SSAGRGA

SEQ ID NO: 1538067 - protein, 18 aa, Mycobacterium tuberculosis
SSPMAADQQTAGPLAGEL

SEQ ID NO: 1538068 - protein, 24 aa, Mycobacterium tuberculosis
SSTKPVSQDTSPKPATSPAAPVTT

SEQ ID NO: 1538069 - protein, 10 aa, Mycobacterium tuberculosis
STETTERPEH

SEQ ID NO: 1538070 - protein, 10 aa, Mycobacterium tuberculosis
STLSPASAAA

SEQ ID NO: 1538071 - protein, 9 aa, Mycobacterium tuberculosis
STNRGSENF

SEQ ID NO: 1538072 - protein, 17 aa, Mycobacterium tuberculosis
STPERVAGGTCSAGQQC

SEQ ID NO: 1538073 - protein, 10 aa, Mycobacterium tuberculosis
STTPQQITRT

SEQ ID NO: 1538074 - protein, 4 aa, Mycobacterium tuberculosis
SVLP

SEQ ID NO: 1538075 - protein, 7 aa, Mycobacterium tuberculosis
TADDNTK

SEQ ID NO: 1538076 - protein, 4 aa, Mycobacterium tuberculosis
TAFG

SEQ ID NO: 1538077 - protein, 12 aa, Mycobacterium tuberculosis
TANLGRPEPTHD

SEQ ID NO: 1538078 - protein, 7 aa, Mycobacterium tuberculosis
TDNAPIA

SEQ ID NO: 1538079 - protein, 8 aa, Mycobacterium tuberculosis
TDQRDALR

SEQ ID NO: 1538080 - protein, 4 aa, Mycobacterium tuberculosis
TEIG

SEQ ID NO: 1538081 - protein, 4 aa, Mycobacterium tuberculosis
TEPV

SEQ ID NO: 1538082 - protein, 10 aa, Mycobacterium tuberculosis
TGAGGAYAAA

SEQ ID NO: 1538083 - protein, 4 aa, Mycobacterium tuberculosis
TGIP

SEQ ID NO: 1538084 - protein, 5 aa, Mycobacterium tuberculosis
TGPVG

SEQ ID NO: 1538085 - protein, 19 aa, Mycobacterium tuberculosis
TGSVQAYDGREVAPAAATE

SEQ ID NO: 1538086 - protein, 13 aa, Mycobacterium tuberculosis
TIAPNGDVSPPIR

SEQ ID NO: 1538087 - protein, 7 aa, Mycobacterium tuberculosis
TKASSED

SEQ ID NO: 1538088 - protein, 7 aa, Mycobacterium tuberculosis
TKNAINA

SEQ ID NO: 1538089 - protein, 8 aa, Mycobacterium tuberculosis
TNATSEAV

SEQ ID NO: 1538090 - protein, 5 aa, Mycobacterium tuberculosis
TNNHP

SEQ ID NO: 1538091 - protein, 14 aa, Mycobacterium tuberculosis
TPAAGERPESRRQA

SEQ ID NO: 1538092 - protein, 8 aa, Mycobacterium tuberculosis
TPSQTANM

SEQ ID NO: 1538093 - protein, 5 aa, Mycobacterium tuberculosis
TQDTP

SEQ ID NO: 1538094 - protein, 4 aa, Mycobacterium tuberculosis
TQRL

SEQ ID NO: 1538095 - protein, 8 aa, Mycobacterium tuberculosis
TSGGSGPA

SEQ ID NO: 1538096 - protein, 10 aa, Mycobacterium tuberculosis
TSSSRAGECE

SEQ ID NO: 1538097 - protein, 7 aa, Mycobacterium tuberculosis
TSTPPGM

SEQ ID NO: 1538098 - protein, 5 aa, Mycobacterium tuberculosis
TTATG

SEQ ID NO: 1538099 - protein, 19 aa, Mycobacterium tuberculosis
VAAPATAELAPAAADEVSA

SEQ ID NO: 1538100 - protein, 5 aa, Mycobacterium tuberculosis
VAKGT

SEQ ID NO: 1538101 - protein, 7 aa, Mycobacterium tuberculosis
VDNDETV

SEQ ID NO: 1538102 - protein, 9 aa, Mycobacterium tuberculosis
VDNPGPSDY

SEQ ID NO: 1538103 - protein, 4 aa, Mycobacterium tuberculosis
VGAN

SEQ ID NO: 1538104 - protein, 14 aa, Mycobacterium tuberculosis
VGAQSTSVASASDV

SEQ ID NO: 1538105 - protein, 19 aa, Mycobacterium tuberculosis
VGGASLTASLGEASSVGGL

SEQ ID NO: 1538106 - protein, 7 aa, Mycobacterium tuberculosis
VGKPSLE

SEQ ID NO: 1538107 - protein, 5 aa, Mycobacterium tuberculosis
VGQIG

SEQ ID NO: 1538108 - protein, 12 aa, Mycobacterium tuberculosis
VGTSPSGQTIPG

SEQ ID NO: 1538109 - protein, 21 aa, Mycobacterium tuberculosis
VLPSETTVDPTQLSDVDRDRA

SEQ ID NO: 1538110 - protein, 12 aa, Mycobacterium tuberculosis
VNPDGDQGGPQI

SEQ ID NO: 1538111 - protein, 6 aa, Mycobacterium tuberculosis
VNPGAR

SEQ ID NO: 1538112 - protein, 5 aa, Mycobacterium tuberculosis
VNRPT

SEQ ID NO: 1538113 - protein, 5 aa, Mycobacterium tuberculosis
VPAEG

SEQ ID NO: 1538114 - protein, 5 aa, Mycobacterium tuberculosis
VPPTW

SEQ ID NO: 1538115 - protein, 11 aa, Mycobacterium tuberculosis
VTGSGSGLDPA

SEQ ID NO: 1538116 - protein, 18 aa, Mycobacterium tuberculosis
VTMPDSNSVKARELSGSS

SEQ ID NO: 1538117 - protein, 5 aa, Mycobacterium tuberculosis
VTPIP

SEQ ID NO: 1538118 - protein, 14 aa, Mycobacterium tuberculosis
YAPSKVDLNGGRPT

SEQ ID NO: 1538119 - protein, 8 aa, Mycobacterium tuberculosis
YGAGPCSG

SEQ ID NO: 1538120 - protein, 14 aa, Mycobacterium tuberculosis
YGNAATLTTTVESS

SEQ ID NO: 1538121 - protein, 4 aa, Mycobacterium tuberculosis
YGQA

SEQ ID NO: 1538122 - protein, 5 aa, Mycobacterium tuberculosis
YGVRP

SEQ ID NO: 1538123 - protein, 5 aa, Mycobacterium tuberculosis
YNYPP

SEQ ID NO: 1538124 - protein, 4 aa, Mycobacterium tuberculosis
YPGD

SEQ ID NO: 1538125 - protein, 27 aa, Mycobacterium tuberculosis
YPPGKSREEIENDNAADFKRSEAAAEY

SEQ ID NO: 1538126 - protein, 20 aa, Mycobacterium tuberculosis
YPQTTPVQESGPARPIPSGI

SEQ ID NO: 1538127 - protein, 12 aa, Mycobacterium tuberculosis
YPTRAAAEATAV

SEQ ID NO: 1538128 - protein, 7 aa, Mycobacterium tuberculosis
YRPRDER

SEQ ID NO: 1538129 - protein, 8 aa, Mycobacterium tuberculosis
YRRTDGQW

SEQ ID NO: 1538130 - protein, 7 aa, Mycobacterium tuberculosis
YSGSQYN

SEQ ID NO: 1538131 - protein, 28 aa, Mycobacterium tuberculosis
YTSGTGQGNASATKDGSHYKITGTATGV

SEQ ID NO: 1538132 - protein, 9 aa, Mycobacterium tuberculosis
YWGPPSKPG

SEQ ID NO: 1538133 - protein, 8 aa, Mycobacterium tuberculosis
AAAVTTPG

SEQ ID NO: 1538134 - protein, 8 aa, Mycobacterium tuberculosis
AAFGPNPL

SEQ ID NO: 1538135 - protein, 7 aa, Mycobacterium tuberculosis
AAGRGTR

SEQ ID NO: 1538136 - protein, 7 aa, Mycobacterium tuberculosis
AANLRSD

SEQ ID NO: 1538137 - protein, 4 aa, Mycobacterium tuberculosis
ADHS

SEQ ID NO: 1538138 - protein, 7 aa, Mycobacterium tuberculosis
ADPNVSF

SEQ ID NO: 1538139 - protein, 10 aa, Mycobacterium tuberculosis
AEPDSSDRDI

SEQ ID NO: 1538140 - protein, 4 aa, Mycobacterium tuberculosis
AEQG

SEQ ID NO: 1538141 - protein, 9 aa, Mycobacterium tuberculosis
AGGARPIGT

SEQ ID NO: 1538142 - protein, 8 aa, Mycobacterium tuberculosis
AGGDCGRC

SEQ ID NO: 1538143 - protein, 7 aa, Mycobacterium tuberculosis
AGGDEVS

SEQ ID NO: 1538144 - protein, 6 aa, Mycobacterium tuberculosis
AGGSDV

SEQ ID NO: 1538145 - protein, 8 aa, Mycobacterium tuberculosis
AGPRPEMA

SEQ ID NO: 1538146 - protein, 7 aa, Mycobacterium tuberculosis
AGSAQRR

SEQ ID NO: 1538147 - protein, 8 aa, Mycobacterium tuberculosis
AGSGPTLA

SEQ ID NO: 1538148 - protein, 5 aa, Mycobacterium tuberculosis
AIDST

SEQ ID NO: 1538149 - protein, 7 aa, Mycobacterium tuberculosis
ANGEERS

SEQ ID NO: 1538150 - protein, 4 aa, Mycobacterium tuberculosis
ANQD

SEQ ID NO: 1538151 - protein, 8 aa, Mycobacterium tuberculosis
ANTGSNNI

SEQ ID NO: 1538152 - protein, 9 aa, Mycobacterium tuberculosis
APDGTALPR

SEQ ID NO: 1538153 - protein, 6 aa, Mycobacterium tuberculosis
APGPGE

SEQ ID NO: 1538154 - protein, 13 aa, Mycobacterium tuberculosis
APTSAAGSNTATT

SEQ ID NO: 1538155 - protein, 7 aa, Mycobacterium tuberculosis
AQTAQTV

SEQ ID NO: 1538156 - protein, 15 aa, Mycobacterium tuberculosis
ARAFQDAKNRADQYA

SEQ ID NO: 1538157 - protein, 9 aa, Mycobacterium tuberculosis
ARAGGDHRR

SEQ ID NO: 1538158 - protein, 6 aa, Mycobacterium tuberculosis
ARAGKM

SEQ ID NO: 1538159 - protein, 24 aa, Mycobacterium tuberculosis
ARPAATPATTSVPTYTAAQTAAAQ

SEQ ID NO: 1538160 - protein, 11 aa, Mycobacterium tuberculosis
ASEAGGKAKSL

SEQ ID NO: 1538161 - protein, 5 aa, Mycobacterium tuberculosis
ASGLP

SEQ ID NO: 1538162 - protein, 6 aa, Mycobacterium tuberculosis
ASTVDE

SEQ ID NO: 1538163 - protein, 7 aa, Mycobacterium tuberculosis
ATDNPVG

SEQ ID NO: 1538164 - protein, 8 aa, Mycobacterium tuberculosis
ATEREALT

SEQ ID NO: 1538165 - protein, 7 aa, Mycobacterium tuberculosis
ATGTTAA

SEQ ID NO: 1538166 - protein, 8 aa, Mycobacterium tuberculosis
ATKAGLPA

SEQ ID NO: 1538167 - protein, 12 aa, Mycobacterium tuberculosis
AVAAAAGQSWED

SEQ ID NO: 1538168 - protein, 9 aa, Mycobacterium tuberculosis
AVAARGGNG

SEQ ID NO: 1538169 - protein, 13 aa, Mycobacterium tuberculosis
AVETEPGGGDRYG

SEQ ID NO: 1538170 - protein, 12 aa, Mycobacterium tuberculosis
CNDQGDPPYQGT

SEQ ID NO: 1538171 - protein, 25 aa, Mycobacterium tuberculosis
CTSPRSRNRSFGERLGRGETLQSAG

SEQ ID NO: 1538172 - protein, 7 aa, Mycobacterium tuberculosis
DAADAQA

SEQ ID NO: 1538173 - protein, 5 aa, Mycobacterium tuberculosis
DAATA

SEQ ID NO: 1538174 - protein, 5 aa, Mycobacterium tuberculosis
DDPDL

SEQ ID NO: 1538175 - protein, 8 aa, Mycobacterium tuberculosis
DEEGGRVS

SEQ ID NO: 1538176 - protein, 11 aa, Mycobacterium tuberculosis
DEIRAAASTDC

SEQ ID NO: 1538177 - protein, 7 aa, Mycobacterium tuberculosis
DGHPTEH

SEQ ID NO: 1538178 - protein, 9 aa, Mycobacterium tuberculosis
DKSGTSDNF

SEQ ID NO: 1538179 - protein, 5 aa, Mycobacterium tuberculosis
DLAGI

SEQ ID NO: 1538180 - protein, 4 aa, Mycobacterium tuberculosis
DPAG

SEQ ID NO: 1538181 - protein, 8 aa, Mycobacterium tuberculosis
DPDRPLSD

SEQ ID NO: 1538182 - protein, 5 aa, Mycobacterium tuberculosis
DQQPV

SEQ ID NO: 1538183 - protein, 8 aa, Mycobacterium tuberculosis
DSPSVTRA

SEQ ID NO: 1538184 - protein, 19 aa, Mycobacterium tuberculosis
DYSGPGSGLGGSDPNGVVS

SEQ ID NO: 1538185 - protein, 28 aa, Mycobacterium tuberculosis
EAARGGWQTVSGSRRNAAYQDGRQTQIS

SEQ ID NO: 1538186 - protein, 7 aa, Mycobacterium tuberculosis
EAVGSGP

SEQ ID NO: 1538187 - protein, 13 aa, Mycobacterium tuberculosis
EGERATADAVGRT

SEQ ID NO: 1538188 - protein, 18 aa, Mycobacterium tuberculosis
EGVAATAATAINANAASK

SEQ ID NO: 1538189 - protein, 4 aa, Mycobacterium tuberculosis
ELGS

SEQ ID NO: 1538190 - protein, 15 aa, Mycobacterium tuberculosis
ELPEAPANRATVPQD

SEQ ID NO: 1538191 - protein, 6 aa, Mycobacterium tuberculosis
ELSDTV

SEQ ID NO: 1538192 - protein, 4 aa, Mycobacterium tuberculosis
EPPR

SEQ ID NO: 1538193 - protein, 5 aa, Mycobacterium tuberculosis
ETETG

SEQ ID NO: 1538194 - protein, 9 aa, Mycobacterium tuberculosis
ETLTGTHTT

SEQ ID NO: 1538195 - protein, 4 aa, Mycobacterium tuberculosis
FGSA

SEQ ID NO: 1538196 - protein, 14 aa, Mycobacterium tuberculosis
FNGATTQTSATDQT

SEQ ID NO: 1538197 - protein, 28 aa, Mycobacterium tuberculosis
FSAEPHATDGSPVANRVEPGKRPRSSMA

SEQ ID NO: 1538198 - protein, 6 aa, Mycobacterium tuberculosis
FSTPPI

SEQ ID NO: 1538199 - protein, 17 aa, Mycobacterium tuberculosis
GADAPSPFGGGAAAEIA

SEQ ID NO: 1538200 - protein, 6 aa, Mycobacterium tuberculosis
GAEPAQ

SEQ ID NO: 1538201 - protein, 14 aa, Mycobacterium tuberculosis
GAGAYAGAEAADAA

SEQ ID NO: 1538202 - protein, 11 aa, Mycobacterium tuberculosis
GALGENGNGGM

SEQ ID NO: 1538203 - protein, 4 aa, Mycobacterium tuberculosis
GAVR

SEQ ID NO: 1538204 - protein, 11 aa, Mycobacterium tuberculosis
GCSADTGDRHP

SEQ ID NO: 1538205 - protein, 16 aa, Mycobacterium tuberculosis
GDGADGTAASPIGEPG

SEQ ID NO: 1538206 - protein, 5 aa, Mycobacterium tuberculosis
GDPGT

SEQ ID NO: 1538207 - protein, 4 aa, Mycobacterium tuberculosis
GELR

SEQ ID NO: 1538208 - protein, 8 aa, Mycobacterium tuberculosis
GGHGPAER

SEQ ID NO: 1538209 - protein, 15 aa, Mycobacterium tuberculosis
GGISGPTRGTGTGIN

SEQ ID NO: 1538210 - protein, 8 aa, Mycobacterium tuberculosis
GGSTDETL

SEQ ID NO: 1538211 - protein, 7 aa, Mycobacterium tuberculosis
GGVEQGL

SEQ ID NO: 1538212 - protein, 4 aa, Mycobacterium tuberculosis
GIGP

SEQ ID NO: 1538213 - protein, 13 aa, Mycobacterium tuberculosis
GINDDTIEQAAEA

SEQ ID NO: 1538214 - protein, 7 aa, Mycobacterium tuberculosis
GIPPDRA

SEQ ID NO: 1538215 - protein, 11 aa, Mycobacterium tuberculosis
GLNPGPRSTDP

SEQ ID NO: 1538216 - protein, 5 aa, Mycobacterium tuberculosis
GPYGY

SEQ ID NO: 1538217 - protein, 30 aa, Mycobacterium tuberculosis; identical to SEQ ID NO: 1438273

SEQ ID NO: 1538218 - protein, 5 aa, Mycobacterium tuberculosis
GSVGN

SEQ ID NO: 1538219 - protein, 10 aa, Mycobacterium tuberculosis
GTASASSTDE

SEQ ID NO: 1538220 - protein, 10 aa, Mycobacterium tuberculosis
GTGEPPGIGS

SEQ ID NO: 1538221 - protein, 10 aa, Mycobacterium tuberculosis
GTGEPPGLGR

SEQ ID NO: 1538222 - protein, 7 aa, Mycobacterium tuberculosis
GTGGVGQ

SEQ ID NO: 1538223 - protein, 20 aa, Mycobacterium tuberculosis
GYYGNTKDRVVDENDSAGTG

SEQ ID NO: 1538224 - protein, 11 aa, Mycobacterium tuberculosis
HPGQSSAAERE

SEQ ID NO: 1538225 - protein, 11 aa, Mycobacterium tuberculosis
HRAKRRSCAAQ

SEQ ID NO: 1538226 - protein, 11 aa, Mycobacterium tuberculosis
HSGASAAAAAL

SEQ ID NO: 1538227 - protein, 11 aa, Mycobacterium tuberculosis
IGAANAAAAVP

SEQ ID NO: 1538228 - protein, 9 aa, Mycobacterium tuberculosis
IRGDTDGYG

SEQ ID NO: 1538229 - protein, 36 aa, Mycobacterium tuberculosis; identical to SEQ ID NO: 1445913

SEQ ID NO: 1538230 - protein, 7 aa, Mycobacterium tuberculosis
IYRGDAS

SEQ ID NO: 1538231 - protein, 4 aa, Mycobacterium tuberculosis
KAFE

SEQ ID NO: 1538232 - protein, 9 aa, Mycobacterium tuberculosis
KSDEHDAAA

SEQ ID NO: 1538233 - protein, 16 aa, Mycobacterium tuberculosis
LAEGTGAAIAPAEGAR

SEQ ID NO: 1538234 - protein, 7 aa, Mycobacterium tuberculosis
LDGPTTA

SEQ ID NO: 1538235 - protein, 10 aa, Mycobacterium tuberculosis
LGNAGSGNVG

SEQ ID NO: 1538236 - protein, 10 aa, Mycobacterium tuberculosis
LKPGRSHDEV

SEQ ID NO: 1538237 - protein, 21 aa, Mycobacterium tuberculosis
LNDDTGSDGSTPQDRAHAAGF

SEQ ID NO: 1538238 - protein, 16 aa, Mycobacterium tuberculosis
LNPTQLDPAGRTSDAV

SEQ ID NO: 1538239 - protein, 18 aa, Mycobacterium tuberculosis
LPAEEAAEAASALGGEAA

SEQ ID NO: 1538240 - protein, 5 aa, Mycobacterium tuberculosis
LPAGL

SEQ ID NO: 1538241 - protein, 8 aa, Mycobacterium tuberculosis
LPGAAQRA

SEQ ID NO: 1538242 - protein, 4 aa, Mycobacterium tuberculosis
LPVG

SEQ ID NO: 1538243 - protein, 6 aa, Mycobacterium tuberculosis
LPVPQT

SEQ ID NO: 1538244 - protein, 13 aa, Mycobacterium tuberculosis
LSDQPPGVIVVVT

SEQ ID NO: 1538245 - protein, 9 aa, Mycobacterium tuberculosis
LTEDATADR

SEQ ID NO: 1538246 - protein, 6 aa, Mycobacterium tuberculosis
LTGSPV

SEQ ID NO: 1538247 - protein, 12 aa, Mycobacterium tuberculosis
LVGSPGQGAYAA

SEQ ID NO: 1538248 - protein, 6 aa, Mycobacterium tuberculosis
MGTPED

SEQ ID NO: 1538249 - protein, 7 aa, Mycobacterium tuberculosis
NALDNPE

SEQ ID NO: 1538250 - protein, 9 aa, Mycobacterium tuberculosis
NANGSGAGV

SEQ ID NO: 1538251 - protein, 47 aa, Mycobacterium tuberculosis; identical to SEQ ID NO: 230582

SEQ ID NO: 1538252 - protein, 7 aa, Mycobacterium tuberculosis
NGVETGR

SEQ ID NO: 1538253 - protein, 4 aa, Mycobacterium tuberculosis
NHDG

SEQ ID NO: 1538254 - protein, 7 aa, Mycobacterium tuberculosis
NHPLTTS

SEQ ID NO: 1538255 - protein, 4 aa, Mycobacterium tuberculosis
NPTF

SEQ ID NO: 1538256 - protein, 4 aa, Mycobacterium tuberculosis
NSGQ

SEQ ID NO: 1538257 - protein, 10 aa, Mycobacterium tuberculosis
NSGTDLPPTP

SEQ ID NO: 1538258 - protein, 7 aa, Mycobacterium tuberculosis
NSVYTSN

SEQ ID NO: 1538259 - protein, 14 aa, Mycobacterium tuberculosis
NTGVANPGSYNTGS

SEQ ID NO: 1538260 - protein, 6 aa, Mycobacterium tuberculosis
NTTPAL

SEQ ID NO: 1538261 - protein, 7 aa, Mycobacterium tuberculosis
NVGGGNV

SEQ ID NO: 1538262 - protein, 13 aa, Mycobacterium tuberculosis
PAARADDKRLNDG

SEQ ID NO: 1538263 - protein, 10 aa, Mycobacterium tuberculosis
PDRASGRTAR

SEQ ID NO: 1538264 - protein, 23 aa, Mycobacterium tuberculosis
PEPVPQADPGQPWPGRLPDPSPA

SEQ ID NO: 1538265 - protein, 13 aa, Mycobacterium tuberculosis
PGARAETGEQFPG

SEQ ID NO: 1538266 - protein, 8 aa, Mycobacterium tuberculosis
PLEPGQQT

SEQ ID NO: 1538267 - protein, 6 aa, Mycobacterium tuberculosis
PPWDPG

SEQ ID NO: 1538268 - protein, 6 aa, Mycobacterium tuberculosis
PRTGEG

SEQ ID NO: 1538269 - protein, 25 aa, Mycobacterium tuberculosis
PSPCTAGYRGTPGNPLTIAYRWDQG

SEQ ID NO: 1538270 - protein, 5 aa, Mycobacterium tuberculosis
PTDAA

SEQ ID NO: 1538271 - protein, 4 aa, Mycobacterium tuberculosis
PTGK

SEQ ID NO: 1538272 - protein, 4 aa, Mycobacterium tuberculosis
PTKI

SEQ ID NO: 1538273 - protein, 7 aa, Mycobacterium tuberculosis
QAADREI

SEQ ID NO: 1538274 - protein, 9 aa, Mycobacterium tuberculosis
QAAGAAGGG

SEQ ID NO: 1538275 - protein, 11 aa, Mycobacterium tuberculosis
QAEGTDNPHEA

SEQ ID NO: 1538276 - protein, 6 aa, Mycobacterium tuberculosis
QGMSQD

SEQ ID NO: 1538277 - protein, 12 aa, Mycobacterium tuberculosis
QGPFGGPDFPAP

SEQ ID NO: 1538278 - protein, 4 aa, Mycobacterium tuberculosis
QLND

SEQ ID NO: 1538279 - protein, 5 aa, Mycobacterium tuberculosis
QPKDE

SEQ ID NO: 1538280 - protein, 6 aa, Mycobacterium tuberculosis
QPNELP

SEQ ID NO: 1538281 - protein, 13 aa, Mycobacterium tuberculosis
QRERRQPVTTRRS

SEQ ID NO: 1538282 - protein, 7 aa, Mycobacterium tuberculosis
QRTSHAR

SEQ ID NO: 1538283 - protein, 5 aa, Mycobacterium tuberculosis
QTATQ

SEQ ID NO: 1538284 - protein, 8 aa, Mycobacterium tuberculosis
QTTDGSIT

SEQ ID NO: 1538285 - protein, 18 aa, Mycobacterium tuberculosis
RAAGAKAGISVKPGTPLE

SEQ ID NO: 1538286 - protein, 8 aa, Mycobacterium tuberculosis
RDGVTTQL

SEQ ID NO: 1538287 - protein, 5 aa, Mycobacterium tuberculosis
REAAR

SEQ ID NO: 1538288 - protein, 5 aa, Mycobacterium tuberculosis
RGVPA

SEQ ID NO: 1538289 - protein, 9 aa, Mycobacterium tuberculosis
RNARDRPTA

SEQ ID NO: 1538290 - protein, 12 aa, Mycobacterium tuberculosis
RNDQGMDPEDPE

SEQ ID NO: 1538291 - protein, 6 aa, Mycobacterium tuberculosis
RSAEKV

SEQ ID NO: 1538292 - protein, 4 aa, Mycobacterium tuberculosis
RSGV

SEQ ID NO: 1538293 - protein, 49 aa, Mycobacterium tuberculosis; identical to SEQ ID NO: 1450215

SEQ ID NO: 1538294 - protein, 7 aa, Mycobacterium tuberculosis
RTSAEAA

SEQ ID NO: 1538295 - protein, 15 aa, Mycobacterium tuberculosis
SAAASYQTAEATGAS

SEQ ID NO: 1538296 - protein, 6 aa, Mycobacterium tuberculosis
SAGKYA

SEQ ID NO: 1538297 - protein, 8 aa, Mycobacterium tuberculosis
SAGPDPVA

SEQ ID NO: 1538298 - protein, 4 aa, Mycobacterium tuberculosis
SAPF

SEQ ID NO: 1538299 - protein, 5 aa, Mycobacterium tuberculosis
SAQAQ

SEQ ID NO: 1538300 - protein, 14 aa, Mycobacterium tuberculosis
SDHGSDAAVARGRQ

SEQ ID NO: 1538301 - protein, 19 aa, Mycobacterium tuberculosis
SEASGAAPTHEAPAPPRGL

SEQ ID NO: 1538302 - protein, 7 aa, Mycobacterium tuberculosis
SGDHPGI

SEQ ID NO: 1538303 - protein, 4 aa, Mycobacterium tuberculosis
SGRA

SEQ ID NO: 1538304 - protein, 6 aa, Mycobacterium tuberculosis
SGRFPG

SEQ ID NO: 1538305 - protein, 4 aa, Mycobacterium tuberculosis
SHDW

SEQ ID NO: 1538306 - protein, 19 aa, Mycobacterium tuberculosis
SKTTGDPPFPGQPPPVAND

SEQ ID NO: 1538307 - protein, 9 aa, Mycobacterium tuberculosis
SNTTTNGAI

SEQ ID NO: 1538308 - protein, 12 aa, Mycobacterium tuberculosis
SPGSGQDREREE

SEQ ID NO: 1538309 - protein, 10 aa, Mycobacterium tuberculosis
SPKNPPTLSY

SEQ ID NO: 1538310 - protein, 4 aa, Mycobacterium tuberculosis
SPML

SEQ ID NO: 1538311 - protein, 5 aa, Mycobacterium tuberculosis
SPRDK

SEQ ID NO: 1538312 - protein, 10 aa, Mycobacterium tuberculosis
SRSTPSPHAT

SEQ ID NO: 1538313 - protein, 12 aa, Mycobacterium tuberculosis
SSCSQGDAPLGS

SEQ ID NO: 1538314 - protein, 6 aa, Mycobacterium tuberculosis
SSGATH

SEQ ID NO: 1538315 - protein, 8 aa, Mycobacterium tuberculosis
STATGYGC

SEQ ID NO: 1538316 - protein, 6 aa, Mycobacterium tuberculosis
SVGGHN

SEQ ID NO: 1538317 - protein, 5 aa, Mycobacterium tuberculosis
SVPSG

SEQ ID NO: 1538318 - protein, 4 aa, Mycobacterium tuberculosis
TAAQ

SEQ ID NO: 1538319 - protein, 17 aa, Mycobacterium tuberculosis
TAASAAPPSFGAGSSAV

SEQ ID NO: 1538320 - protein, 6 aa, Mycobacterium tuberculosis
TCPVNG

SEQ ID NO: 1538321 - protein, 11 aa, Mycobacterium tuberculosis
TDGGGYPTGRE

SEQ ID NO: 1538322 - protein, 4 aa, Mycobacterium tuberculosis
TDRL

SEQ ID NO: 1538323 - protein, 4 aa, Mycobacterium tuberculosis
TEHD

SEQ ID NO: 1538324 - protein, 23 aa, Mycobacterium tuberculosis
TGCSGSSHSGRTYGAQSARTGES

SEQ ID NO: 1538325 - protein, 6 aa, Mycobacterium tuberculosis
TGDHQL

SEQ ID NO: 1538326 - protein, 9 aa, Mycobacterium tuberculosis
TGGDATRIS

SEQ ID NO: 1538327 - protein, 17 aa, Mycobacterium tuberculosis
TGNTNTGIANSGNVNTG

SEQ ID NO: 1538328 - protein, 11 aa, Mycobacterium tuberculosis
TGQLVSNGNTQ

SEQ ID NO: 1538329 - protein, 10 aa, Mycobacterium tuberculosis
TKNSGGKMTR

SEQ ID NO: 1538330 - protein, 10 aa, Mycobacterium tuberculosis
TNWSTGQPMT

SEQ ID NO: 1538331 - protein, 5 aa, Mycobacterium tuberculosis
TPGDL

SEQ ID NO: 1538332 - protein, 4 aa, Mycobacterium tuberculosis
TPKA

SEQ ID NO: 1538333 - protein, 5 aa, Mycobacterium tuberculosis
TQDVA

SEQ ID NO: 1538334 - protein, 7 aa, Mycobacterium tuberculosis
TRINQET

SEQ ID NO: 1538335 - protein, 4 aa, Mycobacterium tuberculosis
TRPG

SEQ ID NO: 1538336 - protein, 9 aa, Mycobacterium tuberculosis
TTGGPNGVG

SEQ ID NO: 1538337 - protein, 8 aa, Mycobacterium tuberculosis
VDPQRGRL

SEQ ID NO: 1538338 - protein, 5 aa, Mycobacterium tuberculosis
VDRNN

SEQ ID NO: 1538339 - protein, 12 aa, Mycobacterium tuberculosis
VDTPGPQALRDG

SEQ ID NO: 1538340 - protein, 9 aa, Mycobacterium tuberculosis
VGAAQGGYG

SEQ ID NO: 1538341 - protein, 8 aa, Mycobacterium tuberculosis
VPTQDAEA

SEQ ID NO: 1538342 - protein, 9 aa, Mycobacterium tuberculosis
VQPEPRDGL

SEQ ID NO: 1538343 - protein, 4 aa, Mycobacterium tuberculosis
VRAG

SEQ ID NO: 1538344 - protein, 10 aa, Mycobacterium tuberculosis
VYGADDPAAA

SEQ ID NO: 1538345 - protein, 6 aa, Mycobacterium tuberculosis
WAKTNN

SEQ ID NO: 1538346 - protein, 4 aa, Mycobacterium tuberculosis
WPDD

SEQ ID NO: 1538347 - protein, 4 aa, Mycobacterium tuberculosis
YDTD

SEQ ID NO: 1538348 - protein, 9 aa, Mycobacterium tuberculosis
YPDATTGTA

SEQ ID NO: 1538349 - protein, 8 aa, Mycobacterium tuberculosis
YPSTPGTT

SEQ ID NO: 1538350 - protein, 4 aa, Mycobacterium tuberculosis
YRNR

SEQ ID NO: 1538351 - protein, 9 aa, Mycobacterium tuberculosis
YRPTQPGSY

SEQ ID NO: 1538352 - protein, 7 aa, Mycobacterium tuberculosis
AAAQGIP

SEQ ID NO: 1538353 - protein, 7 aa, Mycobacterium tuberculosis
AAASARR

SEQ ID NO: 1538354 - protein, 5 aa, Mycobacterium tuberculosis
AAEPK

SEQ ID NO: 1538355 - protein, 10 aa, Mycobacterium tuberculosis
AAPGQVDTVK

SEQ ID NO: 1538356 - protein, 14 aa, Mycobacterium tuberculosis
AAQNPTGPGSVAGM

SEQ ID NO: 1538357 - protein, 9 aa, Mycobacterium tuberculosis
ACSGSAAAQ

SEQ ID NO: 1538358 - protein, 8 aa, Mycobacterium tuberculosis
ADEPFDQF

SEQ ID NO: 1538359 - protein, 13 aa, Mycobacterium tuberculosis
ADITAAASRQEGL

SEQ ID NO: 1538360 - protein, 8 aa, Mycobacterium tuberculosis
ADYSPAGV

SEQ ID NO: 1538361 - protein, 15 aa, Mycobacterium tuberculosis
AEAAAEQQVQGQQAA

SEQ ID NO: 1538362 - protein, 23 aa, Mycobacterium tuberculosis
AEEMTGRHATTATSFSITDQSCA

SEQ ID NO: 1538363 - protein, 7 aa, Mycobacterium tuberculosis
AEGAKQA

SEQ ID NO: 1538364 - protein, 18 aa, Mycobacterium tuberculosis
AFAGNPAVPTESKNVASS

SEQ ID NO: 1538365 - protein, 4 aa, Mycobacterium tuberculosis
AGAD

SEQ ID NO: 1538366 - protein, 6 aa, Mycobacterium tuberculosis
AGDEVS

SEQ ID NO: 1538367 - protein, 16 aa, Mycobacterium tuberculosis
AGGLPPGLPALPGVDP

SEQ ID NO: 1538368 - protein, 7 aa, Mycobacterium tuberculosis
AGGNSYA

SEQ ID NO: 1538369 - protein, 8 aa, Mycobacterium tuberculosis
AGLPTSLP

SEQ ID NO: 1538370 - protein, 11 aa, Mycobacterium tuberculosis
AGVPPPPGSWE

SEQ ID NO: 1538371 - protein, 8 aa, Mycobacterium tuberculosis
AHPSEPGV

SEQ ID NO: 1538372 - protein, 16 aa, Mycobacterium tuberculosis
ANTSWPDNTGQPRRAA

SEQ ID NO: 1538373 - protein, 6 aa, Mycobacterium tuberculosis
APARGQ

SEQ ID NO: 1538374 - protein, 8 aa, Mycobacterium tuberculosis
APTPADPA

SEQ ID NO: 1538375 - protein, 6 aa, Mycobacterium tuberculosis
AQPYGG

SEQ ID NO: 1538376 - protein, 7 aa, Mycobacterium tuberculosis
AQRAPQL

SEQ ID NO: 1538377 - protein, 12 aa, Mycobacterium tuberculosis
ARPGNSGGPIVA

SEQ ID NO: 1538378 - protein, 12 aa, Mycobacterium tuberculosis
ARSGDGPGGASV

SEQ ID NO: 1538379 - protein, 18 aa, Mycobacterium tuberculosis
ASKTGTAEHGTDPRHTPP

SEQ ID NO: 1538380 - protein, 5 aa, Mycobacterium tuberculosis
ATGQR

SEQ ID NO: 1538381 - protein, 14 aa, Mycobacterium tuberculosis
ATSTPHPAAPAGAG

SEQ ID NO: 1538382 - protein, 11 aa, Mycobacterium tuberculosis
ATTASPGATAA

SEQ ID NO: 1538383 - protein, 4 aa, Mycobacterium tuberculosis
ATYG

SEQ ID NO: 1538384 - protein, 18 aa, Mycobacterium tuberculosis
CGGPGAQIAAEGAENAGP

SEQ ID NO: 1538385 - protein, 11 aa, Mycobacterium tuberculosis
CRGGGAVTSRD

SEQ ID NO: 1538386 - protein, 28 aa, Mycobacterium tuberculosis
DASVAGSQQADGVATTKITGNSSADDIA

SEQ ID NO: 1538387 - protein, 15 aa, Mycobacterium tuberculosis
DGANGAPGQPGGPGG

SEQ ID NO: 1538388 - protein, 8 aa, Mycobacterium tuberculosis
DGLGGKFG

SEQ ID NO: 1538389 - protein, 11 aa, Mycobacterium tuberculosis
DGRSQDNIKAN

SEQ ID NO: 1538390 - protein, 8 aa, Mycobacterium tuberculosis
DLGGPNGV

SEQ ID NO: 1538391 - protein, 6 aa, Mycobacterium tuberculosis
DNPRAR

SEQ ID NO: 1538392 - protein, 10 aa, Mycobacterium tuberculosis
DNTPSGSTVA

SEQ ID NO: 1538393 - protein, 7 aa, Mycobacterium tuberculosis
DPEVQAP

SEQ ID NO: 1538394 - protein, 9 aa, Mycobacterium tuberculosis
DPQPDPGKW

SEQ ID NO: 1538395 - protein, 4 aa, Mycobacterium tuberculosis
DRLP

SEQ ID NO: 1538396 - protein, 8 aa, Mycobacterium tuberculosis
DSYETAGM

SEQ ID NO: 1538397 - protein, 13 aa, Mycobacterium tuberculosis
DTATPSGPAAAEH

SEQ ID NO: 1538398 - protein, 16 aa, Mycobacterium tuberculosis
DYRAQESTRHGASRHG

SEQ ID NO: 1538399 - protein, 11 aa, Mycobacterium tuberculosis
EAGSRDTHAPN

SEQ ID NO: 1538400 - protein, 8 aa, Mycobacterium tuberculosis
ECDGTTLT

SEQ ID NO: 1538401 - protein, 9 aa, Mycobacterium tuberculosis
EGPAYSEGL

SEQ ID NO: 1538402 - protein, 12 aa, Mycobacterium tuberculosis
EGPPDKYQTTGV

SEQ ID NO: 1538403 - protein, 7 aa, Mycobacterium tuberculosis
EQSGTAL

SEQ ID NO: 1538404 - protein, 10 aa, Mycobacterium tuberculosis
EVKKSAEQAE

SEQ ID NO: 1538405 - protein, 15 aa, Mycobacterium tuberculosis
EYAPAKSITAYTPGQ

SEQ ID NO: 1538406 - protein, 9 aa, Mycobacterium tuberculosis
FSPATASAD

SEQ ID NO: 1538407 - protein, 6 aa, Mycobacterium tuberculosis
FSVDDR

SEQ ID NO: 1538408 - protein, 5 aa, Mycobacterium tuberculosis
GADTY

SEQ ID NO: 1538409 - protein, 6 aa, Mycobacterium tuberculosis
GATPPD

SEQ ID NO: 1538410 - protein, 11 aa, Mycobacterium tuberculosis
GGAAPVFPGRT

SEQ ID NO: 1538411 - protein, 5 aa, Mycobacterium tuberculosis
GGALP

SEQ ID NO: 1538412 - protein, 13 aa, Mycobacterium tuberculosis
GIPGSAGATPVQN

SEQ ID NO: 1538413 - protein, 17 aa, Mycobacterium tuberculosis
GKTAQDTSFDGRSDYDG

SEQ ID NO: 1538414 - protein, 8 aa, Mycobacterium tuberculosis
GLNSGTGN

SEQ ID NO: 1538415 - protein, 33 aa, Mycobacterium tuberculosis; identical to SEQ ID NO: 229981

SEQ ID NO: 1538416 - protein, 6 aa, Mycobacterium tuberculosis
GNTVEA

SEQ ID NO: 1538417 - protein, 6 aa, Mycobacterium tuberculosis
GQYQQL

SEQ ID NO: 1538418 - protein, 16 aa, Mycobacterium tuberculosis
GSYNTGVGNAGTASTG

SEQ ID NO: 1538419 - protein, 18 aa, Mycobacterium tuberculosis
GTADEPFDPNYHQKTDTL

SEQ ID NO: 1538420 - protein, 21 aa, Mycobacterium tuberculosis
GTEDQPVAAETLQDHDCSITK

SEQ ID NO: 1538421 - protein, 7 aa, Mycobacterium tuberculosis
GTRDFPE

SEQ ID NO: 1538422 - protein, 12 aa, Mycobacterium tuberculosis
GVPGQNTTNHIA

SEQ ID NO: 1538423 - protein, 10 aa, Mycobacterium tuberculosis
HASDTDTIRG

SEQ ID NO: 1538424 - protein, 7 aa, Mycobacterium tuberculosis
HGDAADL

SEQ ID NO: 1538425 - protein, 7 aa, Mycobacterium tuberculosis
HGKASGQ

SEQ ID NO: 1538426 - protein, 8 aa, Mycobacterium tuberculosis
HRGREGGY

SEQ ID NO: 1538427 - protein, 15 aa, Mycobacterium tuberculosis
HVPSAAARSAGLSES

SEQ ID NO: 1538428 - protein, 12 aa, Mycobacterium tuberculosis
ISAANAAALAPT

SEQ ID NO: 1538429 - protein, 4 aa, Mycobacterium tuberculosis
KGID

SEQ ID NO: 1538430 - protein, 12 aa, Mycobacterium tuberculosis
KLGGGYIDTWAC

SEQ ID NO: 1538431 - protein, 14 aa, Mycobacterium tuberculosis
KQRWPDDPTSHAYQ

SEQ ID NO: 1538432 - protein, 4 aa, Mycobacterium tuberculosis
KRRN

SEQ ID NO: 1538433 - protein, 6 aa, Mycobacterium tuberculosis
KSTRFT

SEQ ID NO: 1538434 - protein, 7 aa, Mycobacterium tuberculosis
LADATTT

SEQ ID NO: 1538435 - protein, 7 aa, Mycobacterium tuberculosis
LGAEPGV

SEQ ID NO: 1538436 - protein, 26 aa, Mycobacterium tuberculosis
LGNGNTGNANLGSGNTGQANLGSGNT

SEQ ID NO: 1538437 - protein, 10 aa, Mycobacterium tuberculosis
LKGDKGEPCW

SEQ ID NO: 1538438 - protein, 6 aa, Mycobacterium tuberculosis
LKTNSS

SEQ ID NO: 1538439 - protein, 40 aa, Mycobacterium tuberculosis; identical to SEQ ID NO: 230445

SEQ ID NO: 1538440 - protein, 9 aa, Mycobacterium tuberculosis
LPRTGNQNA

SEQ ID NO: 1538441 - protein, 7 aa, Mycobacterium tuberculosis
LQAQGTE

SEQ ID NO: 1538442 - protein, 7 aa, Mycobacterium tuberculosis
LSEERKV

SEQ ID NO: 1538443 - protein, 6 aa, Mycobacterium tuberculosis
MNPAQA

SEQ ID NO: 1538444 - protein, 9 aa, Mycobacterium tuberculosis
MSAPQTVSG

SEQ ID NO: 1538445 - protein, 9 aa, Mycobacterium tuberculosis
NAPAIAATE

SEQ ID NO: 1538446 - protein, 13 aa, Mycobacterium tuberculosis
NATSGERADPQAV

SEQ ID NO: 1538447 - protein, 10 aa, Mycobacterium tuberculosis
NGAAGTGDPV

SEQ ID NO: 1538448 - protein, 17 aa, Mycobacterium tuberculosis
NGANGLPGTGQNGGDGG

SEQ ID NO: 1538449 - protein, 22 aa, Mycobacterium tuberculosis
NGGPGGLGGPGTSAGNGGMGGN

SEQ ID NO: 1538450 - protein, 7 aa, Mycobacterium tuberculosis
NKSEDAK

SEQ ID NO: 1538451 - protein, 9 aa, Mycobacterium tuberculosis
NPGGPGASA

SEQ ID NO: 1538452 - protein, 5 aa, Mycobacterium tuberculosis
NTTVA

SEQ ID NO: 1538453 - protein, 17 aa, Mycobacterium tuberculosis
NVGAQNLGAANAGSGNF

SEQ ID NO: 1538454 - protein, 16 aa, Mycobacterium tuberculosis
NVGEQLSGLSSAGTAL

SEQ ID NO: 1538455 - protein, 5 aa, Mycobacterium tuberculosis
NVSTE

SEQ ID NO: 1538456 - protein, 9 aa, Mycobacterium tuberculosis
PALRESAGR

SEQ ID NO: 1538457 - protein, 21 aa, Mycobacterium tuberculosis
PHSAGSSNPWDDSAHPLTDDQ

SEQ ID NO: 1538458 - protein, 9 aa, Mycobacterium tuberculosis
PIGPRGRAA

SEQ ID NO: 1538459 - protein, 10 aa, Mycobacterium tuberculosis
PIPPREALKT

SEQ ID NO: 1538460 - protein, 7 aa, Mycobacterium tuberculosis
PLGQTDD

SEQ ID NO: 1538461 - protein, 10 aa, Mycobacterium tuberculosis
PLSAPAGRLT

SEQ ID NO: 1538462 - protein, 12 aa, Mycobacterium tuberculosis
PPTSQPHAVSAP

SEQ ID NO: 1538463 - protein, 22 aa, Mycobacterium tuberculosis
PQYSNPEPAGTATITGYRADND

SEQ ID NO: 1538464 - protein, 33 aa, Mycobacterium tuberculosis
PRFATYSGAGPQGAATTTPPPAGPPPLAAPKND

SEQ ID NO: 1538465 - protein, 11 aa, Mycobacterium tuberculosis
PTNPGASDPAA

SEQ ID NO: 1538466 - protein, 7 aa, Mycobacterium tuberculosis
PTNQNDA

SEQ ID NO: 1538467 - protein, 5 aa, Mycobacterium tuberculosis
PTSER

SEQ ID NO: 1538468 - protein, 7 aa, Mycobacterium tuberculosis
PWQDNEG

SEQ ID NO: 1538469 - protein, 8 aa, Mycobacterium tuberculosis
PYSGPTTA

SEQ ID NO: 1538470 - protein, 13 aa, Mycobacterium tuberculosis
QKPGKTSDPRGLS

SEQ ID NO: 1538471 - protein, 4 aa, Mycobacterium tuberculosis
QLRT

SEQ ID NO: 1538472 - protein, 8 aa, Mycobacterium tuberculosis
QLSQGGQG

SEQ ID NO: 1538473 - protein, 8 aa, Mycobacterium tuberculosis
QPPVTDRD

SEQ ID NO: 1538474 - protein, 12 aa, Mycobacterium tuberculosis
QSRPVVNGPAAA

SEQ ID NO: 1538475 - protein, 5 aa, Mycobacterium tuberculosis
QTPEF

SEQ ID NO: 1538476 - protein, 7 aa, Mycobacterium tuberculosis
QTPPQPL

SEQ ID NO: 1538477 - protein, 5 aa, Mycobacterium tuberculosis
RAATV

SEQ ID NO: 1538478 - protein, 6 aa, Mycobacterium tuberculosis
RAIDST

SEQ ID NO: 1538479 - protein, 5 aa, Mycobacterium tuberculosis
RARRD

SEQ ID NO: 1538480 - protein, 13 aa, Mycobacterium tuberculosis
RGISSPWSHQAEA

SEQ ID NO: 1538481 - protein, 7 aa, Mycobacterium tuberculosis
RHRSPGI

SEQ ID NO: 1538482 - protein, 5 aa, Mycobacterium tuberculosis
RIGSR

SEQ ID NO: 1538483 - protein, 5 aa, Mycobacterium tuberculosis
RLAGP

SEQ ID NO: 1538484 - protein, 10 aa, Mycobacterium tuberculosis
RQAPYGLAGS

SEQ ID NO: 1538485 - protein, 29 aa, Mycobacterium tuberculosis
RRPPDRSTFATPPTAMPAPSHLTDVDRSA

SEQ ID NO: 1538486 - protein, 5 aa, Mycobacterium tuberculosis
RSDDG

SEQ ID NO: 1538487 - protein, 10 aa, Mycobacterium tuberculosis
RWAPPYAEAG

SEQ ID NO: 1538488 - protein, 14 aa, Mycobacterium tuberculosis
SDAAPQLRDDPEAR

SEQ ID NO: 1538489 - protein, 13 aa, Mycobacterium tuberculosis
SDPPGLTPLPEEA

SEQ ID NO: 1538490 - protein, 4 aa, Mycobacterium tuberculosis
SEIR

SEQ ID NO: 1538491 - protein, 6 aa, Mycobacterium tuberculosis
SGASAV

SEQ ID NO: 1538492 - protein, 13 aa, Mycobacterium tuberculosis
SGTEGAAARTADR

SEQ ID NO: 1538493 - protein, 8 aa, Mycobacterium tuberculosis
SIGDDSQL

SEQ ID NO: 1538494 - protein, 9 aa, Mycobacterium tuberculosis
SLDDGESDL

SEQ ID NO: 1538495 - protein, 4 aa, Mycobacterium tuberculosis
SLYE

SEQ ID NO: 1538496 - protein, 14 aa, Mycobacterium tuberculosis
SPRDRIPGTAAAYP

SEQ ID NO: 1538497 - protein, 5 aa, Mycobacterium tuberculosis
SSGLI

SEQ ID NO: 1538498 - protein, 17 aa, Mycobacterium tuberculosis
STGGATGSGSSGSSAMD

SEQ ID NO: 1538499 - protein, 4 aa, Mycobacterium tuberculosis
STHP

SEQ ID NO: 1538500 - protein, 12 aa, Mycobacterium tuberculosis
STTKITGTIPAS

SEQ ID NO: 1538501 - protein, 10 aa, Mycobacterium tuberculosis
STVGPIPDSA

SEQ ID NO: 1538502 - protein, 8 aa, Mycobacterium tuberculosis
SVSPANGA

SEQ ID NO: 1538503 - protein, 7 aa, Mycobacterium tuberculosis
SYGMSGT

SEQ ID NO: 1538504 - protein, 10 aa, Mycobacterium tuberculosis
TAANQDGRTV

SEQ ID NO: 1538505 - protein, 4 aa, Mycobacterium tuberculosis
TASV

SEQ ID NO: 1538506 - protein, 11 aa, Mycobacterium tuberculosis
TGRRTGADQRA

SEQ ID NO: 1538507 - protein, 6 aa, Mycobacterium tuberculosis
TGSAPR

SEQ ID NO: 1538508 - protein, 12 aa, Mycobacterium tuberculosis
TGTGYGAPPFDG

SEQ ID NO: 1538509 - protein, 11 aa, Mycobacterium tuberculosis
THDPATPYQSG

SEQ ID NO: 1538510 - protein, 14 aa, Mycobacterium tuberculosis
THTTRPATCSQEHS

SEQ ID NO: 1538511 - protein, 6 aa, Mycobacterium tuberculosis
TKALGH

SEQ ID NO: 1538512 - protein, 6 aa, Mycobacterium tuberculosis
TMPEKT

SEQ ID NO: 1538513 - protein, 8 aa, Mycobacterium tuberculosis
TRAYPPGV

SEQ ID NO: 1538514 - protein, 6 aa, Mycobacterium tuberculosis
TTPFTR

SEQ ID NO: 1538515 - protein, 12 aa, Mycobacterium tuberculosis
TVTGQGNSLKVG

SEQ ID NO: 1538516 - protein, 5 aa, Mycobacterium tuberculosis
VADRD

SEQ ID NO: 1538517 - protein, 6 aa, Mycobacterium tuberculosis
VDSTYS

SEQ ID NO: 1538518 - protein, 7 aa, Mycobacterium tuberculosis
VETPGPV

SEQ ID NO: 1538519 - protein, 25 aa, Mycobacterium tuberculosis
VGSYNTGSFNAGNTNTGGFNPGNVN

SEQ ID NO: 1538520 - protein, 6 aa, Mycobacterium tuberculosis
VGTGAH

SEQ ID NO: 1538521 - protein, 30 aa, Mycobacterium tuberculosis; identical to SEQ ID NO: 231769

SEQ ID NO: 1538522 - protein, 5 aa, Mycobacterium tuberculosis
YAQGL

SEQ ID NO: 1538523 - protein, 16 aa, Mycobacterium tuberculosis
YDGRDADGHYSNDQDA

SEQ ID NO: 1538524 - protein, 9 aa, Mycobacterium tuberculosis
YDQPGGTQA

SEQ ID NO: 1538525 - protein, 6 aa, Mycobacterium tuberculosis
YGTEGP

SEQ ID NO: 1538526 - protein, 11 aa, Mycobacterium tuberculosis
YTSGSTAAPRG

SEQ ID NO: 1538527 - protein, 11 aa, Mycobacterium tuberculosis
AAAAGLSATAP

SEQ ID NO: 1538528 - protein, 7 aa, Mycobacterium tuberculosis
AAGQRQQ

SEQ ID NO: 1538529 - protein, 17 aa, Mycobacterium tuberculosis
AANPTGPASVQGMSQDP

SEQ ID NO: 1538530 - protein, 6 aa, Mycobacterium tuberculosis
AARGGR

SEQ ID NO: 1538531 - protein, 8 aa, Mycobacterium tuberculosis
AATANPLA

SEQ ID NO: 1538532 - protein, 7 aa, Mycobacterium tuberculosis
ADADRDA

SEQ ID NO: 1538533 - protein, 11 aa, Mycobacterium tuberculosis
ADNLRGQGATI

SEQ ID NO: 1538534 - protein, 6 aa, Mycobacterium tuberculosis
ADTALD

SEQ ID NO: 1538535 - protein, 6 aa, Mycobacterium tuberculosis
ADTQAE

SEQ ID NO: 1538536 - protein, 4 aa, Mycobacterium tuberculosis
AEAR

SEQ ID NO: 1538537 - protein, 8 aa, Mycobacterium tuberculosis
AGFDPKVP

SEQ ID NO: 1538538 - protein, 5 aa, Mycobacterium tuberculosis
AGGNL

SEQ ID NO: 1538539 - protein, 9 aa, Mycobacterium tuberculosis
AGPAGRVSV

SEQ ID NO: 1538540 - protein, 5 aa, Mycobacterium tuberculosis
AGPDV

SEQ ID NO: 1538541 - protein, 14 aa, Mycobacterium tuberculosis
AGRDQNVAHPPAST

SEQ ID NO: 1538542 - protein, 19 aa, Mycobacterium tuberculosis
AKAAKPALRPVKPPPRRPA

SEQ ID NO: 1538543 - protein, 19 aa, Mycobacterium tuberculosis
ALGAPTSPEADAADGARYA

SEQ ID NO: 1538544 - protein, 8 aa, Mycobacterium tuberculosis
ALSGAGPS

SEQ ID NO: 1538545 - protein, 8 aa, Mycobacterium tuberculosis
APDGGPAQ

SEQ ID NO: 1538546 - protein, 5 aa, Mycobacterium tuberculosis
APGFQ

SEQ ID NO: 1538547 - protein, 35 aa, Mycobacterium tuberculosis
APGYPPTIEPAQPAVSPPTSQDPAGAVRPLSGHPR

SEQ ID NO: 1538548 - protein, 4 aa, Mycobacterium tuberculosis
APLA

SEQ ID NO: 1538549 - protein, 7 aa, Mycobacterium tuberculosis
APSVPGV

SEQ ID NO: 1538550 - protein, 6 aa, Mycobacterium tuberculosis
AQGYQQ

SEQ ID NO: 1538551 - protein, 8 aa, Mycobacterium tuberculosis
ARDRGRQM

SEQ ID NO: 1538552 - protein, 22 aa, Mycobacterium tuberculosis
ARFTESTPYNPSSPYSATKAGA

SEQ ID NO: 1538553 - protein, 4 aa, Mycobacterium tuberculosis
ASPA

SEQ ID NO: 1538554 - protein, 10 aa, Mycobacterium tuberculosis
ASSANLGPGF

SEQ ID NO: 1538555 - protein, 12 aa, Mycobacterium tuberculosis
ATADAEEALGGA

SEQ ID NO: 1538556 - protein, 9 aa, Mycobacterium tuberculosis
ATKAEADAA

SEQ ID NO: 1538557 - protein, 7 aa, Mycobacterium tuberculosis
ATQPNTH

SEQ ID NO: 1538558 - protein, 16 aa, Mycobacterium tuberculosis
AYAHSSYHRGVFAPAR

SEQ ID NO: 1538559 - protein, 6 aa, Mycobacterium tuberculosis
AYPDDE

SEQ ID NO: 1538560 - protein, 8 aa, Mycobacterium tuberculosis
AYRDGTLP

SEQ ID NO: 1538561 - protein, 20 aa, Mycobacterium tuberculosis
CGAAEGPYGFTGTSNSFASG

SEQ ID NO: 1538562 - protein, 9 aa, Mycobacterium tuberculosis
DAVGPASPV

SEQ ID NO: 1538563 - protein, 10 aa, Mycobacterium tuberculosis
DDQSGTIPNV

SEQ ID NO: 1538564 - protein, 6 aa, Mycobacterium tuberculosis
DDVRAA

SEQ ID NO: 1538565 - protein, 4 aa, Mycobacterium tuberculosis
DFEE

SEQ ID NO: 1538566 - protein, 8 aa, Mycobacterium tuberculosis
DGGTAADA

SEQ ID NO: 1538567 - protein, 5 aa, Mycobacterium tuberculosis
DGWQT

SEQ ID NO: 1538568 - protein, 12 aa, Mycobacterium tuberculosis
DQINTTRYNPDY

SEQ ID NO: 1538569 - protein, 4 aa, Mycobacterium tuberculosis
DTPA

SEQ ID NO: 1538570 - protein, 10 aa, Mycobacterium tuberculosis
DTRTPPGLRA

SEQ ID NO: 1538571 - protein, 8 aa, Mycobacterium tuberculosis
DVDTDGLA

SEQ ID NO: 1538572 - protein, 9 aa, Mycobacterium tuberculosis
EAPAPLQNT

SEQ ID NO: 1538573 - protein, 10 aa, Mycobacterium tuberculosis
EATPTLPLPT

SEQ ID NO: 1538574 - protein, 6 aa, Mycobacterium tuberculosis
EDPGYA

SEQ ID NO: 1538575 - protein, 7 aa, Mycobacterium tuberculosis
EGGPTYW

SEQ ID NO: 1538576 - protein, 7 aa, Mycobacterium tuberculosis
EGLPTDG

SEQ ID NO: 1538577 - protein, 5 aa, Mycobacterium tuberculosis
EPQPL

SEQ ID NO: 1538578 - protein, 9 aa, Mycobacterium tuberculosis
ESAEGRQKY

SEQ ID NO: 1538579 - protein, 16 aa, Mycobacterium tuberculosis
ETPSRPGTATLEPGHT

SEQ ID NO: 1538580 - protein, 9 aa, Mycobacterium tuberculosis
EVRTDAPSN

SEQ ID NO: 1538581 - protein, 9 aa, Mycobacterium tuberculosis
FEGHPDNAA

SEQ ID NO: 1538582 - protein, 4 aa, Mycobacterium tuberculosis
GAAS

SEQ ID NO: 1538583 - protein, 5 aa, Mycobacterium tuberculosis
GAATD

SEQ ID NO: 1538584 - protein, 13 aa, Mycobacterium tuberculosis
GAIGGKTGYTNAA

SEQ ID NO: 1538585 - protein, 9 aa, Mycobacterium tuberculosis
GAPINSATA

SEQ ID NO: 1538586 - protein, 8 aa, Mycobacterium tuberculosis
GAPSTAGP

SEQ ID NO: 1538587 - protein, 15 aa, Mycobacterium tuberculosis
GDPVAARPAAQEARE

SEQ ID NO: 1538588 - protein, 5 aa, Mycobacterium tuberculosis
GENTA

SEQ ID NO: 1538589 - protein, 9 aa, Mycobacterium tuberculosis
GGAATTPTS

SEQ ID NO: 1538590 - protein, 11 aa, Mycobacterium tuberculosis
GGPGDSGAPVT

SEQ ID NO: 1538591 - protein, 13 aa, Mycobacterium tuberculosis
GGQPEFRQHSEHR

SEQ ID NO: 1538592 - protein, 4 aa, Mycobacterium tuberculosis
GGSL

SEQ ID NO: 1538593 - protein, 5 aa, Mycobacterium tuberculosis
GGTVQ

SEQ ID NO: 1538594 - protein, 6 aa, Mycobacterium tuberculosis
GHTSGH

SEQ ID NO: 1538595 - protein, 4 aa, Mycobacterium tuberculosis
GKQR

SEQ ID NO: 1538596 - protein, 5 aa, Mycobacterium tuberculosis
GNTKA

SEQ ID NO: 1538597 - protein, 6 aa, Mycobacterium tuberculosis
GSDEQF

SEQ ID NO: 1538598 - protein, 11 aa, Mycobacterium tuberculosis
GSQPLADDAEE

SEQ ID NO: 1538599 - protein, 5 aa, Mycobacterium tuberculosis
GTTSL

SEQ ID NO: 1538600 - protein, 8 aa, Mycobacterium tuberculosis
GTYDPRRI

SEQ ID NO: 1538601 - protein, 13 aa, Mycobacterium tuberculosis
GVDPTAADPAGWP

SEQ ID NO: 1538602 - protein, 4 aa, Mycobacterium tuberculosis
GVGT

SEQ ID NO: 1538603 - protein, 10 aa, Mycobacterium tuberculosis
GVPAGKSDRL

SEQ ID NO: 1538604 - protein, 10 aa, Mycobacterium tuberculosis
HDQPGRSTTD

SEQ ID NO: 1538605 - protein, 5 aa, Mycobacterium tuberculosis
HGGQT

SEQ ID NO: 1538606 - protein, 20 aa, Mycobacterium tuberculosis
HRAAGAGRRQRRRRSGDGQW

SEQ ID NO: 1538607 - protein, 27 aa, Mycobacterium tuberculosis
HSMGSARPGDFGAPTAVAPPVPEHGTS

SEQ ID NO: 1538608 - protein, 12 aa, Mycobacterium tuberculosis
IGDGNRGSGNVG

SEQ ID NO: 1538609 - protein, 7 aa, Mycobacterium tuberculosis
IGPDPSF

SEQ ID NO: 1538610 - protein, 6 aa, Mycobacterium tuberculosis
ISLDGP

SEQ ID NO: 1538611 - protein, 4 aa, Mycobacterium tuberculosis
ITDP

SEQ ID NO: 1538612 - protein, 6 aa, Mycobacterium tuberculosis
KLDAGP

SEQ ID NO: 1538613 - protein, 6 aa, Mycobacterium tuberculosis
KNGRHS

SEQ ID NO: 1538614 - protein, 7 aa, Mycobacterium tuberculosis
KPGKDAH

SEQ ID NO: 1538615 - protein, 8 aa, Mycobacterium tuberculosis
KPGRSYTA

SEQ ID NO: 1538616 - protein, 4 aa, Mycobacterium tuberculosis
KTQT

SEQ ID NO: 1538617 - protein, 8 aa, Mycobacterium tuberculosis
LAHGGQPV

SEQ ID NO: 1538618 - protein, 5 aa, Mycobacterium tuberculosis
LARDG

SEQ ID NO: 1538619 - protein, 4 aa, Mycobacterium tuberculosis
LDDQ

SEQ ID NO: 1538620 - protein, 15 aa, Mycobacterium tuberculosis
LDDSRPGNGRPVTAA

SEQ ID NO: 1538621 - protein, 7 aa, Mycobacterium tuberculosis
LGGAATR

SEQ ID NO: 1538622 - protein, 5 aa, Mycobacterium tuberculosis
LGNRT

SEQ ID NO: 1538623 - protein, 11 aa, Mycobacterium tuberculosis
LGSGNDGNGNF

SEQ ID NO: 1538624 - protein, 4 aa, Mycobacterium tuberculosis
LPPE

SEQ ID NO: 1538625 - protein, 15 aa, Mycobacterium tuberculosis
LPRPGRQRAPRAGVH

SEQ ID NO: 1538626 - protein, 16 aa, Mycobacterium tuberculosis
LPSDTDLDTPGPQRSL

SEQ ID NO: 1538627 - protein, 16 aa, Mycobacterium tuberculosis
LSGNPVRDGPAAPAQV

SEQ ID NO: 1538628 - protein, 7 aa, Mycobacterium tuberculosis
MPSSGGV

SEQ ID NO: 1538629 - protein, 14 aa, Mycobacterium tuberculosis
NAKNRPGAGFVPVP

SEQ ID NO: 1538630 - protein, 6 aa, Mycobacterium tuberculosis
NDAANT

SEQ ID NO: 1538631 - protein, 16 aa, Mycobacterium tuberculosis
NGGAGGAGGNGGPAPL

SEQ ID NO: 1538632 - protein, 10 aa, Mycobacterium tuberculosis
NGRPYRDGEV

SEQ ID NO: 1538633 - protein, 4 aa, Mycobacterium tuberculosis
NPAR

SEQ ID NO: 1538634 - protein, 6 aa, Mycobacterium tuberculosis
NPTNTA

SEQ ID NO: 1538635 - protein, 10 aa, Mycobacterium tuberculosis
NSGDGGVSGF

SEQ ID NO: 1538636 - protein, 5 aa, Mycobacterium tuberculosis
PAAVA

SEQ ID NO: 1538637 - protein, 17 aa, Mycobacterium tuberculosis
PATPGFGNTTTAPSSGF

SEQ ID NO: 1538638 - protein, 5 aa, Mycobacterium tuberculosis
PEPET

SEQ ID NO: 1538639 - protein, 4 aa, Mycobacterium tuberculosis
PEPW

SEQ ID NO: 1538640 - protein, 5 aa, Mycobacterium tuberculosis
PGFGG

SEQ ID NO: 1538641 - protein, 13 aa, Mycobacterium tuberculosis
PGTAAPAPESLHG

SEQ ID NO: 1538642 - protein, 14 aa, Mycobacterium tuberculosis
PITQPPAGRPPNDL

SEQ ID NO: 1538643 - protein, 19 aa, Mycobacterium tuberculosis
PLPTGPDAAPACPTGGAGL

SEQ ID NO: 1538644 - protein, 30 aa, Mycobacterium tuberculosis
PNGTPAPKTPPATVPSSRNLATNPEIATGY

SEQ ID NO: 1538645 - protein, 32 aa, Mycobacterium tuberculosis; identical to SEQ ID NO: 1435073

SEQ ID NO: 1538646 - protein, 19 aa, Mycobacterium tuberculosis
PQPPLPPDSSSQDCDPTAS

SEQ ID NO: 1538647 - protein, 8 aa, Mycobacterium tuberculosis
PRDSPITK

SEQ ID NO: 1538648 - protein, 8 aa, Mycobacterium tuberculosis
PRPGVPAA

SEQ ID NO: 1538649 - protein, 5 aa, Mycobacterium tuberculosis
PRSAT

SEQ ID NO: 1538650 - protein, 5 aa, Mycobacterium tuberculosis
PSREF

SEQ ID NO: 1538651 - protein, 5 aa, Mycobacterium tuberculosis
PVQPL

SEQ ID NO: 1538652 - protein, 5 aa, Mycobacterium tuberculosis
PYRAP

SEQ ID NO: 1538653 - protein, 13 aa, Mycobacterium tuberculosis
QAAGGAVDGADTV

SEQ ID NO: 1538654 - protein, 10 aa, Mycobacterium tuberculosis
QATAATDGEW

SEQ ID NO: 1538655 - protein, 16 aa, Mycobacterium tuberculosis
QATSTQPSTAPPTSRV

SEQ ID NO: 1538656 - protein, 7 aa, Mycobacterium tuberculosis
QAVAGRQ

SEQ ID NO: 1538657 - protein, 56 aa, Mycobacterium tuberculosis; identical to SEQ ID NO: 230912

SEQ ID NO: 1538658 - protein, 6 aa, Mycobacterium tuberculosis
QGTEFD

SEQ ID NO: 1538659 - protein, 7 aa, Mycobacterium tuberculosis
QQIGYER

SEQ ID NO: 1538660 - protein, 11 aa, Mycobacterium tuberculosis
QTEVAGAGSGF

SEQ ID NO: 1538661 - protein, 7 aa, Mycobacterium tuberculosis
QTTTGRA

SEQ ID NO: 1538662 - protein, 5 aa, Mycobacterium tuberculosis
RADAD

SEQ ID NO: 1538663 - protein, 10 aa, Mycobacterium tuberculosis
RPKTPPPADA

SEQ ID NO: 1538664 - protein, 7 aa, Mycobacterium tuberculosis
RSQGSTV

SEQ ID NO: 1538665 - protein, 8 aa, Mycobacterium tuberculosis
RTLSTSAD

SEQ ID NO: 1538666 - protein, 16 aa, Mycobacterium tuberculosis
SADSYAATEAANIIAV

SEQ ID NO: 1538667 - protein, 5 aa, Mycobacterium tuberculosis
SATTA

SEQ ID NO: 1538668 - protein, 5 aa, Mycobacterium tuberculosis
SDLSG

SEQ ID NO: 1538669 - protein, 4 aa, Mycobacterium tuberculosis
SDNM

SEQ ID NO: 1538670 - protein, 10 aa, Mycobacterium tuberculosis
SEKGDSGGPV

SEQ ID NO: 1538671 - protein, 5 aa, Mycobacterium tuberculosis
SEPHD

SEQ ID NO: 1538672 - protein, 14 aa, Mycobacterium tuberculosis
SGNTANTNFGSGNL

SEQ ID NO: 1538673 - protein, 5 aa, Mycobacterium tuberculosis
SGYPV

SEQ ID NO: 1538674 - protein, 9 aa, Mycobacterium tuberculosis
SPVAAAKTT

SEQ ID NO: 1538675 - protein, 10 aa, Mycobacterium tuberculosis
SSASATPANI

SEQ ID NO: 1538676 - protein, 4 aa, Mycobacterium tuberculosis
TAQG

SEQ ID NO: 1538677 - protein, 8 aa, Mycobacterium tuberculosis
TARAAGVR

SEQ ID NO: 1538678 - protein, 8 aa, Mycobacterium tuberculosis
TDDNSAAV

SEQ ID NO: 1538679 - protein, 4 aa, Mycobacterium tuberculosis
TGES

SEQ ID NO: 1538680 - protein, 9 aa, Mycobacterium tuberculosis
TLPGRGLSP

SEQ ID NO: 1538681 - protein, 7 aa, Mycobacterium tuberculosis
TREGNRY

SEQ ID NO: 1538682 - protein, 8 aa, Mycobacterium tuberculosis
TSQVGGRS

SEQ ID NO: 1538683 - protein, 10 aa, Mycobacterium tuberculosis
TTAPSAAPNI

SEQ ID NO: 1538684 - protein, 4 aa, Mycobacterium tuberculosis
VADP

SEQ ID NO: 1538685 - protein, 14 aa, Mycobacterium tuberculosis
VEETDSAGNPRSDH

SEQ ID NO: 1538686 - protein, 4 aa, Mycobacterium tuberculosis
VGAT

SEQ ID NO: 1538687 - protein, 7 aa, Mycobacterium tuberculosis
VGGTTVV

SEQ ID NO: 1538688 - protein, 4 aa, Mycobacterium tuberculosis
VGPE

SEQ ID NO: 1538689 - protein, 4 aa, Mycobacterium tuberculosis
VRGE

SEQ ID NO: 1538690 - protein, 10 aa, Mycobacterium tuberculosis
VRPVEQGEGD

SEQ ID NO: 1538691 - protein, 9 aa, Mycobacterium tuberculosis
VTGREPSER

SEQ ID NO: 1538692 - protein, 13 aa, Mycobacterium tuberculosis
VTSAMNQTNDRQQ

SEQ ID NO: 1538693 - protein, 9 aa, Mycobacterium tuberculosis
WGPGESPGT

SEQ ID NO: 1538694 - protein, 10 aa, Mycobacterium tuberculosis
WGPLSAPKLE

SEQ ID NO: 1538695 - protein, 4 aa, Mycobacterium tuberculosis
YPAD

SEQ ID NO: 1538696 - protein, 8 aa, Mycobacterium tuberculosis
YPGGAGFA

SEQ ID NO: 1538697 - protein, 6 aa, Mycobacterium tuberculosis
YSPRGS

SEQ ID NO: 1538698 - protein, 7 aa, Mycobacterium tuberculosis
AAAASPL

SEQ ID NO: 1538699 - protein, 8 aa, Mycobacterium tuberculosis
AAGKTPVP

SEQ ID NO: 1538700 - protein, 18 aa, Mycobacterium tuberculosis
AAGSAYATAEAANASPLQ

SEQ ID NO: 1538701 - protein, 15 aa, Mycobacterium tuberculosis
AASAAAVDTNCGATL

SEQ ID NO: 1538702 - protein, 8 aa, Mycobacterium tuberculosis
AATAQSVQ

SEQ ID NO: 1538703 - protein, 7 aa, Mycobacterium tuberculosis
AATSSEW

SEQ ID NO: 1538704 - protein, 8 aa, Mycobacterium tuberculosis
AAVPTASA

SEQ ID NO: 1538705 - protein, 6 aa, Mycobacterium tuberculosis
ADAAAS

SEQ ID NO: 1538706 - protein, 8 aa, Mycobacterium tuberculosis
ADGSNSIA

SEQ ID NO: 1538707 - protein, 15 aa, Mycobacterium tuberculosis
ADPPRRASVNEVGGT

SEQ ID NO: 1538708 - protein, 9 aa, Mycobacterium tuberculosis
ADRGAAEKA

SEQ ID NO: 1538709 - protein, 6 aa, Mycobacterium tuberculosis
ADTIGA

SEQ ID NO: 1538710 - protein, 9 aa, Mycobacterium tuberculosis
ADVENIGST

SEQ ID NO: 1538711 - protein, 4 aa, Mycobacterium tuberculosis
AGGN

SEQ ID NO: 1538712 - protein, 11 aa, Mycobacterium tuberculosis
AGKTGTAQQIN

SEQ ID NO: 1538713 - protein, 16 aa, Mycobacterium tuberculosis
AGPAKIPLPGPGPGQT

SEQ ID NO: 1538714 - protein, 7 aa, Mycobacterium tuberculosis
AGQAGRE

SEQ ID NO: 1538715 - protein, 10 aa, Mycobacterium tuberculosis
AGTPVISDPG

SEQ ID NO: 1538716 - protein, 13 aa, Mycobacterium tuberculosis
AIRSQQSAYASHP

SEQ ID NO: 1538717 - protein, 7 aa, Mycobacterium tuberculosis
AKSAAES

SEQ ID NO: 1538718 - protein, 6 aa, Mycobacterium tuberculosis
ALGDHS

SEQ ID NO: 1538719 - protein, 12 aa, Mycobacterium tuberculosis
APASGSGKTTIA

SEQ ID NO: 1538720 - protein, 8 aa, Mycobacterium tuberculosis
APPHGNAL

SEQ ID NO: 1538721 - protein, 8 aa, Mycobacterium tuberculosis
APSPASSV

SEQ ID NO: 1538722 - protein, 17 aa, Mycobacterium tuberculosis
APVTAGPVGGTAEVPTP

SEQ ID NO: 1538723 - protein, 6 aa, Mycobacterium tuberculosis
ARLPSG

SEQ ID NO: 1538724 - protein, 8 aa, Mycobacterium tuberculosis
ARRDGAPP

SEQ ID NO: 1538725 - protein, 10 aa, Mycobacterium tuberculosis
ASGETGTEIA

SEQ ID NO: 1538726 - protein, 8 aa, Mycobacterium tuberculosis
ATAAPKTY

SEQ ID NO: 1538727 - protein, 6 aa, Mycobacterium tuberculosis
ATDTGS

SEQ ID NO: 1538728 - protein, 10 aa, Mycobacterium tuberculosis
ATGQNQPATG

SEQ ID NO: 1538729 - protein, 8 aa, Mycobacterium tuberculosis
ATGSGKSE

SEQ ID NO: 1538730 - protein, 16 aa, Mycobacterium tuberculosis
ATLTDGAGPVNSKTVQ

SEQ ID NO: 1538731 - protein, 6 aa, Mycobacterium tuberculosis
ATRIPG

SEQ ID NO: 1538732 - protein, 4 aa, Mycobacterium tuberculosis
AVGG

SEQ ID NO: 1538733 - protein, 10 aa, Mycobacterium tuberculosis
AVNRPTPDRV

SEQ ID NO: 1538734 - protein, 8 aa, Mycobacterium tuberculosis
AVNTRGGK

SEQ ID NO: 1538735 - protein, 15 aa, Mycobacterium tuberculosis
CESGGNWSINTGNGY

SEQ ID NO: 1538736 - protein, 13 aa, Mycobacterium tuberculosis
CTPRPQGPGPAAE

SEQ ID NO: 1538737 - protein, 8 aa, Mycobacterium tuberculosis
DAEPAQAE

SEQ ID NO: 1538738 - protein, 6 aa, Mycobacterium tuberculosis
DDSNRV

SEQ ID NO: 1538739 - protein, 7 aa, Mycobacterium tuberculosis
DDTEVGV

SEQ ID NO: 1538740 - protein, 6 aa, Mycobacterium tuberculosis
DEMRDQ

SEQ ID NO: 1538741 - protein, 4 aa, Mycobacterium tuberculosis
DEPP

SEQ ID NO: 1538742 - protein, 6 aa, Mycobacterium tuberculosis
DGNKAS

SEQ ID NO: 1538743 - protein, 7 aa, Mycobacterium tuberculosis
DLTDSGR

SEQ ID NO: 1538744 - protein, 9 aa, Mycobacterium tuberculosis
DPSADSTTT

SEQ ID NO: 1538745 - protein, 6 aa, Mycobacterium tuberculosis
DRLRSG

SEQ ID NO: 1538746 - protein, 4 aa, Mycobacterium tuberculosis
DRNR

SEQ ID NO: 1538747 - protein, 7 aa, Mycobacterium tuberculosis
DTGSGSI

SEQ ID NO: 1538748 - protein, 10 aa, Mycobacterium tuberculosis
DVQPAARGSI

SEQ ID NO: 1538749 - protein, 13 aa, Mycobacterium tuberculosis
EAIGTASDKLASI

SEQ ID NO: 1538750 - protein, 5 aa, Mycobacterium tuberculosis
EAMGN

SEQ ID NO: 1538751 - protein, 14 aa, Mycobacterium tuberculosis
EASGSAGKVTVSPV

SEQ ID NO: 1538752 - protein, 5 aa, Mycobacterium tuberculosis
ECTPD

SEQ ID NO: 1538753 - protein, 13 aa, Mycobacterium tuberculosis
EDEVERRRGDLPT

SEQ ID NO: 1538754 - protein, 5 aa, Mycobacterium tuberculosis
EISDN

SEQ ID NO: 1538755 - protein, 5 aa, Mycobacterium tuberculosis
ELTSA

SEQ ID NO: 1538756 - protein, 10 aa, Mycobacterium tuberculosis
EQASSSTQPL

SEQ ID NO: 1538757 - protein, 6 aa, Mycobacterium tuberculosis
ERRGQP

SEQ ID NO: 1538758 - protein, 7 aa, Mycobacterium tuberculosis
ESLSSGP

SEQ ID NO: 1538759 - protein, 7 aa, Mycobacterium tuberculosis
ESRDVTR

SEQ ID NO: 1538760 - protein, 11 aa, Mycobacterium tuberculosis
ETAGNQIRDAK

SEQ ID NO: 1538761 - protein, 6 aa, Mycobacterium tuberculosis
FDPAWG

SEQ ID NO: 1538762 - protein, 28 aa, Mycobacterium tuberculosis
FVGNGGAGGNGQLGSGAVSSAGGMGGNG

SEQ ID NO: 1538763 - protein, 5 aa, Mycobacterium tuberculosis
GAAGN

SEQ ID NO: 1538764 - protein, 7 aa, Mycobacterium tuberculosis
GADEVST

SEQ ID NO: 1538765 - protein, 7 aa, Mycobacterium tuberculosis
GAERLPN

SEQ ID NO: 1538766 - protein, 8 aa, Mycobacterium tuberculosis
GAFGPNGN

SEQ ID NO: 1538767 - protein, 19 aa, Mycobacterium tuberculosis
GAGGNGGMGGVAPSTGPSM

SEQ ID NO: 1538768 - protein, 6 aa, Mycobacterium tuberculosis
GAGHTG

SEQ ID NO: 1538769 - protein, 4 aa, Mycobacterium tuberculosis
GAPI

SEQ ID NO: 1538770 - protein, 10 aa, Mycobacterium tuberculosis
GAPQTGKSTA

SEQ ID NO: 1538771 - protein, 23 aa, Mycobacterium tuberculosis
GDLTNLGSSISAANASAASATTQ

SEQ ID NO: 1538772 - protein, 19 aa, Mycobacterium tuberculosis
GDTASAAQLSDNPNEAREA

SEQ ID NO: 1538773 - protein, 5 aa, Mycobacterium tuberculosis
GEMSR

SEQ ID NO: 1538774 - protein, 14 aa, Mycobacterium tuberculosis
GGFGGQGGNGGQSG

SEQ ID NO: 1538775 - protein, 8 aa, Mycobacterium tuberculosis
GGSPAPRC

SEQ ID NO: 1538776 - protein, 7 aa, Mycobacterium tuberculosis
GGSSEYA

SEQ ID NO: 1538777 - protein, 8 aa, Mycobacterium tuberculosis
GGTLPGID

SEQ ID NO: 1538778 - protein, 14 aa, Mycobacterium tuberculosis
GGVGGPGGSGGASA

SEQ ID NO: 1538779 - protein, 7 aa, Mycobacterium tuberculosis
GHNDPEL

SEQ ID NO: 1538780 - protein, 15 aa, Mycobacterium tuberculosis
GIGPARLDKRRNLVR

SEQ ID NO: 1538781 - protein, 4 aa, Mycobacterium tuberculosis
GKGY

SEQ ID NO: 1538782 - protein, 5 aa, Mycobacterium tuberculosis
GLPAT

SEQ ID NO: 1538783 - protein, 7 aa, Mycobacterium tuberculosis
GRAQPQL

SEQ ID NO: 1538784 - protein, 19 aa, Mycobacterium tuberculosis
GSAPPTSQTAAAAKPNPST

SEQ ID NO: 1538785 - protein, 9 aa, Mycobacterium tuberculosis
GSGRGPAPI

SEQ ID NO: 1538786 - protein, 36 aa, Mycobacterium tuberculosis; identical to SEQ ID NO: 1368830

SEQ ID NO: 1538787 - protein, 7 aa, Mycobacterium tuberculosis
GTDEVST

SEQ ID NO: 1538788 - protein, 8 aa, Mycobacterium tuberculosis
GTPGPADV

SEQ ID NO: 1538789 - protein, 9 aa, Mycobacterium tuberculosis
GTRSPARDF

SEQ ID NO: 1538790 - protein, 9 aa, Mycobacterium tuberculosis
GVPTPGLPF

SEQ ID NO: 1538791 - protein, 6 aa, Mycobacterium tuberculosis
GVYANS

SEQ ID NO: 1538792 - protein, 19 aa, Mycobacterium tuberculosis
GYTTTGSIDDAVASLRAAL

SEQ ID NO: 1538793 - protein, 15 aa, Mycobacterium tuberculosis
HADPAPAPAPAPNIP

SEQ ID NO: 1538794 - protein, 4 aa, Mycobacterium tuberculosis
HDAG

SEQ ID NO: 1538795 - protein, 5 aa, Mycobacterium tuberculosis
HGETV

SEQ ID NO: 1538796 - protein, 4 aa, Mycobacterium tuberculosis
HGPA

SEQ ID NO: 1538797 - protein, 9 aa, Mycobacterium tuberculosis
IAPNAGLDP

SEQ ID NO: 1538798 - protein, 7 aa, Mycobacterium tuberculosis
KASSQDV

SEQ ID NO: 1538799 - protein, 11 aa, Mycobacterium tuberculosis
KNTPNSRGTIG

SEQ ID NO: 1538800 - protein, 8 aa, Mycobacterium tuberculosis
KPGTGSTF

SEQ ID NO: 1538801 - protein, 7 aa, Mycobacterium tuberculosis
KSAPGCP

SEQ ID NO: 1538802 - protein, 5 aa, Mycobacterium tuberculosis
KSDSI

SEQ ID NO: 1538803 - protein, 28 aa, Mycobacterium tuberculosis
LGLPTDPKKLASVAPSSNALLAAALVRV

SEQ ID NO: 1538804 - protein, 11 aa, Mycobacterium tuberculosis
LGQPGTYTDFG

SEQ ID NO: 1538805 - protein, 13 aa, Mycobacterium tuberculosis
LPAGAKITRTTTK

SEQ ID NO: 1538806 - protein, 4 aa, Mycobacterium tuberculosis
LPGQ

SEQ ID NO: 1538807 - protein, 11 aa, Mycobacterium tuberculosis
LPPAQRADPVT

SEQ ID NO: 1538808 - protein, 7 aa, Mycobacterium tuberculosis
LPREEWP

SEQ ID NO: 1538809 - protein, 12 aa, Mycobacterium tuberculosis
LQSGSQEDETAW

SEQ ID NO: 1538810 - protein, 9 aa, Mycobacterium tuberculosis
LRRASPSAV

SEQ ID NO: 1538811 - protein, 7 aa, Mycobacterium tuberculosis
LSRDGTR

SEQ ID NO: 1538812 - protein, 11 aa, Mycobacterium tuberculosis
LSRGNDNALGP

SEQ ID NO: 1538813 - protein, 11 aa, Mycobacterium tuberculosis
LTAPEGTPGEW

SEQ ID NO: 1538814 - protein, 7 aa, Mycobacterium tuberculosis
LTQGGRT

SEQ ID NO: 1538815 - protein, 11 aa, Mycobacterium tuberculosis
MPQPPGYDTNA

SEQ ID NO: 1538816 - protein, 9 aa, Mycobacterium tuberculosis
NADEPGCSA

SEQ ID NO: 1538817 - protein, 4 aa, Mycobacterium tuberculosis
NDPD

SEQ ID NO: 1538818 - protein, 4 aa, Mycobacterium tuberculosis
NDPE

SEQ ID NO: 1538819 - protein, 6 aa, Mycobacterium tuberculosis
NGRIAG

SEQ ID NO: 1538820 - protein, 4 aa, Mycobacterium tuberculosis
NSPE

SEQ ID NO: 1538821 - protein, 4 aa, Mycobacterium tuberculosis
PAST

SEQ ID NO: 1538822 - protein, 7 aa, Mycobacterium tuberculosis
PATLPES

SEQ ID NO: 1538823 - protein, 7 aa, Mycobacterium tuberculosis
PDTIDES

SEQ ID NO: 1538824 - protein, 4 aa, Mycobacterium tuberculosis
PGVV

SEQ ID NO: 1538825 - protein, 13 aa, Mycobacterium tuberculosis
PPEQVRTSRPDGA

SEQ ID NO: 1538826 - protein, 6 aa, Mycobacterium tuberculosis
QATASF

SEQ ID NO: 1538827 - protein, 5 aa, Mycobacterium tuberculosis
QLEPQ

SEQ ID NO: 1538828 - protein, 9 aa, Mycobacterium tuberculosis
QLPNTPGAG

SEQ ID NO: 1538829 - protein, 4 aa, Mycobacterium tuberculosis
QNGV

SEQ ID NO: 1538830 - protein, 11 aa, Mycobacterium tuberculosis
QPQRAAAMTAS

SEQ ID NO: 1538831 - protein, 7 aa, Mycobacterium tuberculosis
QTSSPAH

SEQ ID NO: 1538832 - protein, 5 aa, Mycobacterium tuberculosis
QVTST

SEQ ID NO: 1538833 - protein, 7 aa, Mycobacterium tuberculosis
RATAAAK

SEQ ID NO: 1538834 - protein, 6 aa, Mycobacterium tuberculosis
RGAGTI

SEQ ID NO: 1538835 - protein, 18 aa, Mycobacterium tuberculosis
RGEPERAPCGREPPPDLA

SEQ ID NO: 1538836 - protein, 8 aa, Mycobacterium tuberculosis
RKDPTIVR

SEQ ID NO: 1538837 - protein, 6 aa, Mycobacterium tuberculosis
RLDEGR

SEQ ID NO: 1538838 - protein, 6 aa, Mycobacterium tuberculosis
RNDGIA

SEQ ID NO: 1538839 - protein, 28 aa, Mycobacterium tuberculosis
RPTNSGPATAAGTTAEPTYTAAETAAAH

SEQ ID NO: 1538840 - protein, 19 aa, Mycobacterium tuberculosis
RSGLAGRGRIPAHSARRRG

SEQ ID NO: 1538841 - protein, 16 aa, Mycobacterium tuberculosis
RSTSEQVHADLGVTPL

SEQ ID NO: 1538842 - protein, 5 aa, Mycobacterium tuberculosis
RTAPR

SEQ ID NO: 1538843 - protein, 5 aa, Mycobacterium tuberculosis
RTGKL

SEQ ID NO: 1538844 - protein, 13 aa, Mycobacterium tuberculosis
RTSHAAPAAAIGT

SEQ ID NO: 1538845 - protein, 15 aa, Mycobacterium tuberculosis
SAEAPSTGTGPNAAP

SEQ ID NO: 1538846 - protein, 4 aa, Mycobacterium tuberculosis
SAPL

SEQ ID NO: 1538847 - protein, 14 aa, Mycobacterium tuberculosis
SATYQSAIPPRGTQ

SEQ ID NO: 1538848 - protein, 8 aa, Mycobacterium tuberculosis
SDEDSAKA

SEQ ID NO: 1538849 - protein, 6 aa, Mycobacterium tuberculosis
SEHPSF

SEQ ID NO: 1538850 - protein, 8 aa, Mycobacterium tuberculosis
SGFGGGGH

SEQ ID NO: 1538851 - protein, 6 aa, Mycobacterium tuberculosis
SGTGNV

SEQ ID NO: 1538852 - protein, 4 aa, Mycobacterium tuberculosis
SIAP

SEQ ID NO: 1538853 - protein, 7 aa, Mycobacterium tuberculosis
SRSTEFA

SEQ ID NO: 1538854 - protein, 4 aa, Mycobacterium tuberculosis
SSDG

SEQ ID NO: 1538855 - protein, 13 aa, Mycobacterium tuberculosis
SSTNGFNAASPAF

SEQ ID NO: 1538856 - protein, 20 aa, Mycobacterium tuberculosis
STTVSGDRDDLKPGVGDRSW

SEQ ID NO: 1538857 - protein, 10 aa, Mycobacterium tuberculosis
SVGCSRQDVE

SEQ ID NO: 1538858 - protein, 9 aa, Mycobacterium tuberculosis
TAERGNGAI

SEQ ID NO: 1538859 - protein, 7 aa, Mycobacterium tuberculosis
TAGQKKA

SEQ ID NO: 1538860 - protein, 15 aa, Mycobacterium tuberculosis
TATARAGPAKVPTTP

SEQ ID NO: 1538861 - protein, 9 aa, Mycobacterium tuberculosis
TDAVPGLSD

SEQ ID NO: 1538862 - protein, 4 aa, Mycobacterium tuberculosis
TDFG

SEQ ID NO: 1538863 - protein, 8 aa, Mycobacterium tuberculosis
TDGSPVTA

SEQ ID NO: 1538864 - protein, 5 aa, Mycobacterium tuberculosis
TDHDT

SEQ ID NO: 1538865 - protein, 22 aa, Mycobacterium tuberculosis
TGKSGSATLRPRSDINPDGPTT

SEQ ID NO: 1538866 - protein, 9 aa, Mycobacterium tuberculosis
TGPPTGGLT

SEQ ID NO: 1538867 - protein, 6 aa, Mycobacterium tuberculosis
TGRGRR

SEQ ID NO: 1538868 - protein, 4 aa, Mycobacterium tuberculosis
TKDD

SEQ ID NO: 1538869 - protein, 8 aa, Mycobacterium tuberculosis
TLDERDNQ

SEQ ID NO: 1538870 - protein, 7 aa, Mycobacterium tuberculosis
TPAPSFT

SEQ ID NO: 1538871 - protein, 6 aa, Mycobacterium tuberculosis
TQGRGA

SEQ ID NO: 1538872 - protein, 6 aa, Mycobacterium tuberculosis
TRAAAT

SEQ ID NO: 1538873 - protein, 6 aa, Mycobacterium tuberculosis
TTEQLG

SEQ ID NO: 1538874 - protein, 5 aa, Mycobacterium tuberculosis
TTKDR

SEQ ID NO: 1538875 - protein, 6 aa, Mycobacterium tuberculosis
TTQQAE

SEQ ID NO: 1538876 - protein, 8 aa, Mycobacterium tuberculosis
VAAAPTTE

SEQ ID NO: 1538877 - protein, 14 aa, Mycobacterium tuberculosis
VGTTGGAGGNGGGA

SEQ ID NO: 1538878 - protein, 6 aa, Mycobacterium tuberculosis
VKPTVS

SEQ ID NO: 1538879 - protein, 8 aa, Mycobacterium tuberculosis
VPEEAGPV

SEQ ID NO: 1538880 - protein, 4 aa, Mycobacterium tuberculosis
VRVP

SEQ ID NO: 1538881 - protein, 4 aa, Mycobacterium tuberculosis
VSVT

SEQ ID NO: 1538882 - protein, 7 aa, Mycobacterium tuberculosis
VTPDGTA

SEQ ID NO: 1538883 - protein, 7 aa, Mycobacterium tuberculosis
YAEDTGT

SEQ ID NO: 1538884 - protein, 21 aa, Mycobacterium tuberculosis
YGGNPGRPSEQGLAADARAAQ

SEQ ID NO: 1538885 - protein, 8 aa, Mycobacterium tuberculosis
YSPQTRFS

SEQ ID NO: 1538886 - protein, 6 aa, Mycobacterium tuberculosis
AAAPYA

SEQ ID NO: 1538887 - protein, 9 aa, Mycobacterium tuberculosis
AAASDVANI

SEQ ID NO: 1538888 - protein, 8 aa, Mycobacterium tuberculosis
AADPRSNL

SEQ ID NO: 1538889 - protein, 15 aa, Mycobacterium tuberculosis
AAEGRAGYGVPGDHG

SEQ ID NO: 1538890 - protein, 14 aa, Mycobacterium tuberculosis
AAGDYTTAAEDKPA

SEQ ID NO: 1538891 - protein, 9 aa, Mycobacterium tuberculosis
AALAGGDLS

SEQ ID NO: 1538892 - protein, 10 aa, Mycobacterium tuberculosis
AAPGLGKTKI

SEQ ID NO: 1538893 - protein, 19 aa, Mycobacterium tuberculosis
AAQGRGASTISGALRSRDT

SEQ ID NO: 1538894 - protein, 14 aa, Mycobacterium tuberculosis
AARAAGASAQAKAV

SEQ ID NO: 1538895 - protein, 14 aa, Mycobacterium tuberculosis
AARSPTSVLPGLSA

SEQ ID NO: 1538896 - protein, 5 aa, Mycobacterium tuberculosis
ACSSG

SEQ ID NO: 1538897 - protein, 8 aa, Mycobacterium tuberculosis
ADPTETNN

SEQ ID NO: 1538898 - protein, 11 aa, Mycobacterium tuberculosis
ADVDSQPGPVR

SEQ ID NO: 1538899 - protein, 9 aa, Mycobacterium tuberculosis
AEPHYRPSA

SEQ ID NO: 1538900 - protein, 10 aa, Mycobacterium tuberculosis
AGDDSTQGVA

SEQ ID NO: 1538901 - protein, 5 aa, Mycobacterium tuberculosis
AGGNS

SEQ ID NO: 1538902 - protein, 12 aa, Mycobacterium tuberculosis
AKRRDATQLLEV

SEQ ID NO: 1538903 - protein, 14 aa, Mycobacterium tuberculosis
ALSAANAAAAAPTT

SEQ ID NO: 1538904 - protein, 16 aa, Mycobacterium tuberculosis
ANGGGCCGRPAREGVD

SEQ ID NO: 1538905 - protein, 8 aa, Mycobacterium tuberculosis
APDTENAA

SEQ ID NO: 1538906 - protein, 7 aa, Mycobacterium tuberculosis
APRPQRE

SEQ ID NO: 1538907 - protein, 6 aa, Mycobacterium tuberculosis
AQAAAD

SEQ ID NO: 1538908 - protein, 5 aa, Mycobacterium tuberculosis
ARRDE

SEQ ID NO: 1538909 - protein, 6 aa, Mycobacterium tuberculosis
ARRSDG

SEQ ID NO: 1538910 - protein, 7 aa, Mycobacterium tuberculosis
ASPSGVA

SEQ ID NO: 1538911 - protein, 6 aa, Mycobacterium tuberculosis
ASSPMV

SEQ ID NO: 1538912 - protein, 11 aa, Mycobacterium tuberculosis
AVPGSGGIRGP

SEQ ID NO: 1538913 - protein, 9 aa, Mycobacterium tuberculosis
AVRGRGGLS

SEQ ID NO: 1538914 - protein, 6 aa, Mycobacterium tuberculosis
CPSALN

SEQ ID NO: 1538915 - protein, 22 aa, Mycobacterium tuberculosis
DAEEPELNRDPPGDERDTTTPH

SEQ ID NO: 1538916 - protein, 8 aa, Mycobacterium tuberculosis
DATPQVRG

SEQ ID NO: 1538917 - protein, 10 aa, Mycobacterium tuberculosis
DGAGERARTA

SEQ ID NO: 1538918 - protein, 7 aa, Mycobacterium tuberculosis
DGAGRSY

SEQ ID NO: 1538919 - protein, 11 aa, Mycobacterium tuberculosis
DGDQQARGRPI

SEQ ID NO: 1538920 - protein, 7 aa, Mycobacterium tuberculosis
DGPPVPD

SEQ ID NO: 1538921 - protein, 4 aa, Mycobacterium tuberculosis
DSLP

SEQ ID NO: 1538922 - protein, 7 aa, Mycobacterium tuberculosis
EAEYEKV

SEQ ID NO: 1538923 - protein, 4 aa, Mycobacterium tuberculosis
EGVS

SEQ ID NO: 1538924 - protein, 7 aa, Mycobacterium tuberculosis
ELPEVPQ

SEQ ID NO: 1538925 - protein, 13 aa, Mycobacterium tuberculosis
ELSAARAAADAAL

SEQ ID NO: 1538926 - protein, 4 aa, Mycobacterium tuberculosis
ENGG

SEQ ID NO: 1538927 - protein, 4 aa, Mycobacterium tuberculosis
EPCP

SEQ ID NO: 1538928 - protein, 14 aa, Mycobacterium tuberculosis
EPLSGQFDDDGAVS

SEQ ID NO: 1538929 - protein, 5 aa, Mycobacterium tuberculosis
ERAEQ

SEQ ID NO: 1538930 - protein, 10 aa, Mycobacterium tuberculosis
ERTEDGFGQG

SEQ ID NO: 1538931 - protein, 10 aa, Mycobacterium tuberculosis
ESIDDPAGVR

SEQ ID NO: 1538932 - protein, 5 aa, Mycobacterium tuberculosis
ESPAG

SEQ ID NO: 1538933 - protein, 4 aa, Mycobacterium tuberculosis
GAAW

SEQ ID NO: 1538934 - protein, 15 aa, Mycobacterium tuberculosis
GAGDEQLVQVAWSPP

SEQ ID NO: 1538935 - protein, 16 aa, Mycobacterium tuberculosis
GATAGAVSARAAEQQR

SEQ ID NO: 1538936 - protein, 16 aa, Mycobacterium tuberculosis
GCDSHNSGSLGADPRQ

SEQ ID NO: 1538937 - protein, 17 aa, Mycobacterium tuberculosis
GCSSAPTPSANAANHGH

SEQ ID NO: 1538938 - protein, 16 aa, Mycobacterium tuberculosis
GDGGAGGTGGLGDVNG

SEQ ID NO: 1538939 - protein, 12 aa, Mycobacterium tuberculosis
GDQGASGRRTSA

SEQ ID NO: 1538940 - protein, 17 aa, Mycobacterium tuberculosis
GERLNEQAATDTFGNYR

SEQ ID NO: 1538941 - protein, 6 aa, Mycobacterium tuberculosis
GGANDN

SEQ ID NO: 1538942 - protein, 8 aa, Mycobacterium tuberculosis
GGITPGNS

SEQ ID NO: 1538943 - protein, 9 aa, Mycobacterium tuberculosis
GGLRTGNTV

SEQ ID NO: 1538944 - protein, 7 aa, Mycobacterium tuberculosis
GGTAAGV

SEQ ID NO: 1538945 - protein, 7 aa, Mycobacterium tuberculosis
GKLPDSL

SEQ ID NO: 1538946 - protein, 12 aa, Mycobacterium tuberculosis
GKTGEAEFPGGS

SEQ ID NO: 1538947 - protein, 6 aa, Mycobacterium tuberculosis
GLPSSA

SEQ ID NO: 1538948 - protein, 13 aa, Mycobacterium tuberculosis
GNARADRARNTYT

SEQ ID NO: 1538949 - protein, 11 aa, Mycobacterium tuberculosis
GPNTGTPITSV

SEQ ID NO: 1538950 - protein, 4 aa, Mycobacterium tuberculosis
GQAN

SEQ ID NO: 1538951 - protein, 12 aa, Mycobacterium tuberculosis
GRNANDLNRPQF

SEQ ID NO: 1538952 - protein, 8 aa, Mycobacterium tuberculosis
GRPDEGAL

SEQ ID NO: 1538953 - protein, 4 aa, Mycobacterium tuberculosis
GSEL

SEQ ID NO: 1538954 - protein, 6 aa, Mycobacterium tuberculosis
GSGPGF

SEQ ID NO: 1538955 - protein, 8 aa, Mycobacterium tuberculosis
GSHPKGAV

SEQ ID NO: 1538956 - protein, 8 aa, Mycobacterium tuberculosis
GTDARTRA

SEQ ID NO: 1538957 - protein, 8 aa, Mycobacterium tuberculosis
GVASEEGL

SEQ ID NO: 1538958 - protein, 12 aa, Mycobacterium tuberculosis
GVGASGNNGTSA

SEQ ID NO: 1538959 - protein, 8 aa, Mycobacterium tuberculosis
GYDPNGGY

SEQ ID NO: 1538960 - protein, 13 aa, Mycobacterium tuberculosis
HPRGEAANALGAT

SEQ ID NO: 1538961 - protein, 10 aa, Mycobacterium tuberculosis
HTGSSLPSAP

SEQ ID NO: 1538962 - protein, 18 aa, Mycobacterium tuberculosis
IANANDGTRAVGTPGYQA

SEQ ID NO: 1538963 - protein, 13 aa, Mycobacterium tuberculosis
IAPGTYRTEGPSN

SEQ ID NO: 1538964 - protein, 8 aa, Mycobacterium tuberculosis
IDDSTPNR

SEQ ID NO: 1538965 - protein, 12 aa, Mycobacterium tuberculosis
IDPAGTDGGPQL

SEQ ID NO: 1538966 - protein, 4 aa, Mycobacterium tuberculosis
ISNN

SEQ ID NO: 1538967 - protein, 15 aa, Mycobacterium tuberculosis
KKELHSSGSTAQENA

SEQ ID NO: 1538968 - protein, 19 aa, Mycobacterium tuberculosis
KTPTGRSAIAADRGIDEHC

SEQ ID NO: 1538969 - protein, 12 aa, Mycobacterium tuberculosis
KVTSERATGQRE

SEQ ID NO: 1538970 - protein, 8 aa, Mycobacterium tuberculosis
LARPGTEI

SEQ ID NO: 1538971 - protein, 19 aa, Mycobacterium tuberculosis
LDTTTEGPVTTSGATCADN

SEQ ID NO: 1538972 - protein, 7 aa, Mycobacterium tuberculosis
LGLPPGM

SEQ ID NO: 1538973 - protein, 10 aa, Mycobacterium tuberculosis
LGNAGSSNYG

SEQ ID NO: 1538974 - protein, 9 aa, Mycobacterium tuberculosis
LNSGGGQHV

SEQ ID NO: 1538975 - protein, 15 aa, Mycobacterium tuberculosis
LPLPPNARRVEDPEM

SEQ ID NO: 1538976 - protein, 4 aa, Mycobacterium tuberculosis
LRTQ

SEQ ID NO: 1538977 - protein, 10 aa, Mycobacterium tuberculosis
LSKQTGQQVS

SEQ ID NO: 1538978 - protein, 20 aa, Mycobacterium tuberculosis
NAGADADGPVATTGLYPPGS

SEQ ID NO: 1538979 - protein, 7 aa, Mycobacterium tuberculosis
NECGKTA

SEQ ID NO: 1538980 - protein, 7 aa, Mycobacterium tuberculosis
NEFPDPT

SEQ ID NO: 1538981 - protein, 25 aa, Mycobacterium tuberculosis
NGGVGGAGGYGASGDGGNAGNGGLG

SEQ ID NO: 1538982 - protein, 10 aa, Mycobacterium tuberculosis
NGHTYTTHPG

SEQ ID NO: 1538983 - protein, 8 aa, Mycobacterium tuberculosis
NGSLAGGT

SEQ ID NO: 1538984 - protein, 15 aa, Mycobacterium tuberculosis
NNPSGVGTVVFNYPP

SEQ ID NO: 1538985 - protein, 12 aa, Mycobacterium tuberculosis
NPSNRAGGSLSS

SEQ ID NO: 1538986 - protein, 10 aa, Mycobacterium tuberculosis
NTGFGSPVDQ

SEQ ID NO: 1538987 - protein, 11 aa, Mycobacterium tuberculosis
NTGGGGGSGIA

SEQ ID NO: 1538988 - protein, 13 aa, Mycobacterium tuberculosis
PAFSPPAQALGGG

SEQ ID NO: 1538989 - protein, 9 aa, Mycobacterium tuberculosis
PAPDVSQAQ

SEQ ID NO: 1538990 - protein, 77 aa, Mycobacterium tuberculosis; identical to SEQ ID NO: 230694

SEQ ID NO: 1538991 - protein, 55 aa, Mycobacterium tuberculosis; identical to SEQ ID NO: 1447554

SEQ ID NO: 1538992 - protein, 6 aa, Mycobacterium tuberculosis
PDPTEL

SEQ ID NO: 1538993 - protein, 7 aa, Mycobacterium tuberculosis
PDTPEVR

SEQ ID NO: 1538994 - protein, 12 aa, Mycobacterium tuberculosis
PGFGNSTELPSS

SEQ ID NO: 1538995 - protein, 5 aa, Mycobacterium tuberculosis
PIVGN

SEQ ID NO: 1538996 - protein, 8 aa, Mycobacterium tuberculosis
PLCTPSRG

SEQ ID NO: 1538997 - protein, 8 aa, Mycobacterium tuberculosis
PLPPAADD

SEQ ID NO: 1538998 - protein, 8 aa, Mycobacterium tuberculosis
PTARRRDA

SEQ ID NO: 1538999 - protein, 4 aa, Mycobacterium tuberculosis
PTRR

SEQ ID NO: 1539000 - protein, 6 aa, Mycobacterium tuberculosis
PTYPGD

SEQ ID NO: 1539001 - protein, 12 aa, Mycobacterium tuberculosis
QRRQDEAMRPRT

SEQ ID NO: 1539002 - protein, 7 aa, Mycobacterium tuberculosis
RAQAAGQ

SEQ ID NO: 1539003 - protein, 8 aa, Mycobacterium tuberculosis
RDEAPADL

SEQ ID NO: 1539004 - protein, 8 aa, Mycobacterium tuberculosis
RDSISEPT

SEQ ID NO: 1539005 - protein, 7 aa, Mycobacterium tuberculosis
RKDIRTT

SEQ ID NO: 1539006 - protein, 7 aa, Mycobacterium tuberculosis
RKEFGPA

SEQ ID NO: 1539007 - protein, 8 aa, Mycobacterium tuberculosis
RKRPATGW

SEQ ID NO: 1539008 - protein, 8 aa, Mycobacterium tuberculosis
RPMPLPPG

SEQ ID NO: 1539009 - protein, 5 aa, Mycobacterium tuberculosis
RQEPR

SEQ ID NO: 1539010 - protein, 4 aa, Mycobacterium tuberculosis
RRAT

SEQ ID NO: 1539011 - protein, 10 aa, Mycobacterium tuberculosis
RRSGDPVAPP

SEQ ID NO: 1539012 - protein, 7 aa, Mycobacterium tuberculosis
RSGGAAR

SEQ ID NO: 1539013 - protein, 4 aa, Mycobacterium tuberculosis
RTPA

SEQ ID NO: 1539014 - protein, 7 aa, Mycobacterium tuberculosis
RTTTPYT

SEQ ID NO: 1539015 - protein, 7 aa, Mycobacterium tuberculosis
RYPQSNG

SEQ ID NO: 1539016 - protein, 9 aa, Mycobacterium tuberculosis
RYRPADSAA

SEQ ID NO: 1539017 - protein, 19 aa, Mycobacterium tuberculosis
SAAAADNIPGTTITFDIAA

SEQ ID NO: 1539018 - protein, 6 aa, Mycobacterium tuberculosis
SADGYR

SEQ ID NO: 1539019 - protein, 5 aa, Mycobacterium tuberculosis
SAGPI

SEQ ID NO: 1539020 - protein, 25 aa, Mycobacterium tuberculosis
SALDAQPDPHLSGDEPPSRPLTPET

SEQ ID NO: 1539021 - protein, 11 aa, Mycobacterium tuberculosis
SASESRNVLGT

SEQ ID NO: 1539022 - protein, 11 aa, Mycobacterium tuberculosis
SASRPAAPIPL

SEQ ID NO: 1539023 - protein, 6 aa, Mycobacterium tuberculosis
SDEGIQ

SEQ ID NO: 1539024 - protein, 5 aa, Mycobacterium tuberculosis
SELST

SEQ ID NO: 1539025 - protein, 10 aa, Mycobacterium tuberculosis
SGAHRPTPTI

SEQ ID NO: 1539026 - protein, 12 aa, Mycobacterium tuberculosis
SGGSGGSGQPSI

SEQ ID NO: 1539027 - protein, 5 aa, Mycobacterium tuberculosis
SPAAA

SEQ ID NO: 1539028 - protein, 10 aa, Mycobacterium tuberculosis
SPDTQDTRAV

SEQ ID NO: 1539029 - protein, 5 aa, Mycobacterium tuberculosis
SPSNA

SEQ ID NO: 1539030 - protein, 7 aa, Mycobacterium tuberculosis
SSASRRI

SEQ ID NO: 1539031 - protein, 5 aa, Mycobacterium tuberculosis
SSNPL

SEQ ID NO: 1539032 - protein, 9 aa, Mycobacterium tuberculosis
SSPAALGAK

SEQ ID NO: 1539033 - protein, 5 aa, Mycobacterium tuberculosis
TADEA

SEQ ID NO: 1539034 - protein, 9 aa, Mycobacterium tuberculosis
TANAGSFNV

SEQ ID NO: 1539035 - protein, 28 aa, Mycobacterium tuberculosis
TDFAGSDVPLNPSTGQPDRSAERCGSPA

SEQ ID NO: 1539036 - protein, 5 aa, Mycobacterium tuberculosis
TGAGA

SEQ ID NO: 1539037 - protein, 4 aa, Mycobacterium tuberculosis
TGGG

SEQ ID NO: 1539038 - protein, 4 aa, Mycobacterium tuberculosis
TGGI

SEQ ID NO: 1539039 - protein, 12 aa, Mycobacterium tuberculosis
TGQTTGYAPPGT

SEQ ID NO: 1539040 - protein, 11 aa, Mycobacterium tuberculosis
THSAPEVSNEN

SEQ ID NO: 1539041 - protein, 9 aa, Mycobacterium tuberculosis
TKDTGTSRR

SEQ ID NO: 1539042 - protein, 6 aa, Mycobacterium tuberculosis
TLYDAG

SEQ ID NO: 1539043 - protein, 18 aa, Mycobacterium tuberculosis
TPGVEGHPYRQRATPIPT

SEQ ID NO: 1539044 - protein, 12 aa, Mycobacterium tuberculosis
TPPTAPPGTPGE

SEQ ID NO: 1539045 - protein, 4 aa, Mycobacterium tuberculosis
TPTE

SEQ ID NO: 1539046 - protein, 8 aa, Mycobacterium tuberculosis
TPTPAPLH

SEQ ID NO: 1539047 - protein, 15 aa, Mycobacterium tuberculosis
TQETTPVRGTPSGLC

SEQ ID NO: 1539048 - protein, 8 aa, Mycobacterium tuberculosis
TTDGALPS

SEQ ID NO: 1539049 - protein, 22 aa, Mycobacterium tuberculosis
TTGGHRAGVRAPAPPPRPPTVK

SEQ ID NO: 1539050 - protein, 26 aa, Mycobacterium tuberculosis
TTSPAGIANADDAGLDPNAAAGPDAV

SEQ ID NO: 1539051 - protein, 10 aa, Mycobacterium tuberculosis
VETAQRRGEI

SEQ ID NO: 1539052 - protein, 7 aa, Mycobacterium tuberculosis
VGHDDRG

SEQ ID NO: 1539053 - protein, 9 aa, Mycobacterium tuberculosis
VGPTGKVKA

SEQ ID NO: 1539054 - protein, 10 aa, Mycobacterium tuberculosis
VGSGPTIGGV

SEQ ID NO: 1539055 - protein, 15 aa, Mycobacterium tuberculosis
VSPAGSGKSTTIPLS

SEQ ID NO: 1539056 - protein, 13 aa, Mycobacterium tuberculosis
VTPGRQDTTRLRR

SEQ ID NO: 1539057 - protein, 18 aa, Mycobacterium tuberculosis
VTRADGGKSGIGRGYGGA

SEQ ID NO: 1539058 - protein, 11 aa, Mycobacterium tuberculosis
WADGASAAANT

SEQ ID NO: 1539059 - protein, 5 aa, Mycobacterium tuberculosis
WPGAG

SEQ ID NO: 1539060 - protein, 9 aa, Mycobacterium tuberculosis
WPLGPTHPS

SEQ ID NO: 1539061 - protein, 18 aa, Mycobacterium tuberculosis
AAADPATPQPNPTQQLPG

SEQ ID NO: 1539062 - protein, 8 aa, Mycobacterium tuberculosis
AAEQGMGP

SEQ ID NO: 1539063 - protein, 7 aa, Mycobacterium tuberculosis
AAGAGAA

SEQ ID NO: 1539064 - protein, 13 aa, Mycobacterium tuberculosis
AALTAAATDIDGI

SEQ ID NO: 1539065 - protein, 9 aa, Mycobacterium tuberculosis
ADLATREEQ

SEQ ID NO: 1539066 - protein, 4 aa, Mycobacterium tuberculosis
AEPH

SEQ ID NO: 1539067 - protein, 5 aa, Mycobacterium tuberculosis
AEPSA

SEQ ID NO: 1539068 - protein, 6 aa, Mycobacterium tuberculosis
AFPHDS

SEQ ID NO: 1539069 - protein, 8 aa, Mycobacterium tuberculosis
AGADEVSA

SEQ ID NO: 1539070 - protein, 6 aa, Mycobacterium tuberculosis
AGCTND

SEQ ID NO: 1539071 - protein, 14 aa, Mycobacterium tuberculosis
AGDVQTAQHASEAA

SEQ ID NO: 1539072 - protein, 15 aa, Mycobacterium tuberculosis
AGGAGGNGGAGGAAG

SEQ ID NO: 1539073 - protein, 4 aa, Mycobacterium tuberculosis
AGIG

SEQ ID NO: 1539074 - protein, 9 aa, Mycobacterium tuberculosis
AGKDYDEVA

SEQ ID NO: 1539075 - protein, 8 aa, Mycobacterium tuberculosis
AGSADGAG

SEQ ID NO: 1539076 - protein, 8 aa, Mycobacterium tuberculosis
AITGSGDD

SEQ ID NO: 1539077 - protein, 7 aa, Mycobacterium tuberculosis
AKLPQDR

SEQ ID NO: 1539078 - protein, 9 aa, Mycobacterium tuberculosis
ALPAGLPPL

SEQ ID NO: 1539079 - protein, 46 aa, Mycobacterium tuberculosis
ALPGGSSNRFSPAPAPAPIASPIPVGAPGSTAVPPLPPPVTPAISG

SEQ ID NO: 1539080 - protein, 18 aa, Mycobacterium tuberculosis
APPIPSPQPLKSGDTIGL

SEQ ID NO: 1539081 - protein, 14 aa, Mycobacterium tuberculosis
ARAESVRAATDGTT

SEQ ID NO: 1539082 - protein, 8 aa, Mycobacterium tuberculosis
ARGQSVHT

SEQ ID NO: 1539083 - protein, 14 aa, Mycobacterium tuberculosis
ASAAAVDTNCGATL

SEQ ID NO: 1539084 - protein, 7 aa, Mycobacterium tuberculosis
ASEQGRG

SEQ ID NO: 1539085 - protein, 10 aa, Mycobacterium tuberculosis
ATESNPTAAS

SEQ ID NO: 1539086 - protein, 14 aa, Mycobacterium tuberculosis
DAAQAAKGSTITPR

SEQ ID NO: 1539087 - protein, 4 aa, Mycobacterium tuberculosis
DALD

SEQ ID NO: 1539088 - protein, 8 aa, Mycobacterium tuberculosis
DASASSQF

SEQ ID NO: 1539089 - protein, 7 aa, Mycobacterium tuberculosis
DAVSTDD

SEQ ID NO: 1539090 - protein, 10 aa, Mycobacterium tuberculosis
DDNAKPANSH

SEQ ID NO: 1539091 - protein, 6 aa, Mycobacterium tuberculosis
DGGGAV

SEQ ID NO: 1539092 - protein, 26 aa, Mycobacterium tuberculosis
DPADSELDRRQAQRVPVDRPGRGLSR

SEQ ID NO: 1539093 - protein, 5 aa, Mycobacterium tuberculosis
DRDAM

SEQ ID NO: 1539094 - protein, 7 aa, Mycobacterium tuberculosis
DRPINSA

SEQ ID NO: 1539095 - protein, 6 aa, Mycobacterium tuberculosis
DSDRYR

SEQ ID NO: 1539096 - protein, 8 aa, Mycobacterium tuberculosis
DTARGGQI

SEQ ID NO: 1539097 - protein, 7 aa, Mycobacterium tuberculosis
DTNTSMG

SEQ ID NO: 1539098 - protein, 4 aa, Mycobacterium tuberculosis
DVAS

SEQ ID NO: 1539099 - protein, 4 aa, Mycobacterium tuberculosis
DYAR

SEQ ID NO: 1539100 - protein, 6 aa, Mycobacterium tuberculosis
EHEPSD

SEQ ID NO: 1539101 - protein, 4 aa, Mycobacterium tuberculosis
FAGR

SEQ ID NO: 1539102 - protein, 5 aa, Mycobacterium tuberculosis
FGNSG

SEQ ID NO: 1539103 - protein, 14 aa, Mycobacterium tuberculosis
GAVGTASSPDGQDG

SEQ ID NO: 1539104 - protein, 6 aa, Mycobacterium tuberculosis
GDFPES

SEQ ID NO: 1539105 - protein, 8 aa, Mycobacterium tuberculosis
GDTGYTKS

SEQ ID NO: 1539106 - protein, 4 aa, Mycobacterium tuberculosis
GEGN

SEQ ID NO: 1539107 - protein, 7 aa, Mycobacterium tuberculosis
GEQDRLR

SEQ ID NO: 1539108 - protein, 9 aa, Mycobacterium tuberculosis
GGGNLGGQN

SEQ ID NO: 1539109 - protein, 7 aa, Mycobacterium tuberculosis
GGPGAGF

SEQ ID NO: 1539110 - protein, 17 aa, Mycobacterium tuberculosis
GGYNTGIGNGGTGSTGL

SEQ ID NO: 1539111 - protein, 16 aa, Mycobacterium tuberculosis
GKVDKDWDADATKGIP

SEQ ID NO: 1539112 - protein, 7 aa, Mycobacterium tuberculosis
GLGGHPR

SEQ ID NO: 1539113 - protein, 10 aa, Mycobacterium tuberculosis
GLGNAGSLAS

SEQ ID NO: 1539114 - protein, 6 aa, Mycobacterium tuberculosis
GMSPAE

SEQ ID NO: 1539115 - protein, 9 aa, Mycobacterium tuberculosis
GNAGSNNVG

SEQ ID NO: 1539116 - protein, 15 aa, Mycobacterium tuberculosis
GNANTGVANSGTVNT

SEQ ID NO: 1539117 - protein, 7 aa, Mycobacterium tuberculosis
GNPKNIR

SEQ ID NO: 1539118 - protein, 4 aa, Mycobacterium tuberculosis
GNTG

SEQ ID NO: 1539119 - protein, 11 aa, Mycobacterium tuberculosis
GPRHTAPATPG

SEQ ID NO: 1539120 - protein, 6 aa, Mycobacterium tuberculosis
GPRPTE

SEQ ID NO: 1539121 - protein, 4 aa, Mycobacterium tuberculosis
GQAR

SEQ ID NO: 1539122 - protein, 10 aa, Mycobacterium tuberculosis
GRIEPGPGAR

SEQ ID NO: 1539123 - protein, 4 aa, Mycobacterium tuberculosis
GRSG

SEQ ID NO: 1539124 - protein, 10 aa, Mycobacterium tuberculosis
GSAKQAERSY

SEQ ID NO: 1539125 - protein, 10 aa, Mycobacterium tuberculosis
GSANHGSPNV

SEQ ID NO: 1539126 - protein, 5 aa, Mycobacterium tuberculosis
GSAPM

SEQ ID NO: 1539127 - protein, 5 aa, Mycobacterium tuberculosis
GTATA

SEQ ID NO: 1539128 - protein, 9 aa, Mycobacterium tuberculosis
GTENPSGPI

SEQ ID NO: 1539129 - protein, 6 aa, Mycobacterium tuberculosis
GVDPAT

SEQ ID NO: 1539130 - protein, 15 aa, Mycobacterium tuberculosis
HDNPGVAPKDELRDQ

SEQ ID NO: 1539131 - protein, 28 aa, Mycobacterium tuberculosis
HESNTYVAEPGPDAPALTGDRSARSAIP

SEQ ID NO: 1539132 - protein, 13 aa, Mycobacterium tuberculosis
HGAPGTGQPGGAG

SEQ ID NO: 1539133 - protein, 18 aa, Mycobacterium tuberculosis
HGGPSDVVGRAGPDRAHT

SEQ ID NO: 1539134 - protein, 16 aa, Mycobacterium tuberculosis
HGVSGGTEIRRSDAPR

SEQ ID NO: 1539135 - protein, 5 aa, Mycobacterium tuberculosis
HPDPA

SEQ ID NO: 1539136 - protein, 7 aa, Mycobacterium tuberculosis
HVTPPQT

SEQ ID NO: 1539137 - protein, 9 aa, Mycobacterium tuberculosis
IDGDPTKVR

SEQ ID NO: 1539138 - protein, 7 aa, Mycobacterium tuberculosis
IETATAA

SEQ ID NO: 1539139 - protein, 8 aa, Mycobacterium tuberculosis
IETATAAS

SEQ ID NO: 1539140 - protein, 10 aa, Mycobacterium tuberculosis
IKQAEGQKQA

SEQ ID NO: 1539141 - protein, 4 aa, Mycobacterium tuberculosis
IPNN

SEQ ID NO: 1539142 - protein, 5 aa, Mycobacterium tuberculosis
KAGFS

SEQ ID NO: 1539143 - protein, 9 aa, Mycobacterium tuberculosis
KQAEGQKQA

SEQ ID NO: 1539144 - protein, 6 aa, Mycobacterium tuberculosis
LPEEPW

SEQ ID NO: 1539145 - protein, 16 aa, Mycobacterium tuberculosis
LPNPTAPALASGPAAL

SEQ ID NO: 1539146 - protein, 11 aa, Mycobacterium tuberculosis
LPSGRALESRP

SEQ ID NO: 1539147 - protein, 8 aa, Mycobacterium tuberculosis
LRDDGTTT

SEQ ID NO: 1539148 - protein, 4 aa, Mycobacterium tuberculosis
MGQG

SEQ ID NO: 1539149 - protein, 30 aa, Mycobacterium tuberculosis; identical to SEQ ID NO: 1431078

SEQ ID NO: 1539150 - protein, 12 aa, Mycobacterium tuberculosis
NADPLGSATGSV

SEQ ID NO: 1539151 - protein, 6 aa, Mycobacterium tuberculosis
NAPTQA

SEQ ID NO: 1539152 - protein, 21 aa, Mycobacterium tuberculosis
NGGAGGSGAPGGIGAGGNGGN

SEQ ID NO: 1539153 - protein, 31 aa, Mycobacterium tuberculosis; identical to SEQ ID NO: 232262

SEQ ID NO: 1539154 - protein, 8 aa, Mycobacterium tuberculosis
NGTAKEIA

SEQ ID NO: 1539155 - protein, 7 aa, Mycobacterium tuberculosis
NLGDGNV

SEQ ID NO: 1539156 - protein, 12 aa, Mycobacterium tuberculosis
NPEPTPLSGSAT

SEQ ID NO: 1539157 - protein, 6 aa, Mycobacterium tuberculosis
NQHPNA

SEQ ID NO: 1539158 - protein, 6 aa, Mycobacterium tuberculosis
NRRDEA

SEQ ID NO: 1539159 - protein, 5 aa, Mycobacterium tuberculosis
NSGEG

SEQ ID NO: 1539160 - protein, 41 aa, Mycobacterium tuberculosis; identical to SEQ ID NO: 230652

SEQ ID NO: 1539161 - protein, 10 aa, Mycobacterium tuberculosis
NWGDPGRRST

SEQ ID NO: 1539162 - protein, 6 aa, Mycobacterium tuberculosis
PADGRR

SEQ ID NO: 1539163 - protein, 5 aa, Mycobacterium tuberculosis
PAEFE

SEQ ID NO: 1539164 - protein, 48 aa, Mycobacterium tuberculosis; identical to SEQ ID NO: 1438742

SEQ ID NO: 1539165 - protein, 5 aa, Mycobacterium tuberculosis
PDGLG

SEQ ID NO: 1539166 - protein, 5 aa, Mycobacterium tuberculosis
PEMPE

SEQ ID NO: 1539167 - protein, 4 aa, Mycobacterium tuberculosis
PEPG

SEQ ID NO: 1539168 - protein, 5 aa, Mycobacterium tuberculosis
PGPVA

SEQ ID NO: 1539169 - protein, 6 aa, Mycobacterium tuberculosis
PHSGRW

SEQ ID NO: 1539170 - protein, 4 aa, Mycobacterium tuberculosis
PKLG

SEQ ID NO: 1539171 - protein, 14 aa, Mycobacterium tuberculosis
PLQSPSVTDDEPTR

SEQ ID NO: 1539172 - protein, 5 aa, Mycobacterium tuberculosis
PLRSP

SEQ ID NO: 1539173 - protein, 13 aa, Mycobacterium tuberculosis
PSAFQTRPSGLPG

SEQ ID NO: 1539174 - protein, 11 aa, Mycobacterium tuberculosis
PSAQAEPETCP

SEQ ID NO: 1539175 - protein, 10 aa, Mycobacterium tuberculosis
PSPLSSGSAK

SEQ ID NO: 1539176 - protein, 10 aa, Mycobacterium tuberculosis
PTALGSGYGL

SEQ ID NO: 1539177 - protein, 10 aa, Mycobacterium tuberculosis
PTARGTASTV

SEQ ID NO: 1539178 - protein, 7 aa, Mycobacterium tuberculosis
QGNPIRV

SEQ ID NO: 1539179 - protein, 11 aa, Mycobacterium tuberculosis
QLDSTGPGQAI

SEQ ID NO: 1539180 - protein, 16 aa, Mycobacterium tuberculosis
QPAGCPDAKPSPPAAY

SEQ ID NO: 1539181 - protein, 9 aa, Mycobacterium tuberculosis
QRARQTGAQ

SEQ ID NO: 1539182 - protein, 6 aa, Mycobacterium tuberculosis
RAGDEL

SEQ ID NO: 1539183 - protein, 4 aa, Mycobacterium tuberculosis
RATP

SEQ ID NO: 1539184 - protein, 7 aa, Mycobacterium tuberculosis
RDLATPE

SEQ ID NO: 1539185 - protein, 16 aa, Mycobacterium tuberculosis
RGDIGGMSTATGPEGL

SEQ ID NO: 1539186 - protein, 4 aa, Mycobacterium tuberculosis
RGRD

SEQ ID NO: 1539187 - protein, 9 aa, Mycobacterium tuberculosis
RLGDSRGDI

SEQ ID NO: 1539188 - protein, 9 aa, Mycobacterium tuberculosis
RPGSGREAT

SEQ ID NO: 1539189 - protein, 9 aa, Mycobacterium tuberculosis
RSGMQRQEA

SEQ ID NO: 1539190 - protein, 13 aa, Mycobacterium tuberculosis
SAESGVPTFRDDK

SEQ ID NO: 1539191 - protein, 7 aa, Mycobacterium tuberculosis
SGGSTIP

SEQ ID NO: 1539192 - protein, 5 aa, Mycobacterium tuberculosis
SGGTR

SEQ ID NO: 1539193 - protein, 8 aa, Mycobacterium tuberculosis
SGPPQVPW

SEQ ID NO: 1539194 - protein, 6 aa, Mycobacterium tuberculosis
SGVHER

SEQ ID NO: 1539195 - protein, 6 aa, Mycobacterium tuberculosis
SKSALR

SEQ ID NO: 1539196 - protein, 13 aa, Mycobacterium tuberculosis
SQGAISKGQRGGN

SEQ ID NO: 1539197 - protein, 10 aa, Mycobacterium tuberculosis
SRLPPRGLTQ

SEQ ID NO: 1539198 - protein, 15 aa, Mycobacterium tuberculosis
SSAGAYASAEATNVE

SEQ ID NO: 1539199 - protein, 4 aa, Mycobacterium tuberculosis
SSTI

SEQ ID NO: 1539200 - protein, 15 aa, Mycobacterium tuberculosis
STALERAEDPILNGS

SEQ ID NO: 1539201 - protein, 15 aa, Mycobacterium tuberculosis
STGAGAYASAEAAAA

SEQ ID NO: 1539202 - protein, 10 aa, Mycobacterium tuberculosis
STLSGPPLTT

SEQ ID NO: 1539203 - protein, 8 aa, Mycobacterium tuberculosis
TDRGSQYT

SEQ ID NO: 1539204 - protein, 7 aa, Mycobacterium tuberculosis
TDTYDAA

SEQ ID NO: 1539205 - protein, 9 aa, Mycobacterium tuberculosis
TESVGKTIA

SEQ ID NO: 1539206 - protein, 6 aa, Mycobacterium tuberculosis
TGADAL

SEQ ID NO: 1539207 - protein, 9 aa, Mycobacterium tuberculosis
TGAGGSYAL

SEQ ID NO: 1539208 - protein, 9 aa, Mycobacterium tuberculosis
TGETCGTVE

SEQ ID NO: 1539209 - protein, 7 aa, Mycobacterium tuberculosis
TGHTPTV

SEQ ID NO: 1539210 - protein, 86 aa, Mycobacterium tuberculosis; identical to SEQ ID NO: 232992

SEQ ID NO: 1539211 - protein, 10 aa, Mycobacterium tuberculosis
TKVPPPAADY

SEQ ID NO: 1539212 - protein, 5 aa, Mycobacterium tuberculosis
TLAGK

SEQ ID NO: 1539213 - protein, 22 aa, Mycobacterium tuberculosis
TNSTPYQPDPTRAHTPASNYGA

SEQ ID NO: 1539214 - protein, 14 aa, Mycobacterium tuberculosis
TPDPEPDPPATHAP

SEQ ID NO: 1539215 - protein, 11 aa, Mycobacterium tuberculosis
TQLDPCQSPRP

SEQ ID NO: 1539216 - protein, 4 aa, Mycobacterium tuberculosis
TRGP

SEQ ID NO: 1539217 - protein, 17 aa, Mycobacterium tuberculosis
TTASNSPVVTADPRLNT

SEQ ID NO: 1539218 - protein, 7 aa, Mycobacterium tuberculosis
TTDSGLT

SEQ ID NO: 1539219 - protein, 10 aa, Mycobacterium tuberculosis
TTIGDEDRNF

SEQ ID NO: 1539220 - protein, 5 aa, Mycobacterium tuberculosis
TVDPA

SEQ ID NO: 1539221 - protein, 7 aa, Mycobacterium tuberculosis
TVSASEG

SEQ ID NO: 1539222 - protein, 10 aa, Mycobacterium tuberculosis
TVTGSVPPTV

SEQ ID NO: 1539223 - protein, 7 aa, Mycobacterium tuberculosis
VEATGSA

SEQ ID NO: 1539224 - protein, 15 aa, Mycobacterium tuberculosis
VGGTATAGAFSRPGL

SEQ ID NO: 1539225 - protein, 11 aa, Mycobacterium tuberculosis
VGRSKAQSARD

SEQ ID NO: 1539226 - protein, 19 aa, Mycobacterium tuberculosis
VTRADGGKSGIGRGYGGAR

SEQ ID NO: 1539227 - protein, 7 aa, Mycobacterium tuberculosis
VTTDDVR

SEQ ID NO: 1539228 - protein, 5 aa, Mycobacterium tuberculosis
WGADE

SEQ ID NO: 1539229 - protein, 9 aa, Mycobacterium tuberculosis
YPEPPPPGM

SEQ ID NO: 1539230 - protein, 8 aa, Mycobacterium tuberculosis
YTPPEAEE

SEQ ID NO: 1539231 - protein, 17 aa, Mycobacterium tuberculosis
AAAQTSAVQAAAADEVS

SEQ ID NO: 1539232 - protein, 5 aa, Mycobacterium tuberculosis
AAAVN

SEQ ID NO: 1539233 - protein, 10 aa, Mycobacterium tuberculosis
AAGAPPSCAG

SEQ ID NO: 1539234 - protein, 8 aa, Mycobacterium tuberculosis
AAGGGLAS

SEQ ID NO: 1539235 - protein, 4 aa, Mycobacterium tuberculosis
AAIP

SEQ ID NO: 1539236 - protein, 9 aa, Mycobacterium tuberculosis
AAPGLGKTK

SEQ ID NO: 1539237 - protein, 17 aa, Mycobacterium tuberculosis
AATRALSAAAQAKAAAA

SEQ ID NO: 1539238 - protein, 8 aa, Mycobacterium tuberculosis
AATTKTLP

SEQ ID NO: 1539239 - protein, 8 aa, Mycobacterium tuberculosis
ADATTGTI

SEQ ID NO: 1539240 - protein, 15 aa, Mycobacterium tuberculosis
ADDANAVCVQALVAV

SEQ ID NO: 1539241 - protein, 8 aa, Mycobacterium tuberculosis
ADLATREE

SEQ ID NO: 1539242 - protein, 6 aa, Mycobacterium tuberculosis
ADPKLA

SEQ ID NO: 1539243 - protein, 7 aa, Mycobacterium tuberculosis
ADTGLDA

SEQ ID NO: 1539244 - protein, 6 aa, Mycobacterium tuberculosis
AESGAH

SEQ ID NO: 1539245 - protein, 9 aa, Mycobacterium tuberculosis
AGGNGGDGG

SEQ ID NO: 1539246 - protein, 17 aa, Mycobacterium tuberculosis
AGIQPSVGAVGSSYDNA

SEQ ID NO: 1539247 - protein, 5 aa, Mycobacterium tuberculosis
AGLPG

SEQ ID NO: 1539248 - protein, 10 aa, Mycobacterium tuberculosis
AGTPATTMPI

SEQ ID NO: 1539249 - protein, 22 aa, Mycobacterium tuberculosis
ALPGGSSNRFSPAPAPAPIASP

SEQ ID NO: 1539250 - protein, 15 aa, Mycobacterium tuberculosis
ALSTANAAAAAPTTA

SEQ ID NO: 1539251 - protein, 21 aa, Mycobacterium tuberculosis
APPLAGATEEPGAGQTPGAPV

SEQ ID NO: 1539252 - protein, 22 aa, Mycobacterium tuberculosis
APVTPSDAPTPSGTPTTTNGPG

SEQ ID NO: 1539253 - protein, 5 aa, Mycobacterium tuberculosis
AQTHV

SEQ ID NO: 1539254 - protein, 8 aa, Mycobacterium tuberculosis
ARLDESVP

SEQ ID NO: 1539255 - protein, 24 aa, Mycobacterium tuberculosis
ARRSPNASTKARRTHGPAAKRFRA

SEQ ID NO: 1539256 - protein, 8 aa, Mycobacterium tuberculosis
ARTESRGC

SEQ ID NO: 1539257 - protein, 9 aa, Mycobacterium tuberculosis
ASGETGTEI

SEQ ID NO: 1539258 - protein, 4 aa, Mycobacterium tuberculosis
ASPL

SEQ ID NO: 1539259 - protein, 5 aa, Mycobacterium tuberculosis
ATDMP

SEQ ID NO: 1539260 - protein, 4 aa, Mycobacterium tuberculosis
ATGF

SEQ ID NO: 1539261 - protein, 11 aa, Mycobacterium tuberculosis
ATPPNSTRPNL

SEQ ID NO: 1539262 - protein, 15 aa, Mycobacterium tuberculosis
ATSTQPSTAPPTSRV

SEQ ID NO: 1539263 - protein, 12 aa, Mycobacterium tuberculosis
ATTNPAGSTGDG

SEQ ID NO: 1539264 - protein, 7 aa, Mycobacterium tuberculosis
AVETTRS

SEQ ID NO: 1539265 - protein, 11 aa, Mycobacterium tuberculosis
AVGHDGKAVPV

SEQ ID NO: 1539266 - protein, 15 aa, Mycobacterium tuberculosis
AVSGNSGVDPDQAAR

SEQ ID NO: 1539267 - protein, 14 aa, Mycobacterium tuberculosis
CARSPACPLGTDSA

SEQ ID NO: 1539268 - protein, 16 aa, Mycobacterium tuberculosis
CSSAPTPSANAANHGH

SEQ ID NO: 1539269 - protein, 5 aa, Mycobacterium tuberculosis
DALDE

SEQ ID NO: 1539270 - protein, 8 aa, Mycobacterium tuberculosis
DDDGTERK

SEQ ID NO: 1539271 - protein, 8 aa, Mycobacterium tuberculosis
DDTEVGVP

SEQ ID NO: 1539272 - protein, 6 aa, Mycobacterium tuberculosis
DEAQGA

SEQ ID NO: 1539273 - protein, 7 aa, Mycobacterium tuberculosis
DGAYGAQ

SEQ ID NO: 1539274 - protein, 7 aa, Mycobacterium tuberculosis
DGSPVTA

SEQ ID NO: 1539275 - protein, 7 aa, Mycobacterium tuberculosis
DHDLADT

SEQ ID NO: 1539276 - protein, 15 aa, Mycobacterium tuberculosis
DISHPPNPSCDTCHA

SEQ ID NO: 1539277 - protein, 5 aa, Mycobacterium tuberculosis
DIYGD

SEQ ID NO: 1539278 - protein, 8 aa, Mycobacterium tuberculosis
DNDDSVDA

SEQ ID NO: 1539279 - protein, 8 aa, Mycobacterium tuberculosis
DPAGNTDR

SEQ ID NO: 1539280 - protein, 6 aa, Mycobacterium tuberculosis
DPARRT

SEQ ID NO: 1539281 - protein, 8 aa, Mycobacterium tuberculosis
DPVEVTGS

SEQ ID NO: 1539282 - protein, 16 aa, Mycobacterium tuberculosis
DVQPAGSVPIPDGPAQ

SEQ ID NO: 1539283 - protein, 11 aa, Mycobacterium tuberculosis
EALGRSGTIAG

SEQ ID NO: 1539284 - protein, 7 aa, Mycobacterium tuberculosis
EGIKESV

SEQ ID NO: 1539285 - protein, 28 aa, Mycobacterium tuberculosis
ELGQAANSFSSATAALADTAWQGPAATA

SEQ ID NO: 1539286 - protein, 4 aa, Mycobacterium tuberculosis
ENAR

SEQ ID NO: 1539287 - protein, 15 aa, Mycobacterium tuberculosis
EPTNPDSAALGVPAP

SEQ ID NO: 1539288 - protein, 10 aa, Mycobacterium tuberculosis
EVRGPTGYDG

SEQ ID NO: 1539289 - protein, 4 aa, Mycobacterium tuberculosis
FDEQ

SEQ ID NO: 1539290 - protein, 4 aa, Mycobacterium tuberculosis
FDPA

SEQ ID NO: 1539291 - protein, 7 aa, Mycobacterium tuberculosis
GAYSRDR

SEQ ID NO: 1539292 - protein, 11 aa, Mycobacterium tuberculosis
GDQGASGRRTS

SEQ ID NO: 1539293 - protein, 4 aa, Mycobacterium tuberculosis
GDSN

SEQ ID NO: 1539294 - protein, 8 aa, Mycobacterium tuberculosis
GFGNGNSV

SEQ ID NO: 1539295 - protein, 46 aa, Mycobacterium tuberculosis; identical to SEQ ID NO: 229834

SEQ ID NO: 1539296 - protein, 22 aa, Mycobacterium tuberculosis
GGGTNSSSSGAGGTSGSVHCGG

SEQ ID NO: 1539297 - protein, 7 aa, Mycobacterium tuberculosis
GHDKNGD

SEQ ID NO: 1539298 - protein, 13 aa, Mycobacterium tuberculosis
GHPDPSSGTIDAP

SEQ ID NO: 1539299 - protein, 6 aa, Mycobacterium tuberculosis
GKGEYG

SEQ ID NO: 1539300 - protein, 7 aa, Mycobacterium tuberculosis
GLYGRSD

SEQ ID NO: 1539301 - protein, 13 aa, Mycobacterium tuberculosis
GMGGNGGATSVGG

SEQ ID NO: 1539302 - protein, 14 aa, Mycobacterium tuberculosis
GNARADRARNTYTV

SEQ ID NO: 1539303 - protein, 13 aa, Mycobacterium tuberculosis
GNPSNRAGGSLSS

SEQ ID NO: 1539304 - protein, 6 aa, Mycobacterium tuberculosis
GPDVTE

SEQ ID NO: 1539305 - protein, 26 aa, Mycobacterium tuberculosis
GPGQGWGYPQPRSGQRARRATGQGSG

SEQ ID NO: 1539306 - protein, 15 aa, Mycobacterium tuberculosis
GQAPRAAAEEPGRWS

SEQ ID NO: 1539307 - protein, 9 aa, Mycobacterium tuberculosis
GQAQTVPRK

SEQ ID NO: 1539308 - protein, 10 aa, Mycobacterium tuberculosis
GSEIGGSTRI

SEQ ID NO: 1539309 - protein, 24 aa, Mycobacterium tuberculosis
GSGGNGGSGLAGSGQKGGNGGAAG

SEQ ID NO: 1539310 - protein, 15 aa, Mycobacterium tuberculosis
GSTVSAASAAASAPT

SEQ ID NO: 1539311 - protein, 11 aa, Mycobacterium tuberculosis
GSVKKQTAIEP

SEQ ID NO: 1539312 - protein, 17 aa, Mycobacterium tuberculosis
GSYNTGIGNSGTGSTGL

SEQ ID NO: 1539313 - protein, 4 aa, Mycobacterium tuberculosis
GWTG

SEQ ID NO: 1539314 - protein, 26 aa, Mycobacterium tuberculosis
HGGAGGAGGIGSADGGLGGGGGNGRF

SEQ ID NO: 1539315 - protein, 6 aa, Mycobacterium tuberculosis
KLTTAG

SEQ ID NO: 1539316 - protein, 8 aa, Mycobacterium tuberculosis
KPGKPWRS

SEQ ID NO: 1539317 - protein, 21 aa, Mycobacterium tuberculosis
KPHRAGDSADRSAGDFDGTAH

SEQ ID NO: 1539318 - protein, 10 aa, Mycobacterium tuberculosis
KQGRTTGNSC

SEQ ID NO: 1539319 - protein, 11 aa, Mycobacterium tuberculosis
LAEKRPPPAPR

SEQ ID NO: 1539320 - protein, 9 aa, Mycobacterium tuberculosis
LASPGSVSR

SEQ ID NO: 1539321 - protein, 9 aa, Mycobacterium tuberculosis
LDRGSGNSV

SEQ ID NO: 1539322 - protein, 4 aa, Mycobacterium tuberculosis
LNDP

SEQ ID NO: 1539323 - protein, 5 aa, Mycobacterium tuberculosis
LPEGT

SEQ ID NO: 1539324 - protein, 27 aa, Mycobacterium tuberculosis
LPEPDPQPADAPPPGDVTEAPAETPQV

SEQ ID NO: 1539325 - protein, 13 aa, Mycobacterium tuberculosis
LPPPAAKPAATQI

SEQ ID NO: 1539326 - protein, 6 aa, Mycobacterium tuberculosis
LQTGTG

SEQ ID NO: 1539327 - protein, 5 aa, Mycobacterium tuberculosis
LRDGG

SEQ ID NO: 1539328 - protein, 13 aa, Mycobacterium tuberculosis
MSAGAQGNSNVTN

SEQ ID NO: 1539329 - protein, 8 aa, Mycobacterium tuberculosis
NADEPGCS

SEQ ID NO: 1539330 - protein, 6 aa, Mycobacterium tuberculosis
NAPAIA

SEQ ID NO: 1539331 - protein, 17 aa, Mycobacterium tuberculosis
NGANGKPGTGQDGGAGG

SEQ ID NO: 1539332 - protein, 21 aa, Mycobacterium tuberculosis
NGGAGGAGGAGGIGAGGAGGF

SEQ ID NO: 1539333 - protein, 9 aa, Mycobacterium tuberculosis
NGGNGGIGG

SEQ ID NO: 1539334 - protein, 25 aa, Mycobacterium tuberculosis
NGGTGGSGGAGGAGSVGNGGAGGNA

SEQ ID NO: 1539335 - protein, 10 aa, Mycobacterium tuberculosis
NPAATTIPGR

SEQ ID NO: 1539336 - protein, 5 aa, Mycobacterium tuberculosis
PAAGY

SEQ ID NO: 1539337 - protein, 7 aa, Mycobacterium tuberculosis
PADSAAD

SEQ ID NO: 1539338 - protein, 4 aa, Mycobacterium tuberculosis
PATI

SEQ ID NO: 1539339 - protein, 9 aa, Mycobacterium tuberculosis
PAVSPIEES

SEQ ID NO: 1539340 - protein, 23 aa, Mycobacterium tuberculosis
PDAARRVAKRSDAARARGDELGP

SEQ ID NO: 1539341 - protein, 5 aa, Mycobacterium tuberculosis
PGALG

SEQ ID NO: 1539342 - protein, 8 aa, Mycobacterium tuberculosis
PISDKAAV

SEQ ID NO: 1539343 - protein, 16 aa, Mycobacterium tuberculosis
PMGYQQGTGPTAGVPG

SEQ ID NO: 1539344 - protein, 9 aa, Mycobacterium tuberculosis
PRGVGHSTP

SEQ ID NO: 1539345 - protein, 12 aa, Mycobacterium tuberculosis
PWADGASAAANT

SEQ ID NO: 1539346 - protein, 9 aa, Mycobacterium tuberculosis
QAATGRPLI

SEQ ID NO: 1539347 - protein, 6 aa, Mycobacterium tuberculosis
QGNSIT

SEQ ID NO: 1539348 - protein, 5 aa, Mycobacterium tuberculosis
QNAAS

SEQ ID NO: 1539349 - protein, 7 aa, Mycobacterium tuberculosis
QRGSDAG

SEQ ID NO: 1539350 - protein, 7 aa, Mycobacterium tuberculosis
RAGGRRP

SEQ ID NO: 1539351 - protein, 8 aa, Mycobacterium tuberculosis
RATAAAKQ

SEQ ID NO: 1539352 - protein, 18 aa, Mycobacterium tuberculosis
RDPRDTVADTVTALRGLG

SEQ ID NO: 1539353 - protein, 6 aa, Mycobacterium tuberculosis
RGDGAS

SEQ ID NO: 1539354 - protein, 10 aa, Mycobacterium tuberculosis
RGVPTPGLPF

SEQ ID NO: 1539355 - protein, 7 aa, Mycobacterium tuberculosis
RKKSDHL

SEQ ID NO: 1539356 - protein, 4 aa, Mycobacterium tuberculosis
RNVT

SEQ ID NO: 1539357 - protein, 13 aa, Mycobacterium tuberculosis
RPTAVEGDATPIS

SEQ ID NO: 1539358 - protein, 27 aa, Mycobacterium tuberculosis
RPTNSGPATAAGTTAEPTYTAAETAAA

SEQ ID NO: 1539359 - protein, 7 aa, Mycobacterium tuberculosis
RTAGGDL

SEQ ID NO: 1539360 - protein, 6 aa, Mycobacterium tuberculosis
RTPTVT

SEQ ID NO: 1539361 - protein, 13 aa, Mycobacterium tuberculosis
SAANAAAAGPTTQ

SEQ ID NO: 1539362 - protein, 6 aa, Mycobacterium tuberculosis
SAPGCP

SEQ ID NO: 1539363 - protein, 10 aa, Mycobacterium tuberculosis
SASRPAAPIP

SEQ ID NO: 1539364 - protein, 5 aa, Mycobacterium tuberculosis
SDGRR

SEQ ID NO: 1539365 - protein, 5 aa, Mycobacterium tuberculosis
SGAAV

SEQ ID NO: 1539366 - protein, 4 aa, Mycobacterium tuberculosis
SGGT

SEQ ID NO: 1539367 - protein, 8 aa, Mycobacterium tuberculosis
SLPGVSPT

SEQ ID NO: 1539368 - protein, 7 aa, Mycobacterium tuberculosis
SPQTRFS

SEQ ID NO: 1539369 - protein, 7 aa, Mycobacterium tuberculosis
SQVGGRS

SEQ ID NO: 1539370 - protein, 6 aa, Mycobacterium tuberculosis
SRDGTR

SEQ ID NO: 1539371 - protein, 28 aa, Mycobacterium tuberculosis
SVGAGTPGPAGTSGTATTGPKTAPKTAE

SEQ ID NO: 1539372 - protein, 11 aa, Mycobacterium tuberculosis
TAAAALAEEGA

SEQ ID NO: 1539373 - protein, 7 aa, Mycobacterium tuberculosis
TCRETPD

SEQ ID NO: 1539374 - protein, 5 aa, Mycobacterium tuberculosis
TDQGV

SEQ ID NO: 1539375 - protein, 17 aa, Mycobacterium tuberculosis
TGDNQTGFGGLNSGAGN

SEQ ID NO: 1539376 - protein, 7 aa, Mycobacterium tuberculosis
TGNDSNG

SEQ ID NO: 1539377 - protein, 4 aa, Mycobacterium tuberculosis
TGRT

SEQ ID NO: 1539378 - protein, 4 aa, Mycobacterium tuberculosis
TGSS

SEQ ID NO: 1539379 - protein, 15 aa, Mycobacterium tuberculosis
TIAGASGLSTGGNPG

SEQ ID NO: 1539380 - protein, 21 aa, Mycobacterium tuberculosis
TNSTPYQPDPTRAHTPASNYG

SEQ ID NO: 1539381 - protein, 12 aa, Mycobacterium tuberculosis
TPERGLIALPCG

SEQ ID NO: 1539382 - protein, 12 aa, Mycobacterium tuberculosis
TPPTAAAAESGM

SEQ ID NO: 1539383 - protein, 4 aa, Mycobacterium tuberculosis
TQPA

SEQ ID NO: 1539384 - protein, 5 aa, Mycobacterium tuberculosis
TRAAA

SEQ ID NO: 1539385 - protein, 8 aa, Mycobacterium tuberculosis
TTDPPVEG

SEQ ID NO: 1539386 - protein, 6 aa, Mycobacterium tuberculosis
VARTGL

SEQ ID NO: 1539387 - protein, 8 aa, Mycobacterium tuberculosis
VGGEPGSI

SEQ ID NO: 1539388 - protein, 9 aa, Mycobacterium tuberculosis
VGPMRADGG

SEQ ID NO: 1539389 - protein, 4 aa, Mycobacterium tuberculosis
VPPR

SEQ ID NO: 1539390 - protein, 9 aa, Mycobacterium tuberculosis
VYPSSNHAE

SEQ ID NO: 1539391 - protein, 4 aa, Mycobacterium tuberculosis
WGAD

SEQ ID NO: 1539392 - protein, 43 aa, Mycobacterium tuberculosis; identical to SEQ ID NO: 231822

SEQ ID NO: 1539393 - protein, 4 aa, Mycobacterium tuberculosis
WQST

SEQ ID NO: 1539394 - protein, 8 aa, Mycobacterium tuberculosis
YPAGTTVD

SEQ ID NO: 1539395 - protein, 9 aa, Mycobacterium tuberculosis
YTPPEAEEG

SEQ ID NO: 1539396 - protein, 11 aa, Mycobacterium tuberculosis
AADAGFTAPAT

SEQ ID NO: 1539397 - protein, 14 aa, Mycobacterium tuberculosis
AAEGRAGYGVPGDH

SEQ ID NO: 1539398 - protein, 13 aa, Mycobacterium tuberculosis
AAKSDGGRNNQAG

SEQ ID NO: 1539399 - protein, 5 aa, Mycobacterium tuberculosis
AATGF

SEQ ID NO: 1539400 - protein, 14 aa, Mycobacterium tuberculosis
AATRTTPARLASKV

SEQ ID NO: 1539401 - protein, 8 aa, Mycobacterium tuberculosis
AATSSEWN

SEQ ID NO: 1539402 - protein, 12 aa, Mycobacterium tuberculosis
ADATDKDRTRVE

SEQ ID NO: 1539403 - protein, 4 aa, Mycobacterium tuberculosis
ADEV

SEQ ID NO: 1539404 - protein, 6 aa, Mycobacterium tuberculosis
ADLTGI

SEQ ID NO: 1539405 - protein, 14 aa, Mycobacterium tuberculosis
ADPAPAPAPAPNIP

SEQ ID NO: 1539406 - protein, 5 aa, Mycobacterium tuberculosis
ADQPY

SEQ ID NO: 1539407 - protein, 17 aa, Mycobacterium tuberculosis
ADRKRGASAGRGGSAPS

SEQ ID NO: 1539408 - protein, 7 aa, Mycobacterium tuberculosis
AEYAQGP

SEQ ID NO: 1539409 - protein, 6 aa, Mycobacterium tuberculosis
AGADEV

SEQ ID NO: 1539410 - protein, 8 aa, Mycobacterium tuberculosis
AGPAGRVS

SEQ ID NO: 1539411 - protein, 9 aa, Mycobacterium tuberculosis
AGSLGGAAR

SEQ ID NO: 1539412 - protein, 6 aa, Mycobacterium tuberculosis
AHPGVR

SEQ ID NO: 1539413 - protein, 6 aa, Mycobacterium tuberculosis
ANNAAR

SEQ ID NO: 1539414 - protein, 8 aa, Mycobacterium tuberculosis
ASPSGVAG

SEQ ID NO: 1539415 - protein, 5 aa, Mycobacterium tuberculosis
ASSIG

SEQ ID NO: 1539416 - protein, 8 aa, Mycobacterium tuberculosis
ASYPDGTN

SEQ ID NO: 1539417 - protein, 7 aa, Mycobacterium tuberculosis
ATPGDGW

SEQ ID NO: 1539418 - protein, 12 aa, Mycobacterium tuberculosis
ATTRASVARPAP

SEQ ID NO: 1539419 - protein, 4 aa, Mycobacterium tuberculosis
ATVS

SEQ ID NO: 1539420 - protein, 6 aa, Mycobacterium tuberculosis
AVAGRQ

SEQ ID NO: 1539421 - protein, 8 aa, Mycobacterium tuberculosis
AVRGRGGL

SEQ ID NO: 1539422 - protein, 4 aa, Mycobacterium tuberculosis
CSSG

SEQ ID NO: 1539423 - protein, 19 aa, Mycobacterium tuberculosis
DAPLDAAATGESDERGPNA

SEQ ID NO: 1539424 - protein, 11 aa, Mycobacterium tuberculosis
DDQSGTIPNVG

SEQ ID NO: 1539425 - protein, 8 aa, Mycobacterium tuberculosis
DDRPINSA

SEQ ID NO: 1539426 - protein, 6 aa, Mycobacterium tuberculosis
DETASV

SEQ ID NO: 1539427 - protein, 15 aa, Mycobacterium tuberculosis
DGANATTPGGAGGAG

SEQ ID NO: 1539428 - protein, 44 aa, Mycobacterium tuberculosis
DGGNGYSQTTPGAVGGAGGSAGFIGNGGAGGAGGPGAGGGTGGL

SEQ ID NO: 1539429 - protein, 6 aa, Mycobacterium tuberculosis
DGPARI

SEQ ID NO: 1539430 - protein, 21 aa, Mycobacterium tuberculosis
DLASLGSSISAANAAAAANTT

SEQ ID NO: 1539431 - protein, 8 aa, Mycobacterium tuberculosis
DLPPPAAL

SEQ ID NO: 1539432 - protein, 10 aa, Mycobacterium tuberculosis
DQETAAAQAV

SEQ ID NO: 1539433 - protein, 11 aa, Mycobacterium tuberculosis
DTPPAPAPPPF

SEQ ID NO: 1539434 - protein, 14 aa, Mycobacterium tuberculosis
EDEVERRRGDLPTT

SEQ ID NO: 1539435 - protein, 8 aa, Mycobacterium tuberculosis
EGLPTDGY

SEQ ID NO: 1539436 - protein, 5 aa, Mycobacterium tuberculosis
ELTPS

SEQ ID NO: 1539437 - protein, 8 aa, Mycobacterium tuberculosis
EPDNPARV

SEQ ID NO: 1539438 - protein, 4 aa, Mycobacterium tuberculosis
ESHT

SEQ ID NO: 1539439 - protein, 7 aa, Mycobacterium tuberculosis
GAAAAGV

SEQ ID NO: 1539440 - protein, 15 aa, Mycobacterium tuberculosis
GAASAYASAEATNVE

SEQ ID NO: 1539441 - protein, 20 aa, Mycobacterium tuberculosis
GAGGVGGAGGGTGGAGGPGG

SEQ ID NO: 1539442 - protein, 7 aa, Mycobacterium tuberculosis
GAGPCPG

SEQ ID NO: 1539443 - protein, 6 aa, Mycobacterium tuberculosis
GAPATS

SEQ ID NO: 1539444 - protein, 9 aa, Mycobacterium tuberculosis
GAQSAAAAL

SEQ ID NO: 1539445 - protein, 18 aa, Mycobacterium tuberculosis
GASNGAWGKGASETFNGG

SEQ ID NO: 1539446 - protein, 8 aa, Mycobacterium tuberculosis
GFDTPTPL

SEQ ID NO: 1539447 - protein, 26 aa, Mycobacterium tuberculosis
GGAGGAGGLGKAGFAGGAGGTGGTGG

SEQ ID NO: 1539448 - protein, 20 aa, Mycobacterium tuberculosis
GGAGGVGGAGGGTGGAGGRA

SEQ ID NO: 1539449 - protein, 7 aa, Mycobacterium tuberculosis
GGYRSAN

SEQ ID NO: 1539450 - protein, 22 aa, Mycobacterium tuberculosis
GNGGPGGAGGSGGGTGGAGGAG

SEQ ID NO: 1539451 - protein, 42 aa, Mycobacterium tuberculosis; identical to SEQ ID NO: 1427758

SEQ ID NO: 1539452 - protein, 9 aa, Mycobacterium tuberculosis
GPAFPRAKS

SEQ ID NO: 1539453 - protein, 8 aa, Mycobacterium tuberculosis
GPMRADGG

SEQ ID NO: 1539454 - protein, 9 aa, Mycobacterium tuberculosis
GPSSATTGS

SEQ ID NO: 1539455 - protein, 7 aa, Mycobacterium tuberculosis
GQVQGVP

SEQ ID NO: 1539456 - protein, 7 aa, Mycobacterium tuberculosis
GRAFTSG

SEQ ID NO: 1539457 - protein, 5 aa, Mycobacterium tuberculosis
GSAPA

SEQ ID NO: 1539458 - protein, 20 aa, Mycobacterium tuberculosis
GSAPPTSQTAAAAKPNPSTV

SEQ ID NO: 1539459 - protein, 22 aa, Mycobacterium tuberculosis
GSGGVGGAGGLGGPTDGTVQGV

SEQ ID NO: 1539460 - protein, 19 aa, Mycobacterium tuberculosis
GSPAIPSTAQEIPNPLRGQ

SEQ ID NO: 1539461 - protein, 13 aa, Mycobacterium tuberculosis
GTPPTAAAAESGM

SEQ ID NO: 1539462 - protein, 9 aa, Mycobacterium tuberculosis
GVPDPITGV

SEQ ID NO: 1539463 - protein, 5 aa, Mycobacterium tuberculosis
HPGVR

SEQ ID NO: 1539464 - protein, 5 aa, Mycobacterium tuberculosis
HPSLE

SEQ ID NO: 1539465 - protein, 4 aa, Mycobacterium tuberculosis
HSET

SEQ ID NO: 1539466 - protein, 23 aa, Mycobacterium tuberculosis
HTNTGGFNTGNVNTGAFNSGSFN

SEQ ID NO: 1539467 - protein, 4 aa, Mycobacterium tuberculosis
IGST

SEQ ID NO: 1539468 - protein, 9 aa, Mycobacterium tuberculosis
ISNSGTGFN

SEQ ID NO: 1539469 - protein, 7 aa, Mycobacterium tuberculosis
KDPTIVR

SEQ ID NO: 1539470 - protein, 7 aa, Mycobacterium tuberculosis
KETVQST

SEQ ID NO: 1539471 - protein, 9 aa, Mycobacterium tuberculosis
KLPASTIDE

SEQ ID NO: 1539472 - protein, 5 aa, Mycobacterium tuberculosis
KPIDP

SEQ ID NO: 1539473 - protein, 5 aa, Mycobacterium tuberculosis
KQASA

SEQ ID NO: 1539474 - protein, 7 aa, Mycobacterium tuberculosis
LAGAGSG

SEQ ID NO: 1539475 - protein, 4 aa, Mycobacterium tuberculosis
LAGT

SEQ ID NO: 1539476 - protein, 5 aa, Mycobacterium tuberculosis
LANKD

SEQ ID NO: 1539477 - protein, 23 aa, Mycobacterium tuberculosis
LDAEEPELNRDPPGDERDTTTPH

SEQ ID NO: 1539478 - protein, 20 aa, Mycobacterium tuberculosis
LDATDTPPPASATSGQTSLD

SEQ ID NO: 1539479 - protein, 5 aa, Mycobacterium tuberculosis
LGGAP

SEQ ID NO: 1539480 - protein, 13 aa, Mycobacterium tuberculosis
LPDGFPARAVRTR

SEQ ID NO: 1539481 - protein, 6 aa, Mycobacterium tuberculosis
LPGVTP

SEQ ID NO: 1539482 - protein, 8 aa, Mycobacterium tuberculosis
LRAQAAGQ

SEQ ID NO: 1539483 - protein, 15 aa, Mycobacterium tuberculosis
LSGPPSTSAKHTTTP

SEQ ID NO: 1539484 - protein, 8 aa, Mycobacterium tuberculosis
LTQGGRTA

SEQ ID NO: 1539485 - protein, 9 aa, Mycobacterium tuberculosis
MSDGPGDPL

SEQ ID NO: 1539486 - protein, 22 aa, Mycobacterium tuberculosis
NGGAGAAGAPGQAGGPGGPAGL

SEQ ID NO: 1539487 - protein, 45 aa, Mycobacterium tuberculosis
NGGNGAAGGFGQTGGSGGAAGLIGNGGNGGAGGTGAAGGAGGNGG

SEQ ID NO: 1539488 - protein, 21 aa, Mycobacterium tuberculosis
NGGNGGSGAAGQVGGPGGAAG

SEQ ID NO: 1539489 - protein, 27 aa, Mycobacterium tuberculosis
NPAYPYESEAERSAARARRNARQQRSA

SEQ ID NO: 1539490 - protein, 14 aa, Mycobacterium tuberculosis
NTAAADDKLPLGGG

SEQ ID NO: 1539491 - protein, 9 aa, Mycobacterium tuberculosis
PAATTIPGR

SEQ ID NO: 1539492 - protein, 9 aa, Mycobacterium tuberculosis
PAATTPANI

SEQ ID NO: 1539493 - protein, 11 aa, Mycobacterium tuberculosis
PASGSGKTTIA

SEQ ID NO: 1539494 - protein, 19 aa, Mycobacterium tuberculosis
PIPAKSAAAATTSSGETIT

SEQ ID NO: 1539495 - protein, 7 aa, Mycobacterium tuberculosis
PLPPAAD

SEQ ID NO: 1539496 - protein, 11 aa, Mycobacterium tuberculosis
PPASVTGTPKL

SEQ ID NO: 1539497 - protein, 8 aa, Mycobacterium tuberculosis
PPSEATTV

SEQ ID NO: 1539498 - protein, 23 aa, Mycobacterium tuberculosis
PRLPGPAEQVDGRSLRPRGFSDE

SEQ ID NO: 1539499 - protein, 8 aa, Mycobacterium tuberculosis
QAQTVPRK

SEQ ID NO: 1539500 - protein, 14 aa, Mycobacterium tuberculosis
QDPASGQPARIPVD

SEQ ID NO: 1539501 - protein, 15 aa, Mycobacterium tuberculosis
QDPASGQPARIPVDS

SEQ ID NO: 1539502 - protein, 12 aa, Mycobacterium tuberculosis
QGAISKGQRGGN

SEQ ID NO: 1539503 - protein, 6 aa, Mycobacterium tuberculosis
QQTRQR

SEQ ID NO: 1539504 - protein, 7 aa, Mycobacterium tuberculosis
RGDGASL

SEQ ID NO: 1539505 - protein, 10 aa, Mycobacterium tuberculosis
RRPKLYGAGA

SEQ ID NO: 1539506 - protein, 5 aa, Mycobacterium tuberculosis
RRSDG

SEQ ID NO: 1539507 - protein, 8 aa, Mycobacterium tuberculosis
RTGAAGRS

SEQ ID NO: 1539508 - protein, 12 aa, Mycobacterium tuberculosis
SAATAAAAAPTI

SEQ ID NO: 1539509 - protein, 4 aa, Mycobacterium tuberculosis
SAQA

SEQ ID NO: 1539510 - protein, 9 aa, Mycobacterium tuberculosis
SDEDSAKAM

SEQ ID NO: 1539511 - protein, 5 aa, Mycobacterium tuberculosis
SDRYR

SEQ ID NO: 1539512 - protein, 5 aa, Mycobacterium tuberculosis
SGLNP

SEQ ID NO: 1539513 - protein, 8 aa, Mycobacterium tuberculosis
SNSTGMSG

SEQ ID NO: 1539514 - protein, 7 aa, Mycobacterium tuberculosis
SPAYNDR

SEQ ID NO: 1539515 - protein, 4 aa, Mycobacterium tuberculosis
SSGN

SEQ ID NO: 1539516 - protein, 9 aa, Mycobacterium tuberculosis
STLSGPPLT

SEQ ID NO: 1539517 - protein, 19 aa, Mycobacterium tuberculosis
STTVSGDRDDLKPGVGDRS

SEQ ID NO: 1539518 - protein, 10 aa, Mycobacterium tuberculosis
SYAVSGPGNV

SEQ ID NO: 1539519 - protein, 7 aa, Mycobacterium tuberculosis
TALPGAN

SEQ ID NO: 1539520 - protein, 6 aa, Mycobacterium tuberculosis
TALTQS

SEQ ID NO: 1539521 - protein, 8 aa, Mycobacterium tuberculosis
TGMGRSTA

SEQ ID NO: 1539522 - protein, 8 aa, Mycobacterium tuberculosis
TGREPSER

SEQ ID NO: 1539523 - protein, 8 aa, Mycobacterium tuberculosis
THPADGTV

SEQ ID NO: 1539524 - protein, 15 aa, Mycobacterium tuberculosis
TPGFGNATATPSSGF

SEQ ID NO: 1539525 - protein, 12 aa, Mycobacterium tuberculosis
TPSPASDTDTVT

SEQ ID NO: 1539526 - protein, 8 aa, Mycobacterium tuberculosis
TRSDPSRP

SEQ ID NO: 1539527 - protein, 8 aa, Mycobacterium tuberculosis
TRSPARDF

SEQ ID NO: 1539528 - protein, 9 aa, Mycobacterium tuberculosis
TRTKSPRSH

SEQ ID NO: 1539529 - protein, 6 aa, Mycobacterium tuberculosis
TSAVTG

SEQ ID NO: 1539530 - protein, 6 aa, Mycobacterium tuberculosis
TSGGNL

SEQ ID NO: 1539531 - protein, 6 aa, Mycobacterium tuberculosis
TSLPRG

SEQ ID NO: 1539532 - protein, 7 aa, Mycobacterium tuberculosis
VDTDGLA

SEQ ID NO: 1539533 - protein, 13 aa, Mycobacterium tuberculosis
VEETDSAGNPRSD

SEQ ID NO: 1539534 - protein, 6 aa, Mycobacterium tuberculosis
VEPGGA

SEQ ID NO: 1539535 - protein, 10 aa, Mycobacterium tuberculosis
VKNERTVTTE

SEQ ID NO: 1539536 - protein, 5 aa, Mycobacterium tuberculosis
VPDSS

SEQ ID NO: 1539537 - protein, 12 aa, Mycobacterium tuberculosis
VPHLPGSVPQLP

SEQ ID NO: 1539538 - protein, 24 aa, Mycobacterium tuberculosis
VPPPPGDPVPPVDTHAGGRPADQL

SEQ ID NO: 1539539 - protein, 17 aa, Mycobacterium tuberculosis
VSPSTVPPAALPNTSRA

SEQ ID NO: 1539540 - protein, 4 aa, Mycobacterium tuberculosis
YAQR

SEQ ID NO: 1539541 - protein, 8 aa, Mycobacterium tuberculosis
YDQPATTV

SEQ ID NO: 1539542 - protein, 7 aa, Mycobacterium tuberculosis
AAAATEK

SEQ ID NO: 1539543 - protein, 7 aa, Mycobacterium tuberculosis
AADRAGR

SEQ ID NO: 1539544 - protein, 16 aa, Mycobacterium tuberculosis
AAGAPPSCAGLGGTVQ

SEQ ID NO: 1539545 - protein, 8 aa, Mycobacterium tuberculosis
AAGPGASA

SEQ ID NO: 1539546 - protein, 6 aa, Mycobacterium tuberculosis
AAGRHH

SEQ ID NO: 1539547 - protein, 21 aa, Mycobacterium tuberculosis
AAHGGGEFAPSAQLASREQQI

SEQ ID NO: 1539548 - protein, 45 aa, Mycobacterium tuberculosis; identical to SEQ ID NO: 228802

SEQ ID NO: 1539549 - protein, 14 aa, Mycobacterium tuberculosis
AAPSISGCANKNDM

SEQ ID NO: 1539550 - protein, 4 aa, Mycobacterium tuberculosis
AAST

SEQ ID NO: 1539551 - protein, 7 aa, Mycobacterium tuberculosis
AATGRAG

SEQ ID NO: 1539552 - protein, 6 aa, Mycobacterium tuberculosis
ADEVST

SEQ ID NO: 1539553 - protein, 15 aa, Mycobacterium tuberculosis
ADGDGGNRGRQSRVR

SEQ ID NO: 1539554 - protein, 27 aa, Mycobacterium tuberculosis
AFGGDGGNGSDGVAAGSGGGSGGAGGG

SEQ ID NO: 1539555 - protein, 30 aa, Mycobacterium tuberculosis; identical to SEQ ID NO: 228980

SEQ ID NO: 1539556 - protein, 18 aa, Mycobacterium tuberculosis
AGWSTAAPAMTSGTTALE

SEQ ID NO: 1539557 - protein, 21 aa, Mycobacterium tuberculosis
AGWSTAAPAMTSGTTALEGSG

SEQ ID NO: 1539558 - protein, 9 aa, Mycobacterium tuberculosis
AHAGPSGDD

SEQ ID NO: 1539559 - protein, 12 aa, Mycobacterium tuberculosis
AIATERAGKPVQ

SEQ ID NO: 1539560 - protein, 30 aa, Mycobacterium tuberculosis; identical to SEQ ID NO: 1428748

SEQ ID NO: 1539561 - protein, 6 aa, Mycobacterium tuberculosis
AMKPPV

SEQ ID NO: 1539562 - protein, 17 aa, Mycobacterium tuberculosis
ANANDGTRAVGTPGYQA

SEQ ID NO: 1539563 - protein, 8 aa, Mycobacterium tuberculosis
ANPAQSVQ

SEQ ID NO: 1539564 - protein, 8 aa, Mycobacterium tuberculosis
ANPQHHRR

SEQ ID NO: 1539565 - protein, 4 aa, Mycobacterium tuberculosis
APGV

SEQ ID NO: 1539566 - protein, 11 aa, Mycobacterium tuberculosis
APPANQARAAA

SEQ ID NO: 1539567 - protein, 28 aa, Mycobacterium tuberculosis
APPIPSPQPLKSGDTIGLKNSSAYPTVE

SEQ ID NO: 1539568 - protein, 12 aa, Mycobacterium tuberculosis
AQFQAGDDPVAN

SEQ ID NO: 1539569 - protein, 9 aa, Mycobacterium tuberculosis
AQGHTNTSH

SEQ ID NO: 1539570 - protein, 9 aa, Mycobacterium tuberculosis
AQSVPGSQF

SEQ ID NO: 1539571 - protein, 6 aa, Mycobacterium tuberculosis
ARAPRV

SEQ ID NO: 1539572 - protein, 18 aa, Mycobacterium tuberculosis
ARDTATVGGMASTNAGGL

SEQ ID NO: 1539573 - protein, 9 aa, Mycobacterium tuberculosis
ARPRPGSHA

SEQ ID NO: 1539574 - protein, 8 aa, Mycobacterium tuberculosis
ARRTGATR

SEQ ID NO: 1539575 - protein, 17 aa, Mycobacterium tuberculosis
ASTNTSYPGPATDPSTG

SEQ ID NO: 1539576 - protein, 10 aa, Mycobacterium tuberculosis
ATSPAPGTAN

SEQ ID NO: 1539577 - protein, 36 aa, Mycobacterium tuberculosis; identical to SEQ ID NO: 231986

SEQ ID NO: 1539578 - protein, 14 aa, Mycobacterium tuberculosis
ATTDGTRFTNNRTG

SEQ ID NO: 1539579 - protein, 5 aa, Mycobacterium tuberculosis
ATVYD

SEQ ID NO: 1539580 - protein, 21 aa, Mycobacterium tuberculosis
CGPSGHGTRAGEEGPLSPEKV

SEQ ID NO: 1539581 - protein, 7 aa, Mycobacterium tuberculosis
CRSQARR

SEQ ID NO: 1539582 - protein, 10 aa, Mycobacterium tuberculosis
CSAPDRSLGY

SEQ ID NO: 1539583 - protein, 13 aa, Mycobacterium tuberculosis
CSAVDHSSRTPYR

SEQ ID NO: 1539584 - protein, 8 aa, Mycobacterium tuberculosis
CTAGQKKA

SEQ ID NO: 1539585 - protein, 15 aa, Mycobacterium tuberculosis
DAPHGSKQANTGGSI

SEQ ID NO: 1539586 - protein, 9 aa, Mycobacterium tuberculosis
DARGANPRL

SEQ ID NO: 1539587 - protein, 18 aa, Mycobacterium tuberculosis
DEMRDQAQFQAGDDPVAN

SEQ ID NO: 1539588 - protein, 7 aa, Mycobacterium tuberculosis
DETTELS

SEQ ID NO: 1539589 - protein, 15 aa, Mycobacterium tuberculosis
DGANGGPGQDGGPGG

SEQ ID NO: 1539590 - protein, 5 aa, Mycobacterium tuberculosis
DGFVS

SEQ ID NO: 1539591 - protein, 6 aa, Mycobacterium tuberculosis
DGFVSG

SEQ ID NO: 1539592 - protein, 23 aa, Mycobacterium tuberculosis
DGGSGGSTLQGFSDGGTGGNAGM

SEQ ID NO: 1539593 - protein, 7 aa, Mycobacterium tuberculosis
DKNAAAQ

SEQ ID NO: 1539594 - protein, 7 aa, Mycobacterium tuberculosis
DNLTGIG

SEQ ID NO: 1539595 - protein, 6 aa, Mycobacterium tuberculosis
DPGALR

SEQ ID NO: 1539596 - protein, 6 aa, Mycobacterium tuberculosis
DPIVGN

SEQ ID NO: 1539597 - protein, 18 aa, Mycobacterium tuberculosis
DPMGYQQGTGPTAGVPGY

SEQ ID NO: 1539598 - protein, 14 aa, Mycobacterium tuberculosis
DQGERKVRDHPDFP

SEQ ID NO: 1539599 - protein, 12 aa, Mycobacterium tuberculosis
DQPNLGGSGGYS

SEQ ID NO: 1539600 - protein, 17 aa, Mycobacterium tuberculosis
DRGDIGGMSTATGPEGL

SEQ ID NO: 1539601 - protein, 7 aa, Mycobacterium tuberculosis
DRLRSGN

SEQ ID NO: 1539602 - protein, 5 aa, Mycobacterium tuberculosis
DSIPT

SEQ ID NO: 1539603 - protein, 10 aa, Mycobacterium tuberculosis
DSRPTAGPQR

SEQ ID NO: 1539604 - protein, 11 aa, Mycobacterium tuberculosis
DTRTPPGLRAQ

SEQ ID NO: 1539605 - protein, 5 aa, Mycobacterium tuberculosis
DYARM

SEQ ID NO: 1539606 - protein, 4 aa, Mycobacterium tuberculosis
EAQD

SEQ ID NO: 1539607 - protein, 10 aa, Mycobacterium tuberculosis
EAQPGSQALA

SEQ ID NO: 1539608 - protein, 8 aa, Mycobacterium tuberculosis
EAVAPTAT

SEQ ID NO: 1539609 - protein, 13 aa, Mycobacterium tuberculosis
EDDPRTLAQRRAD

SEQ ID NO: 1539610 - protein, 6 aa, Mycobacterium tuberculosis
EEAGPV

SEQ ID NO: 1539611 - protein, 16 aa, Mycobacterium tuberculosis
ESTTNARRAHAPTRTS

SEQ ID NO: 1539612 - protein, 8 aa, Mycobacterium tuberculosis
ESVPLPDD

SEQ ID NO: 1539613 - protein, 7 aa, Mycobacterium tuberculosis
ETSYPKR

SEQ ID NO: 1539614 - protein, 14 aa, Mycobacterium tuberculosis
FAPGGGSGGNGGNG

SEQ ID NO: 1539615 - protein, 8 aa, Mycobacterium tuberculosis
FGDGGNGG

SEQ ID NO: 1539616 - protein, 7 aa, Mycobacterium tuberculosis
FHPGGAT

SEQ ID NO: 1539617 - protein, 6 aa, Mycobacterium tuberculosis
FNKPGT

SEQ ID NO: 1539618 - protein, 18 aa, Mycobacterium tuberculosis
FSGPPGTGGPDATGAVGG

SEQ ID NO: 1539619 - protein, 12 aa, Mycobacterium tuberculosis
FTGTEDQPAAVE

SEQ ID NO: 1539620 - protein, 8 aa, Mycobacterium tuberculosis
GADGEATV

SEQ ID NO: 1539621 - protein, 8 aa, Mycobacterium tuberculosis
GAGGGCGS

SEQ ID NO: 1539622 - protein, 4 aa, Mycobacterium tuberculosis
GAGN

SEQ ID NO: 1539623 - protein, 7 aa, Mycobacterium tuberculosis
GAGPAAM

SEQ ID NO: 1539624 - protein, 5 aa, Mycobacterium tuberculosis
GALPG

SEQ ID NO: 1539625 - protein, 10 aa, Mycobacterium tuberculosis
GAQGHTNTSH

SEQ ID NO: 1539626 - protein, 32 aa, Mycobacterium tuberculosis; identical to SEQ ID NO: 192533

SEQ ID NO: 1539627 - protein, 6 aa, Mycobacterium tuberculosis
GDGVGG

SEQ ID NO: 1539628 - protein, 10 aa, Mycobacterium tuberculosis
GDVPLRPTTT

SEQ ID NO: 1539629 - protein, 16 aa, Mycobacterium tuberculosis
GELDPDELAEDEANGL

SEQ ID NO: 1539630 - protein, 7 aa, Mycobacterium tuberculosis
GFDTPTP

SEQ ID NO: 1539631 - protein, 9 aa, Mycobacterium tuberculosis
GGAAPGGFD

SEQ ID NO: 1539632 - protein, 29 aa, Mycobacterium tuberculosis
GGAGGAGTDGGPGATGGTGGHGGVGGDGG

SEQ ID NO: 1539633 - protein, 103 aa, Mycobacterium tuberculosis; identical to SEQ ID NO: 194128

SEQ ID NO: 1539634 - protein, 9 aa, Mycobacterium tuberculosis
GGDTGYTKS

SEQ ID NO: 1539635 - protein, 5 aa, Mycobacterium tuberculosis
GGTFE

SEQ ID NO: 1539636 - protein, 10 aa, Mycobacterium tuberculosis
GGVGGNGGAA

SEQ ID NO: 1539637 - protein, 16 aa, Mycobacterium tuberculosis
GKPDCPSGAGNDERAA

SEQ ID NO: 1539638 - protein, 9 aa, Mycobacterium tuberculosis
GLAGIGGNA

SEQ ID NO: 1539639 - protein, 6 aa, Mycobacterium tuberculosis
GLYGRS

SEQ ID NO: 1539640 - protein, 8 aa, Mycobacterium tuberculosis
GNAGSTNV

SEQ ID NO: 1539641 - protein, 16 aa, Mycobacterium tuberculosis
GNANTGIANSGNVDTG

SEQ ID NO: 1539642 - protein, 47 aa, Mycobacterium tuberculosis
GNGGNGGNGGIGQPGGAGGDAGLIGNGGNGGIGGPGATGLAGGAGGV

SEQ ID NO: 1539643 - protein, 23 aa, Mycobacterium tuberculosis
GNGGNGGNVPSGAADGGAGGDAR

SEQ ID NO: 1539644 - protein, 53 aa, Mycobacterium tuberculosis; identical to SEQ ID NO: 1444539

SEQ ID NO: 1539645 - protein, 25 aa, Mycobacterium tuberculosis
GNIGTGNSGFNNSGDANSGFQNTNT

SEQ ID NO: 1539646 - protein, 9 aa, Mycobacterium tuberculosis
GPGQEGLDQ

SEQ ID NO: 1539647 - protein, 28 aa, Mycobacterium tuberculosis
GRAGKAAAAHAAAAGRSRATSSATWPEP

SEQ ID NO: 1539648 - protein, 13 aa, Mycobacterium tuberculosis
GRSAPPSATIAFG

SEQ ID NO: 1539649 - protein, 7 aa, Mycobacterium tuberculosis
GSVPQLP

SEQ ID NO: 1539650 - protein, 5 aa, Mycobacterium tuberculosis
GVYAN

SEQ ID NO: 1539651 - protein, 4 aa, Mycobacterium tuberculosis
HAEY

SEQ ID NO: 1539652 - protein, 8 aa, Mycobacterium tuberculosis
HERAGSGA

SEQ ID NO: 1539653 - protein, 5 aa, Mycobacterium tuberculosis
HGEGY

SEQ ID NO: 1539654 - protein, 14 aa, Mycobacterium tuberculosis
IAGASGLSTGGNPG

SEQ ID NO: 1539655 - protein, 11 aa, Mycobacterium tuberculosis
IEESEPEREFE

SEQ ID NO: 1539656 - protein, 15 aa, Mycobacterium tuberculosis
IGAPSWTADYGSETL

SEQ ID NO: 1539657 - protein, 54 aa, Mycobacterium tuberculosis; identical to SEQ ID NO: 1427848

SEQ ID NO: 1539658 - protein, 10 aa, Mycobacterium tuberculosis
IGPGQEGLDQ

SEQ ID NO: 1539659 - protein, 18 aa, Mycobacterium tuberculosis
IGSSISAANAAAAAPTTA

SEQ ID NO: 1539660 - protein, 14 aa, Mycobacterium tuberculosis
ITPTAVATTDGASH

SEQ ID NO: 1539661 - protein, 5 aa, Mycobacterium tuberculosis
KDDAI

SEQ ID NO: 1539662 - protein, 10 aa, Mycobacterium tuberculosis
KNSSAYPTVE

SEQ ID NO: 1539663 - protein, 4 aa, Mycobacterium tuberculosis
KSYP

SEQ ID NO: 1539664 - protein, 7 aa, Mycobacterium tuberculosis
LAGNSAK

SEQ ID NO: 1539665 - protein, 9 aa, Mycobacterium tuberculosis
LAGPTRGAP

SEQ ID NO: 1539666 - protein, 20 aa, Mycobacterium tuberculosis
LANPTRPPANPQALTPPKVP

SEQ ID NO: 1539667 - protein, 10 aa, Mycobacterium tuberculosis
LAPAAADEVS

SEQ ID NO: 1539668 - protein, 44 aa, Mycobacterium tuberculosis; identical to SEQ ID NO: 228687

SEQ ID NO: 1539669 - protein, 19 aa, Mycobacterium tuberculosis
LDATDTPPPASATSGQTSL

SEQ ID NO: 1539670 - protein, 14 aa, Mycobacterium tuberculosis
LDDSRPGNGRPVTA

SEQ ID NO: 1539671 - protein, 6 aa, Mycobacterium tuberculosis
LDGKAG

SEQ ID NO: 1539672 - protein, 12 aa, Mycobacterium tuberculosis
LGAPGPGPDESV

SEQ ID NO: 1539673 - protein, 7 aa, Mycobacterium tuberculosis
LKATGDP

SEQ ID NO: 1539674 - protein, 9 aa, Mycobacterium tuberculosis
LNDNNSRSK

SEQ ID NO: 1539675 - protein, 11 aa, Mycobacterium tuberculosis
LPPIDGDDAPF

SEQ ID NO: 1539676 - protein, 10 aa, Mycobacterium tuberculosis
LRSTGDPRRV

SEQ ID NO: 1539677 - protein, 14 aa, Mycobacterium tuberculosis
LSAANAAAAAGTTG

SEQ ID NO: 1539678 - protein, 9 aa, Mycobacterium tuberculosis
LSAGGADAA

SEQ ID NO: 1539679 - protein, 13 aa, Mycobacterium tuberculosis
MPESDDSPSEKEL

SEQ ID NO: 1539680 - protein, 6 aa, Mycobacterium tuberculosis
NAAAGY

SEQ ID NO: 1539681 - protein, 8 aa, Mycobacterium tuberculosis
NAPGTQSQ

SEQ ID NO: 1539682 - protein, 12 aa, Mycobacterium tuberculosis
NFPDQTATSPMD

SEQ ID NO: 1539683 - protein, 16 aa, Mycobacterium tuberculosis
NGANGTPGTGADGGAG

SEQ ID NO: 1539684 - protein, 14 aa, Mycobacterium tuberculosis
NGCSSSASHRGPLN

SEQ ID NO: 1539685 - protein, 14 aa, Mycobacterium tuberculosis
NGGAGGSGGPTQIP

SEQ ID NO: 1539686 - protein, 13 aa, Mycobacterium tuberculosis
PGTAAPAPESRHG

SEQ ID NO: 1539687 - protein, 4 aa, Mycobacterium tuberculosis
PLAA

SEQ ID NO: 1539688 - protein, 15 aa, Mycobacterium tuberculosis
PPPLPQAATPTLAAG

SEQ ID NO: 1539689 - protein, 4 aa, Mycobacterium tuberculosis
PSHE

SEQ ID NO: 1539690 - protein, 5 aa, Mycobacterium tuberculosis
PSTGE

SEQ ID NO: 1539691 - protein, 9 aa, Mycobacterium tuberculosis
PTALGSGYG

SEQ ID NO: 1539692 - protein, 10 aa, Mycobacterium tuberculosis
PTGSSPRAYY

SEQ ID NO: 1539693 - protein, 5 aa, Mycobacterium tuberculosis
PTPSH

SEQ ID NO: 1539694 - protein, 9 aa, Mycobacterium tuberculosis
PVAPPSVRP

SEQ ID NO: 1539695 - protein, 6 aa, Mycobacterium tuberculosis
QAAGSR

SEQ ID NO: 1539696 - protein, 5 aa, Mycobacterium tuberculosis
QARPV

SEQ ID NO: 1539697 - protein, 9 aa, Mycobacterium tuberculosis
QATTRAGPY

SEQ ID NO: 1539698 - protein, 5 aa, Mycobacterium tuberculosis
QDEVS

SEQ ID NO: 1539699 - protein, 6 aa, Mycobacterium tuberculosis
QGGRTS

SEQ ID NO: 1539700 - protein, 7 aa, Mycobacterium tuberculosis
QGNSDSI

SEQ ID NO: 1539701 - protein, 11 aa, Mycobacterium tuberculosis
QLDRGSGNSVQ

SEQ ID NO: 1539702 - protein, 6 aa, Mycobacterium tuberculosis
QQIGYE

SEQ ID NO: 1539703 - protein, 13 aa, Mycobacterium tuberculosis
QSPGAERLDDRRY

SEQ ID NO: 1539704 - protein, 15 aa, Mycobacterium tuberculosis
RAKPPLEDAKDQYRA

SEQ ID NO: 1539705 - protein, 6 aa, Mycobacterium tuberculosis
RDGCPS

SEQ ID NO: 1539706 - protein, 8 aa, Mycobacterium tuberculosis
REGGHSRR

SEQ ID NO: 1539707 - protein, 21 aa, Mycobacterium tuberculosis
RFTESTPYNPSSPYSATKAGA

SEQ ID NO: 1539708 - protein, 15 aa, Mycobacterium tuberculosis
RFTQPTGNRCFHRRR

SEQ ID NO: 1539709 - protein, 6 aa, Mycobacterium tuberculosis
RHPGDL

SEQ ID NO: 1539710 - protein, 6 aa, Mycobacterium tuberculosis
RISART

SEQ ID NO: 1539711 - protein, 6 aa, Mycobacterium tuberculosis
RPGEPL

SEQ ID NO: 1539712 - protein, 4 aa, Mycobacterium tuberculosis
RPLI

SEQ ID NO: 1539713 - protein, 6 aa, Mycobacterium tuberculosis
RRPGAA

SEQ ID NO: 1539714 - protein, 6 aa, Mycobacterium tuberculosis
RRTRAA

SEQ ID NO: 1539715 - protein, 6 aa, Mycobacterium tuberculosis
RSEEVE

SEQ ID NO: 1539716 - protein, 11 aa, Mycobacterium tuberculosis
RSGASGRQPLA

SEQ ID NO: 1539717 - protein, 7 aa, Mycobacterium tuberculosis
RTAPSRS

SEQ ID NO: 1539718 - protein, 6 aa, Mycobacterium tuberculosis
RTDART

SEQ ID NO: 1539719 - protein, 7 aa, Mycobacterium tuberculosis
RTPPAGA

SEQ ID NO: 1539720 - protein, 12 aa, Mycobacterium tuberculosis
RTSHAAPAAAIG

SEQ ID NO: 1539721 - protein, 25 aa, Mycobacterium tuberculosis
SAAGDLASIGSSINASTRAAAAATT

SEQ ID NO: 1539722 - protein, 8 aa, Mycobacterium tuberculosis
SELPPPLH

SEQ ID NO: 1539723 - protein, 7 aa, Mycobacterium tuberculosis
SEPQRVD

SEQ ID NO: 1539724 - protein, 9 aa, Mycobacterium tuberculosis
SGAGGVSGF

SEQ ID NO: 1539725 - protein, 5 aa, Mycobacterium tuberculosis
SGAQV

SEQ ID NO: 1539726 - protein, 6 aa, Mycobacterium tuberculosis
SGESGL

SEQ ID NO: 1539727 - protein, 33 aa, Mycobacterium tuberculosis; identical to SEQ ID NO: 231262

SEQ ID NO: 1539728 - protein, 8 aa, Mycobacterium tuberculosis
SGGNHGTL

SEQ ID NO: 1539729 - protein, 8 aa, Mycobacterium tuberculosis
SGHQPDGY

SEQ ID NO: 1539730 - protein, 6 aa, Mycobacterium tuberculosis
SGTVVK

SEQ ID NO: 1539731 - protein, 21 aa, Mycobacterium tuberculosis
SIRESASQALPGLLERLPALL

SEQ ID NO: 1539732 - protein, 8 aa, Mycobacterium tuberculosis
SLRTEGRQ

SEQ ID NO: 1539733 - protein, 7 aa, Mycobacterium tuberculosis
SRKTTSV

SEQ ID NO: 1539734 - protein, 5 aa, Mycobacterium tuberculosis
STGAF

SEQ ID NO: 1539735 - protein, 5 aa, Mycobacterium tuberculosis
SYGRT

SEQ ID NO: 1539736 - protein, 5 aa, Mycobacterium tuberculosis
TDLAN

SEQ ID NO: 1539737 - protein, 7 aa, Mycobacterium tuberculosis
TDPGGEI

SEQ ID NO: 1539738 - protein, 11 aa, Mycobacterium tuberculosis
TDVAAGQALQA

SEQ ID NO: 1539739 - protein, 6 aa, Mycobacterium tuberculosis
TNSAGK

SEQ ID NO: 1539740 - protein, 5 aa, Mycobacterium tuberculosis
TNSEH

SEQ ID NO: 1539741 - protein, 15 aa, Mycobacterium tuberculosis
TPSRPGTATLEPGHT

SEQ ID NO: 1539742 - protein, 10 aa, Mycobacterium tuberculosis
TRADGKRDRD

SEQ ID NO: 1539743 - protein, 10 aa, Mycobacterium tuberculosis
TREPNSGIRD

SEQ ID NO: 1539744 - protein, 6 aa, Mycobacterium tuberculosis
TRNPGF

SEQ ID NO: 1539745 - protein, 7 aa, Mycobacterium tuberculosis
TRNRPGH

SEQ ID NO: 1539746 - protein, 14 aa, Mycobacterium tuberculosis
TSGGGAYAAAEAAA

SEQ ID NO: 1539747 - protein, 7 aa, Mycobacterium tuberculosis
TSPANPE

SEQ ID NO: 1539748 - protein, 58 aa, Mycobacterium tuberculosis
TTIDGRPVASPGSGPTEPTFPTPRPTTAPPGTTAPTLPTTPVSPTAPAGAIPLPPDSN

SEQ ID NO: 1539749 - protein, 9 aa, Mycobacterium tuberculosis
TTRGSQLTP

SEQ ID NO: 1539750 - protein, 4 aa, Mycobacterium tuberculosis
TVTD

SEQ ID NO: 1539751 - protein, 5 aa, Mycobacterium tuberculosis
TVTGS

SEQ ID NO: 1539752 - protein, 7 aa, Mycobacterium tuberculosis
VEPGGAV

SEQ ID NO: 1539753 - protein, 10 aa, Mycobacterium tuberculosis
VGDGGLPAEL

SEQ ID NO: 1539754 - protein, 23 aa, Mycobacterium tuberculosis
VGRQSPRPATMDGAGFEAPCMPY

SEQ ID NO: 1539755 - protein, 17 aa, Mycobacterium tuberculosis
VGTASAGRTGPAPGSWR

SEQ ID NO: 1539756 - protein, 7 aa, Mycobacterium tuberculosis
VKSATTN

SEQ ID NO: 1539757 - protein, 5 aa, Mycobacterium tuberculosis
VPHLP

SEQ ID NO: 1539758 - protein, 4 aa, Mycobacterium tuberculosis
VPTQ

SEQ ID NO: 1539759 - protein, 9 aa, Mycobacterium tuberculosis
VQPAARGSI

SEQ ID NO: 1539760 - protein, 4 aa, Mycobacterium tuberculosis
VQTG

SEQ ID NO: 1539761 - protein, 9 aa, Mycobacterium tuberculosis
VRAERVSNE

SEQ ID NO: 1539762 - protein, 9 aa, Mycobacterium tuberculosis
VRPGSAEEV

SEQ ID NO: 1539763 - protein, 9 aa, Mycobacterium tuberculosis
VRRDNTGYD

SEQ ID NO: 1539764 - protein, 13 aa, Mycobacterium tuberculosis
VSNRNSPTPQIDR

SEQ ID NO: 1539765 - protein, 8 aa, Mycobacterium tuberculosis
VSTVTGAA

SEQ ID NO: 1539766 - protein, 6 aa, Mycobacterium tuberculosis
VTTDPD

SEQ ID NO: 1539767 - protein, 14 aa, Mycobacterium tuberculosis
WESSPTPPADPTPI

SEQ ID NO: 1539768 - protein, 6 aa, Mycobacterium tuberculosis
YAPGHE

SEQ ID NO: 1539769 - protein, 8 aa, Mycobacterium tuberculosis
YGAGPCPG

SEQ ID NO: 1539770 - protein, 4 aa, Mycobacterium tuberculosis
YGTA

SEQ ID NO: 1539771 - protein, 9 aa, Mycobacterium tuberculosis
AAITSGAAI

SEQ ID NO: 1539772 - protein, 6 aa, Mycobacterium tuberculosis
AARGTA

SEQ ID NO: 1539773 - protein, 10 aa, Mycobacterium tuberculosis
AATTISGATL

SEQ ID NO: 1539774 - protein, 4 aa, Mycobacterium tuberculosis
ADAD

SEQ ID NO: 1539775 - protein, 10 aa, Mycobacterium tuberculosis
ADDSALTAEA

SEQ ID NO: 1539776 - protein, 15 aa, Mycobacterium tuberculosis
ADSYAATEAANIIAV

SEQ ID NO: 1539777 - protein, 5 aa, Mycobacterium tuberculosis
AEGEP

SEQ ID NO: 1539778 - protein, 14 aa, Mycobacterium tuberculosis
AGAGAYASAEAAGA

SEQ ID NO: 1539779 - protein, 13 aa, Mycobacterium tuberculosis
AGGAGGAGGAGGL

SEQ ID NO: 1539780 - protein, 12 aa, Mycobacterium tuberculosis
AGKTGTAQQINP

SEQ ID NO: 1539781 - protein, 6 aa, Mycobacterium tuberculosis
AGNGRY

SEQ ID NO: 1539782 - protein, 10 aa, Mycobacterium tuberculosis
AGSRDTHAPN

SEQ ID NO: 1539783 - protein, 9 aa, Mycobacterium tuberculosis
AGTGGNGGF

SEQ ID NO: 1539784 - protein, 8 aa, Mycobacterium tuberculosis
AGTPATTM

SEQ ID NO: 1539785 - protein, 10 aa, Mycobacterium tuberculosis
AKSDEHDAAA

SEQ ID NO: 1539786 - protein, 16 aa, Mycobacterium tuberculosis
ALPAPPPLPGPPPLPA

SEQ ID NO: 1539787 - protein, 16 aa, Mycobacterium tuberculosis
ALSTANAAAAAPTTAL

SEQ ID NO: 1539788 - protein, 7 aa, Mycobacterium tuberculosis
ALTGSPV

SEQ ID NO: 1539789 - protein, 4 aa, Mycobacterium tuberculosis
ANKD

SEQ ID NO: 1539790 - protein, 5 aa, Mycobacterium tuberculosis
APHSA

SEQ ID NO: 1539791 - protein, 15 aa, Mycobacterium tuberculosis
APITQPPAGRPPNDL

SEQ ID NO: 1539792 - protein, 6 aa, Mycobacterium tuberculosis
APVAGS

SEQ ID NO: 1539793 - protein, 5 aa, Mycobacterium tuberculosis
AQDPV

SEQ ID NO: 1539794 - protein, 9 aa, Mycobacterium tuberculosis
AQDTDPRTC

SEQ ID NO: 1539795 - protein, 15 aa, Mycobacterium tuberculosis
ARIGPGAAAKRDPQL

SEQ ID NO: 1539796 - protein, 6 aa, Mycobacterium tuberculosis
ARRARQ

SEQ ID NO: 1539797 - protein, 11 aa, Mycobacterium tuberculosis
ATAGAFSRPGL

SEQ ID NO: 1539798 - protein, 13 aa, Mycobacterium tuberculosis
ATGSITKIYLRAT

SEQ ID NO: 1539799 - protein, 7 aa, Mycobacterium tuberculosis
ATVTTAD

SEQ ID NO: 1539800 - protein, 4 aa, Mycobacterium tuberculosis
ATVY

SEQ ID NO: 1539801 - protein, 8 aa, Mycobacterium tuberculosis
AVGPASPV

SEQ ID NO: 1539802 - protein, 9 aa, Mycobacterium tuberculosis
AVNRPTPDR

SEQ ID NO: 1539803 - protein, 19 aa, Mycobacterium tuberculosis
DGASNGAWGKGASETFNGG

SEQ ID NO: 1539804 - protein, 28 aa, Mycobacterium tuberculosis
DGGNGGAGGLGTGPVGATGGIGGPGGAA

SEQ ID NO: 1539805 - protein, 7 aa, Mycobacterium tuberculosis
DHDQTDR

SEQ ID NO: 1539806 - protein, 8 aa, Mycobacterium tuberculosis
DLPGQLNE

SEQ ID NO: 1539807 - protein, 8 aa, Mycobacterium tuberculosis
DPATATPP

SEQ ID NO: 1539808 - protein, 20 aa, Mycobacterium tuberculosis
DYSGPGSGLGGSDPNGVVSP

SEQ ID NO: 1539809 - protein, 10 aa, Mycobacterium tuberculosis
EESEPEREFE

SEQ ID NO: 1539810 - protein, 6 aa, Mycobacterium tuberculosis
EGAKQA

SEQ ID NO: 1539811 - protein, 4 aa, Mycobacterium tuberculosis
ENPL

SEQ ID NO: 1539812 - protein, 6 aa, Mycobacterium tuberculosis
EQSVDA

SEQ ID NO: 1539813 - protein, 5 aa, Mycobacterium tuberculosis
ESAGR

SEQ ID NO: 1539814 - protein, 6 aa, Mycobacterium tuberculosis
FGNSGL

SEQ ID NO: 1539815 - protein, 7 aa, Mycobacterium tuberculosis
FPSDNGE

SEQ ID NO: 1539816 - protein, 8 aa, Mycobacterium tuberculosis
FPSDNGEQ

SEQ ID NO: 1539817 - protein, 4 aa, Mycobacterium tuberculosis
FSVD

SEQ ID NO: 1539818 - protein, 15 aa, Mycobacterium tuberculosis
FTNPRPATPSAGLSI

SEQ ID NO: 1539819 - protein, 5 aa, Mycobacterium tuberculosis
GAAAA

SEQ ID NO: 1539820 - protein, 19 aa, Mycobacterium tuberculosis
GAAEGPYGFTGTSNSFASG

SEQ ID NO: 1539821 - protein, 6 aa, Mycobacterium tuberculosis
GAQDPV

SEQ ID NO: 1539822 - protein, 5 aa, Mycobacterium tuberculosis
GEPTI

SEQ ID NO: 1539823 - protein, 12 aa, Mycobacterium tuberculosis
GGASAAAAALPS

SEQ ID NO: 1539824 - protein, 36 aa, Mycobacterium tuberculosis; identical to SEQ ID NO: 175642

SEQ ID NO: 1539825 - protein, 4 aa, Mycobacterium tuberculosis
GGGN

SEQ ID NO: 1539826 - protein, 14 aa, Mycobacterium tuberculosis
GGISGPTRGTGTGI

SEQ ID NO: 1539827 - protein, 21 aa, Mycobacterium tuberculosis
GGMGGSGGGIGAGTTTVVPPD

SEQ ID NO: 1539828 - protein, 23 aa, Mycobacterium tuberculosis
GGQGGLGGAGGQGGTGGAGGDGV

SEQ ID NO: 1539829 - protein, 10 aa, Mycobacterium tuberculosis
GGVGGAGGNA

SEQ ID NO: 1539830 - protein, 6 aa, Mycobacterium tuberculosis
GHDDRG

SEQ ID NO: 1539831 - protein, 8 aa, Mycobacterium tuberculosis
GLGGHPRL

SEQ ID NO: 1539832 - protein, 16 aa, Mycobacterium tuberculosis
GNANTGVANAGNVNTG

SEQ ID NO: 1539833 - protein, 18 aa, Mycobacterium tuberculosis
GNGANGAPGTGANGAPGG

SEQ ID NO: 1539834 - protein, 5 aa, Mycobacterium tuberculosis
GNSAQ

SEQ ID NO: 1539835 - protein, 9 aa, Mycobacterium tuberculosis
GPPGTGKTT

SEQ ID NO: 1539836 - protein, 7 aa, Mycobacterium tuberculosis
GPRPEMA

SEQ ID NO: 1539837 - protein, 7 aa, Mycobacterium tuberculosis
GQISGSV

SEQ ID NO: 1539838 - protein, 11 aa, Mycobacterium tuberculosis
GRRPKLYGAGA

SEQ ID NO: 1539839 - protein, 29 aa, Mycobacterium tuberculosis
GRSAGKTSEPTCPTEPIDAADSSTTPDPS

SEQ ID NO: 1539840 - protein, 10 aa, Mycobacterium tuberculosis
GSAGSGHQQA

SEQ ID NO: 1539841 - protein, 8 aa, Mycobacterium tuberculosis
GSDPKGAV

SEQ ID NO: 1539842 - protein, 9 aa, Mycobacterium tuberculosis
GSGARYGRQ

SEQ ID NO: 1539843 - protein, 17 aa, Mycobacterium tuberculosis
GSSISAANAAAAAPTTA

SEQ ID NO: 1539844 - protein, 51 aa, Mycobacterium tuberculosis
GSVKKQTAIEPLPPMPGPSPTRPTTTTPTPPSPSAAPAPTTTTGTPSETVA

SEQ ID NO: 1539845 - protein, 15 aa, Mycobacterium tuberculosis
GTHERRAAATRRSAL

SEQ ID NO: 1539846 - protein, 9 aa, Mycobacterium tuberculosis
GTRQTLQGA

SEQ ID NO: 1539847 - protein, 14 aa, Mycobacterium tuberculosis
GVGGTGGKGGVGGV

SEQ ID NO: 1539848 - protein, 4 aa, Mycobacterium tuberculosis
GWGS

SEQ ID NO: 1539849 - protein, 16 aa, Mycobacterium tuberculosis
HDPEKAAQIREEDDAM

SEQ ID NO: 1539850 - protein, 12 aa, Mycobacterium tuberculosis
IEESEPEREFEE

SEQ ID NO: 1539851 - protein, 71 aa, Mycobacterium tuberculosis; identical to SEQ ID NO: 178523

SEQ ID NO: 1539852 - protein, 8 aa, Mycobacterium tuberculosis
IGAAAAGV

SEQ ID NO: 1539853 - protein, 6 aa, Mycobacterium tuberculosis
IPPDRA

SEQ ID NO: 1539854 - protein, 24 aa, Mycobacterium tuberculosis
IPVGAPGSTAVPPLPPPVTPAISG

SEQ ID NO: 1539855 - protein, 13 aa, Mycobacterium tuberculosis
ISAEPADETRTDY

SEQ ID NO: 1539856 - protein, 15 aa, Mycobacterium tuberculosis
KAAEAAAPSSSFPSL

SEQ ID NO: 1539857 - protein, 4 aa, Mycobacterium tuberculosis
KPAL

SEQ ID NO: 1539858 - protein, 6 aa, Mycobacterium tuberculosis
KQASAA

SEQ ID NO: 1539859 - protein, 7 aa, Mycobacterium tuberculosis
KSAGKWP

SEQ ID NO: 1539860 - protein, 15 aa, Mycobacterium tuberculosis
KSLSDGALRGPGEVS

SEQ ID NO: 1539861 - protein, 5 aa, Mycobacterium tuberculosis
KSTRF

SEQ ID NO: 1539862 - protein, 6 aa, Mycobacterium tuberculosis
KVAQPS

SEQ ID NO: 1539863 - protein, 9 aa, Mycobacterium tuberculosis
LAGAGSGIA

SEQ ID NO: 1539864 - protein, 19 aa, Mycobacterium tuberculosis
LANPTRPPANPQALTPPKV

SEQ ID NO: 1539865 - protein, 6 aa, Mycobacterium tuberculosis
LEAAQS

SEQ ID NO: 1539866 - protein, 7 aa, Mycobacterium tuberculosis
LNRSERD

SEQ ID NO: 1539867 - protein, 5 aa, Mycobacterium tuberculosis
LPLGT

SEQ ID NO: 1539868 - protein, 7 aa, Mycobacterium tuberculosis
MRRGGTV

SEQ ID NO: 1539869 - protein, 34 aa, Mycobacterium tuberculosis; identical to SEQ ID NO: 1424350

SEQ ID NO: 1539870 - protein, 26 aa, Mycobacterium tuberculosis
NGGTGGASDLAGTGRGGVGGAGGAGG

SEQ ID NO: 1539871 - protein, 6 aa, Mycobacterium tuberculosis
NKPADH

SEQ ID NO: 1539872 - protein, 7 aa, Mycobacterium tuberculosis
NPNVTGS

SEQ ID NO: 1539873 - protein, 18 aa, Mycobacterium tuberculosis
NTGGGGGSGFSNSGSGMS

SEQ ID NO: 1539874 - protein, 6 aa, Mycobacterium tuberculosis
NVGQNP

SEQ ID NO: 1539875 - protein, 18 aa, Mycobacterium tuberculosis
PAASADPPDPTVSDGACP

SEQ ID NO: 1539876 - protein, 6 aa, Mycobacterium tuberculosis
PANADG

SEQ ID NO: 1539877 - protein, 8 aa, Mycobacterium tuberculosis
PDGMPGGE

SEQ ID NO: 1539878 - protein, 6 aa, Mycobacterium tuberculosis
PDSPEA

SEQ ID NO: 1539879 - protein, 6 aa, Mycobacterium tuberculosis
PIPARS

SEQ ID NO: 1539880 - protein, 5 aa, Mycobacterium tuberculosis
PIPDD

SEQ ID NO: 1539881 - protein, 17 aa, Mycobacterium tuberculosis
PNPPAPPPANTLVGGRH

SEQ ID NO: 1539882 - protein, 11 aa, Mycobacterium tuberculosis
PPTSQPHAVSA

SEQ ID NO: 1539883 - protein, 7 aa, Mycobacterium tuberculosis
PSSPVSL

SEQ ID NO: 1539884 - protein, 6 aa, Mycobacterium tuberculosis
PTDHDT

SEQ ID NO: 1539885 - protein, 9 aa, Mycobacterium tuberculosis
PTLSSKQKW

SEQ ID NO: 1539886 - protein, 10 aa, Mycobacterium tuberculosis
QASGIPKANY

SEQ ID NO: 1539887 - protein, 16 aa, Mycobacterium tuberculosis
QGNPAQQRYPPWPASY

SEQ ID NO: 1539888 - protein, 4 aa, Mycobacterium tuberculosis
QGYQ

SEQ ID NO: 1539889 - protein, 4 aa, Mycobacterium tuberculosis
QNAA

SEQ ID NO: 1539890 - protein, 4 aa, Mycobacterium tuberculosis
QNGA

SEQ ID NO: 1539891 - protein, 7 aa, Mycobacterium tuberculosis
QPPVTDR

SEQ ID NO: 1539892 - protein, 18 aa, Mycobacterium tuberculosis
QPTDPRTLPPDAPDDRKY

SEQ ID NO: 1539893 - protein, 6 aa, Mycobacterium tuberculosis
QTYGAE

SEQ ID NO: 1539894 - protein, 8 aa, Mycobacterium tuberculosis
QVGRTASR

SEQ ID NO: 1539895 - protein, 6 aa, Mycobacterium tuberculosis
QVQGVP

SEQ ID NO: 1539896 - protein, 16 aa, Mycobacterium tuberculosis
RALGSNKSYPASQTAE

SEQ ID NO: 1539897 - protein, 4 aa, Mycobacterium tuberculosis
RATS

SEQ ID NO: 1539898 - protein, 4 aa, Mycobacterium tuberculosis
RDGG

SEQ ID NO: 1539899 - protein, 9 aa, Mycobacterium tuberculosis
RDGRDDSGF

SEQ ID NO: 1539900 - protein, 4 aa, Mycobacterium tuberculosis
RGNG

SEQ ID NO: 1539901 - protein, 13 aa, Mycobacterium tuberculosis
RISRTDTPKPSPT

SEQ ID NO: 1539902 - protein, 5 aa, Mycobacterium tuberculosis
RNDGT

SEQ ID NO: 1539903 - protein, 6 aa, Mycobacterium tuberculosis
RNDGTW

SEQ ID NO: 1539904 - protein, 14 aa, Mycobacterium tuberculosis
RNSPDGDEPLPADG

SEQ ID NO: 1539905 - protein, 4 aa, Mycobacterium tuberculosis
RPPV

SEQ ID NO: 1539906 - protein, 14 aa, Mycobacterium tuberculosis
RRLTEANDSPAGEA

SEQ ID NO: 1539907 - protein, 7 aa, Mycobacterium tuberculosis
RSAEKVS

SEQ ID NO: 1539908 - protein, 10 aa, Mycobacterium tuberculosis
RSGMQRQEAQ

SEQ ID NO: 1539909 - protein, 5 aa, Mycobacterium tuberculosis
RSIAP

SEQ ID NO: 1539910 - protein, 8 aa, Mycobacterium tuberculosis
RSQGNESA

SEQ ID NO: 1539911 - protein, 4 aa, Mycobacterium tuberculosis
RTDV

SEQ ID NO: 1539912 - protein, 26 aa, Mycobacterium tuberculosis
SAQADPEADPGAGEANYGGPPSSPRL

SEQ ID NO: 1539913 - protein, 7 aa, Mycobacterium tuberculosis
SARAEES

SEQ ID NO: 1539914 - protein, 18 aa, Mycobacterium tuberculosis
SDQRGDRSSDQPTPASVA

SEQ ID NO: 1539915 - protein, 4 aa, Mycobacterium tuberculosis
SEQC

SEQ ID NO: 1539916 - protein, 6 aa, Mycobacterium tuberculosis
SESGAE

SEQ ID NO: 1539917 - protein, 8 aa, Mycobacterium tuberculosis
SGGTPPFD

SEQ ID NO: 1539918 - protein, 4 aa, Mycobacterium tuberculosis
SGLP

SEQ ID NO: 1539919 - protein, 8 aa, Mycobacterium tuberculosis
SGLPNQTD

SEQ ID NO: 1539920 - protein, 6 aa, Mycobacterium tuberculosis
SPAYND

SEQ ID NO: 1539921 - protein, 8 aa, Mycobacterium tuberculosis
STENAEQY

SEQ ID NO: 1539922 - protein, 27 aa, Mycobacterium tuberculosis
SVGAGTPGPAGTSGTATTGPKTAPKTA

SEQ ID NO: 1539923 - protein, 12 aa, Mycobacterium tuberculosis
TAELPQTSTAAV

SEQ ID NO: 1539924 - protein, 4 aa, Mycobacterium tuberculosis
TAPT

SEQ ID NO: 1539925 - protein, 7 aa, Mycobacterium tuberculosis
TATAHPA

SEQ ID NO: 1539926 - protein, 6 aa, Mycobacterium tuberculosis
TDIDGI

SEQ ID NO: 1539927 - protein, 8 aa, Mycobacterium tuberculosis
TDTYDAAA

SEQ ID NO: 1539928 - protein, 11 aa, Mycobacterium tuberculosis
TGAGGGSGFGN

SEQ ID NO: 1539929 - protein, 17 aa, Mycobacterium tuberculosis
TGDNQSGIGGLNSGTGN

SEQ ID NO: 1539930 - protein, 7 aa, Mycobacterium tuberculosis
THPEPKV

SEQ ID NO: 1539931 - protein, 6 aa, Mycobacterium tuberculosis
TPGATI

SEQ ID NO: 1539932 - protein, 7 aa, Mycobacterium tuberculosis
TQDGPLT

SEQ ID NO: 1539933 - protein, 6 aa, Mycobacterium tuberculosis
TREGNR

SEQ ID NO: 1539934 - protein, 8 aa, Mycobacterium tuberculosis
TRQTLQGA

SEQ ID NO: 1539935 - protein, 5 aa, Mycobacterium tuberculosis
TSDNM

SEQ ID NO: 1539936 - protein, 12 aa, Mycobacterium tuberculosis
TTADGRDPSSTY

SEQ ID NO: 1539937 - protein, 9 aa, Mycobacterium tuberculosis
TTAPSAAPN

SEQ ID NO: 1539938 - protein, 6 aa, Mycobacterium tuberculosis
TTDSGL

SEQ ID NO: 1539939 - protein, 4 aa, Mycobacterium tuberculosis
TTIG

SEQ ID NO: 1539940 - protein, 9 aa, Mycobacterium tuberculosis
TVKSSQPPV

SEQ ID NO: 1539941 - protein, 5 aa, Mycobacterium tuberculosis
TVPEH

SEQ ID NO: 1539942 - protein, 8 aa, Mycobacterium tuberculosis
TVTTDDVR

SEQ ID NO: 1539943 - protein, 4 aa, Mycobacterium tuberculosis
VADR

SEQ ID NO: 1539944 - protein, 12 aa, Mycobacterium tuberculosis
VETEPGGGDRYG

SEQ ID NO: 1539945 - protein, 5 aa, Mycobacterium tuberculosis
VETSR

SEQ ID NO: 1539946 - protein, 6 aa, Mycobacterium tuberculosis
VGATSE

SEQ ID NO: 1539947 - protein, 7 aa, Mycobacterium tuberculosis
VGNGNVG

SEQ ID NO: 1539948 - protein, 5 aa, Mycobacterium tuberculosis
VGPER

SEQ ID NO: 1539949 - protein, 6 aa, Mycobacterium tuberculosis
VRPPSM

SEQ ID NO: 1539950 - protein, 6 aa, Mycobacterium tuberculosis
VRSAEA

SEQ ID NO: 1539951 - protein, 7 aa, Mycobacterium tuberculosis
VSPANGA

SEQ ID NO: 1539952 - protein, 7 aa, Mycobacterium tuberculosis
VTEEANA

SEQ ID NO: 1539953 - protein, 7 aa, Mycobacterium tuberculosis
VTQTAAA

SEQ ID NO: 1539954 - protein, 10 aa, Mycobacterium tuberculosis
VYPSSNHAEA

SEQ ID NO: 1539955 - protein, 10 aa, Mycobacterium tuberculosis
WGGAAPGGFD

SEQ ID NO: 1539956 - protein, 5 aa, Mycobacterium tuberculosis
WQSTR

SEQ ID NO: 1539957 - protein, 12 aa, Mycobacterium tuberculosis
YDAAATQSGGVC

SEQ ID NO: 1539958 - protein, 4 aa, Mycobacterium tuberculosis
YDES

SEQ ID NO: 1539959 - protein, 18 aa, Mycobacterium tuberculosis
YGASADQSRGVADGKPAD

SEQ ID NO: 1539960 - protein, 6 aa, Mycobacterium tuberculosis
AAAIGG

SEQ ID NO: 1539961 - protein, 8 aa, Mycobacterium tuberculosis
AAGAAGGG

SEQ ID NO: 1539962 - protein, 10 aa, Mycobacterium tuberculosis
AAKAPLRQTA

SEQ ID NO: 1539963 - protein, 18 aa, Mycobacterium tuberculosis
AANPTGPASVQGMSQDPV

SEQ ID NO: 1539964 - protein, 4 aa, Mycobacterium tuberculosis
AAPY

SEQ ID NO: 1539965 - protein, 6 aa, Mycobacterium tuberculosis
AARQTG

SEQ ID NO: 1539966 - protein, 11 aa, Mycobacterium tuberculosis
ADAAAAATTTG

SEQ ID NO: 1539967 - protein, 5 aa, Mycobacterium tuberculosis
AESGA

SEQ ID NO: 1539968 - protein, 32 aa, Mycobacterium tuberculosis; identical to SEQ ID NO: 231923

SEQ ID NO: 1539969 - protein, 33 aa, Mycobacterium tuberculosis; identical to SEQ ID NO: 1433296

SEQ ID NO: 1539970 - protein, 14 aa, Mycobacterium tuberculosis
AGEDQPPAPDEPVT

SEQ ID NO: 1539971 - protein, 29 aa, Mycobacterium tuberculosis
AGGAGGVGGAALGGGAQAAGGNGGAGGVG

SEQ ID NO: 1539972 - protein, 8 aa, Mycobacterium tuberculosis
AGLSATAP

SEQ ID NO: 1539973 - protein, 10 aa, Mycobacterium tuberculosis
AGPPPTPSRV

SEQ ID NO: 1539974 - protein, 7 aa, Mycobacterium tuberculosis
AHPSEPG

SEQ ID NO: 1539975 - protein, 8 aa, Mycobacterium tuberculosis
AKPAAAAS

SEQ ID NO: 1539976 - protein, 10 aa, Mycobacterium tuberculosis
ALGENGNGGM

SEQ ID NO: 1539977 - protein, 9 aa, Mycobacterium tuberculosis
ALGRSGTIA

SEQ ID NO: 1539978 - protein, 6 aa, Mycobacterium tuberculosis
APPGRA

SEQ ID NO: 1539979 - protein, 4 aa, Mycobacterium tuberculosis
APVG

SEQ ID NO: 1539980 - protein, 12 aa, Mycobacterium tuberculosis
APVPPPRPPTVK

SEQ ID NO: 1539981 - protein, 8 aa, Mycobacterium tuberculosis
AQVKSDRL

SEQ ID NO: 1539982 - protein, 9 aa, Mycobacterium tuberculosis
ASGIPKANY

SEQ ID NO: 1539983 - protein, 28 aa, Mycobacterium tuberculosis
ASSEDAEAESDASNPSRGETVVHYRSDP

SEQ ID NO: 1539984 - protein, 9 aa, Mycobacterium tuberculosis
ATADDATHQ

SEQ ID NO: 1539985 - protein, 10 aa, Mycobacterium tuberculosis
ATADPAASGW

SEQ ID NO: 1539986 - protein, 7 aa, Mycobacterium tuberculosis
ATEREAL

SEQ ID NO: 1539987 - protein, 10 aa, Mycobacterium tuberculosis
ATNGSETGRR

SEQ ID NO: 1539988 - protein, 4 aa, Mycobacterium tuberculosis
ATPG

SEQ ID NO: 1539989 - protein, 4 aa, Mycobacterium tuberculosis
ATQR

SEQ ID NO: 1539990 - protein, 5 aa, Mycobacterium tuberculosis
ATRIP

SEQ ID NO: 1539991 - protein, 6 aa, Mycobacterium tuberculosis
CTKPAT

SEQ ID NO: 1539992 - protein, 6 aa, Mycobacterium tuberculosis
DAAGDL

SEQ ID NO: 1539993 - protein, 15 aa, Mycobacterium tuberculosis
DAAIPTGIQNPCFSH

SEQ ID NO: 1539994 - protein, 5 aa, Mycobacterium tuberculosis
DAALS

SEQ ID NO: 1539995 - protein, 6 aa, Mycobacterium tuberculosis
DAALSA

SEQ ID NO: 1539996 - protein, 15 aa, Mycobacterium tuberculosis
DGANGTAENPDGQNG

SEQ ID NO: 1539997 - protein, 10 aa, Mycobacterium tuberculosis
DGGAGGVGGV

SEQ ID NO: 1539998 - protein, 31 aa, Mycobacterium tuberculosis; identical to SEQ ID NO: 1427555

SEQ ID NO: 1539999 - protein, 5 aa, Mycobacterium tuberculosis
DGQTV

SEQ ID NO: 1540000 - protein, 16 aa, Mycobacterium tuberculosis
DGTHGAPGTGQNGGAG

SEQ ID NO: 1540001 - protein, 7 aa, Mycobacterium tuberculosis
DGVTTQL

SEQ ID NO: 1540002 - protein, 4 aa, Mycobacterium tuberculosis
DLTG

SEQ ID NO: 1540003 - protein, 8 aa, Mycobacterium tuberculosis
DNGDPANR

SEQ ID NO: 1540004 - protein, 9 aa, Mycobacterium tuberculosis
DPDEDAGTA

SEQ ID NO: 1540005 - protein, 5 aa, Mycobacterium tuberculosis
DPGAL

SEQ ID NO: 1540006 - protein, 22 aa, Mycobacterium tuberculosis
DPMPARSEAAAANTSGATTTND

SEQ ID NO: 1540007 - protein, 5 aa, Mycobacterium tuberculosis
DSEGC

SEQ ID NO: 1540008 - protein, 21 aa, Mycobacterium tuberculosis
DSNSWVPNKPDAATPVIPGPV

SEQ ID NO: 1540009 - protein, 5 aa, Mycobacterium tuberculosis
DSTYS

SEQ ID NO: 1540010 - protein, 6 aa, Mycobacterium tuberculosis
EAAAVN

SEQ ID NO: 1540011 - protein, 6 aa, Mycobacterium tuberculosis
EAVGSG

SEQ ID NO: 1540012 - protein, 7 aa, Mycobacterium tuberculosis
EGAMTPG

SEQ ID NO: 1540013 - protein, 11 aa, Mycobacterium tuberculosis
EGPPDKYQTTG

SEQ ID NO: 1540014 - protein, 5 aa, Mycobacterium tuberculosis
EHRRT

SEQ ID NO: 1540015 - protein, 5 aa, Mycobacterium tuberculosis
EPAEP

SEQ ID NO: 1540016 - protein, 4 aa, Mycobacterium tuberculosis
EPET

SEQ ID NO: 1540017 - protein, 6 aa, Mycobacterium tuberculosis
ERKDKL

SEQ ID NO: 1540018 - protein, 7 aa, Mycobacterium tuberculosis
ERKDKLE

SEQ ID NO: 1540019 - protein, 69 aa, Mycobacterium tuberculosis
FDGGQGGQGGAGGSAGAGGINGAGGAGGNGGDGGDGATGAAGLGDNGGVGGDGGAGGAAGNGGNAGVGL

SEQ ID NO: 1540020 - protein, 15 aa, Mycobacterium tuberculosis
FGAAGGAAGAGGAGG

SEQ ID NO: 1540021 - protein, 10 aa, Mycobacterium tuberculosis
FGNAGNNNFG

SEQ ID NO: 1540022 - protein, 6 aa, Mycobacterium tuberculosis
FGRGSN

SEQ ID NO: 1540023 - protein, 14 aa, Mycobacterium tuberculosis
FTSTDTVTVSSPRA

SEQ ID NO: 1540024 - protein, 11 aa, Mycobacterium tuberculosis
GAANAAAGAPT

SEQ ID NO: 1540025 - protein, 10 aa, Mycobacterium tuberculosis
GAAPTTDRRT

SEQ ID NO: 1540026 - protein, 5 aa, Mycobacterium tuberculosis
GAGAA

SEQ ID NO: 1540027 - protein, 8 aa, Mycobacterium tuberculosis
GAPINSAT

SEQ ID NO: 1540028 - protein, 10 aa, Mycobacterium tuberculosis
GDAASTGGLT

SEQ ID NO: 1540029 - protein, 9 aa, Mycobacterium tuberculosis
GDGGWGGRG

SEQ ID NO: 1540030 - protein, 5 aa, Mycobacterium tuberculosis
GDHQL

SEQ ID NO: 1540031 - protein, 6 aa, Mycobacterium tuberculosis
GDLDKP

SEQ ID NO: 1540032 - protein, 10 aa, Mycobacterium tuberculosis
GDPDEDAGTA

SEQ ID NO: 1540033 - protein, 26 aa, Mycobacterium tuberculosis
GDTNTGFGNAGFTNTGFGNAGSGNFG

SEQ ID NO: 1540034 - protein, 16 aa, Mycobacterium tuberculosis
GERLNEQAATDTFGNY

SEQ ID NO: 1540035 - protein, 9 aa, Mycobacterium tuberculosis
GFQQGTAPN

SEQ ID NO: 1540036 - protein, 9 aa, Mycobacterium tuberculosis
GGDATGAEV

SEQ ID NO: 1540037 - protein, 23 aa, Mycobacterium tuberculosis
GGGSWGDDCRPAGIGGLGGRGSR

SEQ ID NO: 1540038 - protein, 9 aa, Mycobacterium tuberculosis
GGHQTPNGT

SEQ ID NO: 1540039 - protein, 9 aa, Mycobacterium tuberculosis
GGIRDDESL

SEQ ID NO: 1540040 - protein, 10 aa, Mycobacterium tuberculosis
GGLRTGNTVE

SEQ ID NO: 1540041 - protein, 26 aa, Mycobacterium tuberculosis
GGNGGVGGTSVAAGIGGAGGNGGNAG

SEQ ID NO: 1540042 - protein, 14 aa, Mycobacterium tuberculosis
GGNVSSEHGVGSRK

SEQ ID NO: 1540043 - protein, 9 aa, Mycobacterium tuberculosis
GHGGHGGNA

SEQ ID NO: 1540044 - protein, 5 aa, Mycobacterium tuberculosis
GIGST

SEQ ID NO: 1540045 - protein, 12 aa, Mycobacterium tuberculosis
GKAGSQTEYGSA

SEQ ID NO: 1540046 - protein, 6 aa, Mycobacterium tuberculosis
GKPSLE

SEQ ID NO: 1540047 - protein, 8 aa, Mycobacterium tuberculosis
GLRGHGDD

SEQ ID NO: 1540048 - protein, 14 aa, Mycobacterium tuberculosis
GLSVKGAQPGNASN

SEQ ID NO: 1540049 - protein, 18 aa, Mycobacterium tuberculosis
GNGADGAAGTGQAGGAGG

SEQ ID NO: 1540050 - protein, 26 aa, Mycobacterium tuberculosis
GNGGAGGAGASNQAGNGGAGGNGGAG

SEQ ID NO: 1540051 - protein, 12 aa, Mycobacterium tuberculosis
GNGGDGGTGGTL

SEQ ID NO: 1540052 - protein, 23 aa, Mycobacterium tuberculosis
GNGGSGGSGGAGAAGGVGGSGGW

SEQ ID NO: 1540053 - protein, 5 aa, Mycobacterium tuberculosis
GPDVT

SEQ ID NO: 1540054 - protein, 10 aa, Mycobacterium tuberculosis
GPPPFRPPTF

SEQ ID NO: 1540055 - protein, 12 aa, Mycobacterium tuberculosis
GPVAGQDPTPFV

SEQ ID NO: 1540056 - protein, 10 aa, Mycobacterium tuberculosis
GRLGDSRGDI

SEQ ID NO: 1540057 - protein, 26 aa, Mycobacterium tuberculosis
GSGGVGGAGGFGETGDGGVGGAGGKA

SEQ ID NO: 1540058 - protein, 16 aa, Mycobacterium tuberculosis
GSYNTGIGNSGVASTG

SEQ ID NO: 1540059 - protein, 27 aa, Mycobacterium tuberculosis
GTGGAGGAGGSSTVGDGGAGGAGGSGG

SEQ ID NO: 1540060 - protein, 10 aa, Mycobacterium tuberculosis
GTPPGRGGSA

SEQ ID NO: 1540061 - protein, 4 aa, Mycobacterium tuberculosis
GWTT

SEQ ID NO: 1540062 - protein, 8 aa, Mycobacterium tuberculosis
HGDAADLA

SEQ ID NO: 1540063 - protein, 16 aa, Mycobacterium tuberculosis
HGVSGGTEIRRSNAPR

SEQ ID NO: 1540064 - protein, 13 aa, Mycobacterium tuberculosis
HTTRPATCSQEHS

SEQ ID NO: 1540065 - protein, 4 aa, Mycobacterium tuberculosis
IDNS

SEQ ID NO: 1540066 - protein, 4 aa, Mycobacterium tuberculosis
IDPV

SEQ ID NO: 1540067 - protein, 75 aa, Mycobacterium tuberculosis; identical to SEQ ID NO: 232184

SEQ ID NO: 1540068 - protein, 14 aa, Mycobacterium tuberculosis
IGNGGDGGNSVQTD

SEQ ID NO: 1540069 - protein, 7 aa, Mycobacterium tuberculosis
INTGNGY

SEQ ID NO: 1540070 - protein, 5 aa, Mycobacterium tuberculosis
IPPVP

SEQ ID NO: 1540071 - protein, 8 aa, Mycobacterium tuberculosis
ISYSGNQA

SEQ ID NO: 1540072 - protein, 9 aa, Mycobacterium tuberculosis
ITDARSSTF

SEQ ID NO: 1540073 - protein, 4 aa, Mycobacterium tuberculosis
IYGD

SEQ ID NO: 1540074 - protein, 29 aa, Mycobacterium tuberculosis
KAATLGATSTHATTPSGLDGPGGSGASTA

SEQ ID NO: 1540075 - protein, 7 aa, Mycobacterium tuberculosis
KKSLSDF

SEQ ID NO: 1540076 - protein, 7 aa, Mycobacterium tuberculosis
KLPASTI

SEQ ID NO: 1540077 - protein, 6 aa, Mycobacterium tuberculosis
KNYSGM

SEQ ID NO: 1540078 - protein, 7 aa, Mycobacterium tuberculosis
KPGTGST

SEQ ID NO: 1540079 - protein, 5 aa, Mycobacterium tuberculosis
KRGRD

SEQ ID NO: 1540080 - protein, 7 aa, Mycobacterium tuberculosis
LAHGGQP

SEQ ID NO: 1540081 - protein, 13 aa, Mycobacterium tuberculosis
LDPTGYLNAAVLF

SEQ ID NO: 1540082 - protein, 19 aa, Mycobacterium tuberculosis
LGLPTDPKKLASVAPSSNA

SEQ ID NO: 1540083 - protein, 14 aa, Mycobacterium tuberculosis
LGQPGTYTDFGNGA

SEQ ID NO: 1540084 - protein, 10 aa, Mycobacterium tuberculosis
LGSSAGRHAD

SEQ ID NO: 1540085 - protein, 4 aa, Mycobacterium tuberculosis
LPPQ

SEQ ID NO: 1540086 - protein, 10 aa, Mycobacterium tuberculosis
LQPDDGPQFA

SEQ ID NO: 1540087 - protein, 15 aa, Mycobacterium tuberculosis
LRGTRKAEEAAESAR

SEQ ID NO: 1540088 - protein, 9 aa, Mycobacterium tuberculosis
LSKQTGQQV

SEQ ID NO: 1540089 - protein, 5 aa, Mycobacterium tuberculosis
MGTPE

SEQ ID NO: 1540090 - protein, 20 aa, Mycobacterium tuberculosis
MRATDRSSGLPTSAKPARAR

SEQ ID NO: 1540091 - protein, 6 aa, Mycobacterium tuberculosis
NAGPDV

SEQ ID NO: 1540092 - protein, 24 aa, Mycobacterium tuberculosis
NGGAGGAGGQGAVTGGTGGAGGDG

SEQ ID NO: 1540093 - protein, 32 aa, Mycobacterium tuberculosis
NGGAGGTGSPGAVVGGNGGVGGLGGAGSPGGL

SEQ ID NO: 1540094 - protein, 22 aa, Mycobacterium tuberculosis
NGGNAGIGGTGPTAGDTGAGGI

SEQ ID NO: 1540095 - protein, 21 aa, Mycobacterium tuberculosis
NGGNGGSGAPGQPGGRGGDAG

SEQ ID NO: 1540096 - protein, 75 aa, Mycobacterium tuberculosis; identical to SEQ ID NO: 181337

SEQ ID NO: 1540097 - protein, 21 aa, Mycobacterium tuberculosis
NGNGGAGGAGGTGANGGAGGN

SEQ ID NO: 1540098 - protein, 5 aa, Mycobacterium tuberculosis
NLTGI

SEQ ID NO: 1540099 - protein, 7 aa, Mycobacterium tuberculosis
NPTNTAY

SEQ ID NO: 1540100 - protein, 6 aa, Mycobacterium tuberculosis
NSVYTS

SEQ ID NO: 1540101 - protein, 31 aa, Mycobacterium tuberculosis; identical to SEQ ID NO: 1427982

SEQ ID NO: 1540102 - protein, 8 aa, Mycobacterium tuberculosis
NTGNEEAA

SEQ ID NO: 1540103 - protein, 12 aa, Mycobacterium tuberculosis
PAWAESSTSHYV

SEQ ID NO: 1540104 - protein, 7 aa, Mycobacterium tuberculosis
PCPPTGL

SEQ ID NO: 1540105 - protein, 22 aa, Mycobacterium tuberculosis
PDAARRVAKRSDAARARGDELG

SEQ ID NO: 1540106 - protein, 12 aa, Mycobacterium tuberculosis
PDIPTKQTGGSF

SEQ ID NO: 1540107 - protein, 55 aa, Mycobacterium tuberculosis; identical to SEQ ID NO: 230724

SEQ ID NO: 1540108 - protein, 6 aa, Mycobacterium tuberculosis
PEVQAP

SEQ ID NO: 1540109 - protein, 4 aa, Mycobacterium tuberculosis
PGAL

SEQ ID NO: 1540110 - protein, 10 aa, Mycobacterium tuberculosis
PGARNAAPLQ

SEQ ID NO: 1540111 - protein, 6 aa, Mycobacterium tuberculosis
PGKDAH

SEQ ID NO: 1540112 - protein, 4 aa, Mycobacterium tuberculosis
PGTN

SEQ ID NO: 1540113 - protein, 5 aa, Mycobacterium tuberculosis
PGVTP

SEQ ID NO: 1540114 - protein, 6 aa, Mycobacterium tuberculosis
PHPIDG

SEQ ID NO: 1540115 - protein, 6 aa, Mycobacterium tuberculosis
PHPTSR

SEQ ID NO: 1540116 - protein, 18 aa, Mycobacterium tuberculosis
PLAPPPPDPLAPPPPDPL

SEQ ID NO: 1540117 - protein, 18 aa, Mycobacterium tuberculosis
PLPTGPDAAPACPTGGAG

SEQ ID NO: 1540118 - protein, 6 aa, Mycobacterium tuberculosis
PLRSPV

SEQ ID NO: 1540119 - protein, 7 aa, Mycobacterium tuberculosis
PPDREPA

SEQ ID NO: 1540120 - protein, 14 aa, Mycobacterium tuberculosis
PPKTPSPKPLSPNA

SEQ ID NO: 1540121 - protein, 54 aa, Mycobacterium tuberculosis; identical to SEQ ID NO: 155741

SEQ ID NO: 1540122 - protein, 4 aa, Mycobacterium tuberculosis
PTQT

SEQ ID NO: 1540123 - protein, 15 aa, Mycobacterium tuberculosis
PYIPGGDSPAGTDCS

SEQ ID NO: 1540124 - protein, 7 aa, Mycobacterium tuberculosis
QAGCTND

SEQ ID NO: 1540125 - protein, 4 aa, Mycobacterium tuberculosis
QAND

SEQ ID NO: 1540126 - protein, 11 aa, Mycobacterium tuberculosis
QATAATDGEWD

SEQ ID NO: 1540127 - protein, 7 aa, Mycobacterium tuberculosis
QDRDLGN

SEQ ID NO: 1540128 - protein, 14 aa, Mycobacterium tuberculosis
QLPPLPRATTATTL

SEQ ID NO: 1540129 - protein, 7 aa, Mycobacterium tuberculosis
QNTPAIA

SEQ ID NO: 1540130 - protein, 7 aa, Mycobacterium tuberculosis
QPSATGR

SEQ ID NO: 1540131 - protein, 4 aa, Mycobacterium tuberculosis
QQYQ

SEQ ID NO: 1540132 - protein, 15 aa, Mycobacterium tuberculosis
RASGPDSGGKARFVP

SEQ ID NO: 1540133 - protein, 8 aa, Mycobacterium tuberculosis
RDGEWTTN

SEQ ID NO: 1540134 - protein, 8 aa, Mycobacterium tuberculosis
RGWETDGG

SEQ ID NO: 1540135 - protein, 9 aa, Mycobacterium tuberculosis
RKDPSTPKI

SEQ ID NO: 1540136 - protein, 16 aa, Mycobacterium tuberculosis
RPVPSNLPKPSPGMDP

SEQ ID NO: 1540137 - protein, 9 aa, Mycobacterium tuberculosis
RRPKLYGAG

SEQ ID NO: 1540138 - protein, 5 aa, Mycobacterium tuberculosis
RRSKG

SEQ ID NO: 1540139 - protein, 7 aa, Mycobacterium tuberculosis
RTGAAGR

SEQ ID NO: 1540140 - protein, 14 aa, Mycobacterium tuberculosis
SAEAPSTGTGPNAA

SEQ ID NO: 1540141 - protein, 7 aa, Mycobacterium tuberculosis
SDDNVSV

SEQ ID NO: 1540142 - protein, 16 aa, Mycobacterium tuberculosis
SDVAATDPGVADGAAA

SEQ ID NO: 1540143 - protein, 9 aa, Mycobacterium tuberculosis
SEIGGSTRI

SEQ ID NO: 1540144 - protein, 21 aa, Mycobacterium tuberculosis
SENRPSYSDTNLENSKPFNPK

SEQ ID NO: 1540145 - protein, 9 aa, Mycobacterium tuberculosis
SGDTTKSDN

SEQ ID NO: 1540146 - protein, 4 aa, Mycobacterium tuberculosis
SGGW

SEQ ID NO: 1540147 - protein, 4 aa, Mycobacterium tuberculosis
SGMT

SEQ ID NO: 1540148 - protein, 4 aa, Mycobacterium tuberculosis
SGNF

SEQ ID NO: 1540149 - protein, 4 aa, Mycobacterium tuberculosis
SGNN

SEQ ID NO: 1540150 - protein, 4 aa, Mycobacterium tuberculosis
SGYS

SEQ ID NO: 1540151 - protein, 4 aa, Mycobacterium tuberculosis
SNDG

SEQ ID NO: 1540152 - protein, 8 aa, Mycobacterium tuberculosis
SNVPSACR

SEQ ID NO: 1540153 - protein, 26 aa, Mycobacterium tuberculosis
SPKNPPTLSYQPAGCPDAKPSPPAAY

SEQ ID NO: 1540154 - protein, 19 aa, Mycobacterium tuberculosis
SSFGSVTSGLAGQSWQGAA

SEQ ID NO: 1540155 - protein, 4 aa, Mycobacterium tuberculosis
SSGC

SEQ ID NO: 1540156 - protein, 7 aa, Mycobacterium tuberculosis
STATGYG

SEQ ID NO: 1540157 - protein, 4 aa, Mycobacterium tuberculosis
STVS

SEQ ID NO: 1540158 - protein, 8 aa, Mycobacterium tuberculosis
SVTQTAAA

SEQ ID NO: 1540159 - protein, 5 aa, Mycobacterium tuberculosis
SYTYP

SEQ ID NO: 1540160 - protein, 13 aa, Mycobacterium tuberculosis
TAAADDKLPLGGG

SEQ ID NO: 1540161 - protein, 14 aa, Mycobacterium tuberculosis
TALERAEDPILNGS

SEQ ID NO: 1540162 - protein, 10 aa, Mycobacterium tuberculosis
TAPAPQGPWS

SEQ ID NO: 1540163 - protein, 35 aa, Mycobacterium tuberculosis; identical to SEQ ID NO: 155857

SEQ ID NO: 1540164 - protein, 6 aa, Mycobacterium tuberculosis
TDQGVY

SEQ ID NO: 1540165 - protein, 7 aa, Mycobacterium tuberculosis
TDQRDAL

SEQ ID NO: 1540166 - protein, 13 aa, Mycobacterium tuberculosis
TEAGGEPDARYEI

SEQ ID NO: 1540167 - protein, 5 aa, Mycobacterium tuberculosis
TGESL

SEQ ID NO: 1540168 - protein, 10 aa, Mycobacterium tuberculosis
TGPDSPNKTL

SEQ ID NO: 1540169 - protein, 8 aa, Mycobacterium tuberculosis
TGTGGASL

SEQ ID NO: 1540170 - protein, 5 aa, Mycobacterium tuberculosis
TKATG

SEQ ID NO: 1540171 - protein, 8 aa, Mycobacterium tuberculosis
TLTSRDQI

SEQ ID NO: 1540172 - protein, 4 aa, Mycobacterium tuberculosis
TQDV

SEQ ID NO: 1540173 - protein, 11 aa, Mycobacterium tuberculosis
TQISAAGSFGR

SEQ ID NO: 1540174 - protein, 4 aa, Mycobacterium tuberculosis
TSQL

SEQ ID NO: 1540175 - protein, 8 aa, Mycobacterium tuberculosis
TTGGHRAG

SEQ ID NO: 1540176 - protein, 10 aa, Mycobacterium tuberculosis
VADQGKRNVT

SEQ ID NO: 1540177 - protein, 8 aa, Mycobacterium tuberculosis
VAGRAPGA

SEQ ID NO: 1540178 - protein, 7 aa, Mycobacterium tuberculosis
VAPQQSW

SEQ ID NO: 1540179 - protein, 14 aa, Mycobacterium tuberculosis
VAPVGGTGGNGGRA

SEQ ID NO: 1540180 - protein, 18 aa, Mycobacterium tuberculosis
VEPEMPAPCPTQRPPVTP

SEQ ID NO: 1540181 - protein, 6 aa, Mycobacterium tuberculosis
VGYQQR

SEQ ID NO: 1540182 - protein, 6 aa, Mycobacterium tuberculosis
VNPADL

SEQ ID NO: 1540183 - protein, 14 aa, Mycobacterium tuberculosis
VQSPGAERLDDRRY

SEQ ID NO: 1540184 - protein, 10 aa, Mycobacterium tuberculosis
VSGAGNVGQQ

SEQ ID NO: 1540185 - protein, 8 aa, Mycobacterium tuberculosis
VSKDNGQT

SEQ ID NO: 1540186 - protein, 5 aa, Mycobacterium tuberculosis
VSQTS

SEQ ID NO: 1540187 - protein, 5 aa, Mycobacterium tuberculosis
VTEQE

SEQ ID NO: 1540188 - protein, 20 aa, Mycobacterium tuberculosis
VTSGDASNRYSGSPVRQPGF

SEQ ID NO: 1540189 - protein, 30 aa, Mycobacterium tuberculosis; identical to SEQ ID NO: 232515

SEQ ID NO: 1540190 - protein, 4 aa, Mycobacterium tuberculosis
YKTS

SEQ ID NO: 1540191 - protein, 11 aa, Mycobacterium tuberculosis
YSHPDQAIASG

SEQ ID NO: 1540192 - protein, 12 aa, Mycobacterium tuberculosis
YSYASAEAAAVT

SEQ ID NO: 1540193 - protein, 8 aa, Mycobacterium tuberculosis
AAAAKPKQ

SEQ ID NO: 1540194 - protein, 5 aa, Mycobacterium tuberculosis
AADAQ

SEQ ID NO: 1540195 - protein, 32 aa, Mycobacterium tuberculosis; identical to SEQ ID NO: 232535

SEQ ID NO: 1540196 - protein, 6 aa, Mycobacterium tuberculosis
AADREI

SEQ ID NO: 1540197 - protein, 7 aa, Mycobacterium tuberculosis
AAEPSWN

SEQ ID NO: 1540198 - protein, 7 aa, Mycobacterium tuberculosis
AAFGPNP

SEQ ID NO: 1540199 - protein, 11 aa, Mycobacterium tuberculosis
AAGAPPSCAGL

SEQ ID NO: 1540200 - protein, 5 aa, Mycobacterium tuberculosis
AAGEP

SEQ ID NO: 1540201 - protein, 10 aa, Mycobacterium tuberculosis
AAGGPTSAPI

SEQ ID NO: 1540202 - protein, 5 aa, Mycobacterium tuberculosis
AAGPV

SEQ ID NO: 1540203 - protein, 20 aa, Mycobacterium tuberculosis
AAHGGGEFAPSAQLASREQQ

SEQ ID NO: 1540204 - protein, 4 aa, Mycobacterium tuberculosis
AALS

SEQ ID NO: 1540205 - protein, 6 aa, Mycobacterium tuberculosis
AANTTT

SEQ ID NO: 1540206 - protein, 11 aa, Mycobacterium tuberculosis
AAPARPARTAD

SEQ ID NO: 1540207 - protein, 7 aa, Mycobacterium tuberculosis
AAPGQVD

SEQ ID NO: 1540208 - protein, 4 aa, Mycobacterium tuberculosis
AAQG

SEQ ID NO: 1540209 - protein, 6 aa, Mycobacterium tuberculosis
AAQSVE

SEQ ID NO: 1540210 - protein, 27 aa, Mycobacterium tuberculosis
AARGGWQTVSGSRRNAAYQDGRQTQIS

SEQ ID NO: 1540211 - protein, 5 aa, Mycobacterium tuberculosis
AARLG

SEQ ID NO: 1540212 - protein, 13 aa, Mycobacterium tuberculosis
AARSGDGPGGASV

SEQ ID NO: 1540213 - protein, 16 aa, Mycobacterium tuberculosis
AASAAPPSFGAGSSAV

SEQ ID NO: 1540214 - protein, 16 aa, Mycobacterium tuberculosis
AATRALSAAAQAKAAA

SEQ ID NO: 1540215 - protein, 8 aa, Mycobacterium tuberculosis
AAVTNTLA

SEQ ID NO: 1540216 - protein, 8 aa, Mycobacterium tuberculosis
ACSGSAAA

SEQ ID NO: 1540217 - protein, 5 aa, Mycobacterium tuberculosis
ADAAA

SEQ ID NO: 1540218 - protein, 27 aa, Mycobacterium tuberculosis
ADPDAAPGDPGGPGGPGGTAGPVDPPA

SEQ ID NO: 1540219 - protein, 6 aa, Mycobacterium tuberculosis
ADPNVS

SEQ ID NO: 1540220 - protein, 6 aa, Mycobacterium tuberculosis
ADQPYG

SEQ ID NO: 1540221 - protein, 8 aa, Mycobacterium tuberculosis
ADRAAHRD

SEQ ID NO: 1540222 - protein, 8 aa, Mycobacterium tuberculosis
ADRGAAEK

SEQ ID NO: 1540223 - protein, 8 aa, Mycobacterium tuberculosis
ADRTDAPV

SEQ ID NO: 1540224 - protein, 16 aa, Mycobacterium tuberculosis
ADTAGPDENISRGPDP

SEQ ID NO: 1540225 - protein, 11 aa, Mycobacterium tuberculosis
ADTLPGPLATA

SEQ ID NO: 1540226 - protein, 4 aa, Mycobacterium tuberculosis
ADTY

SEQ ID NO: 1540227 - protein, 7 aa, Mycobacterium tuberculosis
ADVENIG

SEQ ID NO: 1540228 - protein, 8 aa, Mycobacterium tuberculosis
ADVENIGS

SEQ ID NO: 1540229 - protein, 17 aa, Mycobacterium tuberculosis
ADVQPAGSVPIPDGPAQ

SEQ ID NO: 1540230 - protein, 5 aa, Mycobacterium tuberculosis
AEEFY

SEQ ID NO: 1540231 - protein, 10 aa, Mycobacterium tuberculosis
AEGTDNPHEA

SEQ ID NO: 1540232 - protein, 10 aa, Mycobacterium tuberculosis
AELPQTSTAA

SEQ ID NO: 1540233 - protein, 6 aa, Mycobacterium tuberculosis
AERRDY

SEQ ID NO: 1540234 - protein, 4 aa, Mycobacterium tuberculosis
AGAA

SEQ ID NO: 1540235 - protein, 8 aa, Mycobacterium tuberculosis
AGAGSNDV

SEQ ID NO: 1540236 - protein, 4 aa, Mycobacterium tuberculosis
AGAK

SEQ ID NO: 1540237 - protein, 4 aa, Mycobacterium tuberculosis
AGAP

SEQ ID NO: 1540238 - protein, 5 aa, Mycobacterium tuberculosis
AGDDV

SEQ ID NO: 1540239 - protein, 9 aa, Mycobacterium tuberculosis
AGDGPSRRF

SEQ ID NO: 1540240 - protein, 13 aa, Mycobacterium tuberculosis
AGDVQTAQHASEA

SEQ ID NO: 1540241 - protein, 27 aa, Mycobacterium tuberculosis
AGGAGGAGGTGLVGGDGGAGGAGGTGG

SEQ ID NO: 1540242 - protein, 27 aa, Mycobacterium tuberculosis
AGGGHGGTGGLSTNGDGGVGGAGGNAG

SEQ ID NO: 1540243 - protein, 14 aa, Mycobacterium tuberculosis
AGIGGAGGNGGNAG

SEQ ID NO: 1540244 - protein, 8 aa, Mycobacterium tuberculosis
AGKDYDEV

SEQ ID NO: 1540245 - protein, 5 aa, Mycobacterium tuberculosis
AGKYA

SEQ ID NO: 1540246 - protein, 6 aa, Mycobacterium tuberculosis
AGLPPL

SEQ ID NO: 1540247 - protein, 6 aa, Mycobacterium tuberculosis
AGLTQA

SEQ ID NO: 1540248 - protein, 28 aa, Mycobacterium tuberculosis
AGPGGAGGAGGDGENLDTGGDGGAGGSA

SEQ ID NO: 1540249 - protein, 13 aa, Mycobacterium tuberculosis
AGPGGAGGTGGRG

SEQ ID NO: 1540250 - protein, 6 aa, Mycobacterium tuberculosis
AGQRQQ

SEQ ID NO: 1540251 - protein, 6 aa, Mycobacterium tuberculosis
AGRGTR

SEQ ID NO: 1540252 - protein, 12 aa, Mycobacterium tuberculosis
AGRPGEPAPAVP

SEQ ID NO: 1540253 - protein, 10 aa, Mycobacterium tuberculosis
AGSGGFGGAG

SEQ ID NO: 1540254 - protein, 11 aa, Mycobacterium tuberculosis
AGSGGFGGAGG

SEQ ID NO: 1540255 - protein, 11 aa, Mycobacterium tuberculosis
AGTASASSTDE

SEQ ID NO: 1540256 - protein, 9 aa, Mycobacterium tuberculosis
AGTPVISDP

SEQ ID NO: 1540257 - protein, 20 aa, Mycobacterium tuberculosis
AGWSTAAPAMTSGTTALEGS

SEQ ID NO: 1540258 - protein, 20 aa, Mycobacterium tuberculosis
AGYRGTPGNPLTIAYRWDQG

SEQ ID NO: 1540259 - protein, 4 aa, Mycobacterium tuberculosis
AHAR

SEQ ID NO: 1540260 - protein, 19 aa, Mycobacterium tuberculosis
AHGGGEFAPSAQLASREQQ

SEQ ID NO: 1540261 - protein, 8 aa, Mycobacterium tuberculosis
AKNRDPIA

SEQ ID NO: 1540262 - protein, 9 aa, Mycobacterium tuberculosis
AKSAQFSAS

SEQ ID NO: 1540263 - protein, 5 aa, Mycobacterium tuberculosis
AKTNN

SEQ ID NO: 1540264 - protein, 8 aa, Mycobacterium tuberculosis
ALAGGDLS

SEQ ID NO: 1540265 - protein, 6 aa, Mycobacterium tuberculosis
ALDNPE

SEQ ID NO: 1540266 - protein, 4 aa, Mycobacterium tuberculosis
ALEN

SEQ ID NO: 1540267 - protein, 17 aa, Mycobacterium tuberculosis
ALPAPPPLPGPPPLPAL

SEQ ID NO: 1540268 - protein, 5 aa, Mycobacterium tuberculosis
ALPRR

SEQ ID NO: 1540269 - protein, 11 aa, Mycobacterium tuberculosis
ANAGSYNTGSF

SEQ ID NO: 1540270 - protein, 6 aa, Mycobacterium tuberculosis
ANLRSD

SEQ ID NO: 1540271 - protein, 4 aa, Mycobacterium tuberculosis
ANPS

SEQ ID NO: 1540272 - protein, 5 aa, Mycobacterium tuberculosis
ANPST

SEQ ID NO: 1540273 - protein, 7 aa, Mycobacterium tuberculosis
ANSAEKL

SEQ ID NO: 1540274 - protein, 8 aa, Mycobacterium tuberculosis
ANTGTNNL

SEQ ID NO: 1540275 - protein, 15 aa, Mycobacterium tuberculosis
APGFGNDTTAPSSGF

SEQ ID NO: 1540276 - protein, 4 aa, Mycobacterium tuberculosis
APMA

SEQ ID NO: 1540277 - protein, 8 aa, Mycobacterium tuberculosis
APNAGLDP

SEQ ID NO: 1540278 - protein, 4 aa, Mycobacterium tuberculosis
APPI

SEQ ID NO: 1540279 - protein, 28 aa, Mycobacterium tuberculosis
APPLAGATEEPGAGQTPGAPVVAPQQSW

SEQ ID NO: 1540280 - protein, 7 aa, Mycobacterium tuberculosis
APPPDPL

SEQ ID NO: 1540281 - protein, 10 aa, Mycobacterium tuberculosis
APSGASGKAW

SEQ ID NO: 1540282 - protein, 5 aa, Mycobacterium tuberculosis
APTQT

SEQ ID NO: 1540283 - protein, 12 aa, Mycobacterium tuberculosis
APTSAAGSNTAT

SEQ ID NO: 1540284 - protein, 13 aa, Mycobacterium tuberculosis
APVGGTGGNGGRA

SEQ ID NO: 1540285 - protein, 11 aa, Mycobacterium tuberculosis
AQAAVAQTGLT

SEQ ID NO: 1540286 - protein, 6 aa, Mycobacterium tuberculosis
AQGIGQ

SEQ ID NO: 1540287 - protein, 4 aa, Mycobacterium tuberculosis
AQGL

SEQ ID NO: 1540288 - protein, 8 aa, Mycobacterium tuberculosis
AQGQAKAI

SEQ ID NO: 1540289 - protein, 4 aa, Mycobacterium tuberculosis
ARAP

SEQ ID NO: 1540290 - protein, 4 aa, Mycobacterium tuberculosis
ARDL

SEQ ID NO: 1540291 - protein, 5 aa, Mycobacterium tuberculosis
AREGA

SEQ ID NO: 1540292 - protein, 6 aa, Mycobacterium tuberculosis
ARGADV

SEQ ID NO: 1540293 - protein, 4 aa, Mycobacterium tuberculosis
ARLK

SEQ ID NO: 1540294 - protein, 25 aa, Mycobacterium tuberculosis
ARPAATPATTSVPTYTAAQTAAAQR

SEQ ID NO: 1540295 - protein, 33 aa, Mycobacterium tuberculosis; identical to SEQ ID NO: 229178

SEQ ID NO: 1540296 - protein, 13 aa, Mycobacterium tuberculosis
ASAGVQHARRGSE

SEQ ID NO: 1540297 - protein, 5 aa, Mycobacterium tuberculosis
ASDDR

SEQ ID NO: 1540298 - protein, 6 aa, Mycobacterium tuberculosis
ASDLGG

SEQ ID NO: 1540299 - protein, 11 aa, Mycobacterium tuberculosis
ASGAHRPTPTI

SEQ ID NO: 1540300 - protein, 7 aa, Mycobacterium tuberculosis
ASGTAIT

SEQ ID NO: 1540301 - protein, 7 aa, Mycobacterium tuberculosis
ASKFGRE

SEQ ID NO: 1540302 - protein, 40 aa, Mycobacterium tuberculosis; identical to SEQ ID NO: 170076

SEQ ID NO: 1540303 - protein, 16 aa, Mycobacterium tuberculosis
ASQSDAPVGAPRQFRS

SEQ ID NO: 1540304 - protein, 8 aa, Mycobacterium tuberculosis
ASSGLGAG

SEQ ID NO: 1540305 - protein, 6 aa, Mycobacterium tuberculosis
ASSQDV

SEQ ID NO: 1540306 - protein, 16 aa, Mycobacterium tuberculosis
ASTRSAVNSGSDLRAS

SEQ ID NO: 1540307 - protein, 27 aa, Mycobacterium tuberculosis
ASVAGSQQADGVATTKITGNSSADDIA

SEQ ID NO: 1540308 - protein, 7 aa, Mycobacterium tuberculosis
ATAAPKT

SEQ ID NO: 1540309 - protein, 6 aa, Mycobacterium tuberculosis
ATAATE

SEQ ID NO: 1540310 - protein, 12 aa, Mycobacterium tuberculosis
ATGGLGGDGGDA

SEQ ID NO: 1540311 - protein, 6 aa, Mycobacterium tuberculosis
ATGTTA

SEQ ID NO: 1540312 - protein, 7 aa, Mycobacterium tuberculosis
ATLAPNA

SEQ ID NO: 1540313 - protein, 7 aa, Mycobacterium tuberculosis
ATQESEM

SEQ ID NO: 1540314 - protein, 12 aa, Mycobacterium tuberculosis
ATSGERADPQAV

SEQ ID NO: 1540315 - protein, 17 aa, Mycobacterium tuberculosis
ATSRSHRASTSRGQRET

SEQ ID NO: 1540316 - protein, 5 aa, Mycobacterium tuberculosis
ATYGR

SEQ ID NO: 1540317 - protein, 7 aa, Mycobacterium tuberculosis
AWNDDGS

SEQ ID NO: 1540318 - protein, 5 aa, Mycobacterium tuberculosis
AYPDD

SEQ ID NO: 1540319 - protein, 7 aa, Mycobacterium tuberculosis
AYRDGTL

SEQ ID NO: 1540320 - protein, 4 aa, Mycobacterium tuberculosis
CNDP

SEQ ID NO: 1540321 - protein, 40 aa, Mycobacterium tuberculosis; identical to SEQ ID NO: 1437698

SEQ ID NO: 1540322 - protein, 24 aa, Mycobacterium tuberculosis
CSDSGDNKPGATIPSTPANAEGRH

SEQ ID NO: 1540323 - protein, 13 aa, Mycobacterium tuberculosis
DAAGTKSSFRTGD

SEQ ID NO: 1540324 - protein, 8 aa, Mycobacterium tuberculosis
DADGVSVP

SEQ ID NO: 1540325 - protein, 6 aa, Mycobacterium tuberculosis
DADRDA

SEQ ID NO: 1540326 - protein, 5 aa, Mycobacterium tuberculosis
DAGSH

SEQ ID NO: 1540327 - protein, 8 aa, Mycobacterium tuberculosis
DAKSPYEY

SEQ ID NO: 1540328 - protein, 4 aa, Mycobacterium tuberculosis
DAPI

SEQ ID NO: 1540329 - protein, 4 aa, Mycobacterium tuberculosis
DAPS

SEQ ID NO: 1540330 - protein, 4 aa, Mycobacterium tuberculosis
DARD

SEQ ID NO: 1540331 - protein, 7 aa, Mycobacterium tuberculosis
DATTGTI

SEQ ID NO: 1540332 - protein, 7 aa, Mycobacterium tuberculosis
DDNSAAV

SEQ ID NO: 1540333 - protein, 7 aa, Mycobacterium tuberculosis
DDPLSEE

SEQ ID NO: 1540334 - protein, 9 aa, Mycobacterium tuberculosis
DDVAGSDSA

SEQ ID NO: 1540335 - protein, 7 aa, Mycobacterium tuberculosis
DEPFDQF

SEQ ID NO: 1540336 - protein, 8 aa, Mycobacterium tuberculosis
DESGTTDN

SEQ ID NO: 1540337 - protein, 5 aa, Mycobacterium tuberculosis
DFGPA

SEQ ID NO: 1540338 - protein, 33 aa, Mycobacterium tuberculosis; identical to SEQ ID NO: 229388

SEQ ID NO: 1540339 - protein, 23 aa, Mycobacterium tuberculosis
DGGAGGSGAAGSGAPGGAGGAAG

SEQ ID NO: 1540340 - protein, 4 aa, Mycobacterium tuberculosis
DGKT

SEQ ID NO: 1540341 - protein, 6 aa, Mycobacterium tuberculosis
DGSKTY

SEQ ID NO: 1540342 - protein, 5 aa, Mycobacterium tuberculosis
DGTTL

SEQ ID NO: 1540343 - protein, 4 aa, Mycobacterium tuberculosis
DGVT

SEQ ID NO: 1540344 - protein, 6 aa, Mycobacterium tuberculosis
DHDLAD

SEQ ID NO: 1540345 - protein, 5 aa, Mycobacterium tuberculosis
DIGPE

SEQ ID NO: 1540346 - protein, 6 aa, Mycobacterium tuberculosis
DNAPIA

SEQ ID NO: 1540347 - protein, 10 aa, Mycobacterium tuberculosis
DNLRGQGATI

SEQ ID NO: 1540348 - protein, 14 aa, Mycobacterium tuberculosis
DNTTITGSATSGGF

SEQ ID NO: 1540349 - protein, 13 aa, Mycobacterium tuberculosis
DPASGQPARIPVD

SEQ ID NO: 1540350 - protein, 24 aa, Mycobacterium tuberculosis
DPDAARRVAKRSDAARARGDELGP

SEQ ID NO: 1540351 - protein, 5 aa, Mycobacterium tuberculosis
DPDDF

SEQ ID NO: 1540352 - protein, 5 aa, Mycobacterium tuberculosis
DPGYA

SEQ ID NO: 1540353 - protein, 7 aa, Mycobacterium tuberculosis
DPSANPY

SEQ ID NO: 1540354 - protein, 4 aa, Mycobacterium tuberculosis
DPVG

SEQ ID NO: 1540355 - protein, 8 aa, Mycobacterium tuberculosis
DQKDNLND

SEQ ID NO: 1540356 - protein, 9 aa, Mycobacterium tuberculosis
DQPGRSTTD

SEQ ID NO: 1540357 - protein, 4 aa, Mycobacterium tuberculosis
DQQP

SEQ ID NO: 1540358 - protein, 4 aa, Mycobacterium tuberculosis
DQTY

SEQ ID NO: 1540359 - protein, 4 aa, Mycobacterium tuberculosis
DRNN

SEQ ID NO: 1540360 - protein, 4 aa, Mycobacterium tuberculosis
DRSA

SEQ ID NO: 1540361 - protein, 6 aa, Mycobacterium tuberculosis
DSGTFT

SEQ ID NO: 1540362 - protein, 12 aa, Mycobacterium tuberculosis
DSICGDGNSPVA

SEQ ID NO: 1540363 - protein, 9 aa, Mycobacterium tuberculosis
DSTSGFQNI

SEQ ID NO: 1540364 - protein, 7 aa, Mycobacterium tuberculosis
DSYETAG

SEQ ID NO: 1540365 - protein, 11 aa, Mycobacterium tuberculosis
DTAATPSAAGV

SEQ ID NO: 1540366 - protein, 11 aa, Mycobacterium tuberculosis
DTAWQGPAATA

SEQ ID NO: 1540367 - protein, 4 aa, Mycobacterium tuberculosis
DTEN

SEQ ID NO: 1540368 - protein, 4 aa, Mycobacterium tuberculosis
DTSP

SEQ ID NO: 1540369 - protein, 9 aa, Mycobacterium tuberculosis
DVDDVRDGA

SEQ ID NO: 1540370 - protein, 4 aa, Mycobacterium tuberculosis
DVGG

SEQ ID NO: 1540371 - protein, 8 aa, Mycobacterium tuberculosis
DVTGDIGP

SEQ ID NO: 1540372 - protein, 13 aa, Mycobacterium tuberculosis
EAAAEQQVQGQQA

SEQ ID NO: 1540373 - protein, 12 aa, Mycobacterium tuberculosis
EAFDDQGNYRNQ

SEQ ID NO: 1540374 - protein, 12 aa, Mycobacterium tuberculosis
EAIGTASDKLAS

SEQ ID NO: 1540375 - protein, 10 aa, Mycobacterium tuberculosis
EALGRSGTIA

SEQ ID NO: 1540376 - protein, 4 aa, Mycobacterium tuberculosis
EAMG

SEQ ID NO: 1540377 - protein, 13 aa, Mycobacterium tuberculosis
EASGSAGKVTVSP

SEQ ID NO: 1540378 - protein, 5 aa, Mycobacterium tuberculosis
EATGR

SEQ ID NO: 1540379 - protein, 6 aa, Mycobacterium tuberculosis
EATHRR

SEQ ID NO: 1540380 - protein, 13 aa, Mycobacterium tuberculosis
EETDNAEDKPETL

SEQ ID NO: 1540381 - protein, 5 aa, Mycobacterium tuberculosis
EGFET

SEQ ID NO: 1540382 - protein, 28 aa, Mycobacterium tuberculosis
EGPPLGRNPQGAPAPVGGTVIVAPMHSG

SEQ ID NO: 1540383 - protein, 7 aa, Mycobacterium tuberculosis
ENQATDR

SEQ ID NO: 1540384 - protein, 9 aa, Mycobacterium tuberculosis
ENTEGIERR

SEQ ID NO: 1540385 - protein, 7 aa, Mycobacterium tuberculosis
EPDNPAR

SEQ ID NO: 1540386 - protein, 15 aa, Mycobacterium tuberculosis
EPLSGQFDDDGAVSA

SEQ ID NO: 1540387 - protein, 12 aa, Mycobacterium tuberculosis
EPRGAQALPPGG

SEQ ID NO: 1540388 - protein, 7 aa, Mycobacterium tuberculosis
EPTPAER

SEQ ID NO: 1540389 - protein, 5 aa, Mycobacterium tuberculosis
EQDRL

SEQ ID NO: 1540390 - protein, 6 aa, Mycobacterium tuberculosis
EQSGTA

SEQ ID NO: 1540391 - protein, 9 aa, Mycobacterium tuberculosis
ESIDDPAGV

SEQ ID NO: 1540392 - protein, 4 aa, Mycobacterium tuberculosis
ESIG

SEQ ID NO: 1540393 - protein, 8 aa, Mycobacterium tuberculosis
ETLTGTHT

SEQ ID NO: 1540394 - protein, 18 aa, Mycobacterium tuberculosis
EVPQSRSVDVSDDPSGFR

SEQ ID NO: 1540395 - protein, 8 aa, Mycobacterium tuberculosis
EVSTRTPV

SEQ ID NO: 1540396 - protein, 5 aa, Mycobacterium tuberculosis
EYAPA

SEQ ID NO: 1540397 - protein, 8 aa, Mycobacterium tuberculosis
FGAGSSGW

SEQ ID NO: 1540398 - protein, 32 aa, Mycobacterium tuberculosis
FGNGGAGGAGYSPAAGTGAAGGAGGAGGAGGW

SEQ ID NO: 1540399 - protein, 10 aa, Mycobacterium tuberculosis
FNAPASASPL

SEQ ID NO: 1540400 - protein, 10 aa, Mycobacterium tuberculosis
FQAGDDPVAN

SEQ ID NO: 1540401 - protein, 25 aa, Mycobacterium tuberculosis
FRPNNSVPGDPPQPLGAPNYSQIRD

SEQ ID NO: 1540402 - protein, 4 aa, Mycobacterium tuberculosis
GADA

SEQ ID NO: 1540403 - protein, 18 aa, Mycobacterium tuberculosis
GADAPSPFGGGAAAEIAA

SEQ ID NO: 1540404 - protein, 5 aa, Mycobacterium tuberculosis
GAERL

SEQ ID NO: 1540405 - protein, 5 aa, Mycobacterium tuberculosis
GAESE

SEQ ID NO: 1540406 - protein, 8 aa, Mycobacterium tuberculosis
GAGAGMPG

SEQ ID NO: 1540407 - protein, 38 aa, Mycobacterium tuberculosis; identical to SEQ ID NO: 229723

SEQ ID NO: 1540408 - protein, 6 aa, Mycobacterium tuberculosis
GAIGPT

SEQ ID NO: 1540409 - protein, 4 aa, Mycobacterium tuberculosis
GALA

SEQ ID NO: 1540410 - protein, 14 aa, Mycobacterium tuberculosis
GAPSWTADYGSETL

SEQ ID NO: 1540411 - protein, 10 aa, Mycobacterium tuberculosis
GAQSAAAALP

SEQ ID NO: 1540412 - protein, 11 aa, Mycobacterium tuberculosis
GAQSAAQTAPV

SEQ ID NO: 1540413 - protein, 7 aa, Mycobacterium tuberculosis
GAREDLP

SEQ ID NO: 1540414 - protein, 20 aa, Mycobacterium tuberculosis
GCGAGQISQTANQKPAVNGN

SEQ ID NO: 1540415 - protein, 4 aa, Mycobacterium tuberculosis
GCPD

SEQ ID NO: 1540416 - protein, 22 aa, Mycobacterium tuberculosis
GCSGSSHSGRTYGAQSARTGES

SEQ ID NO: 1540417 - protein, 6 aa, Mycobacterium tuberculosis
GDDPYG

SEQ ID NO: 1540418 - protein, 5 aa, Mycobacterium tuberculosis
GDDTV

SEQ ID NO: 1540419 - protein, 9 aa, Mycobacterium tuberculosis
GDEEATNTD

SEQ ID NO: 1540420 - protein, 9 aa, Mycobacterium tuberculosis
GDGGAGGNA

SEQ ID NO: 1540421 - protein, 20 aa, Mycobacterium tuberculosis
GDGNLGSGNVGSTNLGSGNF

SEQ ID NO: 1540422 - protein, 17 aa, Mycobacterium tuberculosis
GDQYNAGRHVPPAEAKR

SEQ ID NO: 1540423 - protein, 41 aa, Mycobacterium tuberculosis; identical to SEQ ID NO: 194109

SEQ ID NO: 1540424 - protein, 4 aa, Mycobacterium tuberculosis
GETV

SEQ ID NO: 1540425 - protein, 7 aa, Mycobacterium tuberculosis
GFDNAQR

SEQ ID NO: 1540426 - protein, 6 aa, Mycobacterium tuberculosis
GFDPKV

SEQ ID NO: 1540427 - protein, 8 aa, Mycobacterium tuberculosis
GGAAPGGF

SEQ ID NO: 1540428 - protein, 11 aa, Mycobacterium tuberculosis
GGAGGAGGDGG

SEQ ID NO: 1540429 - protein, 25 aa, Mycobacterium tuberculosis
GGAGGAGGIGSADGGLGGGGGNGRF

SEQ ID NO: 1540430 - protein, 10 aa, Mycobacterium tuberculosis
GGAGGIGGAS

SEQ ID NO: 1540431 - protein, 17 aa, Mycobacterium tuberculosis
GGAGGTGGNGGSGFNSL

SEQ ID NO: 1540432 - protein, 53 aa, Mycobacterium tuberculosis; identical to SEQ ID NO: 232723

SEQ ID NO: 1540433 - protein, 12 aa, Mycobacterium tuberculosis
GGITADSDPDAE

SEQ ID NO: 1540434 - protein, 44 aa, Mycobacterium tuberculosis; identical to SEQ ID NO: 1444122

SEQ ID NO: 1540435 - protein, 12 aa, Mycobacterium tuberculosis
GGNGGVGGTSVA

SEQ ID NO: 1540436 - protein, 8 aa, Mycobacterium tuberculosis
GGQNPQGP

SEQ ID NO: 1540437 - protein, 14 aa, Mycobacterium tuberculosis
GGQPDPSKGRCAFA

SEQ ID NO: 1540438 - protein, 4 aa, Mycobacterium tuberculosis
GGQT

SEQ ID NO: 1540439 - protein, 5 aa, Mycobacterium tuberculosis
GGSDI

SEQ ID NO: 1540440 - protein, 5 aa, Mycobacterium tuberculosis
GGSDV

SEQ ID NO: 1540441 - protein, 17 aa, Mycobacterium tuberculosis
GGSGGAGTNGGVGGSGG

SEQ ID NO: 1540442 - protein, 7 aa, Mycobacterium tuberculosis
GGSGTLG

SEQ ID NO: 1540443 - protein, 24 aa, Mycobacterium tuberculosis
GGTGGSGGAGLGGDGGAGGAGGNA

SEQ ID NO: 1540444 - protein, 9 aa, Mycobacterium tuberculosis
GGTPRKRRD

SEQ ID NO: 1540445 - protein, 5 aa, Mycobacterium tuberculosis
GGTTV

SEQ ID NO: 1540446 - protein, 24 aa, Mycobacterium tuberculosis
GGVGGFSNGGATGGAGGAGGAGGL

SEQ ID NO: 1540447 - protein, 43 aa, Mycobacterium tuberculosis; identical to SEQ ID NO: 229908

SEQ ID NO: 1540448 - protein, 10 aa, Mycobacterium tuberculosis
GHGNSTTIGA

SEQ ID NO: 1540449 - protein, 5 aa, Mycobacterium tuberculosis
GHTSG

SEQ ID NO: 1540450 - protein, 25 aa, Mycobacterium tuberculosis
GIGGPGGASSIPGMSGGAGGTGGAA

SEQ ID NO: 1540451 - protein, 6 aa, Mycobacterium tuberculosis
GKADTV

SEQ ID NO: 1540452 - protein, 7 aa, Mycobacterium tuberculosis
GKDYDEV

SEQ ID NO: 1540453 - protein, 16 aa, Mycobacterium tuberculosis
GKTAQDTSFDGRSDYD

SEQ ID NO: 1540454 - protein, 8 aa, Mycobacterium tuberculosis
GLASGNCY

SEQ ID NO: 1540455 - protein, 11 aa, Mycobacterium tuberculosis
GLDPGADGTYP

SEQ ID NO: 1540456 - protein, 11 aa, Mycobacterium tuberculosis
GLGGAGGAAGQ

SEQ ID NO: 1540457 - protein, 6 aa, Mycobacterium tuberculosis
GLGGKF

SEQ ID NO: 1540458 - protein, 4 aa, Mycobacterium tuberculosis
GLPG

SEQ ID NO: 1540459 - protein, 17 aa, Mycobacterium tuberculosis
GLPPGSDYRNRAPKMSP

SEQ ID NO: 1540460 - protein, 9 aa, Mycobacterium tuberculosis
GNAGSGNVG

SEQ ID NO: 1540461 - protein, 16 aa, Mycobacterium tuberculosis
GNANTGVANSGNVDTG

SEQ ID NO: 1540462 - protein, 14 aa, Mycobacterium tuberculosis
GNDALDSLAQPYVI

SEQ ID NO: 1540463 - protein, 39 aa, Mycobacterium tuberculosis; identical to SEQ ID NO: 1444473

SEQ ID NO: 1540464 - protein, 21 aa, Mycobacterium tuberculosis
GNGGNGGSGAAGQAGGAGGAA

SEQ ID NO: 1540465 - protein, 18 aa, Mycobacterium tuberculosis
GNGTPGAVGSGATGAPGG

SEQ ID NO: 1540466 - protein, 5 aa, Mycobacterium tuberculosis
GNKAS

SEQ ID NO: 1540467 - protein, 7 aa, Mycobacterium tuberculosis
GNTGTNN

SEQ ID NO: 1540468 - protein, 5 aa, Mycobacterium tuberculosis
GNTVE

SEQ ID NO: 1540469 - protein, 11 aa, Mycobacterium tuberculosis
GPAAADPNQDD

SEQ ID NO: 1540470 - protein, 32 aa, Mycobacterium tuberculosis; identical to SEQ ID NO: 1423575

SEQ ID NO: 1540471 - protein, 5 aa, Mycobacterium tuberculosis
GPTQA

SEQ ID NO: 1540472 - protein, 11 aa, Mycobacterium tuberculosis
GPVPAAAPVPI

SEQ ID NO: 1540473 - protein, 6 aa, Mycobacterium tuberculosis
GQGGPL

SEQ ID NO: 1540474 - protein, 6 aa, Mycobacterium tuberculosis
GQGPTI

SEQ ID NO: 1540475 - protein, 5 aa, Mycobacterium tuberculosis
GQHGH

SEQ ID NO: 1540476 - protein, 15 aa, Mycobacterium tuberculosis
GQHTTRTAASTTYTP

SEQ ID NO: 1540477 - protein, 10 aa, Mycobacterium tuberculosis
GQLVSNGNTQ

SEQ ID NO: 1540478 - protein, 12 aa, Mycobacterium tuberculosis
GQPEFRQHSEHR

SEQ ID NO: 1540479 - protein, 15 aa, Mycobacterium tuberculosis
GRDPRGGNVDTTINP

SEQ ID NO: 1540480 - protein, 5 aa, Mycobacterium tuberculosis
GRPLI

SEQ ID NO: 1540481 - protein, 15 aa, Mycobacterium tuberculosis
GSDSLGDSDVSARPA

SEQ ID NO: 1540482 - protein, 5 aa, Mycobacterium tuberculosis
GSGDP

SEQ ID NO: 1540483 - protein, 84 aa, Mycobacterium tuberculosis; identical to SEQ ID NO: 232768

SEQ ID NO: 1540484 - protein, 21 aa, Mycobacterium tuberculosis
GSGGVGGAGGLGGPTDGTVQG

SEQ ID NO: 1540485 - protein, 8 aa, Mycobacterium tuberculosis
GSGRGPAP

SEQ ID NO: 1540486 - protein, 7 aa, Mycobacterium tuberculosis
GSPKQVA

SEQ ID NO: 1540487 - protein, 16 aa, Mycobacterium tuberculosis
GSTGEFKDKYGKSSAH

SEQ ID NO: 1540488 - protein, 6 aa, Mycobacterium tuberculosis
GSVTPA

SEQ ID NO: 1540489 - protein, 5 aa, Mycobacterium tuberculosis
GTEGP

SEQ ID NO: 1540490 - protein, 9 aa, Mycobacterium tuberculosis
GTGEPPGLG

SEQ ID NO: 1540491 - protein, 25 aa, Mycobacterium tuberculosis
GTGGAGGAGGSSAGGGGAGGAGGAG

SEQ ID NO: 1540492 - protein, 11 aa, Mycobacterium tuberculosis
GTGYGAPPFDG

SEQ ID NO: 1540493 - protein, 11 aa, Mycobacterium tuberculosis
GTPAALGADAA

SEQ ID NO: 1540494 - protein, 5 aa, Mycobacterium tuberculosis
GTPME

SEQ ID NO: 1540495 - protein, 10 aa, Mycobacterium tuberculosis
GTRALGRGPA

SEQ ID NO: 1540496 - protein, 6 aa, Mycobacterium tuberculosis
GTTYAA

SEQ ID NO: 1540497 - protein, 6 aa, Mycobacterium tuberculosis
GVETGR

SEQ ID NO: 1540498 - protein, 13 aa, Mycobacterium tuberculosis
GVETHPPNRHESA

SEQ ID NO: 1540499 - protein, 7 aa, Mycobacterium tuberculosis
GVETRTG

SEQ ID NO: 1540500 - protein, 25 aa, Mycobacterium tuberculosis
GVGGAGGFTNGSALGGAGGAGGAGG

SEQ ID NO: 1540501 - protein, 12 aa, Mycobacterium tuberculosis
GVSGPGGDGRTV

SEQ ID NO: 1540502 - protein, 7 aa, Mycobacterium tuberculosis
GWSDDGM

SEQ ID NO: 1540503 - protein, 7 aa, Mycobacterium tuberculosis
GYSQGAA

SEQ ID NO: 1540504 - protein, 6 aa, Mycobacterium tuberculosis
HDKNGD

SEQ ID NO: 1540505 - protein, 5 aa, Mycobacterium tuberculosis
HDLAD

SEQ ID NO: 1540506 - protein, 5 aa, Mycobacterium tuberculosis
HEPSD

SEQ ID NO: 1540507 - protein, 4 aa, Mycobacterium tuberculosis
HETD

SEQ ID NO: 1540508 - protein, 5 aa, Mycobacterium tuberculosis
HETDR

SEQ ID NO: 1540509 - protein, 41 aa, Mycobacterium tuberculosis; identical to SEQ ID NO: 232169

SEQ ID NO: 1540510 - protein, 26 aa, Mycobacterium tuberculosis
HGNAGGVNVGSGNAGLANTGDFNSGG

SEQ ID NO: 1540511 - protein, 15 aa, Mycobacterium tuberculosis
HIGGNAYSEAEPQTG

SEQ ID NO: 1540512 - protein, 10 aa, Mycobacterium tuberculosis
HPGQSSAAER

SEQ ID NO: 1540513 - protein, 12 aa, Mycobacterium tuberculosis
HPRGEAANALGA

SEQ ID NO: 1540514 - protein, 10 aa, Mycobacterium tuberculosis
HQPPTPASGC

SEQ ID NO: 1540515 - protein, 7 aa, Mycobacterium tuberculosis
HQTGPAA

SEQ ID NO: 1540516 - protein, 19 aa, Mycobacterium tuberculosis
HRAAGAGRRQRRRRSGDGQ

SEQ ID NO: 1540517 - protein, 5 aa, Mycobacterium tuberculosis
HRKGD

SEQ ID NO: 1540518 - protein, 5 aa, Mycobacterium tuberculosis
HSETL

SEQ ID NO: 1540519 - protein, 6 aa, Mycobacterium tuberculosis
IESADN

SEQ ID NO: 1540520 - protein, 12 aa, Mycobacterium tuberculosis
IGAGQSGLGDNG

SEQ ID NO: 1540521 - protein, 7 aa, Mycobacterium tuberculosis
IGPSAQR

SEQ ID NO: 1540522 - protein, 6 aa, Mycobacterium tuberculosis
IKDPDE

SEQ ID NO: 1540523 - protein, 4 aa, Mycobacterium tuberculosis
INTI

SEQ ID NO: 1540524 - protein, 12 aa, Mycobacterium tuberculosis
IPGSAGATPVQN

SEQ ID NO: 1540525 - protein, 21 aa, Mycobacterium tuberculosis
IQPTTVNSRRSRTPALDAGRE

SEQ ID NO: 1540526 - protein, 6 aa, Mycobacterium tuberculosis
IQPVSG

SEQ ID NO: 1540527 - protein, 7 aa, Mycobacterium tuberculosis
ITGSGDD

SEQ ID NO: 1540528 - protein, 5 aa, Mycobacterium tuberculosis
KALGH

SEQ ID NO: 1540529 - protein, 7 aa, Mycobacterium tuberculosis
KARKTSL

SEQ ID NO: 1540530 - protein, 8 aa, Mycobacterium tuberculosis
KASSQDVL

SEQ ID NO: 1540531 - protein, 16 aa, Mycobacterium tuberculosis
KEDTAARRGRPSTDHS

SEQ ID NO: 1540532 - protein, 9 aa, Mycobacterium tuberculosis
KGDKGEPCW

SEQ ID NO: 1540533 - protein, 7 aa, Mycobacterium tuberculosis
KLPPGGT

SEQ ID NO: 1540534 - protein, 8 aa, Mycobacterium tuberculosis
KLSEERKV

SEQ ID NO: 1540535 - protein, 6 aa, Mycobacterium tuberculosis
KNAINA

SEQ ID NO: 1540536 - protein, 9 aa, Mycobacterium tuberculosis
KPGRSHDEV

SEQ ID NO: 1540537 - protein, 6 aa, Mycobacterium tuberculosis
KPNVEL

SEQ ID NO: 1540538 - protein, 5 aa, Mycobacterium tuberculosis
KPTVS

SEQ ID NO: 1540539 - protein, 7 aa, Mycobacterium tuberculosis
KRGGGAI

SEQ ID NO: 1540540 - protein, 7 aa, Mycobacterium tuberculosis
KRPATGW

SEQ ID NO: 1540541 - protein, 10 aa, Mycobacterium tuberculosis
KSITAYTPGQ

SEQ ID NO: 1540542 - protein, 16 aa, Mycobacterium tuberculosis
KSLSDGALRGPGEVSA

SEQ ID NO: 1540543 - protein, 7 aa, Mycobacterium tuberculosis
KSTPAMT

SEQ ID NO: 1540544 - protein, 4 aa, Mycobacterium tuberculosis
KTIG

SEQ ID NO: 1540545 - protein, 5 aa, Mycobacterium tuberculosis
KTNSS

SEQ ID NO: 1540546 - protein, 6 aa, Mycobacterium tuberculosis
KTPPEL

SEQ ID NO: 1540547 - protein, 7 aa, Mycobacterium tuberculosis
KTTRHRA

SEQ ID NO: 1540548 - protein, 6 aa, Mycobacterium tuberculosis
LADATT

SEQ ID NO: 1540549 - protein, 7 aa, Mycobacterium tuberculosis
LAGIGGN

SEQ ID NO: 1540550 - protein, 22 aa, Mycobacterium tuberculosis
LATRDARAKDTYEKIGVHVVVA

SEQ ID NO: 1540551 - protein, 16 aa, Mycobacterium tuberculosis
LDAPPSALRASAKEVA

SEQ ID NO: 1540552 - protein, 8 aa, Mycobacterium tuberculosis
LDDGESDL

SEQ ID NO: 1540553 - protein, 7 aa, Mycobacterium tuberculosis
LDERDNQ

SEQ ID NO: 1540554 - protein, 5 aa, Mycobacterium tuberculosis
LDGPT

SEQ ID NO: 1540555 - protein, 11 aa, Mycobacterium tuberculosis
LDNGDLDRTHR

SEQ ID NO: 1540556 - protein, 8 aa, Mycobacterium tuberculosis
LDPSSDRM

SEQ ID NO: 1540557 - protein, 12 aa, Mycobacterium tuberculosis
LEGQNGENGLLP

SEQ ID NO: 1540558 - protein, 5 aa, Mycobacterium tuberculosis
LETAD

SEQ ID NO: 1540559 - protein, 18 aa, Mycobacterium tuberculosis
LGAPTSPEADAADGARYA

SEQ ID NO: 1540560 - protein, 4 aa, Mycobacterium tuberculosis
LGDH

SEQ ID NO: 1540561 - protein, 8 aa, Mycobacterium tuberculosis
LGGDGGDI

SEQ ID NO: 1540562 - protein, 15 aa, Mycobacterium tuberculosis
LGGGNTGNANLGGGN

SEQ ID NO: 1540563 - protein, 7 aa, Mycobacterium tuberculosis
LGGPNGV

SEQ ID NO: 1540564 - protein, 7 aa, Mycobacterium tuberculosis
LGGRELG

SEQ ID NO: 1540565 - protein, 31 aa, Mycobacterium tuberculosis
LGNGGDGGAGGAGGPAGLALPPGPARPAGAA

SEQ ID NO: 1540566 - protein, 10 aa, Mycobacterium tuberculosis
LGRKGTQDGG

SEQ ID NO: 1540567 - protein, 5 aa, Mycobacterium tuberculosis
LGRNS

SEQ ID NO: 1540568 - protein, 5 aa, Mycobacterium tuberculosis
LNPDH

SEQ ID NO: 1540569 - protein, 10 aa, Mycobacterium tuberculosis
LNPGPRSTDP

SEQ ID NO: 1540570 - protein, 12 aa, Mycobacterium tuberculosis
LPAGAKITRTTT

SEQ ID NO: 1540571 - protein, 15 aa, Mycobacterium tuberculosis
LPAPPPLPGPPPLPA

SEQ ID NO: 1540572 - protein, 10 aa, Mycobacterium tuberculosis
LPASQDVPAD

SEQ ID NO: 1540573 - protein, 6 aa, Mycobacterium tuberculosis
LPASTI

SEQ ID NO: 1540574 - protein, 21 aa, Mycobacterium tuberculosis
LPATNGPSGARPDAPAASGTV

SEQ ID NO: 1540575 - protein, 26 aa, Mycobacterium tuberculosis
LPDGTPVSSGEGGGVRVGGGGAYQPK

SEQ ID NO: 1540576 - protein, 14 aa, Mycobacterium tuberculosis
LPEAPANRATVPQD

SEQ ID NO: 1540577 - protein, 6 aa, Mycobacterium tuberculosis
LPGQLN

SEQ ID NO: 1540578 - protein, 7 aa, Mycobacterium tuberculosis
LPGVSPT

SEQ ID NO: 1540579 - protein, 7 aa, Mycobacterium tuberculosis
LPRSSGQ

SEQ ID NO: 1540580 - protein, 11 aa, Mycobacterium tuberculosis
LQPTGGASGLS

SEQ ID NO: 1540581 - protein, 7 aa, Mycobacterium tuberculosis
LRSEKRD

SEQ ID NO: 1540582 - protein, 12 aa, Mycobacterium tuberculosis
LSAANAAAAAPT

SEQ ID NO: 1540583 - protein, 8 aa, Mycobacterium tuberculosis
LSAPAGRL

SEQ ID NO: 1540584 - protein, 7 aa, Mycobacterium tuberculosis
LSQGGQG

SEQ ID NO: 1540585 - protein, 10 aa, Mycobacterium tuberculosis
LSRGNDNALG

SEQ ID NO: 1540586 - protein, 4 aa, Mycobacterium tuberculosis
LSST

SEQ ID NO: 1540587 - protein, 10 aa, Mycobacterium tuberculosis
LTGPAPVTNA

SEQ ID NO: 1540588 - protein, 5 aa, Mycobacterium tuberculosis
MSPAE

SEQ ID NO: 1540589 - protein, 5 aa, Mycobacterium tuberculosis
MTPRA

SEQ ID NO: 1540590 - protein, 10 aa, Mycobacterium tuberculosis
MTSGSSSGFK

SEQ ID NO: 1540591 - protein, 29 aa, Mycobacterium tuberculosis
MTTLPGGDAPAAGVPGLPGMPASGAGRAG

SEQ ID NO: 1540592 - protein, 26 aa, Mycobacterium tuberculosis
NAGSGGTGGFGDTDGGAGGAGGDAGW

SEQ ID NO: 1540593 - protein, 9 aa, Mycobacterium tuberculosis
NAPTQTLTG

SEQ ID NO: 1540594 - protein, 11 aa, Mycobacterium tuberculosis
NATDPGAAAQF

SEQ ID NO: 1540595 - protein, 12 aa, Mycobacterium tuberculosis
NATVADGEDQQT

SEQ ID NO: 1540596 - protein, 11 aa, Mycobacterium tuberculosis
NDQGMDPEDPE

SEQ ID NO: 1540597 - protein, 9 aa, Mycobacterium tuberculosis
NEGAPGRGP

SEQ ID NO: 1540598 - protein, 4 aa, Mycobacterium tuberculosis
NGAL

SEQ ID NO: 1540599 - protein, 17 aa, Mycobacterium tuberculosis
NGANGQPGTGAPGGPAG

SEQ ID NO: 1540600 - protein, 13 aa, Mycobacterium tuberculosis
NGATTQTSATDQT

SEQ ID NO: 1540601 - protein, 12 aa, Mycobacterium tuberculosis
NGGAGGAGGAAS

SEQ ID NO: 1540602 - protein, 14 aa, Mycobacterium tuberculosis
NGGAGGAGSAGTGV

SEQ ID NO: 1540603 - protein, 26 aa, Mycobacterium tuberculosis
NGGAGGIGGAGTGTGGHGGAGGAGGR

SEQ ID NO: 1540604 - protein, 34 aa, Mycobacterium tuberculosis; identical to SEQ ID NO: 230569

SEQ ID NO: 1540605 - protein, 46 aa, Mycobacterium tuberculosis
NGGNGGNGGIGQPGGAGGDAGLIGNGGNGGIGGPGATGLAGGAGGV

SEQ ID NO: 1540606 - protein, 46 aa, Mycobacterium tuberculosis; identical to SEQ ID NO: 232265

SEQ ID NO: 1540607 - protein, 40 aa, Mycobacterium tuberculosis; identical to SEQ ID NO: 230589

SEQ ID NO: 1540608 - protein, 7 aa, Mycobacterium tuberculosis
NGKGGQP

SEQ ID NO: 1540609 - protein, 6 aa, Mycobacterium tuberculosis
NGPAGS

SEQ ID NO: 1540610 - protein, 4 aa, Mycobacterium tuberculosis
NGTQ

SEQ ID NO: 1540611 - protein, 13 aa, Mycobacterium tuberculosis
NGYPAGDMSVWNW

SEQ ID NO: 1540612 - protein, 5 aa, Mycobacterium tuberculosis
NIPPE

SEQ ID NO: 1540613 - protein, 6 aa, Mycobacterium tuberculosis
NKSEDA

SEQ ID NO: 1540614 - protein, 10 aa, Mycobacterium tuberculosis
NNGKSATAIS

SEQ ID NO: 1540615 - protein, 10 aa, Mycobacterium tuberculosis
NPDGSKQPVL

SEQ ID NO: 1540616 - protein, 5 aa, Mycobacterium tuberculosis
NPRAR

SEQ ID NO: 1540617 - protein, 6 aa, Mycobacterium tuberculosis
NRISPD

SEQ ID NO: 1540618 - protein, 4 aa, Mycobacterium tuberculosis
NRPT

SEQ ID NO: 1540619 - protein, 6 aa, Mycobacterium tuberculosis
NSAQGY

SEQ ID NO: 1540620 - protein, 14 aa, Mycobacterium tuberculosis
NTRGQGRANQAVTG

SEQ ID NO: 1540621 - protein, 15 aa, Mycobacterium tuberculosis
NTSWPDNTGQPRRAA

SEQ ID NO: 1540622 - protein, 5 aa, Mycobacterium tuberculosis
NTTPA

SEQ ID NO: 1540623 - protein, 12 aa, Mycobacterium tuberculosis
PAARADDKRLND

SEQ ID NO: 1540624 - protein, 17 aa, Mycobacterium tuberculosis
PAEEAAEAASALGGEAA

SEQ ID NO: 1540625 - protein, 15 aa, Mycobacterium tuberculosis
PAGCPDAKPSPPAAY

SEQ ID NO: 1540626 - protein, 7 aa, Mycobacterium tuberculosis
PANDPDV

SEQ ID NO: 1540627 - protein, 19 aa, Mycobacterium tuberculosis
PASAPPEPPDLSASRSAID

SEQ ID NO: 1540628 - protein, 21 aa, Mycobacterium tuberculosis
PASDDYRASASNGSDDASAHI

SEQ ID NO: 1540629 - protein, 12 aa, Mycobacterium tuberculosis
PASNDFASSDFP

SEQ ID NO: 1540630 - protein, 8 aa, Mycobacterium tuberculosis
PAVSPIEE

SEQ ID NO: 1540631 - protein, 23 aa, Mycobacterium tuberculosis
PAWQSAANDVNAKDARMKAICGG

SEQ ID NO: 1540632 - protein, 18 aa, Mycobacterium tuberculosis
PDAGADGRPHRIPEAAGG

SEQ ID NO: 1540633 - protein, 6 aa, Mycobacterium tuberculosis
PDASTV

SEQ ID NO: 1540634 - protein, 7 aa, Mycobacterium tuberculosis
PDDLPDS

SEQ ID NO: 1540635 - protein, 4 aa, Mycobacterium tuberculosis
PELS

SEQ ID NO: 1540636 - protein, 5 aa, Mycobacterium tuberculosis
PEQVN

SEQ ID NO: 1540637 - protein, 38 aa, Mycobacterium tuberculosis; identical to SEQ ID NO: 230749

SEQ ID NO: 1540638 - protein, 10 aa, Mycobacterium tuberculosis
PGGPGESGIE

SEQ ID NO: 1540639 - protein, 15 aa, Mycobacterium tuberculosis
PGPIDTEATRTVTPA

SEQ ID NO: 1540640 - protein, 4 aa, Mycobacterium tuberculosis
PGQT

SEQ ID NO: 1540641 - protein, 4 aa, Mycobacterium tuberculosis
PHLP

SEQ ID NO: 1540642 - protein, 8 aa, Mycobacterium tuberculosis
PIPPREAL

SEQ ID NO: 1540643 - protein, 11 aa, Mycobacterium tuberculosis
PKGEYTGGEDP

SEQ ID NO: 1540644 - protein, 19 aa, Mycobacterium tuberculosis
PLAQEREEDDEDDWDEEDD

SEQ ID NO: 1540645 - protein, 9 aa, Mycobacterium tuberculosis
PLASTTTDL

SEQ ID NO: 1540646 - protein, 13 aa, Mycobacterium tuberculosis
PLPPNARRVEDPE

SEQ ID NO: 1540647 - protein, 7 aa, Mycobacterium tuberculosis
PLPPTGP

SEQ ID NO: 1540648 - protein, 7 aa, Mycobacterium tuberculosis
PNLSGPV

SEQ ID NO: 1540649 - protein, 6 aa, Mycobacterium tuberculosis
PPHGNA

SEQ ID NO: 1540650 - protein, 15 aa, Mycobacterium tuberculosis
PPTPGIGNTTTVPSS

SEQ ID NO: 1540651 - protein, 4 aa, Mycobacterium tuberculosis
PPTW

SEQ ID NO: 1540652 - protein, 9 aa, Mycobacterium tuberculosis
PQPATGATV

SEQ ID NO: 1540653 - protein, 4 aa, Mycobacterium tuberculosis
PQPL

SEQ ID NO: 1540654 - protein, 7 aa, Mycobacterium tuberculosis
PQPNELP

SEQ ID NO: 1540655 - protein, 4 aa, Mycobacterium tuberculosis
PQRA

SEQ ID NO: 1540656 - protein, 8 aa, Mycobacterium tuberculosis
PRGTTQGQ

SEQ ID NO: 1540657 - protein, 25 aa, Mycobacterium tuberculosis
PRPSSAGDGYDAAASSGSNLGPTNE

SEQ ID NO: 1540658 - protein, 9 aa, Mycobacterium tuberculosis
PRSRGGAHS

SEQ ID NO: 1540659 - protein, 8 aa, Mycobacterium tuberculosis
PRTGNQNA

SEQ ID NO: 1540660 - protein, 5 aa, Mycobacterium tuberculosis
PSPCT

SEQ ID NO: 1540661 - protein, 20 aa, Mycobacterium tuberculosis
PSPGSSTPVGQLPPAATQTL

SEQ ID NO: 1540662 - protein, 6 aa, Mycobacterium tuberculosis
PSQAMG

SEQ ID NO: 1540663 - protein, 4 aa, Mycobacterium tuberculosis
PSRE

SEQ ID NO: 1540664 - protein, 7 aa, Mycobacterium tuberculosis
PSTPGTT

SEQ ID NO: 1540665 - protein, 4 aa, Mycobacterium tuberculosis
PTRG

SEQ ID NO: 1540666 - protein, 4 aa, Mycobacterium tuberculosis
PYQQ

SEQ ID NO: 1540667 - protein, 5 aa, Mycobacterium tuberculosis
QAARD

SEQ ID NO: 1540668 - protein, 6 aa, Mycobacterium tuberculosis
QAFNTP

SEQ ID NO: 1540669 - protein, 9 aa, Mycobacterium tuberculosis
QAMQAGQGA

SEQ ID NO: 1540670 - protein, 11 aa, Mycobacterium tuberculosis
QANPAPPVGPA

SEQ ID NO: 1540671 - protein, 6 aa, Mycobacterium tuberculosis
QAQGTE

SEQ ID NO: 1540672 - protein, 11 aa, Mycobacterium tuberculosis
QASGIPKANYI

SEQ ID NO: 1540673 - protein, 12 aa, Mycobacterium tuberculosis
QAVKNSLSRAAK

SEQ ID NO: 1540674 - protein, 4 aa, Mycobacterium tuberculosis
QECC

SEQ ID NO: 1540675 - protein, 10 aa, Mycobacterium tuberculosis
QGKAASYRAA

SEQ ID NO: 1540676 - protein, 5 aa, Mycobacterium tuberculosis
QGMSQ

SEQ ID NO: 1540677 - protein, 6 aa, Mycobacterium tuberculosis
QGNPIR

SEQ ID NO: 1540678 - protein, 11 aa, Mycobacterium tuberculosis
QGPFGGPDFPA

SEQ ID NO: 1540679 - protein, 5 aa, Mycobacterium tuberculosis
QGTEF

SEQ ID NO: 1540680 - protein, 63 aa, Mycobacterium tuberculosis; identical to SEQ ID NO: 230924

SEQ ID NO: 1540681 - protein, 8 aa, Mycobacterium tuberculosis
QHKPNGSH

SEQ ID NO: 1540682 - protein, 8 aa, Mycobacterium tuberculosis
QKPFPPPC

SEQ ID NO: 1540683 - protein, 10 aa, Mycobacterium tuberculosis
QLDRGSGNSV

SEQ ID NO: 1540684 - protein, 6 aa, Mycobacterium tuberculosis
QNITTA

SEQ ID NO: 1540685 - protein, 11 aa, Mycobacterium tuberculosis
QNTAGSGAGFG

SEQ ID NO: 1540686 - protein, 5 aa, Mycobacterium tuberculosis
QPAKN

SEQ ID NO: 1540687 - protein, 4 aa, Mycobacterium tuberculosis
QPAV

SEQ ID NO: 1540688 - protein, 9 aa, Mycobacterium tuberculosis
QRHQDRGVG

SEQ ID NO: 1540689 - protein, 6 aa, Mycobacterium tuberculosis
QRTSHA

SEQ ID NO: 1540690 - protein, 6 aa, Mycobacterium tuberculosis
QSAAAE

SEQ ID NO: 1540691 - protein, 5 aa, Mycobacterium tuberculosis
QSEFP

SEQ ID NO: 1540692 - protein, 7 aa, Mycobacterium tuberculosis
QSGDGPP

SEQ ID NO: 1540693 - protein, 11 aa, Mycobacterium tuberculosis
QSRPVVNGPAA

SEQ ID NO: 1540694 - protein, 4 aa, Mycobacterium tuberculosis
QTPE

SEQ ID NO: 1540695 - protein, 5 aa, Mycobacterium tuberculosis
QVGTQ

SEQ ID NO: 1540696 - protein, 10 aa, Mycobacterium tuberculosis
RAAPASAGSL

SEQ ID NO: 1540697 - protein, 8 aa, Mycobacterium tuberculosis
RADETVRR

SEQ ID NO: 1540698 - protein, 13 aa, Mycobacterium tuberculosis
RAESVRAATDGTT

SEQ ID NO: 1540699 - protein, 5 aa, Mycobacterium tuberculosis
RAGKM

SEQ ID NO: 1540700 - protein, 10 aa, Mycobacterium tuberculosis
RAKRRSCAAQ

SEQ ID NO: 1540701 - protein, 29 aa, Mycobacterium tuberculosis
RCPPEGPSKGSSGGSSQGPPDGAAAGFGD

SEQ ID NO: 1540702 - protein, 5 aa, Mycobacterium tuberculosis
RDQLA

SEQ ID NO: 1540703 - protein, 6 aa, Mycobacterium tuberculosis
RDRGRQ

SEQ ID NO: 1540704 - protein, 7 aa, Mycobacterium tuberculosis
RDRIGTA

SEQ ID NO: 1540705 - protein, 5 aa, Mycobacterium tuberculosis
RGAGT

SEQ ID NO: 1540706 - protein, 8 aa, Mycobacterium tuberculosis
RGAPDEAA

SEQ ID NO: 1540707 - protein, 24 aa, Mycobacterium tuberculosis
RGCGPAGAAITAGPAVTANAADTA

SEQ ID NO: 1540708 - protein, 8 aa, Mycobacterium tuberculosis
RGGYDGRG

SEQ ID NO: 1540709 - protein, 12 aa, Mycobacterium tuberculosis
RGISSPWSHQAE

SEQ ID NO: 1540710 - protein, 5 aa, Mycobacterium tuberculosis
RGRAA

SEQ ID NO: 1540711 - protein, 6 aa, Mycobacterium tuberculosis
RGSDAG

SEQ ID NO: 1540712 - protein, 8 aa, Mycobacterium tuberculosis
RGVGHSTP

SEQ ID NO: 1540713 - protein, 4 aa, Mycobacterium tuberculosis
RIAG

SEQ ID NO: 1540714 - protein, 4 aa, Mycobacterium tuberculosis
RIGS

SEQ ID NO: 1540715 - protein, 10 aa, Mycobacterium tuberculosis
RKPTGRKTTA

SEQ ID NO: 1540716 - protein, 6 aa, Mycobacterium tuberculosis
RKTDIS

SEQ ID NO: 1540717 - protein, 8 aa, Mycobacterium tuberculosis
RLGDSRGD

SEQ ID NO: 1540718 - protein, 5 aa, Mycobacterium tuberculosis
RPPTS

SEQ ID NO: 1540719 - protein, 9 aa, Mycobacterium tuberculosis
RPVEQGEGD

SEQ ID NO: 1540720 - protein, 9 aa, Mycobacterium tuberculosis
RQAPYGLAG

SEQ ID NO: 1540721 - protein, 9 aa, Mycobacterium tuberculosis
RQESRDVNG

SEQ ID NO: 1540722 - protein, 9 aa, Mycobacterium tuberculosis
RQPGKPSWN

SEQ ID NO: 1540723 - protein, 7 aa, Mycobacterium tuberculosis
RQTLQGA

SEQ ID NO: 1540724 - protein, 5 aa, Mycobacterium tuberculosis
RRPGA

SEQ ID NO: 1540725 - protein, 5 aa, Mycobacterium tuberculosis
RRSAE

SEQ ID NO: 1540726 - protein, 7 aa, Mycobacterium tuberculosis
RRTDGQW

SEQ ID NO: 1540727 - protein, 8 aa, Mycobacterium tuberculosis
RRYDGDER

SEQ ID NO: 1540728 - protein, 4 aa, Mycobacterium tuberculosis
RSAT

SEQ ID NO: 1540729 - protein, 7 aa, Mycobacterium tuberculosis
RSDGSGD

SEQ ID NO: 1540730 - protein, 7 aa, Mycobacterium tuberculosis
RTLSTSA

SEQ ID NO: 1540731 - protein, 5 aa, Mycobacterium tuberculosis
RWSAN

SEQ ID NO: 1540732 - protein, 6 aa, Mycobacterium tuberculosis
SAAAAD

SEQ ID NO: 1540733 - protein, 4 aa, Mycobacterium tuberculosis
SAAR

SEQ ID NO: 1540734 - protein, 18 aa, Mycobacterium tuberculosis
SACSPQKSPQPSSPRLPD

SEQ ID NO: 1540735 - protein, 23 aa, Mycobacterium tuberculosis
SADDTTPPPSPILTAGSDAPECI

SEQ ID NO: 1540736 - protein, 22 aa, Mycobacterium tuberculosis
SAEPDGANRPPPPIAGPRTPVA

SEQ ID NO: 1540737 - protein, 14 aa, Mycobacterium tuberculosis
SAGGGAYAAAEAAA

SEQ ID NO: 1540738 - protein, 24 aa, Mycobacterium tuberculosis
SAGPVALAPPAASEGRPATSGPGA

SEQ ID NO: 1540739 - protein, 9 aa, Mycobacterium tuberculosis
SAIPPRGTQ

SEQ ID NO: 1540740 - protein, 7 aa, Mycobacterium tuberculosis
SAISGGA

SEQ ID NO: 1540741 - protein, 14 aa, Mycobacterium tuberculosis
SAISSANAAAAVNT

SEQ ID NO: 1540742 - protein, 4 aa, Mycobacterium tuberculosis
SALG

SEQ ID NO: 1540743 - protein, 9 aa, Mycobacterium tuberculosis
SASATPANI

SEQ ID NO: 1540744 - protein, 9 aa, Mycobacterium tuberculosis
SAVPGTDTM

SEQ ID NO: 1540745 - protein, 10 aa, Mycobacterium tuberculosis
SCSQGDAPLG

SEQ ID NO: 1540746 - protein, 13 aa, Mycobacterium tuberculosis
SDDPAGLAENDAV

SEQ ID NO: 1540747 - protein, 5 aa, Mycobacterium tuberculosis
SDEGI

SEQ ID NO: 1540748 - protein, 13 aa, Mycobacterium tuberculosis
SDHGSDAAVARGR

SEQ ID NO: 1540749 - protein, 12 aa, Mycobacterium tuberculosis
SDPPGLTPLPEE

SEQ ID NO: 1540750 - protein, 5 aa, Mycobacterium tuberculosis
SEEVE

SEQ ID NO: 1540751 - protein, 16 aa, Mycobacterium tuberculosis
SFNTGIGNSGTGSTGL

SEQ ID NO: 1540752 - protein, 5 aa, Mycobacterium tuberculosis
SGATH

SEQ ID NO: 1540753 - protein, 17 aa, Mycobacterium tuberculosis
SGDPARALGPPPDGSYS

SEQ ID NO: 1540754 - protein, 9 aa, Mycobacterium tuberculosis
SGGAGGAGG

SEQ ID NO: 1540755 - protein, 23 aa, Mycobacterium tuberculosis
SGGAGGFGGFGTAGGVGGAGGNA

SEQ ID NO: 1540756 - protein, 7 aa, Mycobacterium tuberculosis
SGGVSSL

SEQ ID NO: 1540757 - protein, 8 aa, Mycobacterium tuberculosis
SGNSNEGF

SEQ ID NO: 1540758 - protein, 5 aa, Mycobacterium tuberculosis
SGRFP

SEQ ID NO: 1540759 - protein, 11 aa, Mycobacterium tuberculosis
SGRGPRRYTAG

SEQ ID NO: 1540760 - protein, 41 aa, Mycobacterium tuberculosis; identical to SEQ ID NO: 194996

SEQ ID NO: 1540761 - protein, 5 aa, Mycobacterium tuberculosis
SGVSV

SEQ ID NO: 1540762 - protein, 9 aa, Mycobacterium tuberculosis
SHPDDVDTP

SEQ ID NO: 1540763 - protein, 7 aa, Mycobacterium tuberculosis
SHPETNQ

SEQ ID NO: 1540764 - protein, 4 aa, Mycobacterium tuberculosis
SIQA

SEQ ID NO: 1540765 - protein, 11 aa, Mycobacterium tuberculosis
SKPTASGAAGM

SEQ ID NO: 1540766 - protein, 8 aa, Mycobacterium tuberculosis
SKSSLHPA

SEQ ID NO: 1540767 - protein, 17 aa, Mycobacterium tuberculosis
SKTGTAEHGTDPRHTPP

SEQ ID NO: 1540768 - protein, 5 aa, Mycobacterium tuberculosis
SLPRG

SEQ ID NO: 1540769 - protein, 6 aa, Mycobacterium tuberculosis
SLSSGP

SEQ ID NO: 1540770 - protein, 9 aa, Mycobacterium tuberculosis
SPEADTAGM

SEQ ID NO: 1540771 - protein, 11 aa, Mycobacterium tuberculosis
SPGSGQDRERE

SEQ ID NO: 1540772 - protein, 15 aa, Mycobacterium tuberculosis
SPIGRERKTEELSRA

SEQ ID NO: 1540773 - protein, 4 aa, Mycobacterium tuberculosis
SPRD

SEQ ID NO: 1540774 - protein, 17 aa, Mycobacterium tuberculosis
SPVEDQPKHAADGDDAE

SEQ ID NO: 1540775 - protein, 8 aa, Mycobacterium tuberculosis
SPVGRRSG

SEQ ID NO: 1540776 - protein, 4 aa, Mycobacterium tuberculosis
SQRL

SEQ ID NO: 1540777 - protein, 6 aa, Mycobacterium tuberculosis
SQVGAK

SEQ ID NO: 1540778 - protein, 8 aa, Mycobacterium tuberculosis
SRLKAGQK

SEQ ID NO: 1540779 - protein, 5 aa, Mycobacterium tuberculosis
SRRPL

SEQ ID NO: 1540780 - protein, 9 aa, Mycobacterium tuberculosis
SSDFKTGPA

SEQ ID NO: 1540781 - protein, 5 aa, Mycobacterium tuberculosis
SSERF

SEQ ID NO: 1540782 - protein, 18 aa, Mycobacterium tuberculosis
SSFGSVTSGLAGQSWQGA

SEQ ID NO: 1540783 - protein, 15 aa, Mycobacterium tuberculosis
SSGDGGAGGAGGGGG

SEQ ID NO: 1540784 - protein, 12 aa, Mycobacterium tuberculosis
SSGVAAGVTGPA

SEQ ID NO: 1540785 - protein, 4 aa, Mycobacterium tuberculosis
STGE

SEQ ID NO: 1540786 - protein, 6 aa, Mycobacterium tuberculosis
STQDPS

SEQ ID NO: 1540787 - protein, 18 aa, Mycobacterium tuberculosis
STRDAAIPTGIQNPCFSH

SEQ ID NO: 1540788 - protein, 21 aa, Mycobacterium tuberculosis
STRGKLNRPHPGSCYQINTPT

SEQ ID NO: 1540789 - protein, 8 aa, Mycobacterium tuberculosis
STTDPHSR

SEQ ID NO: 1540790 - protein, 5 aa, Mycobacterium tuberculosis
STVDE

SEQ ID NO: 1540791 - protein, 9 aa, Mycobacterium tuberculosis
STVGPIPDS

SEQ ID NO: 1540792 - protein, 6 aa, Mycobacterium tuberculosis
STYGVP

SEQ ID NO: 1540793 - protein, 9 aa, Mycobacterium tuberculosis
SVAGTGGNG

SEQ ID NO: 1540794 - protein, 9 aa, Mycobacterium tuberculosis
SVKKQTAIE

SEQ ID NO: 1540795 - protein, 6 aa, Mycobacterium tuberculosis
SYGMSG

SEQ ID NO: 1540796 - protein, 9 aa, Mycobacterium tuberculosis
TAANQDGRT

SEQ ID NO: 1540797 - protein, 5 aa, Mycobacterium tuberculosis
TAATE

SEQ ID NO: 1540798 - protein, 16 aa, Mycobacterium tuberculosis
TADEPFDPNYHQKTDT

SEQ ID NO: 1540799 - protein, 7 aa, Mycobacterium tuberculosis
TAGRAGA

SEQ ID NO: 1540800 - protein, 13 aa, Mycobacterium tuberculosis
TALERAEDPILNG

SEQ ID NO: 1540801 - protein, 11 aa, Mycobacterium tuberculosis
TANLGRPEPTH

SEQ ID NO: 1540802 - protein, 21 aa, Mycobacterium tuberculosis
TAQGTGSGAGIAQAAAGTVNI

SEQ ID NO: 1540803 - protein, 7 aa, Mycobacterium tuberculosis
TARAAGV

SEQ ID NO: 1540804 - protein, 8 aa, Mycobacterium tuberculosis
TASGQTDV

SEQ ID NO: 1540805 - protein, 5 aa, Mycobacterium tuberculosis
TCPVN

SEQ ID NO: 1540806 - protein, 8 aa, Mycobacterium tuberculosis
TDAVPGLS

SEQ ID NO: 1540807 - protein, 8 aa, Mycobacterium tuberculosis
TDPRETSR

SEQ ID NO: 1540808 - protein, 7 aa, Mycobacterium tuberculosis
TEAAQSR

SEQ ID NO: 1540809 - protein, 4 aa, Mycobacterium tuberculosis
TEQL

SEQ ID NO: 1540810 - protein, 11 aa, Mycobacterium tuberculosis
TESIDDPAGVR

SEQ ID NO: 1540811 - protein, 8 aa, Mycobacterium tuberculosis
TESVGKTI

SEQ ID NO: 1540812 - protein, 6 aa, Mycobacterium tuberculosis
TETKSP

SEQ ID NO: 1540813 - protein, 9 aa, Mycobacterium tuberculosis
TETTERPEH

SEQ ID NO: 1540814 - protein, 11 aa, Mycobacterium tuberculosis
TGAGGAYAAAE

SEQ ID NO: 1540815 - protein, 14 aa, Mycobacterium tuberculosis
TGGAGGAGGAGGNA

SEQ ID NO: 1540816 - protein, 23 aa, Mycobacterium tuberculosis
TGGAGGAGGFGGFGGDGGDGGIG

SEQ ID NO: 1540817 - protein, 20 aa, Mycobacterium tuberculosis
TGGAGGNGGPGGDGGTGATV

SEQ ID NO: 1540818 - protein, 21 aa, Mycobacterium tuberculosis
TGGAGGNGGPGGDGGTGATVG

SEQ ID NO: 1540819 - protein, 23 aa, Mycobacterium tuberculosis
TGGGGAYAAAEAANVSAAQSTDQ

SEQ ID NO: 1540820 - protein, 6 aa, Mycobacterium tuberculosis
TGNDRT

SEQ ID NO: 1540821 - protein, 8 aa, Mycobacterium tuberculosis
TGPWTGPA

SEQ ID NO: 1540822 - protein, 26 aa, Mycobacterium tuberculosis
TGQGGNGGNAAFGKAGTGSVGVGGAG

SEQ ID NO: 1540823 - protein, 7 aa, Mycobacterium tuberculosis
TGTATGV

SEQ ID NO: 1540824 - protein, 4 aa, Mycobacterium tuberculosis
THSR

SEQ ID NO: 1540825 - protein, 5 aa, Mycobacterium tuberculosis
TISGV

SEQ ID NO: 1540826 - protein, 6 aa, Mycobacterium tuberculosis
TKAGLP

SEQ ID NO: 1540827 - protein, 10 aa, Mycobacterium tuberculosis
TKDGTLGGPN

SEQ ID NO: 1540828 - protein, 4 aa, Mycobacterium tuberculosis
TLAS

SEQ ID NO: 1540829 - protein, 11 aa, Mycobacterium tuberculosis
TLGEDMQQAPP

SEQ ID NO: 1540830 - protein, 7 aa, Mycobacterium tuberculosis
TLPGRGL

SEQ ID NO: 1540831 - protein, 7 aa, Mycobacterium tuberculosis
TLSTTGP

SEQ ID NO: 1540832 - protein, 5 aa, Mycobacterium tuberculosis
TMPEK

SEQ ID NO: 1540833 - protein, 6 aa, Mycobacterium tuberculosis
TNLTTK

SEQ ID NO: 1540834 - protein, 4 aa, Mycobacterium tuberculosis
TNNH

SEQ ID NO: 1540835 - protein, 10 aa, Mycobacterium tuberculosis
TNPGASDPAA

SEQ ID NO: 1540836 - protein, 6 aa, Mycobacterium tuberculosis
TNQNDA

SEQ ID NO: 1540837 - protein, 8 aa, Mycobacterium tuberculosis
TNRGSENF

SEQ ID NO: 1540838 - protein, 9 aa, Mycobacterium tuberculosis
TNWSTGQPM

SEQ ID NO: 1540839 - protein, 7 aa, Mycobacterium tuberculosis
TPTPAPL

SEQ ID NO: 1540840 - protein, 5 aa, Mycobacterium tuberculosis
TQGRG

SEQ ID NO: 1540841 - protein, 7 aa, Mycobacterium tuberculosis
TQSRVGD

SEQ ID NO: 1540842 - protein, 5 aa, Mycobacterium tuberculosis
TRFDY

SEQ ID NO: 1540843 - protein, 8 aa, Mycobacterium tuberculosis
TSAGGDPV

SEQ ID NO: 1540844 - protein, 18 aa, Mycobacterium tuberculosis
TSGGGAYAAAEAAATSPL

SEQ ID NO: 1540845 - protein, 7 aa, Mycobacterium tuberculosis
TSGPGEL

SEQ ID NO: 1540846 - protein, 31 aa, Mycobacterium tuberculosis; identical to SEQ ID NO: 231626

SEQ ID NO: 1540847 - protein, 6 aa, Mycobacterium tuberculosis
TSSPAH

SEQ ID NO: 1540848 - protein, 14 aa, Mycobacterium tuberculosis
TSSVGGAGGAGGHA

SEQ ID NO: 1540849 - protein, 10 aa, Mycobacterium tuberculosis
TTASPGATAA

SEQ ID NO: 1540850 - protein, 6 aa, Mycobacterium tuberculosis
TTDDVR

SEQ ID NO: 1540851 - protein, 21 aa, Mycobacterium tuberculosis
TTGGHRAGVRAPAPPPRPPTV

SEQ ID NO: 1540852 - protein, 4 aa, Mycobacterium tuberculosis
TTGL

SEQ ID NO: 1540853 - protein, 9 aa, Mycobacterium tuberculosis
TTPQQITRT

SEQ ID NO: 1540854 - protein, 7 aa, Mycobacterium tuberculosis
TVGYQQR

SEQ ID NO: 1540855 - protein, 29 aa, Mycobacterium tuberculosis
TYSGAGPQGAATTTPPPAGPPPLAAPKND

SEQ ID NO: 1540856 - protein, 11 aa, Mycobacterium tuberculosis
VAAAAGQSWED

SEQ ID NO: 1540857 - protein, 13 aa, Mycobacterium tuberculosis
VAAADRNSGTAIT

SEQ ID NO: 1540858 - protein, 18 aa, Mycobacterium tuberculosis
VAAPATAELAPAAADEVS

SEQ ID NO: 1540859 - protein, 8 aa, Mycobacterium tuberculosis
VAPPSVRP

SEQ ID NO: 1540860 - protein, 10 aa, Mycobacterium tuberculosis
VAPRGGGHSY

SEQ ID NO: 1540861 - protein, 7 aa, Mycobacterium tuberculosis
VASEEGL

SEQ ID NO: 1540862 - protein, 5 aa, Mycobacterium tuberculosis
VDPAT

SEQ ID NO: 1540863 - protein, 7 aa, Mycobacterium tuberculosis
VDPQRGR

SEQ ID NO: 1540864 - protein, 11 aa, Mycobacterium tuberculosis
VDPTAADPAGW

SEQ ID NO: 1540865 - protein, 11 aa, Mycobacterium tuberculosis
VEEGPPPPLPA

SEQ ID NO: 1540866 - protein, 8 aa, Mycobacterium tuberculosis
VEPNDGHR

SEQ ID NO: 1540867 - protein, 12 aa, Mycobacterium tuberculosis
VETENEETPAGS

SEQ ID NO: 1540868 - protein, 8 aa, Mycobacterium tuberculosis
VGASTANG

SEQ ID NO: 1540869 - protein, 9 aa, Mycobacterium tuberculosis
VGGHDPHEL

SEQ ID NO: 1540870 - protein, 4 aa, Mycobacterium tuberculosis
VGQI

SEQ ID NO: 1540871 - protein, 11 aa, Mycobacterium tuberculosis
VGRLSQSADQY

SEQ ID NO: 1540872 - protein, 9 aa, Mycobacterium tuberculosis
VGSGPTIGG

SEQ ID NO: 1540873 - protein, 14 aa, Mycobacterium tuberculosis
VGTYNKNDGAQDWQ

SEQ ID NO: 1540874 - protein, 4 aa, Mycobacterium tuberculosis
VGYQ

SEQ ID NO: 1540875 - protein, 9 aa, Mycobacterium tuberculosis
VKKSAEQAE

SEQ ID NO: 1540876 - protein, 12 aa, Mycobacterium tuberculosis
VLGGTGGGGGVG

SEQ ID NO: 1540877 - protein, 7 aa, Mycobacterium tuberculosis
VNQSSTA

SEQ ID NO: 1540878 - protein, 4 aa, Mycobacterium tuberculosis
VPAP

SEQ ID NO: 1540879 - protein, 5 aa, Mycobacterium tuberculosis
VPAST

SEQ ID NO: 1540880 - protein, 8 aa, Mycobacterium tuberculosis
VPDPITGV

SEQ ID NO: 1540881 - protein, 4 aa, Mycobacterium tuberculosis
VPEQ

SEQ ID NO: 1540882 - protein, 5 aa, Mycobacterium tuberculosis
VPEQA

SEQ ID NO: 1540883 - protein, 14 aa, Mycobacterium tuberculosis
VPIPGGPVPIPGAP

SEQ ID NO: 1540884 - protein, 5 aa, Mycobacterium tuberculosis
VPQLP

SEQ ID NO: 1540885 - protein, 4 aa, Mycobacterium tuberculosis
VPSG

SEQ ID NO: 1540886 - protein, 8 aa, Mycobacterium tuberculosis
VRTDAPSN

SEQ ID NO: 1540887 - protein, 5 aa, Mycobacterium tuberculosis
VSAQA

SEQ ID NO: 1540888 - protein, 6 aa, Mycobacterium tuberculosis
VSASEG

SEQ ID NO: 1540889 - protein, 10 aa, Mycobacterium tuberculosis
VSEQSPNYRD

SEQ ID NO: 1540890 - protein, 4 aa, Mycobacterium tuberculosis
VTEQ

SEQ ID NO: 1540891 - protein, 10 aa, Mycobacterium tuberculosis
VTGSGSGLDP

SEQ ID NO: 1540892 - protein, 6 aa, Mycobacterium tuberculosis
VTLTRG

SEQ ID NO: 1540893 - protein, 17 aa, Mycobacterium tuberculosis
VTMPDSNSVKARELSGS

SEQ ID NO: 1540894 - protein, 5 aa, Mycobacterium tuberculosis
VTPAT

SEQ ID NO: 1540895 - protein, 13 aa, Mycobacterium tuberculosis
VTVTGQGNSLKVG

SEQ ID NO: 1540896 - protein, 8 aa, Mycobacterium tuberculosis
VYSPAGCG

SEQ ID NO: 1540897 - protein, 8 aa, Mycobacterium tuberculosis
WGPPSKPG

SEQ ID NO: 1540898 - protein, 6 aa, Mycobacterium tuberculosis
WQDNEG

SEQ ID NO: 1540899 - protein, 9 aa, Mycobacterium tuberculosis
YDATTGRVT

SEQ ID NO: 1540900 - protein, 6 aa, Mycobacterium tuberculosis
YDRPPL

SEQ ID NO: 1540901 - protein, 5 aa, Mycobacterium tuberculosis
YNGYT

SEQ ID NO: 1540902 - protein, 8 aa, Mycobacterium tuberculosis
YPDSQVGT

SEQ ID NO: 1540903 - protein, 7 aa, Mycobacterium tuberculosis
YPGGAGF

SEQ ID NO: 1540904 - protein, 9 aa, Mycobacterium tuberculosis
YRPKRPGSY

SEQ ID NO: 1540905 - protein, 5 aa, Mycobacterium tuberculosis
YSPRG

SEQ ID NO: 1540906 - protein, 43 aa, Mycobacterium tuberculosis; identical to SEQ ID NO: 192013

SEQ ID NO: 1540907 - protein, 10 aa, Mycobacterium tuberculosis
YTSGSTAAPR

SEQ ID NO: 1540908 - protein, 20 aa, Mycobacterium tuberculosis
YTSGTGQGNASATKDGSHYK

SEQ ID NO: 1540909 - protein, 19 aa, Mycobacterium tuberculosis
YYGNTKDRVVDENDSAGTG

SEQ ID NO: 1540910 - protein, 7 aa, Mycobacterium tuberculosis
AAAAELA

SEQ ID NO: 1540911 - protein, 16 aa, Mycobacterium tuberculosis
AAAASLQPLDPPDGFT

SEQ ID NO: 1540912 - protein, 17 aa, Mycobacterium tuberculosis
AAADPATPQPNPTQQLP

SEQ ID NO: 1540913 - protein, 36 aa, Mycobacterium tuberculosis; identical to SEQ ID NO: 166758

SEQ ID NO: 1540914 - protein, 10 aa, Mycobacterium tuberculosis
AAALTSDDHG

SEQ ID NO: 1540915 - protein, 11 aa, Mycobacterium tuberculosis
AAELGGDPSRI

SEQ ID NO: 1540916 - protein, 24 aa, Mycobacterium tuberculosis
AAGAGGAGGAGAVGGNGGAGGNGG

SEQ ID NO: 1540917 - protein, 12 aa, Mycobacterium tuberculosis
AAGATETEQLTA

SEQ ID NO: 1540918 - protein, 30 aa, Mycobacterium tuberculosis; identical to SEQ ID NO: 192057

SEQ ID NO: 1540919 - protein, 5 aa, Mycobacterium tuberculosis
AAGRH

SEQ ID NO: 1540920 - protein, 18 aa, Mycobacterium tuberculosis
AAGSAEPAVTANAADTVA

SEQ ID NO: 1540921 - protein, 4 aa, Mycobacterium tuberculosis
AAMT

SEQ ID NO: 1540922 - protein, 22 aa, Mycobacterium tuberculosis
AANAAAAASTTALAAAGADEVS

SEQ ID NO: 1540923 - protein, 12 aa, Mycobacterium tuberculosis
AANAAAAGPTTQ

SEQ ID NO: 1540924 - protein, 8 aa, Mycobacterium tuberculosis
AAQGNYAD

SEQ ID NO: 1540925 - protein, 8 aa, Mycobacterium tuberculosis
AAQPPAMS

SEQ ID NO: 1540926 - protein, 8 aa, Mycobacterium tuberculosis
AASGTVVK

SEQ ID NO: 1540927 - protein, 6 aa, Mycobacterium tuberculosis
AATGRA

SEQ ID NO: 1540928 - protein, 6 aa, Mycobacterium tuberculosis
AATTAG

SEQ ID NO: 1540929 - protein, 231 aa, Mycobacterium tuberculosis
AATTGGAGGNGGAGGFASTGLGGPGGAGGPGGAGDFASGVGGVGGAGGDGGAGGVGGFGGQGGIGGEGRTGGNGGSGGDGGGGISLGGNGGLGGNGGVSETGFGGAGGNGGYGGPGGPEGNGGLGGNGGAGGNGGVSTTGGDGGAGGKGGNGGDGGNVGLGGDAGSGGAGGNGGIGTDAGGAGGAGGAGGNGGSSKSTTTGNAGSGGAGGNGGTGLNGAGGAGGAGGNAGV

SEQ ID NO: 1540930 - protein, 8 aa, Mycobacterium tuberculosis
ACSATAAP

SEQ ID NO: 1540931 - protein, 7 aa, Mycobacterium tuberculosis
ADESPAA

SEQ ID NO: 1540932 - protein, 17 aa, Mycobacterium tuberculosis
ADGKSLNVAGSDNTLTV

SEQ ID NO: 1540933 - protein, 7 aa, Mycobacterium tuberculosis
ADLTNRS

SEQ ID NO: 1540934 - protein, 4 aa, Mycobacterium tuberculosis
ADPA

SEQ ID NO: 1540935 - protein, 5 aa, Mycobacterium tuberculosis
ADPKL

SEQ ID NO: 1540936 - protein, 11 aa, Mycobacterium tuberculosis
ADQAKKQNLAA

SEQ ID NO: 1540937 - protein, 7 aa, Mycobacterium tuberculosis
ADRAAHR

SEQ ID NO: 1540938 - protein, 6 aa, Mycobacterium tuberculosis
ADRGSW

SEQ ID NO: 1540939 - protein, 5 aa, Mycobacterium tuberculosis
AEANA

SEQ ID NO: 1540940 - protein, 7 aa, Mycobacterium tuberculosis
AEDREIP

SEQ ID NO: 1540941 - protein, 9 aa, Mycobacterium tuberculosis
AEPDSSDRD

SEQ ID NO: 1540942 - protein, 7 aa, Mycobacterium tuberculosis
AEQTGKR

SEQ ID NO: 1540943 - protein, 16 aa, Mycobacterium tuberculosis
AETTTNGSVSPATVRD

SEQ ID NO: 1540944 - protein, 12 aa, Mycobacterium tuberculosis
AFSPPAQALGGG

SEQ ID NO: 1540945 - protein, 7 aa, Mycobacterium tuberculosis
AGADEVS

SEQ ID NO: 1540946 - protein, 42 aa, Mycobacterium tuberculosis; identical to SEQ ID NO: 228921

SEQ ID NO: 1540947 - protein, 5 aa, Mycobacterium tuberculosis
AGCTN

SEQ ID NO: 1540948 - protein, 15 aa, Mycobacterium tuberculosis
AGDGGAGGAGGSGGH

SEQ ID NO: 1540949 - protein, 53 aa, Mycobacterium tuberculosis
AGGAGGAGGFGDTGGTGGAGGAGGLFGPGGGSGGVGGFGDTGGTGGDGGSGGL

SEQ ID NO: 1540950 - protein, 11 aa, Mycobacterium tuberculosis
AGGDGGAGGNA

SEQ ID NO: 1540951 - protein, 11 aa, Mycobacterium tuberculosis
AGGEGGSGGHS

SEQ ID NO: 1540952 - protein, 7 aa, Mycobacterium tuberculosis
AGGGLAS

SEQ ID NO: 1540953 - protein, 35 aa, Mycobacterium tuberculosis; identical to SEQ ID NO: 228953

SEQ ID NO: 1540954 - protein, 7 aa, Mycobacterium tuberculosis
AGGTGLN

SEQ ID NO: 1540955 - protein, 10 aa, Mycobacterium tuberculosis
AGIQRAKRTR

SEQ ID NO: 1540956 - protein, 17 aa, Mycobacterium tuberculosis
AGPAGPAAPGGPAGPAA

SEQ ID NO: 1540957 - protein, 19 aa, Mycobacterium tuberculosis
AGPDTISGATIPQGEQSTG

SEQ ID NO: 1540958 - protein, 7 aa, Mycobacterium tuberculosis
AGQVDEV

SEQ ID NO: 1540959 - protein, 10 aa, Mycobacterium tuberculosis
AGRPGQPVYA

SEQ ID NO: 1540960 - protein, 9 aa, Mycobacterium tuberculosis
AHNGYADDG

SEQ ID NO: 1540961 - protein, 10 aa, Mycobacterium tuberculosis
AHPSTQDRSL

SEQ ID NO: 1540962 - protein, 26 aa, Mycobacterium tuberculosis
ALGGNGGGGGVGGNAGAGGTGGSAGW

SEQ ID NO: 1540963 - protein, 8 aa, Mycobacterium tuberculosis
ALRESAGR

SEQ ID NO: 1540964 - protein, 6 aa, Mycobacterium tuberculosis
ALTAAA

SEQ ID NO: 1540965 - protein, 10 aa, Mycobacterium tuberculosis
ANAKTGTSMA

SEQ ID NO: 1540966 - protein, 19 aa, Mycobacterium tuberculosis
ANPTRPPANPQALTPPKVP

SEQ ID NO: 1540967 - protein, 9 aa, Mycobacterium tuberculosis
ANRPEYPHK

SEQ ID NO: 1540968 - protein, 8 aa, Mycobacterium tuberculosis
ANTGSGNF

SEQ ID NO: 1540969 - protein, 5 aa, Mycobacterium tuberculosis
APADL

SEQ ID NO: 1540970 - protein, 9 aa, Mycobacterium tuberculosis
APAHADDSR

SEQ ID NO: 1540971 - protein, 16 aa, Mycobacterium tuberculosis
APCPKPQAAAQSPDGL

SEQ ID NO: 1540972 - protein, 12 aa, Mycobacterium tuberculosis
APGTYRTEGPSN

SEQ ID NO: 1540973 - protein, 22 aa, Mycobacterium tuberculosis
APGVPGGAGGAGGAGGVGGPAG

SEQ ID NO: 1540974 - protein, 29 aa, Mycobacterium tuberculosis
APGYPPTIEPAQPAVSPPTSQDPAGAVRP

SEQ ID NO: 1540975 - protein, 4 aa, Mycobacterium tuberculosis
APHS

SEQ ID NO: 1540976 - protein, 7 aa, Mycobacterium tuberculosis
APPPQRA

SEQ ID NO: 1540977 - protein, 6 aa, Mycobacterium tuberculosis
APQQSW

SEQ ID NO: 1540978 - protein, 27 aa, Mycobacterium tuberculosis
APTIPLPGSTAQLENYGGAPCGDEPTV

SEQ ID NO: 1540979 - protein, 4 aa, Mycobacterium tuberculosis
APVA

SEQ ID NO: 1540980 - protein, 19 aa, Mycobacterium tuberculosis
APYGPGSARAGADGSGPQG

SEQ ID NO: 1540981 - protein, 12 aa, Mycobacterium tuberculosis
AQAAEASRAGVT

SEQ ID NO: 1540982 - protein, 4 aa, Mycobacterium tuberculosis
AQDP

SEQ ID NO: 1540983 - protein, 5 aa, Mycobacterium tuberculosis
AQPYG

SEQ ID NO: 1540984 - protein, 21 aa, Mycobacterium tuberculosis
AQTGAVADQQGQIAGLGRAGR

SEQ ID NO: 1540985 - protein, 15 aa, Mycobacterium tuberculosis
ARAESVRAATDGTTA

SEQ ID NO: 1540986 - protein, 6 aa, Mycobacterium tuberculosis
ARAVTR

SEQ ID NO: 1540987 - protein, 5 aa, Mycobacterium tuberculosis
ARGTA

SEQ ID NO: 1540988 - protein, 11 aa, Mycobacterium tuberculosis
ARPGNSGGPIV

SEQ ID NO: 1540989 - protein, 5 aa, Mycobacterium tuberculosis
ARQRL

SEQ ID NO: 1540990 - protein, 11 aa, Mycobacterium tuberculosis
ARSPACPLGTD

SEQ ID NO: 1540991 - protein, 6 aa, Mycobacterium tuberculosis
ARTSQF

SEQ ID NO: 1540992 - protein, 8 aa, Mycobacterium tuberculosis
ASAAENYG

SEQ ID NO: 1540993 - protein, 7 aa, Mycobacterium tuberculosis
ASAESRS

SEQ ID NO: 1540994 - protein, 5 aa, Mycobacterium tuberculosis
ASDLG

SEQ ID NO: 1540995 - protein, 9 aa, Mycobacterium tuberculosis
ASGGPNCRG

SEQ ID NO: 1540996 - protein, 7 aa, Mycobacterium tuberculosis
ASLPSGG

SEQ ID NO: 1540997 - protein, 39 aa, Mycobacterium tuberculosis; identical to SEQ ID NO: 229207

SEQ ID NO: 1540998 - protein, 16 aa, Mycobacterium tuberculosis
ASTGASAGAGTGASSK

SEQ ID NO: 1540999 - protein, 18 aa, Mycobacterium tuberculosis
ASVAPSSNALLAAALVRV

SEQ ID NO: 1541000 - protein, 12 aa, Mycobacterium tuberculosis
ATAVANRSGTEP

SEQ ID NO: 1541001 - protein, 16 aa, Mycobacterium tuberculosis
ATSEQHSSGQPPQATR

SEQ ID NO: 1541002 - protein, 6 aa, Mycobacterium tuberculosis
ATTRTG

SEQ ID NO: 1541003 - protein, 9 aa, Mycobacterium tuberculosis
ATVSPGATA

SEQ ID NO: 1541004 - protein, 4 aa, Mycobacterium tuberculosis
ATYQ

SEQ ID NO: 1541005 - protein, 40 aa, Mycobacterium tuberculosis; identical to SEQ ID NO: 193797

SEQ ID NO: 1541006 - protein, 13 aa, Mycobacterium tuberculosis
AVGGPDDPEFHPP

SEQ ID NO: 1541007 - protein, 5 aa, Mycobacterium tuberculosis
AVQPD

SEQ ID NO: 1541008 - protein, 4 aa, Mycobacterium tuberculosis
AWAG

SEQ ID NO: 1541009 - protein, 9 aa, Mycobacterium tuberculosis
AYQTVSAQA

SEQ ID NO: 1541010 - protein, 13 aa, Mycobacterium tuberculosis
AYSYASAEAAAVT

SEQ ID NO: 1541011 - protein, 15 aa, Mycobacterium tuberculosis
CDSHNSGSLGADPRQ

SEQ ID NO: 1541012 - protein, 6 aa, Mycobacterium tuberculosis
CRSQAR

SEQ ID NO: 1541013 - protein, 17 aa, Mycobacterium tuberculosis
CTTTTTGKAGLAPNAVP

SEQ ID NO: 1541014 - protein, 5 aa, Mycobacterium tuberculosis
DAEPH

SEQ ID NO: 1541015 - protein, 17 aa, Mycobacterium tuberculosis
DAGAGGNGGKGGAGGAA

SEQ ID NO: 1541016 - protein, 6 aa, Mycobacterium tuberculosis
DASPSL

SEQ ID NO: 1541017 - protein, 7 aa, Mycobacterium tuberculosis
DEEGGRV

SEQ ID NO: 1541018 - protein, 6 aa, Mycobacterium tuberculosis
DEGHSA

SEQ ID NO: 1541019 - protein, 10 aa, Mycobacterium tuberculosis
DGAGGAGGTR

SEQ ID NO: 1541020 - protein, 17 aa, Mycobacterium tuberculosis
DGEDEVTGPDADRARAA

SEQ ID NO: 1541021 - protein, 35 aa, Mycobacterium tuberculosis; identical to SEQ ID NO: 229390

SEQ ID NO: 1541022 - protein, 32 aa, Mycobacterium tuberculosis; identical to SEQ ID NO: 229392

SEQ ID NO: 1541023 - protein, 27 aa, Mycobacterium tuberculosis
DGGNGGAGGLGTGPVGATGGIGGPGGA

SEQ ID NO: 1541024 - protein, 23 aa, Mycobacterium tuberculosis
DGGNGYSQTTPGAVGGAGGSAGF

SEQ ID NO: 1541025 - protein, 14 aa, Mycobacterium tuberculosis
DGGQGGPGGNAGTV

SEQ ID NO: 1541026 - protein, 79 aa, Mycobacterium tuberculosis; identical to SEQ ID NO: 229402

SEQ ID NO: 1541027 - protein, 6 aa, Mycobacterium tuberculosis
DGPHAH

SEQ ID NO: 1541028 - protein, 6 aa, Mycobacterium tuberculosis
DGQTVG

SEQ ID NO: 1541029 - protein, 11 aa, Mycobacterium tuberculosis
DGRFDAEPDEL

SEQ ID NO: 1541030 - protein, 18 aa, Mycobacterium tuberculosis
DLAGTSARVRAKRPDGDW

SEQ ID NO: 1541031 - protein, 5 aa, Mycobacterium tuberculosis
DLDPA

SEQ ID NO: 1541032 - protein, 5 aa, Mycobacterium tuberculosis
DPARR

SEQ ID NO: 1541033 - protein, 20 aa, Mycobacterium tuberculosis
DPDNPRISRPARTKDPRGLS

SEQ ID NO: 1541034 - protein, 15 aa, Mycobacterium tuberculosis
DPGPSVDKLQAGDAI

SEQ ID NO: 1541035 - protein, 26 aa, Mycobacterium tuberculosis
DPHRASDDAVGVPPACGGRSDEEERR

SEQ ID NO: 1541036 - protein, 10 aa, Mycobacterium tuberculosis
DPVCSSGGNW

SEQ ID NO: 1541037 - protein, 16 aa, Mycobacterium tuberculosis
DRNDAPGGHNGCDTRD

SEQ ID NO: 1541038 - protein, 5 aa, Mycobacterium tuberculosis
DRPTA

SEQ ID NO: 1541039 - protein, 7 aa, Mycobacterium tuberculosis
DSGTEST

SEQ ID NO: 1541040 - protein, 5 aa, Mycobacterium tuberculosis
DSGTH

SEQ ID NO: 1541041 - protein, 12 aa, Mycobacterium tuberculosis
DSGTPTGRDEQI

SEQ ID NO: 1541042 - protein, 7 aa, Mycobacterium tuberculosis
DSPSVTR

SEQ ID NO: 1541043 - protein, 10 aa, Mycobacterium tuberculosis
DSRDPDPRAA

SEQ ID NO: 1541044 - protein, 12 aa, Mycobacterium tuberculosis
DSVPGSGGIRGP

SEQ ID NO: 1541045 - protein, 4 aa, Mycobacterium tuberculosis
DTPW

SEQ ID NO: 1541046 - protein, 11 aa, Mycobacterium tuberculosis
DTRGFDDTTPP

SEQ ID NO: 1541047 - protein, 9 aa, Mycobacterium tuberculosis
DTSKPAAAA

SEQ ID NO: 1541048 - protein, 13 aa, Mycobacterium tuberculosis
DVGATQQVGTQQV

SEQ ID NO: 1541049 - protein, 6 aa, Mycobacterium tuberculosis
DVGGPP

SEQ ID NO: 1541050 - protein, 9 aa, Mycobacterium tuberculosis
DYDNPHSTG

SEQ ID NO: 1541051 - protein, 5 aa, Mycobacterium tuberculosis
EAAGG

SEQ ID NO: 1541052 - protein, 15 aa, Mycobacterium tuberculosis
EASGSAGKVTVSPVR

SEQ ID NO: 1541053 - protein, 10 aa, Mycobacterium tuberculosis
EDDPRTLAQR

SEQ ID NO: 1541054 - protein, 15 aa, Mycobacterium tuberculosis
EDEAERARSAGGGNW

SEQ ID NO: 1541055 - protein, 4 aa, Mycobacterium tuberculosis
EEEL

SEQ ID NO: 1541056 - protein, 5 aa, Mycobacterium tuberculosis
EEELR

SEQ ID NO: 1541057 - protein, 5 aa, Mycobacterium tuberculosis
EESAA

SEQ ID NO: 1541058 - protein, 8 aa, Mycobacterium tuberculosis
EGHPDNAA

SEQ ID NO: 1541059 - protein, 17 aa, Mycobacterium tuberculosis
EGIATGDYTTAAEDKPA

SEQ ID NO: 1541060 - protein, 17 aa, Mycobacterium tuberculosis
EGVAATAATAINANAAS

SEQ ID NO: 1541061 - protein, 5 aa, Mycobacterium tuberculosis
EHGYP

SEQ ID NO: 1541062 - protein, 6 aa, Mycobacterium tuberculosis
EHGYPT

SEQ ID NO: 1541063 - protein, 10 aa, Mycobacterium tuberculosis
EINGNGSRIQ

SEQ ID NO: 1541064 - protein, 4 aa, Mycobacterium tuberculosis
EKRA

SEQ ID NO: 1541065 - protein, 4 aa, Mycobacterium tuberculosis
ELTS

SEQ ID NO: 1541066 - protein, 4 aa, Mycobacterium tuberculosis
ENDR

SEQ ID NO: 1541067 - protein, 8 aa, Mycobacterium tuberculosis
ENPPTDTR

SEQ ID NO: 1541068 - protein, 14 aa, Mycobacterium tuberculosis
EPSATGASDPCAAS

SEQ ID NO: 1541069 - protein, 10 aa, Mycobacterium tuberculosis
EPTNPDSAAL

SEQ ID NO: 1541070 - protein, 12 aa, Mycobacterium tuberculosis
ERDGRTDPFGQE

SEQ ID NO: 1541071 - protein, 11 aa, Mycobacterium tuberculosis
ESASNAWDDAG

SEQ ID NO: 1541072 - protein, 4 aa, Mycobacterium tuberculosis
ESQA

SEQ ID NO: 1541073 - protein, 4 aa, Mycobacterium tuberculosis
EVAR

SEQ ID NO: 1541074 - protein, 12 aa, Mycobacterium tuberculosis
EVDDQSRARAAL

SEQ ID NO: 1541075 - protein, 135 aa, Mycobacterium tuberculosis; identical to SEQ ID NO: 232055

SEQ ID NO: 1541076 - protein, 15 aa, Mycobacterium tuberculosis
FGSGGAGGNGGVGQG

SEQ ID NO: 1541077 - protein, 15 aa, Mycobacterium tuberculosis
FNTGIGNSGTGSTGL

SEQ ID NO: 1541078 - protein, 8 aa, Mycobacterium tuberculosis
FNTGSGNV

SEQ ID NO: 1541079 - protein, 5 aa, Mycobacterium tuberculosis
FPRGA

SEQ ID NO: 1541080 - protein, 12 aa, Mycobacterium tuberculosis
FTNSPLRDGEHA

SEQ ID NO: 1541081 - protein, 8 aa, Mycobacterium tuberculosis
GAAQGGYG

SEQ ID NO: 1541082 - protein, 9 aa, Mycobacterium tuberculosis
GAASGQWTP

SEQ ID NO: 1541083 - protein, 5 aa, Mycobacterium tuberculosis
GADAL

SEQ ID NO: 1541084 - protein, 13 aa, Mycobacterium tuberculosis
GADATDIAKRRQQ

SEQ ID NO: 1541085 - protein, 14 aa, Mycobacterium tuberculosis
GAGAYAGAEAANVE

SEQ ID NO: 1541086 - protein, 49 aa, Mycobacterium tuberculosis; identical to SEQ ID NO: 229719

SEQ ID NO: 1541087 - protein, 8 aa, Mycobacterium tuberculosis
GAGGAYAA

SEQ ID NO: 1541088 - protein, 26 aa, Mycobacterium tuberculosis
GAGGHGGAGGLGAVTGGVGGAGGAGG

SEQ ID NO: 1541089 - protein, 27 aa, Mycobacterium tuberculosis
GAGGTGGAGGGSTLAGGAGGAGGNGGL

SEQ ID NO: 1541090 - protein, 29 aa, Mycobacterium tuberculosis
GAGGTGGAGSHSTAAGVSGGAGGAGGDAG

SEQ ID NO: 1541091 - protein, 28 aa, Mycobacterium tuberculosis
GAGGTGGHGGFADSSFGGVGGAGGAGGL

SEQ ID NO: 1541092 - protein, 36 aa, Mycobacterium tuberculosis; identical to SEQ ID NO: 1443597

SEQ ID NO: 1541093 - protein, 9 aa, Mycobacterium tuberculosis
GAHRPTPTI

SEQ ID NO: 1541094 - protein, 6 aa, Mycobacterium tuberculosis
GALPNL

SEQ ID NO: 1541095 - protein, 16 aa, Mycobacterium tuberculosis
GAPAALADSVRNGDTQ

SEQ ID NO: 1541096 - protein, 7 aa, Mycobacterium tuberculosis
GAPGDGV

SEQ ID NO: 1541097 - protein, 17 aa, Mycobacterium tuberculosis
GASADQSRGVADGKPAD

SEQ ID NO: 1541098 - protein, 16 aa, Mycobacterium tuberculosis
GASGGAGGSGGSSLTA

SEQ ID NO: 1541099 - protein, 9 aa, Mycobacterium tuberculosis
GDAASTGGL

SEQ ID NO: 1541100 - protein, 18 aa, Mycobacterium tuberculosis
GDGGAGGAGGAGAAGGFG

SEQ ID NO: 1541101 - protein, 90 aa, Mycobacterium tuberculosis
GDGGAGGAGGMGSTGGTGGGGGFGGGTGGNGGNGHAGGAGGSGGTAGLLGSGGSGGTGGDGGNGGLGAGSGAKGNGGNGGDGGKGGDAQL

SEQ ID NO: 1541102 - protein, 15 aa, Mycobacterium tuberculosis
GDGGAGGTGGLGDVN

SEQ ID NO: 1541103 - protein, 17 aa, Mycobacterium tuberculosis
GDGTDAAPGSGGAGGAG

SEQ ID NO: 1541104 - protein, 18 aa, Mycobacterium tuberculosis
GDGTDAAPGSGGAGGAGG

SEQ ID NO: 1541105 - protein, 13 aa, Mycobacterium tuberculosis
GDHATSGPAAINQ

SEQ ID NO: 1541106 - protein, 12 aa, Mycobacterium tuberculosis
GDLYGGNEPSRT

SEQ ID NO: 1541107 - protein, 8 aa, Mycobacterium tuberculosis
GDPICSDG

SEQ ID NO: 1541108 - protein, 4 aa, Mycobacterium tuberculosis
GDTD

SEQ ID NO: 1541109 - protein, 5 aa, Mycobacterium tuberculosis
GEKGR

SEQ ID NO: 1541110 - protein, 7 aa, Mycobacterium tuberculosis
GETMRPQ

SEQ ID NO: 1541111 - protein, 10 aa, Mycobacterium tuberculosis
GFGNNGNNNI

SEQ ID NO: 1541112 - protein, 4 aa, Mycobacterium tuberculosis
GFVS

SEQ ID NO: 1541113 - protein, 13 aa, Mycobacterium tuberculosis
GGAATAGAFSRPG

SEQ ID NO: 1541114 - protein, 6 aa, Mycobacterium tuberculosis
GGAATR

SEQ ID NO: 1541115 - protein, 23 aa, Mycobacterium tuberculosis
GGAGGAGGFGQSGAAGGAGGAGG

SEQ ID NO: 1541116 - protein, 9 aa, Mycobacterium tuberculosis
GGAGGAGGG

SEQ ID NO: 1541117 - protein, 48 aa, Mycobacterium tuberculosis; identical to SEQ ID NO: 229823

SEQ ID NO: 1541118 - protein, 36 aa, Mycobacterium tuberculosis; identical to SEQ ID NO: 229829

SEQ ID NO: 1541119 - protein, 27 aa, Mycobacterium tuberculosis
GGAGGTGGAVTGVSTTGGPGGHGGDAG

SEQ ID NO: 1541120 - protein, 20 aa, Mycobacterium tuberculosis
GGAPVAGADPQRYDGDVPGM

SEQ ID NO: 1541121 - protein, 18 aa, Mycobacterium tuberculosis
GGASLTASLGEASSVGGL

SEQ ID NO: 1541122 - protein, 10 aa, Mycobacterium tuberculosis
GGDATGAEVQ

SEQ ID NO: 1541123 - protein, 12 aa, Mycobacterium tuberculosis
GGFGGAGGGGAV

SEQ ID NO: 1541124 - protein, 22 aa, Mycobacterium tuberculosis
GGGAAGSGGDGGTGGQGGAGGA

SEQ ID NO: 1541125 - protein, 112 aa, Mycobacterium tuberculosis; identical to SEQ ID NO: 1444067

SEQ ID NO: 1541126 - protein, 8 aa, Mycobacterium tuberculosis
GGGGGNFG

SEQ ID NO: 1541127 - protein, 20 aa, Mycobacterium tuberculosis
GGGTNSSSSGAGGTSGSVHC

SEQ ID NO: 1541128 - protein, 37 aa, Mycobacterium tuberculosis; identical to SEQ ID NO: 192569

SEQ ID NO: 1541129 - protein, 13 aa, Mycobacterium tuberculosis
GGIGGAGGVGGHG

SEQ ID NO: 1541130 - protein, 9 aa, Mycobacterium tuberculosis
GGIGGTEAR

SEQ ID NO: 1541131 - protein, 20 aa, Mycobacterium tuberculosis
GGMGGSGGGIGAGTTTVVPP

SEQ ID NO: 1541132 - protein, 6 aa, Mycobacterium tuberculosis
GGSTIP

SEQ ID NO: 1541133 - protein, 7 aa, Mycobacterium tuberculosis
GGTLPGI

SEQ ID NO: 1541134 - protein, 24 aa, Mycobacterium tuberculosis
GGVGGAGGYGASGDGGNAGNGGLG

SEQ ID NO: 1541135 - protein, 24 aa, Mycobacterium tuberculosis
GGVGGSGGAGSSGGAGGAGGAGGL

SEQ ID NO: 1541136 - protein, 24 aa, Mycobacterium tuberculosis
GGVGGVGGLGAGAGGAGGVGGAGG

SEQ ID NO: 1541137 - protein, 9 aa, Mycobacterium tuberculosis
GHGGDGGNA

SEQ ID NO: 1541138 - protein, 12 aa, Mycobacterium tuberculosis
GHPDPSSGTIDA

SEQ ID NO: 1541139 - protein, 14 aa, Mycobacterium tuberculosis
GHTEPAERLRASTR

SEQ ID NO: 1541140 - protein, 5 aa, Mycobacterium tuberculosis
GHTPT

SEQ ID NO: 1541141 - protein, 5 aa, Mycobacterium tuberculosis
GIGGA

SEQ ID NO: 1541142 - protein, 15 aa, Mycobacterium tuberculosis
GIGPARLDKLRNLVR

SEQ ID NO: 1541143 - protein, 23 aa, Mycobacterium tuberculosis
GINGDGGTGGMGGQGGAGGNGWA

SEQ ID NO: 1541144 - protein, 7 aa, Mycobacterium tuberculosis
GINGTIP

SEQ ID NO: 1541145 - protein, 7 aa, Mycobacterium tuberculosis
GIPAAPG

SEQ ID NO: 1541146 - protein, 11 aa, Mycobacterium tuberculosis
GITADSDPDAE

SEQ ID NO: 1541147 - protein, 8 aa, Mycobacterium tuberculosis
GKGGVGGS

SEQ ID NO: 1541148 - protein, 10 aa, Mycobacterium tuberculosis
GKLNNKPDAA

SEQ ID NO: 1541149 - protein, 11 aa, Mycobacterium tuberculosis
GKPSDLGGNNL

SEQ ID NO: 1541150 - protein, 23 aa, Mycobacterium tuberculosis
GKVPNKAVSYEKGTGGNRSEYRV

SEQ ID NO: 1541151 - protein, 12 aa, Mycobacterium tuberculosis
GLGSGGAKGCPK

SEQ ID NO: 1541152 - protein, 38 aa, Mycobacterium tuberculosis; identical to SEQ ID NO: 192603

SEQ ID NO: 1541153 - protein, 20 aa, Mycobacterium tuberculosis
GNAGHGGAGGNGAAAGAGGE

SEQ ID NO: 1541154 - protein, 9 aa, Mycobacterium tuberculosis
GNAGSSNYG

SEQ ID NO: 1541155 - protein, 6 aa, Mycobacterium tuberculosis
GNAGSY

SEQ ID NO: 1541156 - protein, 17 aa, Mycobacterium tuberculosis
GNGADGTAANPNGGAGG

SEQ ID NO: 1541157 - protein, 18 aa, Mycobacterium tuberculosis
GNGANGAPGTGANGGDGG

SEQ ID NO: 1541158 - protein, 18 aa, Mycobacterium tuberculosis
GNGANGAPGTGANGGPGG

SEQ ID NO: 1541159 - protein, 18 aa, Mycobacterium tuberculosis
GNGANGQPGTGAPGGPAG

SEQ ID NO: 1541160 - protein, 31 aa, Mycobacterium tuberculosis; identical to SEQ ID NO: 229980

SEQ ID NO: 1541161 - protein, 33 aa, Mycobacterium tuberculosis; identical to SEQ ID NO: 1438215

SEQ ID NO: 1541162 - protein, 26 aa, Mycobacterium tuberculosis
GNGGDGGSVGAAPTGIGNGGNGGNGG

SEQ ID NO: 1541163 - protein, 23 aa, Mycobacterium tuberculosis
GNGGHGGAGGTGVPNGSGGAGGL

SEQ ID NO: 1541164 - protein, 7 aa, Mycobacterium tuberculosis
GNPNPPA

SEQ ID NO: 1541165 - protein, 8 aa, Mycobacterium tuberculosis
GPPTGGLT

SEQ ID NO: 1541166 - protein, 15 aa, Mycobacterium tuberculosis
GQAPRAAAGEPGRWS

SEQ ID NO: 1541167 - protein, 5 aa, Mycobacterium tuberculosis
GQARA

SEQ ID NO: 1541168 - protein, 14 aa, Mycobacterium tuberculosis
GQRTGVGLPGESAG

SEQ ID NO: 1541169 - protein, 7 aa, Mycobacterium tuberculosis
GQSTTPY

SEQ ID NO: 1541170 - protein, 10 aa, Mycobacterium tuberculosis
GQTRETKRAG

SEQ ID NO: 1541171 - protein, 29 aa, Mycobacterium tuberculosis
GQTSVTTIGADGHAQQALRAGQGATTMAA

SEQ ID NO: 1541172 - protein, 5 aa, Mycobacterium tuberculosis
GQTTI

SEQ ID NO: 1541173 - protein, 10 aa, Mycobacterium tuberculosis
GRGIPTGTCP

SEQ ID NO: 1541174 - protein, 5 aa, Mycobacterium tuberculosis
GRIAG

SEQ ID NO: 1541175 - protein, 4 aa, Mycobacterium tuberculosis
GRSV

SEQ ID NO: 1541176 - protein, 8 aa, Mycobacterium tuberculosis
GSGGARGY

SEQ ID NO: 1541177 - protein, 10 aa, Mycobacterium tuberculosis
GSQPLADDAE

SEQ ID NO: 1541178 - protein, 4 aa, Mycobacterium tuberculosis
GSTG

SEQ ID NO: 1541179 - protein, 102 aa, Mycobacterium tuberculosis; identical to SEQ ID NO: 1445064

SEQ ID NO: 1541180 - protein, 4 aa, Mycobacterium tuberculosis
GSVG

SEQ ID NO: 1541181 - protein, 15 aa, Mycobacterium tuberculosis
GSYNTGIGNSGIAST

SEQ ID NO: 1541182 - protein, 4 aa, Mycobacterium tuberculosis
GTAD

SEQ ID NO: 1541183 - protein, 10 aa, Mycobacterium tuberculosis
GTEDQPVAAE

SEQ ID NO: 1541184 - protein, 14 aa, Mycobacterium tuberculosis
GTFGTNGAGGTGGL

SEQ ID NO: 1541185 - protein, 11 aa, Mycobacterium tuberculosis
GTGEPPGVGGI

SEQ ID NO: 1541186 - protein, 44 aa, Mycobacterium tuberculosis; identical to SEQ ID NO: 230114

SEQ ID NO: 1541187 - protein, 52 aa, Mycobacterium tuberculosis; identical to SEQ ID NO: 1445117

SEQ ID NO: 1541188 - protein, 16 aa, Mycobacterium tuberculosis
GTGGKGGNGGNGGAGM

SEQ ID NO: 1541189 - protein, 9 aa, Mycobacterium tuberculosis
GTPDSSTGA

SEQ ID NO: 1541190 - protein, 10 aa, Mycobacterium tuberculosis
GTPDSSTGAW

SEQ ID NO: 1541191 - protein, 10 aa, Mycobacterium tuberculosis
GTQPTGTENH

SEQ ID NO: 1541192 - protein, 5 aa, Mycobacterium tuberculosis
GTTPN

SEQ ID NO: 1541193 - protein, 17 aa, Mycobacterium tuberculosis
GTWPSGTTVHANPDGTA

SEQ ID NO: 1541194 - protein, 26 aa, Mycobacterium tuberculosis
GTYGPGYHSDSTRTYSIGEPDSDVAQ

SEQ ID NO: 1541195 - protein, 32 aa, Mycobacterium tuberculosis; identical to SEQ ID NO: 1425621

SEQ ID NO: 1541196 - protein, 5 aa, Mycobacterium tuberculosis
GVGTV

SEQ ID NO: 1541197 - protein, 6 aa, Mycobacterium tuberculosis
GVPGVK

SEQ ID NO: 1541198 - protein, 25 aa, Mycobacterium tuberculosis
GVPPPPGDPVPPVDTHAGGRPADQL

SEQ ID NO: 1541199 - protein, 11 aa, Mycobacterium tuberculosis
GVTAEQVDAAA

SEQ ID NO: 1541200 - protein, 4 aa, Mycobacterium tuberculosis
GYPV

SEQ ID NO: 1541201 - protein, 14 aa, Mycobacterium tuberculosis
HDNPGVAPKDELRD

SEQ ID NO: 1541202 - protein, 8 aa, Mycobacterium tuberculosis
HGGDGGNA

SEQ ID NO: 1541203 - protein, 33 aa, Mycobacterium tuberculosis; identical to SEQ ID NO: 230179

SEQ ID NO: 1541204 - protein, 21 aa, Mycobacterium tuberculosis
HGGTGGVGGTGAAGGAGGTGG

SEQ ID NO: 1541205 - protein, 7 aa, Mycobacterium tuberculosis
HPADGTV

SEQ ID NO: 1541206 - protein, 5 aa, Mycobacterium tuberculosis
HPGDL

SEQ ID NO: 1541207 - protein, 7 aa, Mycobacterium tuberculosis
HRRPRPP

SEQ ID NO: 1541208 - protein, 9 aa, Mycobacterium tuberculosis
HSAPEVSNE

SEQ ID NO: 1541209 - protein, 9 aa, Mycobacterium tuberculosis
HTSAEQVGE

SEQ ID NO: 1541210 - protein, 12 aa, Mycobacterium tuberculosis
IDDDESAAATIE

SEQ ID NO: 1541211 - protein, 9 aa, Mycobacterium tuberculosis
IERDGRPAA

SEQ ID NO: 1541212 - protein, 30 aa, Mycobacterium tuberculosis; identical to SEQ ID NO: 230237

SEQ ID NO: 1541213 - protein, 23 aa, Mycobacterium tuberculosis
IGNGGAGGGGGAGAAGGNGGAGG

SEQ ID NO: 1541214 - protein, 27 aa, Mycobacterium tuberculosis
IGNGGDGGSVGAAPTGIGNGGNGGNGG

SEQ ID NO: 1541215 - protein, 27 aa, Mycobacterium tuberculosis
IGNGGNGGAAGVSGDGTPGTGGNGGYA

SEQ ID NO: 1541216 - protein, 23 aa, Mycobacterium tuberculosis
IGNGGNGGAGGTGAAGGAGGNGG

SEQ ID NO: 1541217 - protein, 19 aa, Mycobacterium tuberculosis
IGNGGNGGGGGNGGTGADG

SEQ ID NO: 1541218 - protein, 17 aa, Mycobacterium tuberculosis
IGNGGNGGNGGKGGTGL

SEQ ID NO: 1541219 - protein, 6 aa, Mycobacterium tuberculosis
IGTTAT

SEQ ID NO: 1541220 - protein, 22 aa, Mycobacterium tuberculosis
INGTGGAGGSRGQISGNPGTPG

SEQ ID NO: 1541221 - protein, 10 aa, Mycobacterium tuberculosis
IPAKREGSPR

SEQ ID NO: 1541222 - protein, 16 aa, Mycobacterium tuberculosis
IPDGAPLDAPRPMPPE

SEQ ID NO: 1541223 - protein, 4 aa, Mycobacterium tuberculosis
ISAR

SEQ ID NO: 1541224 - protein, 4 aa, Mycobacterium tuberculosis
ISDN

SEQ ID NO: 1541225 - protein, 5 aa, Mycobacterium tuberculosis
ISLDG

SEQ ID NO: 1541226 - protein, 6 aa, Mycobacterium tuberculosis
ITGPQI

SEQ ID NO: 1541227 - protein, 6 aa, Mycobacterium tuberculosis
IYRGDA

SEQ ID NO: 1541228 - protein, 8 aa, Mycobacterium tuberculosis
KAERPGRK

SEQ ID NO: 1541229 - protein, 6 aa, Mycobacterium tuberculosis
KDIRTT

SEQ ID NO: 1541230 - protein, 6 aa, Mycobacterium tuberculosis
KDNLGR

SEQ ID NO: 1541231 - protein, 8 aa, Mycobacterium tuberculosis
KDPSTPKI

SEQ ID NO: 1541232 - protein, 14 aa, Mycobacterium tuberculosis
KELHSSGSTAQENA

SEQ ID NO: 1541233 - protein, 6 aa, Mycobacterium tuberculosis
KETVQS

SEQ ID NO: 1541234 - protein, 14 aa, Mycobacterium tuberculosis
KNAGCPLGADPAKA

SEQ ID NO: 1541235 - protein, 6 aa, Mycobacterium tuberculosis
KNASAY

SEQ ID NO: 1541236 - protein, 15 aa, Mycobacterium tuberculosis
KPDCPSGAGNDERAA

SEQ ID NO: 1541237 - protein, 4 aa, Mycobacterium tuberculosis
KPID

SEQ ID NO: 1541238 - protein, 5 aa, Mycobacterium tuberculosis
KRGRR

SEQ ID NO: 1541239 - protein, 6 aa, Mycobacterium tuberculosis
KSDSIG

SEQ ID NO: 1541240 - protein, 4 aa, Mycobacterium tuberculosis
KVNK

SEQ ID NO: 1541241 - protein, 5 aa, Mycobacterium tuberculosis
LADTQ

SEQ ID NO: 1541242 - protein, 8 aa, Mycobacterium tuberculosis
LAGNSAKV

SEQ ID NO: 1541243 - protein, 10 aa, Mycobacterium tuberculosis
LAQSGPPAEA

SEQ ID NO: 1541244 - protein, 15 aa, Mycobacterium tuberculosis
LDAPPSALRASAKEV

SEQ ID NO: 1541245 - protein, 20 aa, Mycobacterium tuberculosis
LDATDTPPPAPATSGQTSLD

SEQ ID NO: 1541246 - protein, 21 aa, Mycobacterium tuberculosis
LGGAGGDAGDSGEGGFGGPGL

SEQ ID NO: 1541247 - protein, 11 aa, Mycobacterium tuberculosis
LGGGLGANSRH

SEQ ID NO: 1541248 - protein, 10 aa, Mycobacterium tuberculosis
LGLPTDPKKL

SEQ ID NO: 1541249 - protein, 68 aa, Mycobacterium tuberculosis; identical to SEQ ID NO: 1446471

SEQ ID NO: 1541250 - protein, 7 aa, Mycobacterium tuberculosis
LNGTKNI

SEQ ID NO: 1541251 - protein, 8 aa, Mycobacterium tuberculosis
LNPSPLGY

SEQ ID NO: 1541252 - protein, 8 aa, Mycobacterium tuberculosis
LNQQRDDI

SEQ ID NO: 1541253 - protein, 8 aa, Mycobacterium tuberculosis
LPAAPSAL

SEQ ID NO: 1541254 - protein, 98 aa, Mycobacterium tuberculosis; identical to SEQ ID NO: 194470

SEQ ID NO: 1541255 - protein, 14 aa, Mycobacterium tuberculosis
LPLPPNARRVEDPE

SEQ ID NO: 1541256 - protein, 15 aa, Mycobacterium tuberculosis
LPNPTAPALASGPAA

SEQ ID NO: 1541257 - protein, 19 aa, Mycobacterium tuberculosis
LPSETTVDPTQLSDVDRDR

SEQ ID NO: 1541258 - protein, 12 aa, Mycobacterium tuberculosis
LQATAQATQTTL

SEQ ID NO: 1541259 - protein, 11 aa, Mycobacterium tuberculosis
LQSGSQEDETA

SEQ ID NO: 1541260 - protein, 6 aa, Mycobacterium tuberculosis
LSDGTV

SEQ ID NO: 1541261 - protein, 7 aa, Mycobacterium tuberculosis
LSGAGPS

SEQ ID NO: 1541262 - protein, 7 aa, Mycobacterium tuberculosis
LSGGNDP

SEQ ID NO: 1541263 - protein, 5 aa, Mycobacterium tuberculosis
LSGHP

SEQ ID NO: 1541264 - protein, 45 aa, Mycobacterium tuberculosis
LSGNGGAGGNGGTGASGADGGGGLPPVPASPGGNGGGGGAGGAAG

SEQ ID NO: 1541265 - protein, 30 aa, Mycobacterium tuberculosis; identical to SEQ ID NO: 230478

SEQ ID NO: 1541266 - protein, 48 aa, Mycobacterium tuberculosis; identical to SEQ ID NO: 230479

SEQ ID NO: 1541267 - protein, 28 aa, Mycobacterium tuberculosis
LSGNGGDAGTGGGGGNAGNGGNGGSAGW

SEQ ID NO: 1541268 - protein, 11 aa, Mycobacterium tuberculosis
LSRSRRNHPRH

SEQ ID NO: 1541269 - protein, 21 aa, Mycobacterium tuberculosis
LTPAAPAAAAAPALTPSIPGV

SEQ ID NO: 1541270 - protein, 11 aa, Mycobacterium tuberculosis
LTRQANPKLPA

SEQ ID NO: 1541271 - protein, 11 aa, Mycobacterium tuberculosis
MAGGNGGAAGL

SEQ ID NO: 1541272 - protein, 4 aa, Mycobacterium tuberculosis
MNGP

SEQ ID NO: 1541273 - protein, 10 aa, Mycobacterium tuberculosis
MPQPPGYDTN

SEQ ID NO: 1541274 - protein, 10 aa, Mycobacterium tuberculosis
NAAPAGTPVR

SEQ ID NO: 1541275 - protein, 9 aa, Mycobacterium tuberculosis
NAPASTSPL

SEQ ID NO: 1541276 - protein, 7 aa, Mycobacterium tuberculosis
NASPVAQ

SEQ ID NO: 1541277 - protein, 11 aa, Mycobacterium tuberculosis
NAYETLAPAEQ

SEQ ID NO: 1541278 - protein, 17 aa, Mycobacterium tuberculosis
NDDTGSDGSTPQDRAHA

SEQ ID NO: 1541279 - protein, 17 aa, Mycobacterium tuberculosis
NGAGGGGGVGGNGATGP

SEQ ID NO: 1541280 - protein, 17 aa, Mycobacterium tuberculosis
NGANGAPGTGANGGDGG

SEQ ID NO: 1541281 - protein, 12 aa, Mycobacterium tuberculosis
NGGAGGAGGTSV

SEQ ID NO: 1541282 - protein, 24 aa, Mycobacterium tuberculosis
NGGAGGAGGVGGDGGKGGAGDPSF

SEQ ID NO: 1541283 - protein, 19 aa, Mycobacterium tuberculosis
NGGAGGAGNSGGDGGTGLN

SEQ ID NO: 1541284 - protein, 48 aa, Mycobacterium tuberculosis; identical to SEQ ID NO: 230559

SEQ ID NO: 1541285 - protein, 9 aa, Mycobacterium tuberculosis
NGGAGGIGG

SEQ ID NO: 1541286 - protein, 28 aa, Mycobacterium tuberculosis
NGGAGGPGGFGSPAGAGGIGGAGGNGGL

SEQ ID NO: 1541287 - protein, 38 aa, Mycobacterium tuberculosis; identical to SEQ ID NO: 230564

SEQ ID NO: 1541288 - protein, 34 aa, Mycobacterium tuberculosis; identical to SEQ ID NO: 230565

SEQ ID NO: 1541289 - protein, 50 aa, Mycobacterium tuberculosis; identical to SEQ ID NO: 1446982

SEQ ID NO: 1541290 - protein, 32 aa, Mycobacterium tuberculosis; identical to SEQ ID NO: 230568

SEQ ID NO: 1541291 - protein, 33 aa, Mycobacterium tuberculosis; identical to SEQ ID NO: 230570

SEQ ID NO: 1541292 - protein, 22 aa, Mycobacterium tuberculosis
NGGNGAAGGFGQTGGSGGAAGL

SEQ ID NO: 1541293 - protein, 74 aa, Mycobacterium tuberculosis; identical to SEQ ID NO: 1447038

SEQ ID NO: 1541294 - protein, 31 aa, Mycobacterium tuberculosis; identical to SEQ ID NO: 230577

SEQ ID NO: 1541295 - protein, 38 aa, Mycobacterium tuberculosis; identical to SEQ ID NO: 230578

SEQ ID NO: 1541296 - protein, 24 aa, Mycobacterium tuberculosis
NGGNGGQGTIGGVNGGAGGAGGAG

SEQ ID NO: 1541297 - protein, 20 aa, Mycobacterium tuberculosis
NGGNGGSGGIGAGKAGVGGV

SEQ ID NO: 1541298 - protein, 23 aa, Mycobacterium tuberculosis
NGGNGGSGGTGATLGKAGIGGTG

SEQ ID NO: 1541299 - protein, 22 aa, Mycobacterium tuberculosis
NGGNGGSGGVNQAGGNGGNAGL

SEQ ID NO: 1541300 - protein, 23 aa, Mycobacterium tuberculosis
NGGNGGTSTTAGVAGGNGGAAGL

SEQ ID NO: 1541301 - protein, 12 aa, Mycobacterium tuberculosis
NGGNGGTSTTVG

SEQ ID NO: 1541302 - protein, 20 aa, Mycobacterium tuberculosis
NGNIGLNGATGGIGSTTLTN

SEQ ID NO: 1541303 - protein, 5 aa, Mycobacterium tuberculosis
NGPLQ

SEQ ID NO: 1541304 - protein, 9 aa, Mycobacterium tuberculosis
NGRPDLETV

SEQ ID NO: 1541305 - protein, 16 aa, Mycobacterium tuberculosis
NGSEAGPARDAEPNVT

SEQ ID NO: 1541306 - protein, 24 aa, Mycobacterium tuberculosis
NIGTGNSGFNNSGDANSGFQNTNT

SEQ ID NO: 1541307 - protein, 16 aa, Mycobacterium tuberculosis
NLPPCPAAGNGPGAAA

SEQ ID NO: 1541308 - protein, 24 aa, Mycobacterium tuberculosis
NNGAGGNGGHGGNPGVGGAGGAGG

SEQ ID NO: 1541309 - protein, 5 aa, Mycobacterium tuberculosis
NPDTG

SEQ ID NO: 1541310 - protein, 4 aa, Mycobacterium tuberculosis
NPGF

SEQ ID NO: 1541311 - protein, 4 aa, Mycobacterium tuberculosis
NPGL

SEQ ID NO: 1541312 - protein, 4 aa, Mycobacterium tuberculosis
NPRY

SEQ ID NO: 1541313 - protein, 5 aa, Mycobacterium tuberculosis
NPSRP

SEQ ID NO: 1541314 - protein, 92 aa, Mycobacterium tuberculosis; identical to SEQ ID NO: 232278

SEQ ID NO: 1541315 - protein, 7 aa, Mycobacterium tuberculosis
NQPPARY

SEQ ID NO: 1541316 - protein, 6 aa, Mycobacterium tuberculosis
NRSQAA

SEQ ID NO: 1541317 - protein, 5 aa, Mycobacterium tuberculosis
NSDPF

SEQ ID NO: 1541318 - protein, 10 aa, Mycobacterium tuberculosis
NSGDGGGSGF

SEQ ID NO: 1541319 - protein, 4 aa, Mycobacterium tuberculosis
NTKA

SEQ ID NO: 1541320 - protein, 6 aa, Mycobacterium tuberculosis
NTLAGK

SEQ ID NO: 1541321 - protein, 5 aa, Mycobacterium tuberculosis
NTLTG

SEQ ID NO: 1541322 - protein, 12 aa, Mycobacterium tuberculosis
NVDGKGASYGSH

SEQ ID NO: 1541323 - protein, 5 aa, Mycobacterium tuberculosis
NYRGS

SEQ ID NO: 1541324 - protein, 9 aa, Mycobacterium tuberculosis
PAGSGGSVA

SEQ ID NO: 1541325 - protein, 4 aa, Mycobacterium tuberculosis
PAKT

SEQ ID NO: 1541326 - protein, 5 aa, Mycobacterium tuberculosis
PASVE

SEQ ID NO: 1541327 - protein, 8 aa, Mycobacterium tuberculosis
PATAQGIA

SEQ ID NO: 1541328 - protein, 7 aa, Mycobacterium tuberculosis
PATTDFP

SEQ ID NO: 1541329 - protein, 8 aa, Mycobacterium tuberculosis
PAVSKTES

SEQ ID NO: 1541330 - protein, 5 aa, Mycobacterium tuberculosis
PAYND

SEQ ID NO: 1541331 - protein, 13 aa, Mycobacterium tuberculosis
PDAGADGRPHRIP

SEQ ID NO: 1541332 - protein, 8 aa, Mycobacterium tuberculosis
PDGTDGGP

SEQ ID NO: 1541333 - protein, 5 aa, Mycobacterium tuberculosis
PDLSG

SEQ ID NO: 1541334 - protein, 54 aa, Mycobacterium tuberculosis
PDPNGTRFPNGAPPAAPPVREGTPKHPGPAVPPGTPCSYTPAAGALPRPDTPLP

SEQ ID NO: 1541335 - protein, 6 aa, Mycobacterium tuberculosis
PDTIDE

SEQ ID NO: 1541336 - protein, 8 aa, Mycobacterium tuberculosis
PDTQDTRA

SEQ ID NO: 1541337 - protein, 9 aa, Mycobacterium tuberculosis
PEDPTYDPT

SEQ ID NO: 1541338 - protein, 8 aa, Mycobacterium tuberculosis
PEGIPPTD

SEQ ID NO: 1541339 - protein, 8 aa, Mycobacterium tuberculosis
PEHPYPAG

SEQ ID NO: 1541340 - protein, 4 aa, Mycobacterium tuberculosis
PEQA

SEQ ID NO: 1541341 - protein, 15 aa, Mycobacterium tuberculosis
PFNTGFGNGGNTNFG

SEQ ID NO: 1541342 - protein, 34 aa, Mycobacterium tuberculosis; identical to SEQ ID NO: 1427059

SEQ ID NO: 1541343 - protein, 8 aa, Mycobacterium tuberculosis
PGGLRTSY

SEQ ID NO: 1541344 - protein, 6 aa, Mycobacterium tuberculosis
PGGSFN

SEQ ID NO: 1541345 - protein, 4 aa, Mycobacterium tuberculosis
PGHT

SEQ ID NO: 1541346 - protein, 23 aa, Mycobacterium tuberculosis
PGIGGNGGDTGNAGNGGNGGSAA

SEQ ID NO: 1541347 - protein, 5 aa, Mycobacterium tuberculosis
PGPTF

SEQ ID NO: 1541348 - protein, 5 aa, Mycobacterium tuberculosis
PGVVD

SEQ ID NO: 1541349 - protein, 13 aa, Mycobacterium tuberculosis
PITNPANRHAAER

SEQ ID NO: 1541350 - protein, 4 aa, Mycobacterium tuberculosis
PKAS

SEQ ID NO: 1541351 - protein, 7 aa, Mycobacterium tuberculosis
PLETNAT

SEQ ID NO: 1541352 - protein, 13 aa, Mycobacterium tuberculosis
PLSGQFDDDGAVS

SEQ ID NO: 1541353 - protein, 9 aa, Mycobacterium tuberculosis
PNNGFPGTS

SEQ ID NO: 1541354 - protein, 6 aa, Mycobacterium tuberculosis
PPEGFD

SEQ ID NO: 1541355 - protein, 25 aa, Mycobacterium tuberculosis
PPGKSREEIENDNAADFKRSEAAAE

SEQ ID NO: 1541356 - protein, 4 aa, Mycobacterium tuberculosis
PPQS

SEQ ID NO: 1541357 - protein, 11 aa, Mycobacterium tuberculosis
PPRRGRSKRHR

SEQ ID NO: 1541358 - protein, 17 aa, Mycobacterium tuberculosis
PPTPGFGNTTTTPSSGF

SEQ ID NO: 1541359 - protein, 11 aa, Mycobacterium tuberculosis
PPTPPPGTPGE

SEQ ID NO: 1541360 - protein, 12 aa, Mycobacterium tuberculosis
PSDQGSADISTS

SEQ ID NO: 1541361 - protein, 6 aa, Mycobacterium tuberculosis
PSTPAP

SEQ ID NO: 1541362 - protein, 12 aa, Mycobacterium tuberculosis
PTVQEVDGSDAA

SEQ ID NO: 1541363 - protein, 23 aa, Mycobacterium tuberculosis
PVGAPGSTAVPPLPPPVTPAISG

SEQ ID NO: 1541364 - protein, 13 aa, Mycobacterium tuberculosis
PVGDQFGEAGEGV

SEQ ID NO: 1541365 - protein, 9 aa, Mycobacterium tuberculosis
QAADPRSNL

SEQ ID NO: 1541366 - protein, 5 aa, Mycobacterium tuberculosis
QAELD

SEQ ID NO: 1541367 - protein, 5 aa, Mycobacterium tuberculosis
QAPGI

SEQ ID NO: 1541368 - protein, 13 aa, Mycobacterium tuberculosis
QDGTPVPACSRGT

SEQ ID NO: 1541369 - protein, 5 aa, Mycobacterium tuberculosis
QDLTG

SEQ ID NO: 1541370 - protein, 6 aa, Mycobacterium tuberculosis
QDLTGK

SEQ ID NO: 1541371 - protein, 4 aa, Mycobacterium tuberculosis
QDTP

SEQ ID NO: 1541372 - protein, 12 aa, Mycobacterium tuberculosis
QGQAYQAASAQA

SEQ ID NO: 1541373 - protein, 9 aa, Mycobacterium tuberculosis
QGRTTGNSC

SEQ ID NO: 1541374 - protein, 4 aa, Mycobacterium tuberculosis
QHGH

SEQ ID NO: 1541375 - protein, 33 aa, Mycobacterium tuberculosis; identical to SEQ ID NO: 232337

SEQ ID NO: 1541376 - protein, 8 aa, Mycobacterium tuberculosis
QPEPRDGL

SEQ ID NO: 1541377 - protein, 5 aa, Mycobacterium tuberculosis
QPVSG

SEQ ID NO: 1541378 - protein, 10 aa, Mycobacterium tuberculosis
QRAVKDANAA

SEQ ID NO: 1541379 - protein, 10 aa, Mycobacterium tuberculosis
QRRVPDDGPF

SEQ ID NO: 1541380 - protein, 9 aa, Mycobacterium tuberculosis
QRTPARAEQ

SEQ ID NO: 1541381 - protein, 12 aa, Mycobacterium tuberculosis
QRWPDDPTSHAY

SEQ ID NO: 1541382 - protein, 6 aa, Mycobacterium tuberculosis
QSTPSV

SEQ ID NO: 1541383 - protein, 17 aa, Mycobacterium tuberculosis
QSTRGEGSSTCNVAGIT

SEQ ID NO: 1541384 - protein, 5 aa, Mycobacterium tuberculosis
QTAQT

SEQ ID NO: 1541385 - protein, 8 aa, Mycobacterium tuberculosis
RAAASTDC

SEQ ID NO: 1541386 - protein, 7 aa, Mycobacterium tuberculosis
RARPTPW

SEQ ID NO: 1541387 - protein, 6 aa, Mycobacterium tuberculosis
RDPSLR

SEQ ID NO: 1541388 - protein, 8 aa, Mycobacterium tuberculosis
RDSRITPT

SEQ ID NO: 1541389 - protein, 8 aa, Mycobacterium tuberculosis
RELAEETG

SEQ ID NO: 1541390 - protein, 20 aa, Mycobacterium tuberculosis
RERIGEESPTPAISDLHDHD

SEQ ID NO: 1541391 - protein, 12 aa, Mycobacterium tuberculosis
RERRQPVTTRRS

SEQ ID NO: 1541392 - protein, 17 aa, Mycobacterium tuberculosis
RGEPERAPCGREPPPDL

SEQ ID NO: 1541393 - protein, 7 aa, Mycobacterium tuberculosis
RGRQGRR

SEQ ID NO: 1541394 - protein, 4 aa, Mycobacterium tuberculosis
RHRP

SEQ ID NO: 1541395 - protein, 11 aa, Mycobacterium tuberculosis
RLGTSPEKDVG

SEQ ID NO: 1541396 - protein, 5 aa, Mycobacterium tuberculosis
RNDGI

SEQ ID NO: 1541397 - protein, 14 aa, Mycobacterium tuberculosis
RNDGTPIPDQVDSV

SEQ ID NO: 1541398 - protein, 6 aa, Mycobacterium tuberculosis
RNGNEV

SEQ ID NO: 1541399 - protein, 5 aa, Mycobacterium tuberculosis
RNNRL

SEQ ID NO: 1541400 - protein, 20 aa, Mycobacterium tuberculosis
RPLATELDNRKAEVNNDIEQ

SEQ ID NO: 1541401 - protein, 5 aa, Mycobacterium tuberculosis
RPPPA

SEQ ID NO: 1541402 - protein, 15 aa, Mycobacterium tuberculosis
RQKYDPSRVMFSGLN

SEQ ID NO: 1541403 - protein, 5 aa, Mycobacterium tuberculosis
RRRHP

SEQ ID NO: 1541404 - protein, 9 aa, Mycobacterium tuberculosis
RSAGPPPVV

SEQ ID NO: 1541405 - protein, 5 aa, Mycobacterium tuberculosis
RSDTR

SEQ ID NO: 1541406 - protein, 10 aa, Mycobacterium tuberculosis
RSSKARGAWR

SEQ ID NO: 1541407 - protein, 9 aa, Mycobacterium tuberculosis
RTASASTTD

SEQ ID NO: 1541408 - protein, 6 aa, Mycobacterium tuberculosis
RTEADV

SEQ ID NO: 1541409 - protein, 5 aa, Mycobacterium tuberculosis
RTRAA

SEQ ID NO: 1541410 - protein, 16 aa, Mycobacterium tuberculosis
RYGPWNGPAMAVPLAR

SEQ ID NO: 1541411 - protein, 10 aa, Mycobacterium tuberculosis
SAAAGAGSGF

SEQ ID NO: 1541412 - protein, 13 aa, Mycobacterium tuberculosis
SAANAAAAAGTTG

SEQ ID NO: 1541413 - protein, 10 aa, Mycobacterium tuberculosis
SAARAAADAA

SEQ ID NO: 1541414 - protein, 5 aa, Mycobacterium tuberculosis
SAATD

SEQ ID NO: 1541415 - protein, 6 aa, Mycobacterium tuberculosis
SAATDL

SEQ ID NO: 1541416 - protein, 22 aa, Mycobacterium tuberculosis
SAATPSAGSEGAMGGAGGVGGN

SEQ ID NO: 1541417 - protein, 8 aa, Mycobacterium tuberculosis
SAEGRQKY

SEQ ID NO: 1541418 - protein, 11 aa, Mycobacterium tuberculosis
SAGQGGPSRTL

SEQ ID NO: 1541419 - protein, 9 aa, Mycobacterium tuberculosis
SANHGSPNV

SEQ ID NO: 1541420 - protein, 6 aa, Mycobacterium tuberculosis
SATTAF

SEQ ID NO: 1541421 - protein, 4 aa, Mycobacterium tuberculosis
SDGR

SEQ ID NO: 1541422 - protein, 4 aa, Mycobacterium tuberculosis
SDGW

SEQ ID NO: 1541423 - protein, 6 aa, Mycobacterium tuberculosis
SDHPRP

SEQ ID NO: 1541424 - protein, 8 aa, Mycobacterium tuberculosis
SDRDSVRE

SEQ ID NO: 1541425 - protein, 4 aa, Mycobacterium tuberculosis
SDTF

SEQ ID NO: 1541426 - protein, 5 aa, Mycobacterium tuberculosis
SEHPS

SEQ ID NO: 1541427 - protein, 8 aa, Mycobacterium tuberculosis
SEIGGSTR

SEQ ID NO: 1541428 - protein, 4 aa, Mycobacterium tuberculosis
SELS

SEQ ID NO: 1541429 - protein, 8 aa, Mycobacterium tuberculosis
SETPSSWD

SEQ ID NO: 1541430 - protein, 9 aa, Mycobacterium tuberculosis
SGDEADADI

SEQ ID NO: 1541431 - protein, 16 aa, Mycobacterium tuberculosis
SGDGNTGFGNAGDVNT

SEQ ID NO: 1541432 - protein, 43 aa, Mycobacterium tuberculosis; identical to SEQ ID NO: 231253

SEQ ID NO: 1541433 - protein, 33 aa, Mycobacterium tuberculosis
SGGAGGAGGAGGLNNAGGATGGTGGTGGAGGSG

SEQ ID NO: 1541434 - protein, 25 aa, Mycobacterium tuberculosis
SGGAGGSGGFSNSGNGGAGGAGGDA

SEQ ID NO: 1541435 - protein, 24 aa, Mycobacterium tuberculosis
SGGGPGGNGGVGGVGGVGGAGGRA

SEQ ID NO: 1541436 - protein, 7 aa, Mycobacterium tuberculosis
SGGNHGT

SEQ ID NO: 1541437 - protein, 10 aa, Mycobacterium tuberculosis
SGGSGGAGGF

SEQ ID NO: 1541438 - protein, 26 aa, Mycobacterium tuberculosis
SGIGGNTGSFNSGNLNTGFGNAGDLN

SEQ ID NO: 1541439 - protein, 18 aa, Mycobacterium tuberculosis
SGLAGRGRIPAHSARRRG

SEQ ID NO: 1541440 - protein, 7 aa, Mycobacterium tuberculosis
SGLPDHA

SEQ ID NO: 1541441 - protein, 44 aa, Mycobacterium tuberculosis
SGNGGAGGNGGTGASGADGGGGLPPVPASPGGNGGGGDAGGAAG

SEQ ID NO: 1541442 - protein, 50 aa, Mycobacterium tuberculosis; identical to SEQ ID NO: 194986

SEQ ID NO: 1541443 - protein, 5 aa, Mycobacterium tuberculosis
SGNGN

SEQ ID NO: 1541444 - protein, 18 aa, Mycobacterium tuberculosis
SGNIGNTNFGNGNQGNLN

SEQ ID NO: 1541445 - protein, 4 aa, Mycobacterium tuberculosis
SGNM

SEQ ID NO: 1541446 - protein, 5 aa, Mycobacterium tuberculosis
SGNNN

SEQ ID NO: 1541447 - protein, 19 aa, Mycobacterium tuberculosis
SGPHGADPHHGYSDRELRE

SEQ ID NO: 1541448 - protein, 13 aa, Mycobacterium tuberculosis
SGQAVTASATDHP

SEQ ID NO: 1541449 - protein, 6 aa, Mycobacterium tuberculosis
SGTAIT

SEQ ID NO: 1541450 - protein, 9 aa, Mycobacterium tuberculosis
SHSHSVSKA

SEQ ID NO: 1541451 - protein, 7 aa, Mycobacterium tuberculosis
SKIGEKS

SEQ ID NO: 1541452 - protein, 5 aa, Mycobacterium tuberculosis
SLPTI

SEQ ID NO: 1541453 - protein, 13 aa, Mycobacterium tuberculosis
SLSDGALRGPGEV

SEQ ID NO: 1541454 - protein, 8 aa, Mycobacterium tuberculosis
SNTTTNGA

SEQ ID NO: 1541455 - protein, 8 aa, Mycobacterium tuberculosis
SPAGVTTR

SEQ ID NO: 1541456 - protein, 6 aa, Mycobacterium tuberculosis
SPFGQG

SEQ ID NO: 1541457 - protein, 13 aa, Mycobacterium tuberculosis
SPRDRIPGTAAAY

SEQ ID NO: 1541458 - protein, 4 aa, Mycobacterium tuberculosis
SPSN

SEQ ID NO: 1541459 - protein, 4 aa, Mycobacterium tuberculosis
SQRY

SEQ ID NO: 1541460 - protein, 8 aa, Mycobacterium tuberculosis
SRGDDDTL

SEQ ID NO: 1541461 - protein, 14 aa, Mycobacterium tuberculosis
SRITEANTDRFPTT

SEQ ID NO: 1541462 - protein, 10 aa, Mycobacterium tuberculosis
SRQAEQTTEA

SEQ ID NO: 1541463 - protein, 12 aa, Mycobacterium tuberculosis
SRTDAHGNPLSA

SEQ ID NO: 1541464 - protein, 5 aa, Mycobacterium tuberculosis
SSAAR

SEQ ID NO: 1541465 - protein, 9 aa, Mycobacterium tuberculosis
SSANLGPGF

SEQ ID NO: 1541466 - protein, 7 aa, Mycobacterium tuberculosis
SSGKPVA

SEQ ID NO: 1541467 - protein, 4 aa, Mycobacterium tuberculosis
SSGL

SEQ ID NO: 1541468 - protein, 27 aa, Mycobacterium tuberculosis
SSGSKGGAGSGHAGKARSAVTTTDADW

SEQ ID NO: 1541469 - protein, 17 aa, Mycobacterium tuberculosis
SSIGAANAAAAGSTTSV

SEQ ID NO: 1541470 - protein, 15 aa, Mycobacterium tuberculosis
STLAQANAAALAPTT

SEQ ID NO: 1541471 - protein, 10 aa, Mycobacterium tuberculosis
STNSAQLHTD

SEQ ID NO: 1541472 - protein, 11 aa, Mycobacterium tuberculosis
SVGCSRQDVEN

SEQ ID NO: 1541473 - protein, 4 aa, Mycobacterium tuberculosis
SVPG

SEQ ID NO: 1541474 - protein, 64 aa, Mycobacterium tuberculosis; identical to SEQ ID NO: 154316

SEQ ID NO: 1541475 - protein, 6 aa, Mycobacterium tuberculosis
TAGGDL

SEQ ID NO: 1541476 - protein, 9 aa, Mycobacterium tuberculosis
TAPASTSPL

SEQ ID NO: 1541477 - protein, 4 aa, Mycobacterium tuberculosis
TAPR

SEQ ID NO: 1541478 - protein, 8 aa, Mycobacterium tuberculosis
TASASTTD

SEQ ID NO: 1541479 - protein, 28 aa, Mycobacterium tuberculosis
TDFAGSDVPLNPSTGQPDRAAERCGSPA

SEQ ID NO: 1541480 - protein, 4 aa, Mycobacterium tuberculosis
TDPA

SEQ ID NO: 1541481 - protein, 4 aa, Mycobacterium tuberculosis
TEQA

SEQ ID NO: 1541482 - protein, 14 aa, Mycobacterium tuberculosis
TFPQSAAADSTEDF

SEQ ID NO: 1541483 - protein, 15 aa, Mycobacterium tuberculosis
TGAGGTGGNGGTAGL

SEQ ID NO: 1541484 - protein, 42 aa, Mycobacterium tuberculosis; identical to SEQ ID NO: 1435761

SEQ ID NO: 1541485 - protein, 5 aa, Mycobacterium tuberculosis
TGEGR

SEQ ID NO: 1541486 - protein, 26 aa, Mycobacterium tuberculosis
TGGAGGAGGNGGNGGKAGFSPGPTNF

SEQ ID NO: 1541487 - protein, 23 aa, Mycobacterium tuberculosis
TGGTGGSGGPGATGLGGIGGAGG

SEQ ID NO: 1541488 - protein, 8 aa, Mycobacterium tuberculosis
TGKLNDGS

SEQ ID NO: 1541489 - protein, 13 aa, Mycobacterium tuberculosis
TGRADDVVRPTDV

SEQ ID NO: 1541490 - protein, 12 aa, Mycobacterium tuberculosis
TGSITKIYLRAT

SEQ ID NO: 1541491 - protein, 9 aa, Mycobacterium tuberculosis
TGTAGYAGG

SEQ ID NO: 1541492 - protein, 5 aa, Mycobacterium tuberculosis
THDPV

SEQ ID NO: 1541493 - protein, 12 aa, Mycobacterium tuberculosis
THVEQTAANCPQ

SEQ ID NO: 1541494 - protein, 6 aa, Mycobacterium tuberculosis
TNEGLR

SEQ ID NO: 1541495 - protein, 5 aa, Mycobacterium tuberculosis
TNNDK

SEQ ID NO: 1541496 - protein, 11 aa, Mycobacterium tuberculosis
TNSPLRDGEHA

SEQ ID NO: 1541497 - protein, 6 aa, Mycobacterium tuberculosis
TNTSMG

SEQ ID NO: 1541498 - protein, 15 aa, Mycobacterium tuberculosis
TPAAGERPESRRQAL

SEQ ID NO: 1541499 - protein, 8 aa, Mycobacterium tuberculosis
TPPITTPP

SEQ ID NO: 1541500 - protein, 4 aa, Mycobacterium tuberculosis
TPRP

SEQ ID NO: 1541501 - protein, 7 aa, Mycobacterium tuberculosis
TPSQTAN

SEQ ID NO: 1541502 - protein, 99 aa, Mycobacterium tuberculosis; identical to SEQ ID NO: 232468

SEQ ID NO: 1541503 - protein, 6 aa, Mycobacterium tuberculosis
TQPNTH

SEQ ID NO: 1541504 - protein, 11 aa, Mycobacterium tuberculosis
TRDEPHADADR

SEQ ID NO: 1541505 - protein, 5 aa, Mycobacterium tuberculosis
TSDGQ

SEQ ID NO: 1541506 - protein, 9 aa, Mycobacterium tuberculosis
TSLAGNGVD

SEQ ID NO: 1541507 - protein, 6 aa, Mycobacterium tuberculosis
TSQPAL

SEQ ID NO: 1541508 - protein, 9 aa, Mycobacterium tuberculosis
TSSSPGTLG

SEQ ID NO: 1541509 - protein, 9 aa, Mycobacterium tuberculosis
TTATNTPFV

SEQ ID NO: 1541510 - protein, 7 aa, Mycobacterium tuberculosis
TTATRDI

SEQ ID NO: 1541511 - protein, 4 aa, Mycobacterium tuberculosis
TTET

SEQ ID NO: 1541512 - protein, 11 aa, Mycobacterium tuberculosis
TTKITGTIPAS

SEQ ID NO: 1541513 - protein, 5 aa, Mycobacterium tuberculosis
TTRGP

SEQ ID NO: 1541514 - protein, 4 aa, Mycobacterium tuberculosis
TTSP

SEQ ID NO: 1541515 - protein, 6 aa, Mycobacterium tuberculosis
TTTGRA

SEQ ID NO: 1541516 - protein, 5 aa, Mycobacterium tuberculosis
TTTPY

SEQ ID NO: 1541517 - protein, 4 aa, Mycobacterium tuberculosis
TVDP

SEQ ID NO: 1541518 - protein, 7 aa, Mycobacterium tuberculosis
TVGPARA

SEQ ID NO: 1541519 - protein, 9 aa, Mycobacterium tuberculosis
TVTGGSANY

SEQ ID NO: 1541520 - protein, 8 aa, Mycobacterium tuberculosis
VAARGGNG

SEQ ID NO: 1541521 - protein, 14 aa, Mycobacterium tuberculosis
VAGGNGGAGGSAGL

SEQ ID NO: 1541522 - protein, 7 aa, Mycobacterium tuberculosis
VAGGSAD

SEQ ID NO: 1541523 - protein, 15 aa, Mycobacterium tuberculosis
VAPPASDTNDNGDFS

SEQ ID NO: 1541524 - protein, 4 aa, Mycobacterium tuberculosis
VATH

SEQ ID NO: 1541525 - protein, 12 aa, Mycobacterium tuberculosis
VDAPAESTEEEY

SEQ ID NO: 1541526 - protein, 10 aa, Mycobacterium tuberculosis
VDHTGRYRGR

SEQ ID NO: 1541527 - protein, 11 aa, Mycobacterium tuberculosis
VDHTGRYRGRA

SEQ ID NO: 1541528 - protein, 4 aa, Mycobacterium tuberculosis
VDPL

SEQ ID NO: 1541529 - protein, 11 aa, Mycobacterium tuberculosis
VDTPGPQALRD

SEQ ID NO: 1541530 - protein, 7 aa, Mycobacterium tuberculosis
VEPNDGH

SEQ ID NO: 1541531 - protein, 4 aa, Mycobacterium tuberculosis
VEQG

SEQ ID NO: 1541532 - protein, 11 aa, Mycobacterium tuberculosis
VGASGNNGTSA

SEQ ID NO: 1541533 - protein, 8 aa, Mycobacterium tuberculosis
VGCSRQDV

SEQ ID NO: 1541534 - protein, 10 aa, Mycobacterium tuberculosis
VGEGTRGAPT

SEQ ID NO: 1541535 - protein, 6 aa, Mycobacterium tuberculosis
VGGANN

SEQ ID NO: 1541536 - protein, 7 aa, Mycobacterium tuberculosis
VGGEPGS

SEQ ID NO: 1541537 - protein, 4 aa, Mycobacterium tuberculosis
VGGH

SEQ ID NO: 1541538 - protein, 14 aa, Mycobacterium tuberculosis
VGGTATAGAFSRPG

SEQ ID NO: 1541539 - protein, 74 aa, Mycobacterium tuberculosis; identical to SEQ ID NO: 232504

SEQ ID NO: 1541540 - protein, 8 aa, Mycobacterium tuberculosis
VGPTGKVK

SEQ ID NO: 1541541 - protein, 11 aa, Mycobacterium tuberculosis
VGTSPSGQTIP

SEQ ID NO: 1541542 - protein, 5 aa, Mycobacterium tuberculosis
VNDPD

SEQ ID NO: 1541543 - protein, 4 aa, Mycobacterium tuberculosis
VPAG

SEQ ID NO: 1541544 - protein, 23 aa, Mycobacterium tuberculosis
VPPPPGDPVPPVDTHAGGRPADQ

SEQ ID NO: 1541545 - protein, 19 aa, Mycobacterium tuberculosis
VPPSVPVKSADDKPVVTKS

SEQ ID NO: 1541546 - protein, 14 aa, Mycobacterium tuberculosis
VPSAAARSAGLSES

SEQ ID NO: 1541547 - protein, 7 aa, Mycobacterium tuberculosis
VPTQDAE

SEQ ID NO: 1541548 - protein, 4 aa, Mycobacterium tuberculosis
VPVP

SEQ ID NO: 1541549 - protein, 6 aa, Mycobacterium tuberculosis
VRPATP

SEQ ID NO: 1541550 - protein, 5 aa, Mycobacterium tuberculosis
VRSAE

SEQ ID NO: 1541551 - protein, 4 aa, Mycobacterium tuberculosis
VTAT

SEQ ID NO: 1541552 - protein, 19 aa, Mycobacterium tuberculosis
VTGSGRVGIGPSGDEPGFQ

SEQ ID NO: 1541553 - protein, 7 aa, Mycobacterium tuberculosis
VTRRGYG

SEQ ID NO: 1541554 - protein, 9 aa, Mycobacterium tuberculosis
VTSSPIKGT

SEQ ID NO: 1541555 - protein, 21 aa, Mycobacterium tuberculosis
VTYKNGDPTIDNLGAGNRINK

SEQ ID NO: 1541556 - protein, 7 aa, Mycobacterium tuberculosis
VYSPAGC

SEQ ID NO: 1541557 - protein, 6 aa, Mycobacterium tuberculosis
WASATS

SEQ ID NO: 1541558 - protein, 21 aa, Mycobacterium tuberculosis
WGGGGAGGVGGTGGGAGLGAQ

SEQ ID NO: 1541559 - protein, 11 aa, Mycobacterium tuberculosis
WGPKEDPAWQR

SEQ ID NO: 1541560 - protein, 35 aa, Mycobacterium tuberculosis; identical to SEQ ID NO: 231823

SEQ ID NO: 1541561 - protein, 8 aa, Mycobacterium tuberculosis
WNGGANDN

SEQ ID NO: 1541562 - protein, 4 aa, Mycobacterium tuberculosis
WNPM

SEQ ID NO: 1541563 - protein, 9 aa, Mycobacterium tuberculosis
YAVSGPGNV

SEQ ID NO: 1541564 - protein, 16 aa, Mycobacterium tuberculosis
YEGQSAVKTAKTIDQA

SEQ ID NO: 1541565 - protein, 4 aa, Mycobacterium tuberculosis
YEPL

SEQ ID NO: 1541566 - protein, 11 aa, Mycobacterium tuberculosis
YPTRAAAEATA

SEQ ID NO: 1541567 - protein, 6 aa, Mycobacterium tuberculosis
YRTGSV

SEQ ID NO: 1541568 - protein, 6 aa, Mycobacterium tuberculosis
YSGSQY

SEQ ID NO: 1541569 - protein, 4 aa, Mycobacterium tuberculosis
YSPE

SEQ ID NO: 1541570 - protein, 5 aa, Mycobacterium tuberculosis
AAAPY

SEQ ID NO: 1541571 - protein, 7 aa, Mycobacterium tuberculosis
AAASTVQ

SEQ ID NO: 1541572 - protein, 45 aa, Mycobacterium tuberculosis
AADATDTVAAGATTAASAAGAAVAAGRAGAGPTVAASRGGPGSAA

SEQ ID NO: 1541573 - protein, 19 aa, Mycobacterium tuberculosis
AADDDHDHDHDHGGEPTPL

SEQ ID NO: 1541574 - protein, 7 aa, Mycobacterium tuberculosis
AADPTAQ

SEQ ID NO: 1541575 - protein, 13 aa, Mycobacterium tuberculosis
AADTRCDGRSRGQ

SEQ ID NO: 1541576 - protein, 11 aa, Mycobacterium tuberculosis
AAGGAVDGADT

SEQ ID NO: 1541577 - protein, 17 aa, Mycobacterium tuberculosis
AAGTGVGPAAAGAARTA

SEQ ID NO: 1541578 - protein, 53 aa, Mycobacterium tuberculosis; identical to SEQ ID NO: 1439905

SEQ ID NO: 1541579 - protein, 53 aa, Mycobacterium tuberculosis; identical to SEQ ID NO: 167072

SEQ ID NO: 1541580 - protein, 7 aa, Mycobacterium tuberculosis
AAKAEPL

SEQ ID NO: 1541581 - protein, 8 aa, Mycobacterium tuberculosis
AALAEEGA

SEQ ID NO: 1541582 - protein, 7 aa, Mycobacterium tuberculosis
AALAPTT

SEQ ID NO: 1541583 - protein, 7 aa, Mycobacterium tuberculosis
AALTAAA

SEQ ID NO: 1541584 - protein, 6 aa, Mycobacterium tuberculosis
AAQGGD

SEQ ID NO: 1541585 - protein, 7 aa, Mycobacterium tuberculosis
AAQGNYA

SEQ ID NO: 1541586 - protein, 11 aa, Mycobacterium tuberculosis
AARAGGAAVQA

SEQ ID NO: 1541587 - protein, 8 aa, Mycobacterium tuberculosis
AATADAGL

SEQ ID NO: 1541588 - protein, 7 aa, Mycobacterium tuberculosis
AATARPV

SEQ ID NO: 1541589 - protein, 10 aa, Mycobacterium tuberculosis
ADAGFTAPAT

SEQ ID NO: 1541590 - protein, 9 aa, Mycobacterium tuberculosis
ADDPAAQVT

SEQ ID NO: 1541591 - protein, 7 aa, Mycobacterium tuberculosis
ADGEATV

SEQ ID NO: 1541592 - protein, 4 aa, Mycobacterium tuberculosis
ADGQ

SEQ ID NO: 1541593 - protein, 7 aa, Mycobacterium tuberculosis
ADGTPLA

SEQ ID NO: 1541594 - protein, 7 aa, Mycobacterium tuberculosis
ADPGIPA

SEQ ID NO: 1541595 - protein, 17 aa, Mycobacterium tuberculosis
ADRKRGACAGRGGSAPS

SEQ ID NO: 1541596 - protein, 4 aa, Mycobacterium tuberculosis
AELD

SEQ ID NO: 1541597 - protein, 4 aa, Mycobacterium tuberculosis
AETF

SEQ ID NO: 1541598 - protein, 15 aa, Mycobacterium tuberculosis
AGAGAYAGAEAANVE

SEQ ID NO: 1541599 - protein, 17 aa, Mycobacterium tuberculosis
AGALAGAGHRKSPKQGV

SEQ ID NO: 1541600 - protein, 9 aa, Mycobacterium tuberculosis
AGAPSTAGP

SEQ ID NO: 1541601 - protein, 9 aa, Mycobacterium tuberculosis
AGDSAGGNI

SEQ ID NO: 1541602 - protein, 13 aa, Mycobacterium tuberculosis
AGDYTTAAEDKPA

SEQ ID NO: 1541603 - protein, 8 aa, Mycobacterium tuberculosis
AGFDPSKP

SEQ ID NO: 1541604 - protein, 8 aa, Mycobacterium tuberculosis
AGFGGGGV

SEQ ID NO: 1541605 - protein, 436 aa, Mycobacterium tuberculosis
AGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGTGGTGGKGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGL

SEQ ID NO: 1541606 - protein, 74 aa, Mycobacterium tuberculosis; identical to SEQ ID NO: 228942

SEQ ID NO: 1541607 - protein, 103 aa, Mycobacterium tuberculosis; identical to SEQ ID NO: 228943

SEQ ID NO: 1541608 - protein, 5 aa, Mycobacterium tuberculosis
AGHTG

SEQ ID NO: 1541609 - protein, 5 aa, Mycobacterium tuberculosis
AGMTT

SEQ ID NO: 1541610 - protein, 6 aa, Mycobacterium tuberculosis
AGRVAT

SEQ ID NO: 1541611 - protein, 48 aa, Mycobacterium tuberculosis; identical to SEQ ID NO: 168538

SEQ ID NO: 1541612 - protein, 25 aa, Mycobacterium tuberculosis
AGTYGVTESLNSSAAASPLSGITGE

SEQ ID NO: 1541613 - protein, 9 aa, Mycobacterium tuberculosis
AHAGPPGPV

SEQ ID NO: 1541614 - protein, 10 aa, Mycobacterium tuberculosis
AHEDDSFDEE

SEQ ID NO: 1541615 - protein, 6 aa, Mycobacterium tuberculosis
AHTDRL

SEQ ID NO: 1541616 - protein, 14 aa, Mycobacterium tuberculosis
AKAEGRDTINGQNT

SEQ ID NO: 1541617 - protein, 12 aa, Mycobacterium tuberculosis
AKERLSSSTVTT

SEQ ID NO: 1541618 - protein, 7 aa, Mycobacterium tuberculosis
AKTDGNS

SEQ ID NO: 1541619 - protein, 9 aa, Mycobacterium tuberculosis
ALSKTGARY

SEQ ID NO: 1541620 - protein, 10 aa, Mycobacterium tuberculosis
ANAGSYNTGS

SEQ ID NO: 1541621 - protein, 17 aa, Mycobacterium tuberculosis
ANPPANTTSPTAGQSLD

SEQ ID NO: 1541622 - protein, 8 aa, Mycobacterium tuberculosis
ANTGTGNI

SEQ ID NO: 1541623 - protein, 7 aa, Mycobacterium tuberculosis
ANTGTNN

SEQ ID NO: 1541624 - protein, 7 aa, Mycobacterium tuberculosis
APGTQSQ

SEQ ID NO: 1541625 - protein, 12 aa, Mycobacterium tuberculosis
APPNPSKPNLDH

SEQ ID NO: 1541626 - protein, 29 aa, Mycobacterium tuberculosis
APTAGADPTGALPPMTSSGSGPVIGDGDA

SEQ ID NO: 1541627 - protein, 18 aa, Mycobacterium tuberculosis
ARGRIGEEAPLPAGARVD

SEQ ID NO: 1541628 - protein, 7 aa, Mycobacterium tuberculosis
ARPGTEI

SEQ ID NO: 1541629 - protein, 6 aa, Mycobacterium tuberculosis
ARQPPG

SEQ ID NO: 1541630 - protein, 6 aa, Mycobacterium tuberculosis
ASADPV

SEQ ID NO: 1541631 - protein, 30 aa, Mycobacterium tuberculosis; identical to SEQ ID NO: 1364990

SEQ ID NO: 1541632 - protein, 15 aa, Mycobacterium tuberculosis
ASQSDAPVGAPRQFR

SEQ ID NO: 1541633 - protein, 4 aa, Mycobacterium tuberculosis
ASRD

SEQ ID NO: 1541634 - protein, 7 aa, Mycobacterium tuberculosis
ATANPLA

SEQ ID NO: 1541635 - protein, 16 aa, Mycobacterium tuberculosis
ATATRRVNTIAELARR

SEQ ID NO: 1541636 - protein, 5 aa, Mycobacterium tuberculosis
ATEDR

SEQ ID NO: 1541637 - protein, 6 aa, Mycobacterium tuberculosis
AVAPTA

SEQ ID NO: 1541638 - protein, 8 aa, Mycobacterium tuberculosis
AVPGTDTM

SEQ ID NO: 1541639 - protein, 7 aa, Mycobacterium tuberculosis
AVPTASA

SEQ ID NO: 1541640 - protein, 6 aa, Mycobacterium tuberculosis
AVSTDD

SEQ ID NO: 1541641 - protein, 10 aa, Mycobacterium tuberculosis
CGQAQTVPRK

SEQ ID NO: 1541642 - protein, 11 aa, Mycobacterium tuberculosis
CNDQGDPPYQG

SEQ ID NO: 1541643 - protein, 5 aa, Mycobacterium tuberculosis
CPSAL

SEQ ID NO: 1541644 - protein, 5 aa, Mycobacterium tuberculosis
DADAE

SEQ ID NO: 1541645 - protein, 10 aa, Mycobacterium tuberculosis
DATDKDRTRV

SEQ ID NO: 1541646 - protein, 12 aa, Mycobacterium tuberculosis
DDFGDGPTTPMV

SEQ ID NO: 1541647 - protein, 14 aa, Mycobacterium tuberculosis
DDVGGTWRDNTYPG

SEQ ID NO: 1541648 - protein, 6 aa, Mycobacterium tuberculosis
DETGII

SEQ ID NO: 1541649 - protein, 4 aa, Mycobacterium tuberculosis
DEVG

SEQ ID NO: 1541650 - protein, 5 aa, Mycobacterium tuberculosis
DEYRP

SEQ ID NO: 1541651 - protein, 9 aa, Mycobacterium tuberculosis
DGAASGLRA

SEQ ID NO: 1541652 - protein, 7 aa, Mycobacterium tuberculosis
DGGTAAD

SEQ ID NO: 1541653 - protein, 5 aa, Mycobacterium tuberculosis
DGREL

SEQ ID NO: 1541654 - protein, 15 aa, Mycobacterium tuberculosis
DINTGVANSGDVNTG

SEQ ID NO: 1541655 - protein, 14 aa, Mycobacterium tuberculosis
DPVAARPAAQEARE

SEQ ID NO: 1541656 - protein, 4 aa, Mycobacterium tuberculosis
DQER

SEQ ID NO: 1541657 - protein, 14 aa, Mycobacterium tuberculosis
DQTNSVNSSAKYGE

SEQ ID NO: 1541658 - protein, 6 aa, Mycobacterium tuberculosis
DRDPRT

SEQ ID NO: 1541659 - protein, 5 aa, Mycobacterium tuberculosis
DRPED

SEQ ID NO: 1541660 - protein, 44 aa, Mycobacterium tuberculosis
DSPDPEAEPDVVGGKGGDGGKGGSGLGVGGAGGTGGAGGNGGAG

SEQ ID NO: 1541661 - protein, 10 aa, Mycobacterium tuberculosis
DTPAGPPGST

SEQ ID NO: 1541662 - protein, 5 aa, Mycobacterium tuberculosis
EADPD

SEQ ID NO: 1541663 - protein, 4 aa, Mycobacterium tuberculosis
EAST

SEQ ID NO: 1541664 - protein, 5 aa, Mycobacterium tuberculosis
EATHR

SEQ ID NO: 1541665 - protein, 5 aa, Mycobacterium tuberculosis
EESTV

SEQ ID NO: 1541666 - protein, 5 aa, Mycobacterium tuberculosis
EGAGG

SEQ ID NO: 1541667 - protein, 17 aa, Mycobacterium tuberculosis
EGGSRDVAPAAQLQRRR

SEQ ID NO: 1541668 - protein, 4 aa, Mycobacterium tuberculosis
EGPA

SEQ ID NO: 1541669 - protein, 14 aa, Mycobacterium tuberculosis
EGQSAVKTAKTIDQ

SEQ ID NO: 1541670 - protein, 4 aa, Mycobacterium tuberculosis
EGRG

SEQ ID NO: 1541671 - protein, 7 aa, Mycobacterium tuberculosis
ELDGKAG

SEQ ID NO: 1541672 - protein, 8 aa, Mycobacterium tuberculosis
ENRANVGG

SEQ ID NO: 1541673 - protein, 7 aa, Mycobacterium tuberculosis
ENTPDRT

SEQ ID NO: 1541674 - protein, 11 aa, Mycobacterium tuberculosis
ERDGRTDPFGQ

SEQ ID NO: 1541675 - protein, 8 aa, Mycobacterium tuberculosis
ERDYPTDK

SEQ ID NO: 1541676 - protein, 14 aa, Mycobacterium tuberculosis
ERGGYDAQGHGNSV

SEQ ID NO: 1541677 - protein, 18 aa, Mycobacterium tuberculosis
ESFGSGAVGPITTGSAVP

SEQ ID NO: 1541678 - protein, 16 aa, Mycobacterium tuberculosis
ESSISAANAAAAANTT

SEQ ID NO: 1541679 - protein, 4 aa, Mycobacterium tuberculosis
ETDR

SEQ ID NO: 1541680 - protein, 5 aa, Mycobacterium tuberculosis
ETEID

SEQ ID NO: 1541681 - protein, 13 aa, Mycobacterium tuberculosis
EWSHGTSSTAQPL

SEQ ID NO: 1541682 - protein, 16 aa, Mycobacterium tuberculosis
EYAPAKSITAYKPGQY

SEQ ID NO: 1541683 - protein, 9 aa, Mycobacterium tuberculosis
FANTGSNNI

SEQ ID NO: 1541684 - protein, 45 aa, Mycobacterium tuberculosis; identical to SEQ ID NO: 1426176

SEQ ID NO: 1541685 - protein, 8 aa, Mycobacterium tuberculosis
FGNTGTNN

SEQ ID NO: 1541686 - protein, 206 aa, Mycobacterium tuberculosis
FSNGSNGGTGGTGGVGGTGGDGGNAGTGAGDPGKGGTGGTGGTGGSGGAGGSGGANFNGGTGGTGGTGGTGGKGGMGGIAGDGGPGGDGGNAGVGGKGGTNGNGGSGGTGGTGGPGGSGGAPTGSGTGGKGGAGGDGGDGADGGAATGVGDGGDGGNGGNGGNGGTGVGSPGGLGGAGGTGGLGGAGAGGGADGDDGDDGQPGNNG

SEQ ID NO: 1541687 - protein, 15 aa, Mycobacterium tuberculosis
FTNTGFGNAGSGNFG

SEQ ID NO: 1541688 - protein, 15 aa, Mycobacterium tuberculosis
GAASAYASAKATNVE

SEQ ID NO: 1541689 - protein, 4 aa, Mycobacterium tuberculosis
GAAV

SEQ ID NO: 1541690 - protein, 57 aa, Mycobacterium tuberculosis; identical to SEQ ID NO: 229721

SEQ ID NO: 1541691 - protein, 25 aa, Mycobacterium tuberculosis
GAGGTGGAGGSLGPGAGGAGGNGGL

SEQ ID NO: 1541692 - protein, 4 aa, Mycobacterium tuberculosis
GALP

SEQ ID NO: 1541693 - protein, 5 aa, Mycobacterium tuberculosis
GCHPP

SEQ ID NO: 1541694 - protein, 9 aa, Mycobacterium tuberculosis
GDTNTGFGN

SEQ ID NO: 1541695 - protein, 36 aa, Mycobacterium tuberculosis; identical to SEQ ID NO: 1438087

SEQ ID NO: 1541696 - protein, 4 aa, Mycobacterium tuberculosis
GEKR

SEQ ID NO: 1541697 - protein, 4 aa, Mycobacterium tuberculosis
GENT

SEQ ID NO: 1541698 - protein, 8 aa, Mycobacterium tuberculosis
GEQAAAAA

SEQ ID NO: 1541699 - protein, 137 aa, Mycobacterium tuberculosis; identical to SEQ ID NO: 232089

SEQ ID NO: 1541700 - protein, 6 aa, Mycobacterium tuberculosis
GFDNAQ

SEQ ID NO: 1541701 - protein, 20 aa, Mycobacterium tuberculosis
GFGNNGDNNLGLGNNGNNNI

SEQ ID NO: 1541702 - protein, 43 aa, Mycobacterium tuberculosis; identical to SEQ ID NO: 229819

SEQ ID NO: 1541703 - protein, 9 aa, Mycobacterium tuberculosis
GGAGGAGGL

SEQ ID NO: 1541704 - protein, 23 aa, Mycobacterium tuberculosis
GGAGGGGGKGGNGAGGGLGGGSF

SEQ ID NO: 1541705 - protein, 23 aa, Mycobacterium tuberculosis
GGAGGHGASGGAGDRGGAGGTGF

SEQ ID NO: 1541706 - protein, 45 aa, Mycobacterium tuberculosis; identical to SEQ ID NO: 229828

SEQ ID NO: 1541707 - protein, 50 aa, Mycobacterium tuberculosis; identical to SEQ ID NO: 192562

SEQ ID NO: 1541708 - protein, 52 aa, Mycobacterium tuberculosis; identical to SEQ ID NO: 229830

SEQ ID NO: 1541709 - protein, 10 aa, Mycobacterium tuberculosis
GGASAAAAAL

SEQ ID NO: 1541710 - protein, 10 aa, Mycobacterium tuberculosis
GGASAAAAQL

SEQ ID NO: 1541711 - protein, 4 aa, Mycobacterium tuberculosis
GGEI

SEQ ID NO: 1541712 - protein, 4 aa, Mycobacterium tuberculosis
GGIE

SEQ ID NO: 1541713 - protein, 7 aa, Mycobacterium tuberculosis
GGIGGNH

SEQ ID NO: 1541714 - protein, 53 aa, Mycobacterium tuberculosis; identical to SEQ ID NO: 229863

SEQ ID NO: 1541715 - protein, 5 aa, Mycobacterium tuberculosis
GGSAG

SEQ ID NO: 1541716 - protein, 7 aa, Mycobacterium tuberculosis
GGSGTGI

SEQ ID NO: 1541717 - protein, 8 aa, Mycobacterium tuberculosis
GGSTGAGC

SEQ ID NO: 1541718 - protein, 5 aa, Mycobacterium tuberculosis
GHPGC

SEQ ID NO: 1541719 - protein, 11 aa, Mycobacterium tuberculosis
GIPVDDPDGYR

SEQ ID NO: 1541720 - protein, 5 aa, Mycobacterium tuberculosis
GISHS

SEQ ID NO: 1541721 - protein, 13 aa, Mycobacterium tuberculosis
GLAGGSGQAWQGA

SEQ ID NO: 1541722 - protein, 8 aa, Mycobacterium tuberculosis
GLAGIGGN

SEQ ID NO: 1541723 - protein, 6 aa, Mycobacterium tuberculosis
GLPATS

SEQ ID NO: 1541724 - protein, 6 aa, Mycobacterium tuberculosis
GLPPGM

SEQ ID NO: 1541725 - protein, 9 aa, Mycobacterium tuberculosis
GNAGNNNFG

SEQ ID NO: 1541726 - protein, 14 aa, Mycobacterium tuberculosis
GNAGNQSVGFGNAG

SEQ ID NO: 1541727 - protein, 26 aa, Mycobacterium tuberculosis
GNGGAGGAGGAGGAGGRGGDGGSAGW

SEQ ID NO: 1541728 - protein, 15 aa, Mycobacterium tuberculosis
GNGGAGGAGSAGTGV

SEQ ID NO: 1541729 - protein, 24 aa, Mycobacterium tuberculosis
GNGNFGSGNLGSGNTGSTNFGGGN

SEQ ID NO: 1541730 - protein, 4 aa, Mycobacterium tuberculosis
GNNN

SEQ ID NO: 1541731 - protein, 41 aa, Mycobacterium tuberculosis; identical to SEQ ID NO: 229990

SEQ ID NO: 1541732 - protein, 8 aa, Mycobacterium tuberculosis
GPAFPRAK

SEQ ID NO: 1541733 - protein, 5 aa, Mycobacterium tuberculosis
GQSVH

SEQ ID NO: 1541734 - protein, 12 aa, Mycobacterium tuberculosis
GRAAGRGAAEDI

SEQ ID NO: 1541735 - protein, 4 aa, Mycobacterium tuberculosis
GRDG

SEQ ID NO: 1541736 - protein, 5 aa, Mycobacterium tuberculosis
GRLGG

SEQ ID NO: 1541737 - protein, 23 aa, Mycobacterium tuberculosis
GRPLIGNGTNGAPGTGANGGDGG

SEQ ID NO: 1541738 - protein, 4 aa, Mycobacterium tuberculosis
GSAP

SEQ ID NO: 1541739 - protein, 4 aa, Mycobacterium tuberculosis
GSRE

SEQ ID NO: 1541740 - protein, 35 aa, Mycobacterium tuberculosis; identical to SEQ ID NO: 155272

SEQ ID NO: 1541741 - protein, 15 aa, Mycobacterium tuberculosis
GSTGEFKDKYGKSSA

SEQ ID NO: 1541742 - protein, 11 aa, Mycobacterium tuberculosis
GSVAGTGGNGG

SEQ ID NO: 1541743 - protein, 5 aa, Mycobacterium tuberculosis
GSVYR

SEQ ID NO: 1541744 - protein, 6 aa, Mycobacterium tuberculosis
GTAPIR

SEQ ID NO: 1541745 - protein, 10 aa, Mycobacterium tuberculosis
GTPRPAPRTT

SEQ ID NO: 1541746 - protein, 13 aa, Mycobacterium tuberculosis
GTRRAEAAAESAR

SEQ ID NO: 1541747 - protein, 5 aa, Mycobacterium tuberculosis
GVHER

SEQ ID NO: 1541748 - protein, 15 aa, Mycobacterium tuberculosis
GVSGGTEIRRSDAPR

SEQ ID NO: 1541749 - protein, 8 aa, Mycobacterium tuberculosis
HDRVDPSS

SEQ ID NO: 1541750 - protein, 8 aa, Mycobacterium tuberculosis
HEDPSGPV

SEQ ID NO: 1541751 - protein, 7 aa, Mycobacterium tuberculosis
HERAGSG

SEQ ID NO: 1541752 - protein, 5 aa, Mycobacterium tuberculosis
HNDPE

SEQ ID NO: 1541753 - protein, 12 aa, Mycobacterium tuberculosis
HPEYSAPECTDP

SEQ ID NO: 1541754 - protein, 6 aa, Mycobacterium tuberculosis
HPLTTS

SEQ ID NO: 1541755 - protein, 16 aa, Mycobacterium tuberculosis
HRDSDGPDHSRDYPGP

SEQ ID NO: 1541756 - protein, 4 aa, Mycobacterium tuberculosis
HSIT

SEQ ID NO: 1541757 - protein, 11 aa, Mycobacterium tuberculosis
IATERAGKPVQ

SEQ ID NO: 1541758 - protein, 5 aa, Mycobacterium tuberculosis
IDGDE

SEQ ID NO: 1541759 - protein, 6 aa, Mycobacterium tuberculosis
IGESTL

SEQ ID NO: 1541760 - protein, 21 aa, Mycobacterium tuberculosis
IGNGGAGGAGGPGAGGGTGGL

SEQ ID NO: 1541761 - protein, 4 aa, Mycobacterium tuberculosis
IGPS

SEQ ID NO: 1541762 - protein, 10 aa, Mycobacterium tuberculosis
IGTPPYAGRR

SEQ ID NO: 1541763 - protein, 10 aa, Mycobacterium tuberculosis
INTTRYNPDY

SEQ ID NO: 1541764 - protein, 11 aa, Mycobacterium tuberculosis
IRSQQSAYASH

SEQ ID NO: 1541765 - protein, 13 aa, Mycobacterium tuberculosis
ISSPSDPTANPIL

SEQ ID NO: 1541766 - protein, 14 aa, Mycobacterium tuberculosis
KAAEAAAPSSSFPS

SEQ ID NO: 1541767 - protein, 224 aa, Mycobacterium tuberculosis
KAGNGGAGGNGGNVGVAGQGGAGGKGAIPAMKGATGADGTAPTSGGDGGNGGNGASPTVAGGNGGDGGKGGSGGNVGNGGNGGAGGNGAAGQAGTPGPTSGDSGTSGTDGGAGGNGGAGGAGGTLAGHGGNGGKGGNGGQGGIGGAGERGADGAGPNANGANGENGGSGGNGGDGGAGGNGGAGGKAQAAGYTDGATGTGGDGGNGGDGGKAGDGGAGENGLNS

SEQ ID NO: 1541768 - protein, 4 aa, Mycobacterium tuberculosis
KKNT

SEQ ID NO: 1541769 - protein, 5 aa, Mycobacterium tuberculosis
KNPNW

SEQ ID NO: 1541770 - protein, 9 aa, Mycobacterium tuberculosis
KNSSAYPTV

SEQ ID NO: 1541771 - protein, 6 aa, Mycobacterium tuberculosis
KQSEFP

SEQ ID NO: 1541772 - protein, 5 aa, Mycobacterium tuberculosis
KRAAT

SEQ ID NO: 1541773 - protein, 5 aa, Mycobacterium tuberculosis
KSALR

SEQ ID NO: 1541774 - protein, 4 aa, Mycobacterium tuberculosis
KSGH

SEQ ID NO: 1541775 - protein, 9 aa, Mycobacterium tuberculosis
KSPPARARR

SEQ ID NO: 1541776 - protein, 9 aa, Mycobacterium tuberculosis
KYSKDGQIT

SEQ ID NO: 1541777 - protein, 6 aa, Mycobacterium tuberculosis
LAETST

SEQ ID NO: 1541778 - protein, 4 aa, Mycobacterium tuberculosis
LAGP

SEQ ID NO: 1541779 - protein, 12 aa, Mycobacterium tuberculosis
LAPGNADLSGLP

SEQ ID NO: 1541780 - protein, 6 aa, Mycobacterium tuberculosis
LATATD

SEQ ID NO: 1541781 - protein, 16 aa, Mycobacterium tuberculosis
LDGGPAAAGFGATSTV

SEQ ID NO: 1541782 - protein, 17 aa, Mycobacterium tuberculosis
LEPSDEPRGAPSSRKSV

SEQ ID NO: 1541783 - protein, 5 aa, Mycobacterium tuberculosis
LGDSD

SEQ ID NO: 1541784 - protein, 10 aa, Mycobacterium tuberculosis
LGEDMQQAPP

SEQ ID NO: 1541785 - protein, 6 aa, Mycobacterium tuberculosis
LGLPDD

SEQ ID NO: 1541786 - protein, 16 aa, Mycobacterium tuberculosis
LGQAANSFSSATAALA

SEQ ID NO: 1541787 - protein, 11 aa, Mycobacterium tuberculosis
LGSDAVAGSAQ

SEQ ID NO: 1541788 - protein, 28 aa, Mycobacterium tuberculosis
LKDPSYRLKTTTAEQIASRADPWDPGSV

SEQ ID NO: 1541789 - protein, 37 aa, Mycobacterium tuberculosis; identical to SEQ ID NO: 1424971

SEQ ID NO: 1541790 - protein, 4 aa, Mycobacterium tuberculosis
LPEV

SEQ ID NO: 1541791 - protein, 17 aa, Mycobacterium tuberculosis
LPGTGAFDPAGTSAIGS

SEQ ID NO: 1541792 - protein, 6 aa, Mycobacterium tuberculosis
LPREEW

SEQ ID NO: 1541793 - protein, 11 aa, Mycobacterium tuberculosis
LPTARGTASTV

SEQ ID NO: 1541794 - protein, 24 aa, Mycobacterium tuberculosis
LRGGNGAKVEELTESDKDLLPIGL

SEQ ID NO: 1541795 - protein, 7 aa, Mycobacterium tuberculosis
LSSEGRT

SEQ ID NO: 1541796 - protein, 9 aa, Mycobacterium tuberculosis
LTDPKAGPL

SEQ ID NO: 1541797 - protein, 11 aa, Mycobacterium tuberculosis
MGRPEYPTPVG

SEQ ID NO: 1541798 - protein, 8 aa, Mycobacterium tuberculosis
MSAPQTVS

SEQ ID NO: 1541799 - protein, 8 aa, Mycobacterium tuberculosis
NAATARPV

SEQ ID NO: 1541800 - protein, 15 aa, Mycobacterium tuberculosis
NAGNEDMGVGNGGSF

SEQ ID NO: 1541801 - protein, 8 aa, Mycobacterium tuberculosis
NALPGSIS

SEQ ID NO: 1541802 - protein, 4 aa, Mycobacterium tuberculosis
NEGL

SEQ ID NO: 1541803 - protein, 33 aa, Mycobacterium tuberculosis; identical to SEQ ID NO: 230555

SEQ ID NO: 1541804 - protein, 49 aa, Mycobacterium tuberculosis
NGGAGGQGATAGAGGAGANGVSSTNGGGTGGNGGIGGTGGSGGAGGNAG

SEQ ID NO: 1541805 - protein, 23 aa, Mycobacterium tuberculosis
NGGAGGSAAAGSGLPGGAGGAAG

SEQ ID NO: 1541806 - protein, 21 aa, Mycobacterium tuberculosis
NGGAGGSGAAGVNGGAGGNGG

SEQ ID NO: 1541807 - protein, 9 aa, Mycobacterium tuberculosis
NGGGPRGTD

SEQ ID NO: 1541808 - protein, 5 aa, Mycobacterium tuberculosis
NGSDM

SEQ ID NO: 1541809 - protein, 5 aa, Mycobacterium tuberculosis
NITTA

SEQ ID NO: 1541810 - protein, 58 aa, Mycobacterium tuberculosis; identical to SEQ ID NO: 1418809

SEQ ID NO: 1541811 - protein, 11 aa, Mycobacterium tuberculosis
NLGSGNRGFGN

SEQ ID NO: 1541812 - protein, 30 aa, Mycobacterium tuberculosis; identical to SEQ ID NO: 232273

SEQ ID NO: 1541813 - protein, 7 aa, Mycobacterium tuberculosis
NNQRGDL

SEQ ID NO: 1541814 - protein, 10 aa, Mycobacterium tuberculosis
NNRSGGGVRV

SEQ ID NO: 1541815 - protein, 8 aa, Mycobacterium tuberculosis
NPEEGELR

SEQ ID NO: 1541816 - protein, 6 aa, Mycobacterium tuberculosis
NPLNDS

SEQ ID NO: 1541817 - protein, 16 aa, Mycobacterium tuberculosis
NPPANTTSPTAGQSLD

SEQ ID NO: 1541818 - protein, 7 aa, Mycobacterium tuberculosis
NSGLTPG

SEQ ID NO: 1541819 - protein, 5 aa, Mycobacterium tuberculosis
NSGSH

SEQ ID NO: 1541820 - protein, 8 aa, Mycobacterium tuberculosis
NSSTAPLT

SEQ ID NO: 1541821 - protein, 30 aa, Mycobacterium tuberculosis; identical to SEQ ID NO: 230653

SEQ ID NO: 1541822 - protein, 7 aa, Mycobacterium tuberculosis
NVAPSPQ

SEQ ID NO: 1541823 - protein, 6 aa, Mycobacterium tuberculosis
NVPGAG

SEQ ID NO: 1541824 - protein, 6 aa, Mycobacterium tuberculosis
NVSTEI

SEQ ID NO: 1541825 - protein, 17 aa, Mycobacterium tuberculosis
PAAATAAVTPPALNTGL

SEQ ID NO: 1541826 - protein, 5 aa, Mycobacterium tuberculosis
PADGR

SEQ ID NO: 1541827 - protein, 4 aa, Mycobacterium tuberculosis
PAEV

SEQ ID NO: 1541828 - protein, 41 aa, Mycobacterium tuberculosis
PAGASNGLSAVGAGGALAAAATTSSGTTRTAGPALATGSTV

SEQ ID NO: 1541829 - protein, 12 aa, Mycobacterium tuberculosis
PAGGRAAHADPC

SEQ ID NO: 1541830 - protein, 7 aa, Mycobacterium tuberculosis
PASGANY

SEQ ID NO: 1541831 - protein, 9 aa, Mycobacterium tuberculosis
PASQDVPAD

SEQ ID NO: 1541832 - protein, 16 aa, Mycobacterium tuberculosis
PCSGDAANAPPPPSAI

SEQ ID NO: 1541833 - protein, 4 aa, Mycobacterium tuberculosis
PDGQ

SEQ ID NO: 1541834 - protein, 5 aa, Mycobacterium tuberculosis
PDPTE

SEQ ID NO: 1541835 - protein, 23 aa, Mycobacterium tuberculosis
PDWGPPPGEDPVTSTVASDRGAG

SEQ ID NO: 1541836 - protein, 12 aa, Mycobacterium tuberculosis
PEQVRTSRPDGA

SEQ ID NO: 1541837 - protein, 31 aa, Mycobacterium tuberculosis
PGGSATGGLRGGLTGSYSPPSSCLLNGQYPC

SEQ ID NO: 1541838 - protein, 17 aa, Mycobacterium tuberculosis
PGIGAPSWTADYGSETL

SEQ ID NO: 1541839 - protein, 10 aa, Mycobacterium tuberculosis
PGSDPIPRRS

SEQ ID NO: 1541840 - protein, 8 aa, Mycobacterium tuberculosis
PLRGSKAH

SEQ ID NO: 1541841 - protein, 17 aa, Mycobacterium tuberculosis
PMGYQQGTGPTAGVPGY

SEQ ID NO: 1541842 - protein, 29 aa, Mycobacterium tuberculosis
PNGTPAPKTPPATVPSSRNLATNPEIATG

SEQ ID NO: 1541843 - protein, 4 aa, Mycobacterium tuberculosis
PPEV

SEQ ID NO: 1541844 - protein, 5 aa, Mycobacterium tuberculosis
PPGIG

SEQ ID NO: 1541845 - protein, 10 aa, Mycobacterium tuberculosis
PSGRALESRP

SEQ ID NO: 1541846 - protein, 6 aa, Mycobacterium tuberculosis
PSSGGV

SEQ ID NO: 1541847 - protein, 10 aa, Mycobacterium tuberculosis
QAAVAQTGLT

SEQ ID NO: 1541848 - protein, 10 aa, Mycobacterium tuberculosis
QAYQTVSAQA

SEQ ID NO: 1541849 - protein, 14 aa, Mycobacterium tuberculosis
QIPKLAESAELRSV

SEQ ID NO: 1541850 - protein, 4 aa, Mycobacterium tuberculosis
QNTP

SEQ ID NO: 1541851 - protein, 8 aa, Mycobacterium tuberculosis
QPASGPRR

SEQ ID NO: 1541852 - protein, 4 aa, Mycobacterium tuberculosis
QSYG

SEQ ID NO: 1541853 - protein, 4 aa, Mycobacterium tuberculosis
QTIA

SEQ ID NO: 1541854 - protein, 15 aa, Mycobacterium tuberculosis
QTRAVADGKPLHSET

SEQ ID NO: 1541855 - protein, 12 aa, Mycobacterium tuberculosis
RAAETESDNPLI

SEQ ID NO: 1541856 - protein, 14 aa, Mycobacterium tuberculosis
RATTVTGSVTVESD

SEQ ID NO: 1541857 - protein, 28 aa, Mycobacterium tuberculosis
RCPPEGPSKGSSGGSSQGPPDGAAAGFG

SEQ ID NO: 1541858 - protein, 4 aa, Mycobacterium tuberculosis
RGGK

SEQ ID NO: 1541859 - protein, 6 aa, Mycobacterium tuberculosis
RHPETM

SEQ ID NO: 1541860 - protein, 14 aa, Mycobacterium tuberculosis
RKNGDDGKSEGSGV

SEQ ID NO: 1541861 - protein, 13 aa, Mycobacterium tuberculosis
RPGMSGDSSSWKG

SEQ ID NO: 1541862 - protein, 17 aa, Mycobacterium tuberculosis
RPPEVGVPSENPRLDEP

SEQ ID NO: 1541863 - protein, 5 aa, Mycobacterium tuberculosis
RPSTV

SEQ ID NO: 1541864 - protein, 14 aa, Mycobacterium tuberculosis
RPTAVEGDATPISQ

SEQ ID NO: 1541865 - protein, 10 aa, Mycobacterium tuberculosis
RQHGAQPASQ

SEQ ID NO: 1541866 - protein, 6 aa, Mycobacterium tuberculosis
RRRHPQ

SEQ ID NO: 1541867 - protein, 7 aa, Mycobacterium tuberculosis
RRYDGDE

SEQ ID NO: 1541868 - protein, 6 aa, Mycobacterium tuberculosis
RRYRGD

SEQ ID NO: 1541869 - protein, 14 aa, Mycobacterium tuberculosis
RTATPPGTETGAGH

SEQ ID NO: 1541870 - protein, 15 aa, Mycobacterium tuberculosis
RTATPPGTETGAGHG

SEQ ID NO: 1541871 - protein, 6 aa, Mycobacterium tuberculosis
RTGKLG

SEQ ID NO: 1541872 - protein, 11 aa, Mycobacterium tuberculosis
RTPTPAPTPPS

SEQ ID NO: 1541873 - protein, 4 aa, Mycobacterium tuberculosis
RTYP

SEQ ID NO: 1541874 - protein, 18 aa, Mycobacterium tuberculosis
RVGGPGSAAAAARAHDSS

SEQ ID NO: 1541875 - protein, 13 aa, Mycobacterium tuberculosis
SALTAGAAPGADA

SEQ ID NO: 1541876 - protein, 5 aa, Mycobacterium tuberculosis
SAQAA

SEQ ID NO: 1541877 - protein, 23 aa, Mycobacterium tuberculosis
SASSTISQGPAPREHRDGDTPEA

SEQ ID NO: 1541878 - protein, 7 aa, Mycobacterium tuberculosis
SDAGVDS

SEQ ID NO: 1541879 - protein, 7 aa, Mycobacterium tuberculosis
SDLAGIG

SEQ ID NO: 1541880 - protein, 22 aa, Mycobacterium tuberculosis
SDLAGIGSTLAQANAAALAPTT

SEQ ID NO: 1541881 - protein, 8 aa, Mycobacterium tuberculosis
SEGIKESV

SEQ ID NO: 1541882 - protein, 5 aa, Mycobacterium tuberculosis
SEPPG

SEQ ID NO: 1541883 - protein, 16 aa, Mycobacterium tuberculosis
SFNTGIGNGGTGSTGL

SEQ ID NO: 1541884 - protein, 10 aa, Mycobacterium tuberculosis
SFTENADAPI

SEQ ID NO: 1541885 - protein, 8 aa, Mycobacterium tuberculosis
SGAGGVSG

SEQ ID NO: 1541886 - protein, 9 aa, Mycobacterium tuberculosis
SGAGNVGQQ

SEQ ID NO: 1541887 - protein, 8 aa, Mycobacterium tuberculosis
SGAGTVGI

SEQ ID NO: 1541888 - protein, 5 aa, Mycobacterium tuberculosis
SGDGN

SEQ ID NO: 1541889 - protein, 56 aa, Mycobacterium tuberculosis; identical to SEQ ID NO: 231266

SEQ ID NO: 1541890 - protein, 8 aa, Mycobacterium tuberculosis
SGMQRQEA

SEQ ID NO: 1541891 - protein, 8 aa, Mycobacterium tuberculosis
SGNENHVH

SEQ ID NO: 1541892 - protein, 8 aa, Mycobacterium tuberculosis
SGNIGSSN

SEQ ID NO: 1541893 - protein, 12 aa, Mycobacterium tuberculosis
SGQEQNPDLTGR

SEQ ID NO: 1541894 - protein, 5 aa, Mycobacterium tuberculosis
SGTVV

SEQ ID NO: 1541895 - protein, 22 aa, Mycobacterium tuberculosis
SIPHSGEDSIPPNLFVSAQRAT

SEQ ID NO: 1541896 - protein, 17 aa, Mycobacterium tuberculosis
SMPTQETAPTRGIPSGL

SEQ ID NO: 1541897 - protein, 5 aa, Mycobacterium tuberculosis
SNEPT

SEQ ID NO: 1541898 - protein, 4 aa, Mycobacterium tuberculosis
SNGD

SEQ ID NO: 1541899 - protein, 8 aa, Mycobacterium tuberculosis
SNSGTGFN

SEQ ID NO: 1541900 - protein, 6 aa, Mycobacterium tuberculosis
SPEQRR

SEQ ID NO: 1541901 - protein, 4 aa, Mycobacterium tuberculosis
SPEV

SEQ ID NO: 1541902 - protein, 6 aa, Mycobacterium tuberculosis
SPLRDA

SEQ ID NO: 1541903 - protein, 8 aa, Mycobacterium tuberculosis
SPVAAAKT

SEQ ID NO: 1541904 - protein, 4 aa, Mycobacterium tuberculosis
SPVG

SEQ ID NO: 1541905 - protein, 5 aa, Mycobacterium tuberculosis
SRPGS

SEQ ID NO: 1541906 - protein, 6 aa, Mycobacterium tuberculosis
SRSTEF

SEQ ID NO: 1541907 - protein, 9 aa, Mycobacterium tuberculosis
SRTGTVGDY

SEQ ID NO: 1541908 - protein, 23 aa, Mycobacterium tuberculosis
SSDGGAGGDGGDGGNGGAGGTGG

SEQ ID NO: 1541909 - protein, 8 aa, Mycobacterium tuberculosis
SSGHTGRV

SEQ ID NO: 1541910 - protein, 9 aa, Mycobacterium tuberculosis
SSGPGPGSV

SEQ ID NO: 1541911 - protein, 15 aa, Mycobacterium tuberculosis
SSIAAANAAAAANTT

SEQ ID NO: 1541912 - protein, 6 aa, Mycobacterium tuberculosis
SSITSE

SEQ ID NO: 1541913 - protein, 19 aa, Mycobacterium tuberculosis
SSPAHADTDIGQPCSPEGA

SEQ ID NO: 1541914 - protein, 41 aa, Mycobacterium tuberculosis
SSTANPPAATTTPATATTTTATSGPTAAPTVTTGESTTASI

SEQ ID NO: 1541915 - protein, 16 aa, Mycobacterium tuberculosis
STGGATGSGSSGSSAM

SEQ ID NO: 1541916 - protein, 10 aa, Mycobacterium tuberculosis
SVNTDTAPLV

SEQ ID NO: 1541917 - protein, 6 aa, Mycobacterium tuberculosis
SVPGAA

SEQ ID NO: 1541918 - protein, 17 aa, Mycobacterium tuberculosis
SWDPDRDAPGSAEPGDR

SEQ ID NO: 1541919 - protein, 4 aa, Mycobacterium tuberculosis
TAAG

SEQ ID NO: 1541920 - protein, 16 aa, Mycobacterium tuberculosis
TAAQTKQTATQARAAA

SEQ ID NO: 1541921 - protein, 11 aa, Mycobacterium tuberculosis
TADAEEALGGA

SEQ ID NO: 1541922 - protein, 24 aa, Mycobacterium tuberculosis
TAGKGGTGGVGGDGGGGGAGGGGG

SEQ ID NO: 1541923 - protein, 13 aa, Mycobacterium tuberculosis
TALSPSSPIAQGS

SEQ ID NO: 1541924 - protein, 8 aa, Mycobacterium tuberculosis
TANAGSFN

SEQ ID NO: 1541925 - protein, 10 aa, Mycobacterium tuberculosis
TAPEGTPGEW

SEQ ID NO: 1541926 - protein, 5 aa, Mycobacterium tuberculosis
TAQSA

SEQ ID NO: 1541927 - protein, 5 aa, Mycobacterium tuberculosis
TARDR

SEQ ID NO: 1541928 - protein, 11 aa, Mycobacterium tuberculosis
TATGGRALPGS

SEQ ID NO: 1541929 - protein, 7 aa, Mycobacterium tuberculosis
TDLDPDL

SEQ ID NO: 1541930 - protein, 7 aa, Mycobacterium tuberculosis
TENAEQY

SEQ ID NO: 1541931 - protein, 8 aa, Mycobacterium tuberculosis
TGETCGTV

SEQ ID NO: 1541932 - protein, 9 aa, Mycobacterium tuberculosis
TGQNQPATG

SEQ ID NO: 1541933 - protein, 7 aa, Mycobacterium tuberculosis
TGSTETG

SEQ ID NO: 1541934 - protein, 5 aa, Mycobacterium tuberculosis
THGDT

SEQ ID NO: 1541935 - protein, 12 aa, Mycobacterium tuberculosis
TMEPKSAATEAY

SEQ ID NO: 1541936 - protein, 8 aa, Mycobacterium tuberculosis
TNAAAGSV

SEQ ID NO: 1541937 - protein, 8 aa, Mycobacterium tuberculosis
TNDKDTLG

SEQ ID NO: 1541938 - protein, 9 aa, Mycobacterium tuberculosis
TNGSETGRR

SEQ ID NO: 1541939 - protein, 6 aa, Mycobacterium tuberculosis
TPAPSF

SEQ ID NO: 1541940 - protein, 5 aa, Mycobacterium tuberculosis
TPDYE

SEQ ID NO: 1541941 - protein, 5 aa, Mycobacterium tuberculosis
TPESV

SEQ ID NO: 1541942 - protein, 17 aa, Mycobacterium tuberculosis
TRADGSIGLAPTAKEVT

SEQ ID NO: 1541943 - protein, 6 aa, Mycobacterium tuberculosis
TRRSGA

SEQ ID NO: 1541944 - protein, 10 aa, Mycobacterium tuberculosis
TSGSPSEATS

SEQ ID NO: 1541945 - protein, 7 aa, Mycobacterium tuberculosis
TSLPRGD

SEQ ID NO: 1541946 - protein, 25 aa, Mycobacterium tuberculosis
TSPAGIANADDAGLDPNAAAGPDAV

SEQ ID NO: 1541947 - protein, 16 aa, Mycobacterium tuberculosis
TSRSHRASTSRGQRET

SEQ ID NO: 1541948 - protein, 6 aa, Mycobacterium tuberculosis
TSYPKR

SEQ ID NO: 1541949 - protein, 5 aa, Mycobacterium tuberculosis
TYSPE

SEQ ID NO: 1541950 - protein, 4 aa, Mycobacterium tuberculosis
VAKG

SEQ ID NO: 1541951 - protein, 11 aa, Mycobacterium tuberculosis
VDDQSRARAAL

SEQ ID NO: 1541952 - protein, 7 aa, Mycobacterium tuberculosis
VEDPARQ

SEQ ID NO: 1541953 - protein, 6 aa, Mycobacterium tuberculosis
VEPAPT

SEQ ID NO: 1541954 - protein, 31 aa, Mycobacterium tuberculosis; identical to SEQ ID NO: 1439603

SEQ ID NO: 1541955 - protein, 13 aa, Mycobacterium tuberculosis
VGKGGGPDNKVDA

SEQ ID NO: 1541956 - protein, 6 aa, Mycobacterium tuberculosis
VQRESG

SEQ ID NO: 1541957 - protein, 6 aa, Mycobacterium tuberculosis
VQRPND

SEQ ID NO: 1541958 - protein, 23 aa, Mycobacterium tuberculosis
VSAGYGNNGDVQSGINNTNSGGF

SEQ ID NO: 1541959 - protein, 9 aa, Mycobacterium tuberculosis
VTDNSGRER

SEQ ID NO: 1541960 - protein, 4 aa, Mycobacterium tuberculosis
VTGV

SEQ ID NO: 1541961 - protein, 10 aa, Mycobacterium tuberculosis
VVTSSPIKGT

SEQ ID NO: 1541962 - protein, 8 aa, Mycobacterium tuberculosis
YGAEVSDT

SEQ ID NO: 1541963 - protein, 8 aa, Mycobacterium tuberculosis
YGDDGTRI

SEQ ID NO: 1541964 - protein, 20 aa, Mycobacterium tuberculosis
YGGNPGRPSEQGLAADARAA

SEQ ID NO: 1541965 - protein, 8 aa, Mycobacterium tuberculosis
YPSSNHAE

SEQ ID NO: 1541966 - protein, 10 aa, Mycobacterium tuberculosis
AAAADAGAKA

SEQ ID NO: 1541967 - protein, 9 aa, Mycobacterium tuberculosis
AAAAEPAKS

SEQ ID NO: 1541968 - protein, 19 aa, Mycobacterium tuberculosis
AAAARAAAVAGGAAGDACS

SEQ ID NO: 1541969 - protein, 9 aa, Mycobacterium tuberculosis
AAAGGTTAL

SEQ ID NO: 1541970 - protein, 8 aa, Mycobacterium tuberculosis
AAAPPTLP

SEQ ID NO: 1541971 - protein, 9 aa, Mycobacterium tuberculosis
AAARRERTQ

SEQ ID NO: 1541972 - protein, 13 aa, Mycobacterium tuberculosis
AAASAESAAGQAR

SEQ ID NO: 1541973 - protein, 12 aa, Mycobacterium tuberculosis
AADAAAAATTTG

SEQ ID NO: 1541974 - protein, 6 aa, Mycobacterium tuberculosis
AADPAV

SEQ ID NO: 1541975 - protein, 17 aa, Mycobacterium tuberculosis
AAEATGRGLAALKRALH

SEQ ID NO: 1541976 - protein, 7 aa, Mycobacterium tuberculosis
AAEQGMG

SEQ ID NO: 1541977 - protein, 9 aa, Mycobacterium tuberculosis
AAGGPTHAS

SEQ ID NO: 1541978 - protein, 16 aa, Mycobacterium tuberculosis
AAGPRRARSGAGTGLA

SEQ ID NO: 1541979 - protein, 27 aa, Mycobacterium tuberculosis
AAGSAERGIAAPASDPANRAIVVGASS

SEQ ID NO: 1541980 - protein, 35 aa, Mycobacterium tuberculosis
AAGTSGPAADAVDAATASTAGSTVAAGRAGSAMPA

SEQ ID NO: 1541981 - protein, 6 aa, Mycobacterium tuberculosis
AANAPQ

SEQ ID NO: 1541982 - protein, 7 aa, Mycobacterium tuberculosis
AANTPAQ

SEQ ID NO: 1541983 - protein, 11 aa, Mycobacterium tuberculosis
AAPAGRPGYLG

SEQ ID NO: 1541984 - protein, 16 aa, Mycobacterium tuberculosis
AAPASPTLAAGSAVPA

SEQ ID NO: 1541985 - protein, 6 aa, Mycobacterium tuberculosis
AAPEVP

SEQ ID NO: 1541986 - protein, 8 aa, Mycobacterium tuberculosis
AAPGQVDT

SEQ ID NO: 1541987 - protein, 13 aa, Mycobacterium tuberculosis
AAQNPTGPGSVAG

SEQ ID NO: 1541988 - protein, 15 aa, Mycobacterium tuberculosis
AAQPPSGDPGPVAPM

SEQ ID NO: 1541989 - protein, 10 aa, Mycobacterium tuberculosis
AASPNWNPGH

SEQ ID NO: 1541990 - protein, 7 aa, Mycobacterium tuberculosis
AATADAG

SEQ ID NO: 1541991 - protein, 11 aa, Mycobacterium tuberculosis
ADGTSWDPTEL

SEQ ID NO: 1541992 - protein, 6 aa, Mycobacterium tuberculosis
ADRAGR

SEQ ID NO: 1541993 - protein, 14 aa, Mycobacterium tuberculosis
ADRRRRGVDGYRGA

SEQ ID NO: 1541994 - protein, 6 aa, Mycobacterium tuberculosis
AEAMGN

SEQ ID NO: 1541995 - protein, 12 aa, Mycobacterium tuberculosis
AEANAAALAPTT

SEQ ID NO: 1541996 - protein, 27 aa, Mycobacterium tuberculosis
AEKAERHRHPDQAADQLAQSPGSLPGD

SEQ ID NO: 1541997 - protein, 10 aa, Mycobacterium tuberculosis
AESTAGPDAR

SEQ ID NO: 1541998 - protein, 13 aa, Mycobacterium tuberculosis
AGAALGQTVTLTL

SEQ ID NO: 1541999 - protein, 25 aa, Mycobacterium tuberculosis
AGAAVPGLAGGAGDRGAAGAATTAV

SEQ ID NO: 1542000 - protein, 21 aa, Mycobacterium tuberculosis
AGADPEPAPTPKTAIDSDGTY

SEQ ID NO: 1542001 - protein, 28 aa, Mycobacterium tuberculosis
AGAGGAGGSGANALGAGTGGTGGDGGHA

SEQ ID NO: 1542002 - protein, 14 aa, Mycobacterium tuberculosis
AGCAGDADGTSRAI

SEQ ID NO: 1542003 - protein, 8 aa, Mycobacterium tuberculosis
AGGDDVSA

SEQ ID NO: 1542004 - protein, 124 aa, Mycobacterium tuberculosis
AGHGGNGGNGGNGGNGSAGAGGQGGAGGSAGNGGHGGGATGGDGGNGGNGGNSGNSTGVAGLAGGAAGAGGNGGGTSSAAGHGGSGGSGGSGTTGGAGAAGGNGGAGAGGGSLSTGQSGGPRRQ

SEQ ID NO: 1542005 - protein, 18 aa, Mycobacterium tuberculosis
AGNINSSFGNSGDGNSGF

SEQ ID NO: 1542006 - protein, 7 aa, Mycobacterium tuberculosis
AGPTTAL

SEQ ID NO: 1542007 - protein, 11 aa, Mycobacterium tuberculosis
AGRGAGKYPTI

SEQ ID NO: 1542008 - protein, 31 aa, Mycobacterium tuberculosis; identical to SEQ ID NO: 1423388

SEQ ID NO: 1542009 - protein, 25 aa, Mycobacterium tuberculosis
AGSYNTGSFNAGQANTGGFNPGSVN

SEQ ID NO: 1542010 - protein, 4 aa, Mycobacterium tuberculosis
AGTA

SEQ ID NO: 1542011 - protein, 23 aa, Mycobacterium tuberculosis
AGTGGAGASTKAGGTGGTGGNGG

SEQ ID NO: 1542012 - protein, 25 aa, Mycobacterium tuberculosis
AGTGGHGAAGGVPAGVGGAGGNGGL

SEQ ID NO: 1542013 - protein, 22 aa, Mycobacterium tuberculosis
AGTVGADGTAVAARGTTGTGVS

SEQ ID NO: 1542014 - protein, 34 aa, Mycobacterium tuberculosis; identical to SEQ ID NO: 1425402

SEQ ID NO: 1542015 - protein, 6 aa, Mycobacterium tuberculosis
AHRTGA

SEQ ID NO: 1542016 - protein, 5 aa, Mycobacterium tuberculosis
AHTDR

SEQ ID NO: 1542017 - protein, 13 aa, Mycobacterium tuberculosis
AIGAANAAAGAPT

SEQ ID NO: 1542018 - protein, 13 aa, Mycobacterium tuberculosis
AKALSGELSRETL

SEQ ID NO: 1542019 - protein, 13 aa, Mycobacterium tuberculosis
AKKPEDRYASAGD

SEQ ID NO: 1542020 - protein, 8 aa, Mycobacterium tuberculosis
ALAGGADR

SEQ ID NO: 1542021 - protein, 8 aa, Mycobacterium tuberculosis
ALARPGTR

SEQ ID NO: 1542022 - protein, 5 aa, Mycobacterium tuberculosis
ALDAS

SEQ ID NO: 1542023 - protein, 13 aa, Mycobacterium tuberculosis
ALDRASSASRQRK

SEQ ID NO: 1542024 - protein, 4 aa, Mycobacterium tuberculosis
ALPA

SEQ ID NO: 1542025 - protein, 10 aa, Mycobacterium tuberculosis
ALPAPPRPTV

SEQ ID NO: 1542026 - protein, 10 aa, Mycobacterium tuberculosis
ALSDPDQDHA

SEQ ID NO: 1542027 - protein, 8 aa, Mycobacterium tuberculosis
AMQAGQGA

SEQ ID NO: 1542028 - protein, 11 aa, Mycobacterium tuberculosis
AMSDAQDSRVG

SEQ ID NO: 1542029 - protein, 6 aa, Mycobacterium tuberculosis
ANKGSL

SEQ ID NO: 1542030 - protein, 5 aa, Mycobacterium tuberculosis
ANRDG

SEQ ID NO: 1542031 - protein, 18 aa, Mycobacterium tuberculosis
ANTGSNNVGFGNTGSNNV

SEQ ID NO: 1542032 - protein, 18 aa, Mycobacterium tuberculosis
APAAPVGPAGTAAPAVPA

SEQ ID NO: 1542033 - protein, 8 aa, Mycobacterium tuberculosis
APAKLSDT

SEQ ID NO: 1542034 - protein, 12 aa, Mycobacterium tuberculosis
APALPDDLATAA

SEQ ID NO: 1542035 - protein, 31 aa, Mycobacterium tuberculosis; identical to SEQ ID NO: 1419815

SEQ ID NO: 1542036 - protein, 9 aa, Mycobacterium tuberculosis
APAVSKTES

SEQ ID NO: 1542037 - protein, 6 aa, Mycobacterium tuberculosis
APFGSP

SEQ ID NO: 1542038 - protein, 14 aa, Mycobacterium tuberculosis
APGFGNDTTAPSSG

SEQ ID NO: 1542039 - protein, 14 aa, Mycobacterium tuberculosis
APGTYSSAGPVGDG

SEQ ID NO: 1542040 - protein, 9 aa, Mycobacterium tuberculosis
APLPSGSTV

SEQ ID NO: 1542041 - protein, 10 aa, Mycobacterium tuberculosis
APPNSTRPNL

SEQ ID NO: 1542042 - protein, 11 aa, Mycobacterium tuberculosis
APTALGSGYGL

SEQ ID NO: 1542043 - protein, 6 aa, Mycobacterium tuberculosis
AQAHPK

SEQ ID NO: 1542044 - protein, 10 aa, Mycobacterium tuberculosis
AQATTRAGPY

SEQ ID NO: 1542045 - protein, 8 aa, Mycobacterium tuberculosis
AQGHTNTS

SEQ ID NO: 1542046 - protein, 5 aa, Mycobacterium tuberculosis
AQGYQ

SEQ ID NO: 1542047 - protein, 12 aa, Mycobacterium tuberculosis
AQPTAANDPIYA

SEQ ID NO: 1542048 - protein, 10 aa, Mycobacterium tuberculosis
AQRTRPDVSA

SEQ ID NO: 1542049 - protein, 4 aa, Mycobacterium tuberculosis
AQTP

SEQ ID NO: 1542050 - protein, 17 aa, Mycobacterium tuberculosis
ARAARQRGNEISGGASA

SEQ ID NO: 1542051 - protein, 9 aa, Mycobacterium tuberculosis
ARAGDVQAG

SEQ ID NO: 1542052 - protein, 31 aa, Mycobacterium tuberculosis
ARHRPTGATGSAGTARAAGLPRIASTAVAAT

SEQ ID NO: 1542053 - protein, 8 aa, Mycobacterium tuberculosis
ARNNTEAR

SEQ ID NO: 1542054 - protein, 47 aa, Mycobacterium tuberculosis; identical to SEQ ID NO: 1441358

SEQ ID NO: 1542055 - protein, 9 aa, Mycobacterium tuberculosis
ASAATARAT

SEQ ID NO: 1542056 - protein, 12 aa, Mycobacterium tuberculosis
ASAPQTTPAPPI

SEQ ID NO: 1542057 - protein, 25 aa, Mycobacterium tuberculosis
ASGGAGGSGGSSLTDGGGIGGVGGA

SEQ ID NO: 1542058 - protein, 8 aa, Mycobacterium tuberculosis
ASGGPNCR

SEQ ID NO: 1542059 - protein, 12 aa, Mycobacterium tuberculosis
ASGRGGQAADIA

SEQ ID NO: 1542060 - protein, 7 aa, Mycobacterium tuberculosis
ASKNSRL

SEQ ID NO: 1542061 - protein, 8 aa, Mycobacterium tuberculosis
ASPMGDAE

SEQ ID NO: 1542062 - protein, 9 aa, Mycobacterium tuberculosis
ASPNWNPGH

SEQ ID NO: 1542063 - protein, 9 aa, Mycobacterium tuberculosis
ATADPQTDT

SEQ ID NO: 1542064 - protein, 4 aa, Mycobacterium tuberculosis
ATDM

SEQ ID NO: 1542065 - protein, 17 aa, Mycobacterium tuberculosis
ATGAASPGRPTGTTAAA

SEQ ID NO: 1542066 - protein, 6 aa, Mycobacterium tuberculosis
ATGAVG

SEQ ID NO: 1542067 - protein, 9 aa, Mycobacterium tuberculosis
ATLKDGTEL

SEQ ID NO: 1542068 - protein, 8 aa, Mycobacterium tuberculosis
ATLTGASI

SEQ ID NO: 1542069 - protein, 12 aa, Mycobacterium tuberculosis
ATPKASRTTPEA

SEQ ID NO: 1542070 - protein, 4 aa, Mycobacterium tuberculosis
ATSD

SEQ ID NO: 1542071 - protein, 6 aa, Mycobacterium tuberculosis
ATTARE

SEQ ID NO: 1542072 - protein, 8 aa, Mycobacterium tuberculosis
AVETTRSR

SEQ ID NO: 1542073 - protein, 12 aa, Mycobacterium tuberculosis
AVGSSGGGGGTG

SEQ ID NO: 1542074 - protein, 5 aa, Mycobacterium tuberculosis
AVPGA

SEQ ID NO: 1542075 - protein, 22 aa, Mycobacterium tuberculosis
AVTSSTALRTSLDGGTDQYQPA

SEQ ID NO: 1542076 - protein, 10 aa, Mycobacterium tuberculosis
AWAESSTSHY

SEQ ID NO: 1542077 - protein, 11 aa, Mycobacterium tuberculosis
CAAGKRPAAPP

SEQ ID NO: 1542078 - protein, 24 aa, Mycobacterium tuberculosis
CGSTHQALGPPSGLPDASPNERSA

SEQ ID NO: 1542079 - protein, 25 aa, Mycobacterium tuberculosis
CNPPPQPAGSAPTNLGEQVSRTDMT

SEQ ID NO: 1542080 - protein, 6 aa, Mycobacterium tuberculosis
CPPTGL

SEQ ID NO: 1542081 - protein, 4 aa, Mycobacterium tuberculosis
CRTP

SEQ ID NO: 1542082 - protein, 28 aa, Mycobacterium tuberculosis
CSAGATSPTGATSPTVAASNGEPSEGTV

SEQ ID NO: 1542083 - protein, 12 aa, Mycobacterium tuberculosis
DAAPQLRDDPEA

SEQ ID NO: 1542084 - protein, 7 aa, Mycobacterium tuberculosis
DAPASEL

SEQ ID NO: 1542085 - protein, 10 aa, Mycobacterium tuberculosis
DAPGGGLGGS

SEQ ID NO: 1542086 - protein, 16 aa, Mycobacterium tuberculosis
DAPPGPCRASRSMPNS

SEQ ID NO: 1542087 - protein, 17 aa, Mycobacterium tuberculosis
DAPPGTCRASRSMPNSA

SEQ ID NO: 1542088 - protein, 8 aa, Mycobacterium tuberculosis
DARAQAGA

SEQ ID NO: 1542089 - protein, 7 aa, Mycobacterium tuberculosis
DDPDTSL

SEQ ID NO: 1542090 - protein, 6 aa, Mycobacterium tuberculosis
DDYPSS

SEQ ID NO: 1542091 - protein, 5 aa, Mycobacterium tuberculosis
DERGL

SEQ ID NO: 1542092 - protein, 5 aa, Mycobacterium tuberculosis
DERGV

SEQ ID NO: 1542093 - protein, 8 aa, Mycobacterium tuberculosis
DGAASGLR

SEQ ID NO: 1542094 - protein, 15 aa, Mycobacterium tuberculosis
DGANGGPGQPGGPGG

SEQ ID NO: 1542095 - protein, 17 aa, Mycobacterium tuberculosis
DGASQLRDASAAQRQQR

SEQ ID NO: 1542096 - protein, 33 aa, Mycobacterium tuberculosis
DGGNGGAGGAGGIGGDGATGGARGKRRQRWHRE

SEQ ID NO: 1542097 - protein, 22 aa, Mycobacterium tuberculosis
DGGPTPGSTGAGAAGGHGGDAQ

SEQ ID NO: 1542098 - protein, 4 aa, Mycobacterium tuberculosis
DGKA

SEQ ID NO: 1542099 - protein, 7 aa, Mycobacterium tuberculosis
DGLGGKF

SEQ ID NO: 1542100 - protein, 12 aa, Mycobacterium tuberculosis
DGPAQEKVYAGT

SEQ ID NO: 1542101 - protein, 12 aa, Mycobacterium tuberculosis
DGRARCTPTDAA

SEQ ID NO: 1542102 - protein, 6 aa, Mycobacterium tuberculosis
DGRLGG

SEQ ID NO: 1542103 - protein, 6 aa, Mycobacterium tuberculosis
DGTTLT

SEQ ID NO: 1542104 - protein, 4 aa, Mycobacterium tuberculosis
DLAG

SEQ ID NO: 1542105 - protein, 6 aa, Mycobacterium tuberculosis
DLATPE

SEQ ID NO: 1542106 - protein, 8 aa, Mycobacterium tuberculosis
DLEGKSDN

SEQ ID NO: 1542107 - protein, 15 aa, Mycobacterium tuberculosis
DPADSELDRRQAQRV

SEQ ID NO: 1542108 - protein, 5 aa, Mycobacterium tuberculosis
DRDGN

SEQ ID NO: 1542109 - protein, 10 aa, Mycobacterium tuberculosis
DRGGPALGET

SEQ ID NO: 1542110 - protein, 7 aa, Mycobacterium tuberculosis
DRVDPSS

SEQ ID NO: 1542111 - protein, 18 aa, Mycobacterium tuberculosis
DSDRYGGGQGNDLDGAAP

SEQ ID NO: 1542112 - protein, 5 aa, Mycobacterium tuberculosis
DSGYP

SEQ ID NO: 1542113 - protein, 6 aa, Mycobacterium tuberculosis
DSPNSA

SEQ ID NO: 1542114 - protein, 9 aa, Mycobacterium tuberculosis
DSQTHTSDA

SEQ ID NO: 1542115 - protein, 7 aa, Mycobacterium tuberculosis
DSRGQAY

SEQ ID NO: 1542116 - protein, 7 aa, Mycobacterium tuberculosis
DSWGPAT

SEQ ID NO: 1542117 - protein, 12 aa, Mycobacterium tuberculosis
DTATPSGPAAAE

SEQ ID NO: 1542118 - protein, 5 aa, Mycobacterium tuberculosis
DTEAQ

SEQ ID NO: 1542119 - protein, 15 aa, Mycobacterium tuberculosis
DTESTPTGGPVNSPD

SEQ ID NO: 1542120 - protein, 6 aa, Mycobacterium tuberculosis
DTGLDA

SEQ ID NO: 1542121 - protein, 8 aa, Mycobacterium tuberculosis
DTNGNNPA

SEQ ID NO: 1542122 - protein, 16 aa, Mycobacterium tuberculosis
DVNAKEAAMNEVCADG

SEQ ID NO: 1542123 - protein, 32 aa, Mycobacterium tuberculosis; identical to SEQ ID NO: 1415289

SEQ ID NO: 1542124 - protein, 9 aa, Mycobacterium tuberculosis
EAATAQSVQ

SEQ ID NO: 1542125 - protein, 9 aa, Mycobacterium tuberculosis
EAATKRRRG

SEQ ID NO: 1542126 - protein, 11 aa, Mycobacterium tuberculosis
EADSKATGPGV

SEQ ID NO: 1542127 - protein, 5 aa, Mycobacterium tuberculosis
EAEYE

SEQ ID NO: 1542128 - protein, 8 aa, Mycobacterium tuberculosis
EALGGDPQ

SEQ ID NO: 1542129 - protein, 8 aa, Mycobacterium tuberculosis
EANPKVAS

SEQ ID NO: 1542130 - protein, 9 aa, Mycobacterium tuberculosis
EARPPGKKI

SEQ ID NO: 1542131 - protein, 5 aa, Mycobacterium tuberculosis
ECRAG

SEQ ID NO: 1542132 - protein, 4 aa, Mycobacterium tuberculosis
ECTP

SEQ ID NO: 1542133 - protein, 4 aa, Mycobacterium tuberculosis
EEFY

SEQ ID NO: 1542134 - protein, 5 aa, Mycobacterium tuberculosis
EEQDI

SEQ ID NO: 1542135 - protein, 4 aa, Mycobacterium tuberculosis
EGAG

SEQ ID NO: 1542136 - protein, 8 aa, Mycobacterium tuberculosis
EGGPSRHH

SEQ ID NO: 1542137 - protein, 8 aa, Mycobacterium tuberculosis
EGPAYSEG

SEQ ID NO: 1542138 - protein, 5 aa, Mycobacterium tuberculosis
EGTMN

SEQ ID NO: 1542139 - protein, 8 aa, Mycobacterium tuberculosis
EHDPLRDD

SEQ ID NO: 1542140 - protein, 9 aa, Mycobacterium tuberculosis
EINGNGSRI

SEQ ID NO: 1542141 - protein, 8 aa, Mycobacterium tuberculosis
EINGSDMA

SEQ ID NO: 1542142 - protein, 7 aa, Mycobacterium tuberculosis
EKTGTMG

SEQ ID NO: 1542143 - protein, 17 aa, Mycobacterium tuberculosis
ELGQAANSFSSATAALA

SEQ ID NO: 1542144 - protein, 20 aa, Mycobacterium tuberculosis
ENRPSYSDTNLENSKPFNPK

SEQ ID NO: 1542145 - protein, 9 aa, Mycobacterium tuberculosis
EPAPASTSV

SEQ ID NO: 1542146 - protein, 27 aa, Mycobacterium tuberculosis
EPAQPAVSPPTSQDPAGAVRPLSGHPR

SEQ ID NO: 1542147 - protein, 6 aa, Mycobacterium tuberculosis
EPNDGH

SEQ ID NO: 1542148 - protein, 7 aa, Mycobacterium tuberculosis
EPTDKAF

SEQ ID NO: 1542149 - protein, 8 aa, Mycobacterium tuberculosis
EQGFNSGD

SEQ ID NO: 1542150 - protein, 8 aa, Mycobacterium tuberculosis
ERAFGAGP

SEQ ID NO: 1542151 - protein, 19 aa, Mycobacterium tuberculosis
ERIGEESPTPAISDLHDHD

SEQ ID NO: 1542152 - protein, 12 aa, Mycobacterium tuberculosis
ESLGGAADSDLG

SEQ ID NO: 1542153 - protein, 6 aa, Mycobacterium tuberculosis
ESRDVT

SEQ ID NO: 1542154 - protein, 15 aa, Mycobacterium tuberculosis
ETDPALDGRHRDAAR

SEQ ID NO: 1542155 - protein, 4 aa, Mycobacterium tuberculosis
ETEI

SEQ ID NO: 1542156 - protein, 6 aa, Mycobacterium tuberculosis
ETGAIK

SEQ ID NO: 1542157 - protein, 8 aa, Mycobacterium tuberculosis
ETLAPAEQ

SEQ ID NO: 1542158 - protein, 7 aa, Mycobacterium tuberculosis
ETQAPSI

SEQ ID NO: 1542159 - protein, 5 aa, Mycobacterium tuberculosis
ETSPD

SEQ ID NO: 1542160 - protein, 8 aa, Mycobacterium tuberculosis
EVSDPDAH

SEQ ID NO: 1542161 - protein, 4 aa, Mycobacterium tuberculosis
EYPP

SEQ ID NO: 1542162 - protein, 7 aa, Mycobacterium tuberculosis
FGDGAPV

SEQ ID NO: 1542163 - protein, 52 aa, Mycobacterium tuberculosis; identical to SEQ ID NO: 174380

SEQ ID NO: 1542164 - protein, 15 aa, Mycobacterium tuberculosis
FNTGIGNGGTGSTGL

SEQ ID NO: 1542165 - protein, 5 aa, Mycobacterium tuberculosis
FPGRT

SEQ ID NO: 1542166 - protein, 7 aa, Mycobacterium tuberculosis
FSGAKTA

SEQ ID NO: 1542167 - protein, 9 aa, Mycobacterium tuberculosis
GAAPTTDRR

SEQ ID NO: 1542168 - protein, 5 aa, Mycobacterium tuberculosis
GAAPV

SEQ ID NO: 1542169 - protein, 4 aa, Mycobacterium tuberculosis
GAES

SEQ ID NO: 1542170 - protein, 32 aa, Mycobacterium tuberculosis
GAGAGGSAGSAGSAGPAGPAGPACGAGGGGGG

SEQ ID NO: 1542171 - protein, 79 aa, Mycobacterium tuberculosis; identical to SEQ ID NO: 192510

SEQ ID NO: 1542172 - protein, 27 aa, Mycobacterium tuberculosis
GAGGTGGAAGSGGSGITTGGGGHGGNA

SEQ ID NO: 1542173 - protein, 7 aa, Mycobacterium tuberculosis
GAGPNCD

SEQ ID NO: 1542174 - protein, 7 aa, Mycobacterium tuberculosis
GAHTPAA

SEQ ID NO: 1542175 - protein, 5 aa, Mycobacterium tuberculosis
GAIGP

SEQ ID NO: 1542176 - protein, 19 aa, Mycobacterium tuberculosis
GALGAGAEGANKDKPVEKR

SEQ ID NO: 1542177 - protein, 15 aa, Mycobacterium tuberculosis
GANGTPGTGAAGGAG

SEQ ID NO: 1542178 - protein, 13 aa, Mycobacterium tuberculosis
GAPPYRADSAGTL

SEQ ID NO: 1542179 - protein, 26 aa, Mycobacterium tuberculosis
GASGGAGGSGGASSLAGGAGGTGGNG

SEQ ID NO: 1542180 - protein, 9 aa, Mycobacterium tuberculosis
GAWQGPSAA

SEQ ID NO: 1542181 - protein, 7 aa, Mycobacterium tuberculosis
GDAAATE

SEQ ID NO: 1542182 - protein, 14 aa, Mycobacterium tuberculosis
GDAPPEPGYAPSKA

SEQ ID NO: 1542183 - protein, 45 aa, Mycobacterium tuberculosis
GDGGNGYSQTTPGAVGGAGGSAGFIGNGGAGGAGGPGAGGGTGGL

SEQ ID NO: 1542184 - protein, 5 aa, Mycobacterium tuberculosis
GDGQI

SEQ ID NO: 1542185 - protein, 6 aa, Mycobacterium tuberculosis
GDGQIG

SEQ ID NO: 1542186 - protein, 18 aa, Mycobacterium tuberculosis
GDINTGFGNAGDTNTGFG

SEQ ID NO: 1542187 - protein, 5 aa, Mycobacterium tuberculosis
GDLDK

SEQ ID NO: 1542188 - protein, 15 aa, Mycobacterium tuberculosis
GERLNEQAATDTFGN

SEQ ID NO: 1542189 - protein, 36 aa, Mycobacterium tuberculosis; identical to SEQ ID NO: 175457

SEQ ID NO: 1542190 - protein, 26 aa, Mycobacterium tuberculosis
GGAGGAGGFGQSGAAGGAGGAGGAGG

SEQ ID NO: 1542191 - protein, 36 aa, Mycobacterium tuberculosis; identical to SEQ ID NO: 229824

SEQ ID NO: 1542192 - protein, 56 aa, Mycobacterium tuberculosis
GGAGGSGAAGVNGGAGGNGGAGGNGGAGGLIGNGGAGGAGGVASSGIGGSGGAGGN

SEQ ID NO: 1542193 - protein, 16 aa, Mycobacterium tuberculosis
GGEGHSGAIGGVGEQV

SEQ ID NO: 1542194 - protein, 6 aa, Mycobacterium tuberculosis
GGEKAL

SEQ ID NO: 1542195 - protein, 18 aa, Mycobacterium tuberculosis
GGGAGRGGGRAGAGRGGG

SEQ ID NO: 1542196 - protein, 9 aa, Mycobacterium tuberculosis
GGGANIPAV

SEQ ID NO: 1542197 - protein, 4 aa, Mycobacterium tuberculosis
GGGE

SEQ ID NO: 1542198 - protein, 10 aa, Mycobacterium tuberculosis
GGGNIGGNNV

SEQ ID NO: 1542199 - protein, 21 aa, Mycobacterium tuberculosis
GGGTNSSSSGAGGTSGSVHCG

SEQ ID NO: 1542200 - protein, 18 aa, Mycobacterium tuberculosis
GGSTNTGLANAGAGNTGF

SEQ ID NO: 1542201 - protein, 6 aa, Mycobacterium tuberculosis
GGTAAG

SEQ ID NO: 1542202 - protein, 25 aa, Mycobacterium tuberculosis
GGVGGVGGLGAGAGGAGGVGGAGGL

SEQ ID NO: 1542203 - protein, 12 aa, Mycobacterium tuberculosis
GHITGGTGSAIT

SEQ ID NO: 1542204 - protein, 6 aa, Mycobacterium tuberculosis
GHTPTV

SEQ ID NO: 1542205 - protein, 12 aa, Mycobacterium tuberculosis
GIPTDQRAGGRV

SEQ ID NO: 1542206 - protein, 10 aa, Mycobacterium tuberculosis
GIPVDDPDGY

SEQ ID NO: 1542207 - protein, 15 aa, Mycobacterium tuberculosis
GITDQNGDEPPRTSD

SEQ ID NO: 1542208 - protein, 9 aa, Mycobacterium tuberculosis
GKGRGTDHS

SEQ ID NO: 1542209 - protein, 7 aa, Mycobacterium tuberculosis
GKQALSA

SEQ ID NO: 1542210 - protein, 4 aa, Mycobacterium tuberculosis
GKRK

SEQ ID NO: 1542211 - protein, 12 aa, Mycobacterium tuberculosis
GKTVTVTNKAKT

SEQ ID NO: 1542212 - protein, 8 aa, Mycobacterium tuberculosis
GLAPMSPA

SEQ ID NO: 1542213 - protein, 10 aa, Mycobacterium tuberculosis
GLGGAGGAAG

SEQ ID NO: 1542214 - protein, 8 aa, Mycobacterium tuberculosis
GLRPGGQA

SEQ ID NO: 1542215 - protein, 5 aa, Mycobacterium tuberculosis
GMGPD

SEQ ID NO: 1542216 - protein, 8 aa, Mycobacterium tuberculosis
GNAGSGNV

SEQ ID NO: 1542217 - protein, 27 aa, Mycobacterium tuberculosis
GNGGAGGAGASNQAGNGGAGGNGGAGG

SEQ ID NO: 1542218 - protein, 117 aa, Mycobacterium tuberculosis; identical to SEQ ID NO: 232749

SEQ ID NO: 1542219 - protein, 8 aa, Mycobacterium tuberculosis
GNGGDGGC

SEQ ID NO: 1542220 - protein, 26 aa, Mycobacterium tuberculosis
GNGGDGGTGGTLIGNGGDGGNSVQTD

SEQ ID NO: 1542221 - protein, 39 aa, Mycobacterium tuberculosis; identical to SEQ ID NO: 232132

SEQ ID NO: 1542222 - protein, 23 aa, Mycobacterium tuberculosis
GNGGNGGSGGVNQAGGNGGNAGL

SEQ ID NO: 1542223 - protein, 6 aa, Mycobacterium tuberculosis
GNNNIG

SEQ ID NO: 1542224 - protein, 13 aa, Mycobacterium tuberculosis
GNNNVGSGNTGDY

SEQ ID NO: 1542225 - protein, 6 aa, Mycobacterium tuberculosis
GNPDGA

SEQ ID NO: 1542226 - protein, 34 aa, Mycobacterium tuberculosis; identical to SEQ ID NO: 1444573

SEQ ID NO: 1542227 - protein, 8 aa, Mycobacterium tuberculosis
GNTGTNNL

SEQ ID NO: 1542228 - protein, 5 aa, Mycobacterium tuberculosis
GNYSN

SEQ ID NO: 1542229 - protein, 4 aa, Mycobacterium tuberculosis
GPAT

SEQ ID NO: 1542230 - protein, 11 aa, Mycobacterium tuberculosis
GPLPSHPDEDD

SEQ ID NO: 1542231 - protein, 5 aa, Mycobacterium tuberculosis
GPSPT

SEQ ID NO: 1542232 - protein, 12 aa, Mycobacterium tuberculosis
GQANYAAAKAGI

SEQ ID NO: 1542233 - protein, 9 aa, Mycobacterium tuberculosis
GQLQTHDSA

SEQ ID NO: 1542234 - protein, 7 aa, Mycobacterium tuberculosis
GQPVSAP

SEQ ID NO: 1542235 - protein, 8 aa, Mycobacterium tuberculosis
GQPVSAPT

SEQ ID NO: 1542236 - protein, 5 aa, Mycobacterium tuberculosis
GQQYQ

SEQ ID NO: 1542237 - protein, 15 aa, Mycobacterium tuberculosis
GRGESPRVLPPRRSW

SEQ ID NO: 1542238 - protein, 19 aa, Mycobacterium tuberculosis
GRPATTRGVEGISCSPQMM

SEQ ID NO: 1542239 - protein, 10 aa, Mycobacterium tuberculosis
GRPEYPTPVG

SEQ ID NO: 1542240 - protein, 14 aa, Mycobacterium tuberculosis
GRPSAEDVDPDTEF

SEQ ID NO: 1542241 - protein, 7 aa, Mycobacterium tuberculosis
GRRITSP

SEQ ID NO: 1542242 - protein, 17 aa, Mycobacterium tuberculosis
GSCGDGGDGGNGAPGGV

SEQ ID NO: 1542243 - protein, 49 aa, Mycobacterium tuberculosis; identical to SEQ ID NO: 194248

SEQ ID NO: 1542244 - protein, 7 aa, Mycobacterium tuberculosis
GSPATRH

SEQ ID NO: 1542245 - protein, 7 aa, Mycobacterium tuberculosis
GSPPAAE

SEQ ID NO: 1542246 - protein, 7 aa, Mycobacterium tuberculosis
GSVPPTV

SEQ ID NO: 1542247 - protein, 6 aa, Mycobacterium tuberculosis
GTAKEI

SEQ ID NO: 1542248 - protein, 9 aa, Mycobacterium tuberculosis
GTARREAVA

SEQ ID NO: 1542249 - protein, 5 aa, Mycobacterium tuberculosis
GTGAH

SEQ ID NO: 1542250 - protein, 6 aa, Mycobacterium tuberculosis
GTGSTG

SEQ ID NO: 1542251 - protein, 11 aa, Mycobacterium tuberculosis
GTVTNTGDRPV

SEQ ID NO: 1542252 - protein, 13 aa, Mycobacterium tuberculosis
GVATRGARSPRLR

SEQ ID NO: 1542253 - protein, 20 aa, Mycobacterium tuberculosis
GVGTGAPGRRSRARNASGSV

SEQ ID NO: 1542254 - protein, 9 aa, Mycobacterium tuberculosis
GVPPPPGSW

SEQ ID NO: 1542255 - protein, 14 aa, Mycobacterium tuberculosis
GVSGGTEIRRSNAP

SEQ ID NO: 1542256 - protein, 11 aa, Mycobacterium tuberculosis
HDNPGVAPKDE

SEQ ID NO: 1542257 - protein, 7 aa, Mycobacterium tuberculosis
HGGISGR

SEQ ID NO: 1542258 - protein, 25 aa, Mycobacterium tuberculosis
HGGTGGAVTGVSTTGGPGGHGGDAG

SEQ ID NO: 1542259 - protein, 8 aa, Mycobacterium tuberculosis
HIGDSRTC

SEQ ID NO: 1542260 - protein, 5 aa, Mycobacterium tuberculosis
HIGPS

SEQ ID NO: 1542261 - protein, 7 aa, Mycobacterium tuberculosis
HKPNGSH

SEQ ID NO: 1542262 - protein, 4 aa, Mycobacterium tuberculosis
HPDP

SEQ ID NO: 1542263 - protein, 8 aa, Mycobacterium tuberculosis
HPGVGSAS

SEQ ID NO: 1542264 - protein, 14 aa, Mycobacterium tuberculosis
HPMTGTAHSGWTAG

SEQ ID NO: 1542265 - protein, 10 aa, Mycobacterium tuberculosis
HQGESAAAFQ

SEQ ID NO: 1542266 - protein, 11 aa, Mycobacterium tuberculosis
HQPSSEHTQPA

SEQ ID NO: 1542267 - protein, 11 aa, Mycobacterium tuberculosis
HRPPRKPADRH

SEQ ID NO: 1542268 - protein, 19 aa, Mycobacterium tuberculosis
HSAGSSNPWDDSAHPLTDD

SEQ ID NO: 1542269 - protein, 20 aa, Mycobacterium tuberculosis
HSAGSSNPWDDSAHPLTDDQ

SEQ ID NO: 1542270 - protein, 9 aa, Mycobacterium tuberculosis
HSGAPRGSA

SEQ ID NO: 1542271 - protein, 8 aa, Mycobacterium tuberculosis
HTSAEQVG

SEQ ID NO: 1542272 - protein, 8 aa, Mycobacterium tuberculosis
IDGDPTKV

SEQ ID NO: 1542273 - protein, 5 aa, Mycobacterium tuberculosis
IDGPT

SEQ ID NO: 1542274 - protein, 6 aa, Mycobacterium tuberculosis
IDIPSD

SEQ ID NO: 1542275 - protein, 11 aa, Mycobacterium tuberculosis
IGGAGGRGGDA

SEQ ID NO: 1542276 - protein, 5 aa, Mycobacterium tuberculosis
IGGGF

SEQ ID NO: 1542277 - protein, 35 aa, Mycobacterium tuberculosis
IGTGAGTTPGTAGASGAGEAGVPPTPGEVPGRGTT

SEQ ID NO: 1542278 - protein, 7 aa, Mycobacterium tuberculosis
INGSDMA

SEQ ID NO: 1542279 - protein, 13 aa, Mycobacterium tuberculosis
IPGTDPGVPTPSQ

SEQ ID NO: 1542280 - protein, 6 aa, Mycobacterium tuberculosis
IPPGNL

SEQ ID NO: 1542281 - protein, 11 aa, Mycobacterium tuberculosis
IPQPSAIRPGI

SEQ ID NO: 1542282 - protein, 8 aa, Mycobacterium tuberculosis
IQPLPPKR

SEQ ID NO: 1542283 - protein, 5 aa, Mycobacterium tuberculosis
IQPNT

SEQ ID NO: 1542284 - protein, 8 aa, Mycobacterium tuberculosis
ISQRATAD

SEQ ID NO: 1542285 - protein, 4 aa, Mycobacterium tuberculosis
ITAP

SEQ ID NO: 1542286 - protein, 7 aa, Mycobacterium tuberculosis
KAAGDDY

SEQ ID NO: 1542287 - protein, 9 aa, Mycobacterium tuberculosis
KAAPGGDRE

SEQ ID NO: 1542288 - protein, 11 aa, Mycobacterium tuberculosis
KAGGDTSTLGV

SEQ ID NO: 1542289 - protein, 10 aa, Mycobacterium tuberculosis
KAKDAEGGSV

SEQ ID NO: 1542290 - protein, 6 aa, Mycobacterium tuberculosis
KATGDP

SEQ ID NO: 1542291 - protein, 12 aa, Mycobacterium tuberculosis
KESGLRASAKGY

SEQ ID NO: 1542292 - protein, 7 aa, Mycobacterium tuberculosis
KGSPPTI

SEQ ID NO: 1542293 - protein, 12 aa, Mycobacterium tuberculosis
KIAKDRGIGGPV

SEQ ID NO: 1542294 - protein, 12 aa, Mycobacterium tuberculosis
KPVQPPQPVAEE

SEQ ID NO: 1542295 - protein, 9 aa, Mycobacterium tuberculosis
KRDSDAASL

SEQ ID NO: 1542296 - protein, 9 aa, Mycobacterium tuberculosis
KRLPTEDEV

SEQ ID NO: 1542297 - protein, 15 aa, Mycobacterium tuberculosis
KRSATTLPDGSQADL

SEQ ID NO: 1542298 - protein, 5 aa, Mycobacterium tuberculosis
KSGPL

SEQ ID NO: 1542299 - protein, 14 aa, Mycobacterium tuberculosis
KSLSDGALRGPGEV

SEQ ID NO: 1542300 - protein, 6 aa, Mycobacterium tuberculosis
KSQVGA

SEQ ID NO: 1542301 - protein, 5 aa, Mycobacterium tuberculosis
KSVGA

SEQ ID NO: 1542302 - protein, 6 aa, Mycobacterium tuberculosis
KTRFQG

SEQ ID NO: 1542303 - protein, 4 aa, Mycobacterium tuberculosis
LAGI

SEQ ID NO: 1542304 - protein, 34 aa, Mycobacterium tuberculosis
LAKPPAPPDPPAPPEPNSRPALPPAPPAPPELPV

SEQ ID NO: 1542305 - protein, 4 aa, Mycobacterium tuberculosis
LANA

SEQ ID NO: 1542306 - protein, 29 aa, Mycobacterium tuberculosis
LAPSKPNNSPPMPPTPVPPGASPIPPLPP

SEQ ID NO: 1542307 - protein, 10 aa, Mycobacterium tuberculosis
LAQSGRPAEA

SEQ ID NO: 1542308 - protein, 12 aa, Mycobacterium tuberculosis
LASSPTGPAITA

SEQ ID NO: 1542309 - protein, 5 aa, Mycobacterium tuberculosis
LDPVT

SEQ ID NO: 1542310 - protein, 12 aa, Mycobacterium tuberculosis
LDRASSASRQRK

SEQ ID NO: 1542311 - protein, 8 aa, Mycobacterium tuberculosis
LDRGQEAG

SEQ ID NO: 1542312 - protein, 4 aa, Mycobacterium tuberculosis
LDSP

SEQ ID NO: 1542313 - protein, 6 aa, Mycobacterium tuberculosis
LEDTIR

SEQ ID NO: 1542314 - protein, 6 aa, Mycobacterium tuberculosis
LETNAT

SEQ ID NO: 1542315 - protein, 8 aa, Mycobacterium tuberculosis
LGEPPRLT

SEQ ID NO: 1542316 - protein, 9 aa, Mycobacterium tuberculosis
LGPNPNWDS

SEQ ID NO: 1542317 - protein, 10 aa, Mycobacterium tuberculosis
LGRAASVGSL

SEQ ID NO: 1542318 - protein, 26 aa, Mycobacterium tuberculosis
LGSGNTGDTNVGSGNIGNTNLGGGNI

SEQ ID NO: 1542319 - protein, 31 aa, Mycobacterium tuberculosis
LPAPTAWADPSRPAASAGPTPAPAAPAAATG

SEQ ID NO: 1542320 - protein, 7 aa, Mycobacterium tuberculosis
LPVPSGR

SEQ ID NO: 1542321 - protein, 12 aa, Mycobacterium tuberculosis
LRPGTALTPGDV

SEQ ID NO: 1542322 - protein, 5 aa, Mycobacterium tuberculosis
LRPWP

SEQ ID NO: 1542323 - protein, 9 aa, Mycobacterium tuberculosis
LRSGGDDEL

SEQ ID NO: 1542324 - protein, 8 aa, Mycobacterium tuberculosis
LSANPTVS

SEQ ID NO: 1542325 - protein, 9 aa, Mycobacterium tuberculosis
LSGASSEPY

SEQ ID NO: 1542326 - protein, 25 aa, Mycobacterium tuberculosis
LSGLSGGDGGAGGAGGAGGAGGTGG

SEQ ID NO: 1542327 - protein, 11 aa, Mycobacterium tuberculosis
LSGLSSAGTAL

SEQ ID NO: 1542328 - protein, 7 aa, Mycobacterium tuberculosis
LSGQGTS

SEQ ID NO: 1542329 - protein, 7 aa, Mycobacterium tuberculosis
LSPPDVR

SEQ ID NO: 1542330 - protein, 6 aa, Mycobacterium tuberculosis
LSTTGP

SEQ ID NO: 1542331 - protein, 10 aa, Mycobacterium tuberculosis
LTAKSSSDAF

SEQ ID NO: 1542332 - protein, 6 aa, Mycobacterium tuberculosis
LTEAGA

SEQ ID NO: 1542333 - protein, 5 aa, Mycobacterium tuberculosis
LTEPD

SEQ ID NO: 1542334 - protein, 4 aa, Mycobacterium tuberculosis
LTSQ

SEQ ID NO: 1542335 - protein, 39 aa, Mycobacterium tuberculosis; identical to SEQ ID NO: 1436768

SEQ ID NO: 1542336 - protein, 16 aa, Mycobacterium tuberculosis
MSGSRPTESGDPTSQV

SEQ ID NO: 1542337 - protein, 7 aa, Mycobacterium tuberculosis
NAAAGSV

SEQ ID NO: 1542338 - protein, 9 aa, Mycobacterium tuberculosis
NAASPPLKN

SEQ ID NO: 1542339 - protein, 8 aa, Mycobacterium tuberculosis
NAGPIGVP

SEQ ID NO: 1542340 - protein, 19 aa, Mycobacterium tuberculosis
NANLGNGNIGNANLGSGNA

SEQ ID NO: 1542341 - protein, 8 aa, Mycobacterium tuberculosis
NARSFSGA

SEQ ID NO: 1542342 - protein, 46 aa, Mycobacterium tuberculosis; identical to SEQ ID NO: 181284

SEQ ID NO: 1542343 - protein, 22 aa, Mycobacterium tuberculosis
NGGAGGSAAAGSGLPGGAGGAA

SEQ ID NO: 1542344 - protein, 24 aa, Mycobacterium tuberculosis
NGGAGGSAAAGSGLPGGAGGAAGL

SEQ ID NO: 1542345 - protein, 25 aa, Mycobacterium tuberculosis
NGGAGGSGGLGGDAGTGGAGGNGGL

SEQ ID NO: 1542346 - protein, 20 aa, Mycobacterium tuberculosis
NGGFGGGGGPGAAGGNGGAG

SEQ ID NO: 1542347 - protein, 10 aa, Mycobacterium tuberculosis
NGGGPRGTDV

SEQ ID NO: 1542348 - protein, 57 aa, Mycobacterium tuberculosis; identical to SEQ ID NO: 181311

SEQ ID NO: 1542349 - protein, 24 aa, Mycobacterium tuberculosis
NGGNGGHGATNTAATATGGAGGAG

SEQ ID NO: 1542350 - protein, 22 aa, Mycobacterium tuberculosis
NGGNGGNGGKAGGTPGAGGTSG

SEQ ID NO: 1542351 - protein, 39 aa, Mycobacterium tuberculosis
NGGNGGNGGTGGSGGVGGNGGIGGDGAGGGNATSTSSIP

SEQ ID NO: 1542352 - protein, 23 aa, Mycobacterium tuberculosis
NGGNGGSGATGTNGGDGGDGGAG

SEQ ID NO: 1542353 - protein, 13 aa, Mycobacterium tuberculosis
NGNDGNTNFGSGN

SEQ ID NO: 1542354 - protein, 16 aa, Mycobacterium tuberculosis
NGPLSPDPGPPLVLQA

SEQ ID NO: 1542355 - protein, 13 aa, Mycobacterium tuberculosis
NGTPDYGAPARLD

SEQ ID NO: 1542356 - protein, 5 aa, Mycobacterium tuberculosis
NHDGT

SEQ ID NO: 1542357 - protein, 17 aa, Mycobacterium tuberculosis
NIAQDGKGYASGTQLGE

SEQ ID NO: 1542358 - protein, 12 aa, Mycobacterium tuberculosis
NIPGGAPIPQEE

SEQ ID NO: 1542359 - protein, 8 aa, Mycobacterium tuberculosis
NIYRGDAS

SEQ ID NO: 1542360 - protein, 5 aa, Mycobacterium tuberculosis
NKGSL

SEQ ID NO: 1542361 - protein, 8 aa, Mycobacterium tuberculosis
NLGEAAGT

SEQ ID NO: 1542362 - protein, 5 aa, Mycobacterium tuberculosis
NNNFG

SEQ ID NO: 1542363 - protein, 11 aa, Mycobacterium tuberculosis
NPETGKYGPIY

SEQ ID NO: 1542364 - protein, 4 aa, Mycobacterium tuberculosis
NPLA

SEQ ID NO: 1542365 - protein, 5 aa, Mycobacterium tuberculosis
NQAGQ

SEQ ID NO: 1542366 - protein, 8 aa, Mycobacterium tuberculosis
NRLRTKDS

SEQ ID NO: 1542367 - protein, 49 aa, Mycobacterium tuberculosis; identical to SEQ ID NO: 181753

SEQ ID NO: 1542368 - protein, 9 aa, Mycobacterium tuberculosis
NSKSPHWTG

SEQ ID NO: 1542369 - protein, 5 aa, Mycobacterium tuberculosis
NVGEQ

SEQ ID NO: 1542370 - protein, 20 aa, Mycobacterium tuberculosis
NWKGDPNATVPGLGSGQDIP

SEQ ID NO: 1542371 - protein, 14 aa, Mycobacterium tuberculosis
NYATSSKFSDDERA

SEQ ID NO: 1542372 - protein, 7 aa, Mycobacterium tuberculosis
PAAAEVN

SEQ ID NO: 1542373 - protein, 16 aa, Mycobacterium tuberculosis
PAAATAAVTPPALNTG

SEQ ID NO: 1542374 - protein, 8 aa, Mycobacterium tuberculosis
PAATPRCG

SEQ ID NO: 1542375 - protein, 4 aa, Mycobacterium tuberculosis
PAEF

SEQ ID NO: 1542376 - protein, 4 aa, Mycobacterium tuberculosis
PAEG

SEQ ID NO: 1542377 - protein, 40 aa, Mycobacterium tuberculosis
PAPLGEPLPAAPADPAPPADLAPPAPADLAPPAPADLAPP

SEQ ID NO: 1542378 - protein, 47 aa, Mycobacterium tuberculosis
PAPLGEPLPAAPADPAPPADLAPPAPADLAPPAPADLAPPAPADLAP

SEQ ID NO: 1542379 - protein, 7 aa, Mycobacterium tuberculosis
PAPRGHK

SEQ ID NO: 1542380 - protein, 11 aa, Mycobacterium tuberculosis
PARAGRRSAVA

SEQ ID NO: 1542381 - protein, 15 aa, Mycobacterium tuberculosis
PCSGDAANAPPPPSA

SEQ ID NO: 1542382 - protein, 10 aa, Mycobacterium tuberculosis
PDGNYGEPEE

SEQ ID NO: 1542383 - protein, 4 aa, Mycobacterium tuberculosis
PEGT

SEQ ID NO: 1542384 - protein, 5 aa, Mycobacterium tuberculosis
PESAT

SEQ ID NO: 1542385 - protein, 4 aa, Mycobacterium tuberculosis
PGFG

SEQ ID NO: 1542386 - protein, 4 aa, Mycobacterium tuberculosis
PGGM

SEQ ID NO: 1542387 - protein, 21 aa, Mycobacterium tuberculosis
PGLNGSGGDGGDGGNGAPGGV

SEQ ID NO: 1542388 - protein, 8 aa, Mycobacterium tuberculosis
PGNEQAAA

SEQ ID NO: 1542389 - protein, 17 aa, Mycobacterium tuberculosis
PGVEGHPYRQRATPIPT

SEQ ID NO: 1542390 - protein, 8 aa, Mycobacterium tuberculosis
PIGPRGRA

SEQ ID NO: 1542391 - protein, 6 aa, Mycobacterium tuberculosis
PLDPQA

SEQ ID NO: 1542392 - protein, 6 aa, Mycobacterium tuberculosis
PLTPPR

SEQ ID NO: 1542393 - protein, 78 aa, Mycobacterium tuberculosis
PPLPPAPGIPPRTPATAGPPCPPAPPSPNNIPPAPPLPPAAPAPPRPPTPPLPINSGPAPPSPPGAPSPPTPPPPPVP

SEQ ID NO: 1542394 - protein, 5 aa, Mycobacterium tuberculosis
PPPCT

SEQ ID NO: 1542395 - protein, 10 aa, Mycobacterium tuberculosis
PPPGAGAPPW

SEQ ID NO: 1542396 - protein, 14 aa, Mycobacterium tuberculosis
PPPLPQAATPTLAA

SEQ ID NO: 1542397 - protein, 4 aa, Mycobacterium tuberculosis
PPTE

SEQ ID NO: 1542398 - protein, 14 aa, Mycobacterium tuberculosis
PPWDPGTASRYRTS

SEQ ID NO: 1542399 - protein, 6 aa, Mycobacterium tuberculosis
PPYPPS

SEQ ID NO: 1542400 - protein, 4 aa, Mycobacterium tuberculosis
PQDP

SEQ ID NO: 1542401 - protein, 4 aa, Mycobacterium tuberculosis
PQQA

SEQ ID NO: 1542402 - protein, 4 aa, Mycobacterium tuberculosis
PQSV

SEQ ID NO: 1542403 - protein, 12 aa, Mycobacterium tuberculosis
PRPARSTQPVQR

SEQ ID NO: 1542404 - protein, 4 aa, Mycobacterium tuberculosis
PSGD

SEQ ID NO: 1542405 - protein, 5 aa, Mycobacterium tuberculosis
PTADK

SEQ ID NO: 1542406 - protein, 4 aa, Mycobacterium tuberculosis
PTME

SEQ ID NO: 1542407 - protein, 14 aa, Mycobacterium tuberculosis
PTPGIGNTTTVPSS

SEQ ID NO: 1542408 - protein, 6 aa, Mycobacterium tuberculosis
PTPTAV

SEQ ID NO: 1542409 - protein, 4 aa, Mycobacterium tuberculosis
PTRT

SEQ ID NO: 1542410 - protein, 11 aa, Mycobacterium tuberculosis
PVDRPGRGLSR

SEQ ID NO: 1542411 - protein, 14 aa, Mycobacterium tuberculosis
PVPPCPPAPPDPNQ

SEQ ID NO: 1542412 - protein, 7 aa, Mycobacterium tuberculosis
PVTDSPA

SEQ ID NO: 1542413 - protein, 13 aa, Mycobacterium tuberculosis
PWDPGTASRYRTS

SEQ ID NO: 1542414 - protein, 25 aa, Mycobacterium tuberculosis
PWQNTGSEGAAPAGVPGPEAGAQLQ

SEQ ID NO: 1542415 - protein, 7 aa, Mycobacterium tuberculosis
QAEQQAM

SEQ ID NO: 1542416 - protein, 5 aa, Mycobacterium tuberculosis
QAFNT

SEQ ID NO: 1542417 - protein, 19 aa, Mycobacterium tuberculosis
QAGGHQVDATDPCCAERRQ

SEQ ID NO: 1542418 - protein, 7 aa, Mycobacterium tuberculosis
QAGPNSG

SEQ ID NO: 1542419 - protein, 8 aa, Mycobacterium tuberculosis
QARERGEQ

SEQ ID NO: 1542420 - protein, 8 aa, Mycobacterium tuberculosis
QATTRAGP

SEQ ID NO: 1542421 - protein, 9 aa, Mycobacterium tuberculosis
QDAGKTKRA

SEQ ID NO: 1542422 - protein, 7 aa, Mycobacterium tuberculosis
QDNGPWG

SEQ ID NO: 1542423 - protein, 6 aa, Mycobacterium tuberculosis
QDSPFN

SEQ ID NO: 1542424 - protein, 7 aa, Mycobacterium tuberculosis
QEHKTRI

SEQ ID NO: 1542425 - protein, 15 aa, Mycobacterium tuberculosis
QGNPAQQRYPPWPAS

SEQ ID NO: 1542426 - protein, 11 aa, Mycobacterium tuberculosis
QGRGDAAEQTI

SEQ ID NO: 1542427 - protein, 5 aa, Mycobacterium tuberculosis
QHPNA

SEQ ID NO: 1542428 - protein, 6 aa, Mycobacterium tuberculosis
QNTPAI

SEQ ID NO: 1542429 - protein, 4 aa, Mycobacterium tuberculosis
QPGV

SEQ ID NO: 1542430 - protein, 17 aa, Mycobacterium tuberculosis
QPTDPRTLPPDAPDDRK

SEQ ID NO: 1542431 - protein, 10 aa, Mycobacterium tuberculosis
QQKAQAADSD

SEQ ID NO: 1542432 - protein, 7 aa, Mycobacterium tuberculosis
QTAPPIL

SEQ ID NO: 1542433 - protein, 5 aa, Mycobacterium tuberculosis
QTGTG

SEQ ID NO: 1542434 - protein, 11 aa, Mycobacterium tuberculosis
QVTTTSPKEVT

SEQ ID NO: 1542435 - protein, 9 aa, Mycobacterium tuberculosis
RADETVRRD

SEQ ID NO: 1542436 - protein, 5 aa, Mycobacterium tuberculosis
RAGDE

SEQ ID NO: 1542437 - protein, 19 aa, Mycobacterium tuberculosis
RAGRAAGSVATRAPTAPWA

SEQ ID NO: 1542438 - protein, 7 aa, Mycobacterium tuberculosis
RAKADAQ

SEQ ID NO: 1542439 - protein, 15 aa, Mycobacterium tuberculosis
RALGSNKSYPASQTA

SEQ ID NO: 1542440 - protein, 8 aa, Mycobacterium tuberculosis
RARQTGAQ

SEQ ID NO: 1542441 - protein, 5 aa, Mycobacterium tuberculosis
RATSR

SEQ ID NO: 1542442 - protein, 16 aa, Mycobacterium tuberculosis
RDAAIPTGIQNPCFSH

SEQ ID NO: 1542443 - protein, 8 aa, Mycobacterium tuberculosis
RDRLRSGN

SEQ ID NO: 1542444 - protein, 4 aa, Mycobacterium tuberculosis
REFK

SEQ ID NO: 1542445 - protein, 7 aa, Mycobacterium tuberculosis
REGGHSR

SEQ ID NO: 1542446 - protein, 6 aa, Mycobacterium tuberculosis
REGREG

SEQ ID NO: 1542447 - protein, 7 aa, Mycobacterium tuberculosis
REPDHDK

SEQ ID NO: 1542448 - protein, 19 aa, Mycobacterium tuberculosis
RESASQALPGLLERLPALL

SEQ ID NO: 1542449 - protein, 7 aa, Mycobacterium tuberculosis
RETKAAT

SEQ ID NO: 1542450 - protein, 7 aa, Mycobacterium tuberculosis
REVDEDE

SEQ ID NO: 1542451 - protein, 4 aa, Mycobacterium tuberculosis
RGEG

SEQ ID NO: 1542452 - protein, 8 aa, Mycobacterium tuberculosis
RGGTRRSC

SEQ ID NO: 1542453 - protein, 5 aa, Mycobacterium tuberculosis
RGKWD

SEQ ID NO: 1542454 - protein, 5 aa, Mycobacterium tuberculosis
RGNGK

SEQ ID NO: 1542455 - protein, 4 aa, Mycobacterium tuberculosis
RGSV

SEQ ID NO: 1542456 - protein, 5 aa, Mycobacterium tuberculosis
RKDKL

SEQ ID NO: 1542457 - protein, 13 aa, Mycobacterium tuberculosis
RKPFPRTVSTGQA

SEQ ID NO: 1542458 - protein, 6 aa, Mycobacterium tuberculosis
RKTTSV

SEQ ID NO: 1542459 - protein, 16 aa, Mycobacterium tuberculosis
RLESKKISKTQAVTSN

SEQ ID NO: 1542460 - protein, 8 aa, Mycobacterium tuberculosis
RLPPRGLT

SEQ ID NO: 1542461 - protein, 13 aa, Mycobacterium tuberculosis
RPADTVVRRSATS

SEQ ID NO: 1542462 - protein, 20 aa, Mycobacterium tuberculosis
RPGATEPSDPALLAKIHANS

SEQ ID NO: 1542463 - protein, 12 aa, Mycobacterium tuberculosis
RPGTSLSESDRH

SEQ ID NO: 1542464 - protein, 22 aa, Mycobacterium tuberculosis
RPLIGNGTNGAPGTGANGGDGG

SEQ ID NO: 1542465 - protein, 6 aa, Mycobacterium tuberculosis
RPPDVR

SEQ ID NO: 1542466 - protein, 4 aa, Mycobacterium tuberculosis
RQAA

SEQ ID NO: 1542467 - protein, 8 aa, Mycobacterium tuberculosis
RQAALNPP

SEQ ID NO: 1542468 - protein, 5 aa, Mycobacterium tuberculosis
RQAGR

SEQ ID NO: 1542469 - protein, 8 aa, Mycobacterium tuberculosis
RQPGKPSW

SEQ ID NO: 1542470 - protein, 6 aa, Mycobacterium tuberculosis
RRAAGD

SEQ ID NO: 1542471 - protein, 20 aa, Mycobacterium tuberculosis
RRADRQRRQRRQRRQSRGHA

SEQ ID NO: 1542472 - protein, 10 aa, Mycobacterium tuberculosis
RRATDEAAAM

SEQ ID NO: 1542473 - protein, 11 aa, Mycobacterium tuberculosis
RRDLNDPKTIE

SEQ ID NO: 1542474 - protein, 11 aa, Mycobacterium tuberculosis
RRGDRAEGAAE

SEQ ID NO: 1542475 - protein, 10 aa, Mycobacterium tuberculosis
RRGRSGPMTR

SEQ ID NO: 1542476 - protein, 22 aa, Mycobacterium tuberculosis
RRPRRRQIDDTGDATSSKSALA

SEQ ID NO: 1542477 - protein, 5 aa, Mycobacterium tuberculosis
RRQRR

SEQ ID NO: 1542478 - protein, 8 aa, Mycobacterium tuberculosis
RRRDPFDD

SEQ ID NO: 1542479 - protein, 5 aa, Mycobacterium tuberculosis
RRRFR

SEQ ID NO: 1542480 - protein, 9 aa, Mycobacterium tuberculosis
RRRTRAQDR

SEQ ID NO: 1542481 - protein, 8 aa, Mycobacterium tuberculosis
RSAPSPTI

SEQ ID NO: 1542482 - protein, 9 aa, Mycobacterium tuberculosis
RSENLTSTG

SEQ ID NO: 1542483 - protein, 5 aa, Mycobacterium tuberculosis
RSGIR

SEQ ID NO: 1542484 - protein, 5 aa, Mycobacterium tuberculosis
RSLPE

SEQ ID NO: 1542485 - protein, 25 aa, Mycobacterium tuberculosis
RSPAGIANADDAGLDPNAAAGPDAV

SEQ ID NO: 1542486 - protein, 17 aa, Mycobacterium tuberculosis
RTATPPGTETGAGHGSN

SEQ ID NO: 1542487 - protein, 5 aa, Mycobacterium tuberculosis
RTPVR

SEQ ID NO: 1542488 - protein, 6 aa, Mycobacterium tuberculosis
RVAGAD

SEQ ID NO: 1542489 - protein, 6 aa, Mycobacterium tuberculosis
RYSARD

SEQ ID NO: 1542490 - protein, 15 aa, Mycobacterium tuberculosis
SAAPHALAGEPSPTP

SEQ ID NO: 1542491 - protein, 10 aa, Mycobacterium tuberculosis
SAAPVFPGRT

SEQ ID NO: 1542492 - protein, 10 aa, Mycobacterium tuberculosis
SADDPAAQVT

SEQ ID NO: 1542493 - protein, 10 aa, Mycobacterium tuberculosis
SAEATNAAPL

SEQ ID NO: 1542494 - protein, 8 aa, Mycobacterium tuberculosis
SAGGATQH

SEQ ID NO: 1542495 - protein, 24 aa, Mycobacterium tuberculosis
SAGPVALAPPAASEGRPATSAPGA

SEQ ID NO: 1542496 - protein, 12 aa, Mycobacterium tuberculosis
SAMSDAQDSRVG

SEQ ID NO: 1542497 - protein, 7 aa, Mycobacterium tuberculosis
SAPVAGS

SEQ ID NO: 1542498 - protein, 22 aa, Mycobacterium tuberculosis
SAQSSAQAVTAQAVGSTVPGPL

SEQ ID NO: 1542499 - protein, 5 aa, Mycobacterium tuberculosis
SARHE

SEQ ID NO: 1542500 - protein, 10 aa, Mycobacterium tuberculosis
SATTDEKLTQ

SEQ ID NO: 1542501 - protein, 15 aa, Mycobacterium tuberculosis
SATTGVSASAADGAV

SEQ ID NO: 1542502 - protein, 6 aa, Mycobacterium tuberculosis
SDEPYL

SEQ ID NO: 1542503 - protein, 7 aa, Mycobacterium tuberculosis
SDRGAGA

SEQ ID NO: 1542504 - protein, 16 aa, Mycobacterium tuberculosis
SDTVGARSGTGAARAR

SEQ ID NO: 1542505 - protein, 7 aa, Mycobacterium tuberculosis
SEAGPAR

SEQ ID NO: 1542506 - protein, 5 aa, Mycobacterium tuberculosis
SEGGI

SEQ ID NO: 1542507 - protein, 13 aa, Mycobacterium tuberculosis
SETSAEAAARHET

SEQ ID NO: 1542508 - protein, 4 aa, Mycobacterium tuberculosis
SGAQ

SEQ ID NO: 1542509 - protein, 25 aa, Mycobacterium tuberculosis
SGGAGGSGGAGAVGGNGGAGGNAGA

SEQ ID NO: 1542510 - protein, 25 aa, Mycobacterium tuberculosis
SGGAGGSGGAGGVGGNGGAGGNAGA

SEQ ID NO: 1542511 - protein, 26 aa, Mycobacterium tuberculosis
SGGNGGSGGAGLTAGGDGGDGGNAGS

SEQ ID NO: 1542512 - protein, 6 aa, Mycobacterium tuberculosis
SGGTDP

SEQ ID NO: 1542513 - protein, 7 aa, Mycobacterium tuberculosis
SGGTDPF

SEQ ID NO: 1542514 - protein, 12 aa, Mycobacterium tuberculosis
SGGTGGNGGNSI

SEQ ID NO: 1542515 - protein, 12 aa, Mycobacterium tuberculosis
SGKTGTTETHRS

SEQ ID NO: 1542516 - protein, 6 aa, Mycobacterium tuberculosis
SGLGTP

SEQ ID NO: 1542517 - protein, 4 aa, Mycobacterium tuberculosis
SGLI

SEQ ID NO: 1542518 - protein, 41 aa, Mycobacterium tuberculosis; identical to SEQ ID NO: 187446

SEQ ID NO: 1542519 - protein, 10 aa, Mycobacterium tuberculosis
SGNEGSGNLG

SEQ ID NO: 1542520 - protein, 5 aa, Mycobacterium tuberculosis
SGSGN

SEQ ID NO: 1542521 - protein, 6 aa, Mycobacterium tuberculosis
SGSGNV

SEQ ID NO: 1542522 - protein, 7 aa, Mycobacterium tuberculosis
SGTDTDW

SEQ ID NO: 1542523 - protein, 25 aa, Mycobacterium tuberculosis
SGTGNVGFGNSGTANTGFGNAGNVN

SEQ ID NO: 1542524 - protein, 10 aa, Mycobacterium tuberculosis
SHPDQAIASG

SEQ ID NO: 1542525 - protein, 15 aa, Mycobacterium tuberculosis
SIQQGGAGGAGGNGG

SEQ ID NO: 1542526 - protein, 5 aa, Mycobacterium tuberculosis
SKKPQ

SEQ ID NO: 1542527 - protein, 10 aa, Mycobacterium tuberculosis
SLPQAEPTAP

SEQ ID NO: 1542528 - protein, 25 aa, Mycobacterium tuberculosis
SMGSARPGDFGAPTAVAPPVPEHGT

SEQ ID NO: 1542529 - protein, 12 aa, Mycobacterium tuberculosis
SMSTRRDLPQSP

SEQ ID NO: 1542530 - protein, 19 aa, Mycobacterium tuberculosis
SNSTGQAGLATTATDQLKR

SEQ ID NO: 1542531 - protein, 7 aa, Mycobacterium tuberculosis
SNVPSAC

SEQ ID NO: 1542532 - protein, 9 aa, Mycobacterium tuberculosis
SPAGEQVSG

SEQ ID NO: 1542533 - protein, 10 aa, Mycobacterium tuberculosis
SPAGEQVSGQ

SEQ ID NO: 1542534 - protein, 7 aa, Mycobacterium tuberculosis
SPAHADG

SEQ ID NO: 1542535 - protein, 28 aa, Mycobacterium tuberculosis
SPAPPPAPPAPPFPAPPVATDVPPLPPL

SEQ ID NO: 1542536 - protein, 15 aa, Mycobacterium tuberculosis
SPAPPPAPPAPPVEP

SEQ ID NO: 1542537 - protein, 9 aa, Mycobacterium tuberculosis
SPEADTGGM

SEQ ID NO: 1542538 - protein, 8 aa, Mycobacterium tuberculosis
SPPEQLPD

SEQ ID NO: 1542539 - protein, 7 aa, Mycobacterium tuberculosis
SPRDGER

SEQ ID NO: 1542540 - protein, 13 aa, Mycobacterium tuberculosis
SPSGHTYVSTPGS

SEQ ID NO: 1542541 - protein, 8 aa, Mycobacterium tuberculosis
SPTPRPAS

SEQ ID NO: 1542542 - protein, 7 aa, Mycobacterium tuberculosis
SQAPHAH

SEQ ID NO: 1542543 - protein, 4 aa, Mycobacterium tuberculosis
SQSP

SEQ ID NO: 1542544 - protein, 5 aa, Mycobacterium tuberculosis
SQTNR

SEQ ID NO: 1542545 - protein, 7 aa, Mycobacterium tuberculosis
SRADDSV

SEQ ID NO: 1542546 - protein, 23 aa, Mycobacterium tuberculosis
SRAGANANIGAGDAEDAGGARSD

SEQ ID NO: 1542547 - protein, 13 aa, Mycobacterium tuberculosis
SRDGGGGAGTSVA

SEQ ID NO: 1542548 - protein, 8 aa, Mycobacterium tuberculosis
SRKLPPSV

SEQ ID NO: 1542549 - protein, 8 aa, Mycobacterium tuberculosis
SRSGNRQL

SEQ ID NO: 1542550 - protein, 8 aa, Mycobacterium tuberculosis
SSEPGDNY

SEQ ID NO: 1542551 - protein, 5 aa, Mycobacterium tuberculosis
SSGLS

SEQ ID NO: 1542552 - protein, 19 aa, Mycobacterium tuberculosis
SSSMQPGKPITSMDSSPVT

SEQ ID NO: 1542553 - protein, 11 aa, Mycobacterium tuberculosis
STASSSIPMPA

SEQ ID NO: 1542554 - protein, 15 aa, Mycobacterium tuberculosis
STGGATGSGSSGSCA

SEQ ID NO: 1542555 - protein, 15 aa, Mycobacterium tuberculosis
STGQGPLNSTAECSG

SEQ ID NO: 1542556 - protein, 10 aa, Mycobacterium tuberculosis
STLQDDGDSV

SEQ ID NO: 1542557 - protein, 8 aa, Mycobacterium tuberculosis
SVDENHTH

SEQ ID NO: 1542558 - protein, 6 aa, Mycobacterium tuberculosis
SYHSRT

SEQ ID NO: 1542559 - protein, 8 aa, Mycobacterium tuberculosis
SYPEAEGI

SEQ ID NO: 1542560 - protein, 20 aa, Mycobacterium tuberculosis
TAAATDTHGPPPDHNDDPPP

SEQ ID NO: 1542561 - protein, 7 aa, Mycobacterium tuberculosis
TAANSDL

SEQ ID NO: 1542562 - protein, 16 aa, Mycobacterium tuberculosis
TAANSDLKRLPTEDEV

SEQ ID NO: 1542563 - protein, 11 aa, Mycobacterium tuberculosis
TADPHSVTDEQ

SEQ ID NO: 1542564 - protein, 12 aa, Mycobacterium tuberculosis
TAGKESVGQPAG

SEQ ID NO: 1542565 - protein, 7 aa, Mycobacterium tuberculosis
TAGQATA

SEQ ID NO: 1542566 - protein, 6 aa, Mycobacterium tuberculosis
TAGTTA

SEQ ID NO: 1542567 - protein, 126 aa, Mycobacterium tuberculosis; identical to SEQ ID NO: 232444

SEQ ID NO: 1542568 - protein, 126 aa, Mycobacterium tuberculosis
TAKAGDGGAAGNGGNGGAGGAGGAGDNNFNGGQGGAGGQGGQGGLGGASTTSINANGGAGGNGGTGGKGGAGGAGTLGVGGSGGTGGDGGDAGSGGGGGFGGAAGKAGGGGNGGRGGDGGDGASGL

SEQ ID NO: 1542569 - protein, 126 aa, Mycobacterium tuberculosis
TAKAGDGGAAGNGGNGGAGGAGGAGDNNFNGGQGGAGGQGGQGGLGGASTTSINANGGAGGNGGTGGKGGAGGAGTLGVGGSGGTGGDGGDAGSGGGGGFGGAAGKAGGGGNGGVGGDGGEGASGL

SEQ ID NO: 1542570 - protein, 8 aa, Mycobacterium tuberculosis
TALDPSAP

SEQ ID NO: 1542571 - protein, 6 aa, Mycobacterium tuberculosis
TAREPH

SEQ ID NO: 1542572 - protein, 69 aa, Mycobacterium tuberculosis
TARRPNARGAGHTGLTTAPAITPATGGTAQPGATGDAEQAARAARAARAAVSAGAAVTADPAVTPVTSV

SEQ ID NO: 1542573 - protein, 6 aa, Mycobacterium tuberculosis
TATGLT

SEQ ID NO: 1542574 - protein, 13 aa, Mycobacterium tuberculosis
TCSSAPTRALQSP

SEQ ID NO: 1542575 - protein, 4 aa, Mycobacterium tuberculosis
TDAA

SEQ ID NO: 1542576 - protein, 7 aa, Mycobacterium tuberculosis
TDIRDAQ

SEQ ID NO: 1542577 - protein, 12 aa, Mycobacterium tuberculosis
TEASSGRVPNPY

SEQ ID NO: 1542578 - protein, 5 aa, Mycobacterium tuberculosis
TEHRG

SEQ ID NO: 1542579 - protein, 55 aa, Mycobacterium tuberculosis; identical to SEQ ID NO: 231521

SEQ ID NO: 1542580 - protein, 25 aa, Mycobacterium tuberculosis
TGGNGGTGGIATGAGGIGGAGGAGG

SEQ ID NO: 1542581 - protein, 24 aa, Mycobacterium tuberculosis
TGGTGGAGGVGTTGTGGDGGAGGA

SEQ ID NO: 1542582 - protein, 4 aa, Mycobacterium tuberculosis
TGGV

SEQ ID NO: 1542583 - protein, 9 aa, Mycobacterium tuberculosis
TGHPDSPEE

SEQ ID NO: 1542584 - protein, 4 aa, Mycobacterium tuberculosis
TGKV

SEQ ID NO: 1542585 - protein, 5 aa, Mycobacterium tuberculosis
TGNGQ

SEQ ID NO: 1542586 - protein, 4 aa, Mycobacterium tuberculosis
TGNS

SEQ ID NO: 1542587 - protein, 10 aa, Mycobacterium tuberculosis
TGRDAAVPTP

SEQ ID NO: 1542588 - protein, 7 aa, Mycobacterium tuberculosis
TGRKPSR

SEQ ID NO: 1542589 - protein, 4 aa, Mycobacterium tuberculosis
THRR

SEQ ID NO: 1542590 - protein, 14 aa, Mycobacterium tuberculosis
TINGTGSAPASQMN

SEQ ID NO: 1542591 - protein, 6 aa, Mycobacterium tuberculosis
TKATGA

SEQ ID NO: 1542592 - protein, 7 aa, Mycobacterium tuberculosis
TKQAYRG

SEQ ID NO: 1542593 - protein, 10 aa, Mycobacterium tuberculosis
TLASPTRRGE

SEQ ID NO: 1542594 - protein, 34 aa, Mycobacterium tuberculosis
TLGSPGADGGMGGNGGKGGDGGKAGDGGAGAAGD

SEQ ID NO: 1542595 - protein, 14 aa, Mycobacterium tuberculosis
TLTDGAGPVNSKTV

SEQ ID NO: 1542596 - protein, 7 aa, Mycobacterium tuberculosis
TNSAGKV

SEQ ID NO: 1542597 - protein, 4 aa, Mycobacterium tuberculosis
TPDR

SEQ ID NO: 1542598 - protein, 4 aa, Mycobacterium tuberculosis
TPES

SEQ ID NO: 1542599 - protein, 5 aa, Mycobacterium tuberculosis
TPKLA

SEQ ID NO: 1542600 - protein, 4 aa, Mycobacterium tuberculosis
TPPP

SEQ ID NO: 1542601 - protein, 13 aa, Mycobacterium tuberculosis
TPSPASDTDTVTV

SEQ ID NO: 1542602 - protein, 6 aa, Mycobacterium tuberculosis
TPSPPV

SEQ ID NO: 1542603 - protein, 15 aa, Mycobacterium tuberculosis
TPTGSRHRSGAPPHL

SEQ ID NO: 1542604 - protein, 8 aa, Mycobacterium tuberculosis
TQEGAEGW

SEQ ID NO: 1542605 - protein, 12 aa, Mycobacterium tuberculosis
TQERRAKRAERA

SEQ ID NO: 1542606 - protein, 100 aa, Mycobacterium tuberculosis; identical to SEQ ID NO: 1452002

SEQ ID NO: 1542607 - protein, 4 aa, Mycobacterium tuberculosis
TQPS

SEQ ID NO: 1542608 - protein, 56 aa, Mycobacterium tuberculosis
TQPTPVQQAPVQPAPVQQAPVQQAPVQQAPVQQAPVQQAPVQQAPVQPPPFGTARS

SEQ ID NO: 1542609 - protein, 5 aa, Mycobacterium tuberculosis
TRGPF

SEQ ID NO: 1542610 - protein, 10 aa, Mycobacterium tuberculosis
TRQANPKLPA

SEQ ID NO: 1542611 - protein, 9 aa, Mycobacterium tuberculosis
TSAAQTAPG

SEQ ID NO: 1542612 - protein, 9 aa, Mycobacterium tuberculosis
TSADKWKNC

SEQ ID NO: 1542613 - protein, 12 aa, Mycobacterium tuberculosis
TSAMNQTNDRQQ

SEQ ID NO: 1542614 - protein, 4 aa, Mycobacterium tuberculosis
TSDY

SEQ ID NO: 1542615 - protein, 5 aa, Mycobacterium tuberculosis
TSDYS

SEQ ID NO: 1542616 - protein, 9 aa, Mycobacterium tuberculosis
TSGSSSGFK

SEQ ID NO: 1542617 - protein, 12 aa, Mycobacterium tuberculosis
TSQDPVYAGTGY

SEQ ID NO: 1542618 - protein, 8 aa, Mycobacterium tuberculosis
TSSEAGLV

SEQ ID NO: 1542619 - protein, 4 aa, Mycobacterium tuberculosis
TSVD

SEQ ID NO: 1542620 - protein, 7 aa, Mycobacterium tuberculosis
TSVPPDI

SEQ ID NO: 1542621 - protein, 4 aa, Mycobacterium tuberculosis
TTPL

SEQ ID NO: 1542622 - protein, 10 aa, Mycobacterium tuberculosis
TTVKSSQPPV

SEQ ID NO: 1542623 - protein, 12 aa, Mycobacterium tuberculosis
TVGSPGQGNYSA

SEQ ID NO: 1542624 - protein, 4 aa, Mycobacterium tuberculosis
VAGP

SEQ ID NO: 1542625 - protein, 7 aa, Mycobacterium tuberculosis
VAPETTA

SEQ ID NO: 1542626 - protein, 6 aa, Mycobacterium tuberculosis
VAPSPQ

SEQ ID NO: 1542627 - protein, 6 aa, Mycobacterium tuberculosis
VARSGT

SEQ ID NO: 1542628 - protein, 8 aa, Mycobacterium tuberculosis
VDASDDGL

SEQ ID NO: 1542629 - protein, 63 aa, Mycobacterium tuberculosis; identical to SEQ ID NO: 190667

SEQ ID NO: 1542630 - protein, 10 aa, Mycobacterium tuberculosis
VGAAAGAPAA

SEQ ID NO: 1542631 - protein, 5 aa, Mycobacterium tuberculosis
VGAAG

SEQ ID NO: 1542632 - protein, 5 aa, Mycobacterium tuberculosis
VGGEL

SEQ ID NO: 1542633 - protein, 7 aa, Mycobacterium tuberculosis
VKAARKD

SEQ ID NO: 1542634 - protein, 8 aa, Mycobacterium tuberculosis
VPGKRAPT

SEQ ID NO: 1542635 - protein, 10 aa, Mycobacterium tuberculosis
VPPDQATDFG

SEQ ID NO: 1542636 - protein, 10 aa, Mycobacterium tuberculosis
VPVPGDTGGA

SEQ ID NO: 1542637 - protein, 21 aa, Mycobacterium tuberculosis
VREGGPSAGRRHHPGGNGAPL

SEQ ID NO: 1542638 - protein, 29 aa, Mycobacterium tuberculosis
VRGDGGVGMASGDGGLSTGAAGASAEGGL

SEQ ID NO: 1542639 - protein, 4 aa, Mycobacterium tuberculosis
VRTA

SEQ ID NO: 1542640 - protein, 10 aa, Mycobacterium tuberculosis
VSASGSDSAV

SEQ ID NO: 1542641 - protein, 7 aa, Mycobacterium tuberculosis
VSPPPID

SEQ ID NO: 1542642 - protein, 6 aa, Mycobacterium tuberculosis
VSPSNA

SEQ ID NO: 1542643 - protein, 18 aa, Mycobacterium tuberculosis
VTAESGRAFGRAERSAQL

SEQ ID NO: 1542644 - protein, 9 aa, Mycobacterium tuberculosis
VTDQRSRAT

SEQ ID NO: 1542645 - protein, 7 aa, Mycobacterium tuberculosis
VTGDIGP

SEQ ID NO: 1542646 - protein, 11 aa, Mycobacterium tuberculosis
VVTTSSEPHVT

SEQ ID NO: 1542647 - protein, 14 aa, Mycobacterium tuberculosis
WADGGPTSAHNGLG

SEQ ID NO: 1542648 - protein, 9 aa, Mycobacterium tuberculosis
WGDPGRRST

SEQ ID NO: 1542649 - protein, 14 aa, Mycobacterium tuberculosis
YAAKSDGGRNNQAG

SEQ ID NO: 1542650 - protein, 12 aa, Mycobacterium tuberculosis
YAARGADPDFHK

SEQ ID NO: 1542651 - protein, 4 aa, Mycobacterium tuberculosis
YDDG

SEQ ID NO: 1542652 - protein, 6 aa, Mycobacterium tuberculosis
YEPRDP

SEQ ID NO: 1542653 - protein, 11 aa, Mycobacterium tuberculosis
YGQTRETKRAG

SEQ ID NO: 1542654 - protein, 7 aa, Mycobacterium tuberculosis
YPDRPAG

SEQ ID NO: 1542655 - protein, 7 aa, Mycobacterium tuberculosis
YSPYENV

SEQ ID NO: 1542656 - protein, 4 aa, Mycobacterium tuberculosis
AAAA

SEQ ID NO: 1542657 - protein, 5 aa, Mycobacterium tuberculosis
AAAAG

SEQ ID NO: 1542658 - protein, 23 aa, Mycobacterium tuberculosis
AAAAGLSATASVAATLANRVISC

SEQ ID NO: 1542659 - protein, 10 aa, Mycobacterium tuberculosis
AAAALAEEGA

SEQ ID NO: 1542660 - protein, 6 aa, Mycobacterium tuberculosis
AAAALP

SEQ ID NO: 1542661 - protein, 8 aa, Mycobacterium tuberculosis
AAAASTVQ

SEQ ID NO: 1542662 - protein, 10 aa, Mycobacterium tuberculosis
AAADHDGDLD

SEQ ID NO: 1542663 - protein, 15 aa, Mycobacterium tuberculosis
AAADNSVDATAARDF

SEQ ID NO: 1542664 - protein, 26 aa, Mycobacterium tuberculosis
AAADPATPQPNPTQQLPGLPALALLS

SEQ ID NO: 1542665 - protein, 17 aa, Mycobacterium tuberculosis
AAAGGRGAVRPGRTVQG

SEQ ID NO: 1542666 - protein, 18 aa, Mycobacterium tuberculosis
AAAGGRGAVRPGRTVQGR

SEQ ID NO: 1542667 - protein, 59 aa, Mycobacterium tuberculosis
AAAGPRGHGGQTGVGGKVGENNFGGAGGAGGTGGLIGNGGAGGTGGQGAISGAGGAGGN

SEQ ID NO: 1542668 - protein, 11 aa, Mycobacterium tuberculosis
AAAGTNPTVPT

SEQ ID NO: 1542669 - protein, 16 aa, Mycobacterium tuberculosis
AAAHAGSQAMASAAAY

SEQ ID NO: 1542670 - protein, 13 aa, Mycobacterium tuberculosis
AAAIASGAAITND

SEQ ID NO: 1542671 - protein, 7 aa, Mycobacterium tuberculosis
AAAKPKQ

SEQ ID NO: 1542672 - protein, 10 aa, Mycobacterium tuberculosis
AAALGESRTA

SEQ ID NO: 1542673 - protein, 12 aa, Mycobacterium tuberculosis
AAANAATTAGAA

SEQ ID NO: 1542674 - protein, 9 aa, Mycobacterium tuberculosis
AAAPDDRAL

SEQ ID NO: 1542675 - protein, 12 aa, Mycobacterium tuberculosis
AAAPNLPAPSAQ

SEQ ID NO: 1542676 - protein, 8 aa, Mycobacterium tuberculosis
AAAPSTLP

SEQ ID NO: 1542677 - protein, 18 aa, Mycobacterium tuberculosis
AAAQTSAVQAAAADEVSA

SEQ ID NO: 1542678 - protein, 15 aa, Mycobacterium tuberculosis
AAASAPAGAPATAGI

SEQ ID NO: 1542679 - protein, 14 aa, Mycobacterium tuberculosis
AAASLQPLDPPDGF

SEQ ID NO: 1542680 - protein, 16 aa, Mycobacterium tuberculosis
AAATAAVTPPALNTGL

SEQ ID NO: 1542681 - protein, 5 aa, Mycobacterium tuberculosis
AAATG

SEQ ID NO: 1542682 - protein, 5 aa, Mycobacterium tuberculosis
AAAYP

SEQ ID NO: 1542683 - protein, 8 aa, Mycobacterium tuberculosis
AADAAGRG

SEQ ID NO: 1542684 - protein, 20 aa, Mycobacterium tuberculosis
AADPTRRTTDPAGAAGSPVA

SEQ ID NO: 1542685 - protein, 13 aa, Mycobacterium tuberculosis
AADRGRHRRPGAL

SEQ ID NO: 1542686 - protein, 5 aa, Mycobacterium tuberculosis
AADWE

SEQ ID NO: 1542687 - protein, 12 aa, Mycobacterium tuberculosis
AAEAANASPLQT

SEQ ID NO: 1542688 - protein, 7 aa, Mycobacterium tuberculosis
AAEDPRV

SEQ ID NO: 1542689 - protein, 12 aa, Mycobacterium tuberculosis
AAEGQVSRQNPT

SEQ ID NO: 1542690 - protein, 8 aa, Mycobacterium tuberculosis
AAERDSRA

SEQ ID NO: 1542691 - protein, 6 aa, Mycobacterium tuberculosis
AAFPGG

SEQ ID NO: 1542692 - protein, 28 aa, Mycobacterium tuberculosis
AAGAAGAAGAAGAPVAGGATWAAGTAKS

SEQ ID NO: 1542693 - protein, 20 aa, Mycobacterium tuberculosis
AAGAGGAAASAGATVAQHSA

SEQ ID NO: 1542694 - protein, 16 aa, Mycobacterium tuberculosis
AAGATGATLTASPRDR

SEQ ID NO: 1542695 - protein, 4 aa, Mycobacterium tuberculosis
AAGD

SEQ ID NO: 1542696 - protein, 8 aa, Mycobacterium tuberculosis
AAGDEVSA

SEQ ID NO: 1542697 - protein, 10 aa, Mycobacterium tuberculosis
AAGEAGPGRA

SEQ ID NO: 1542698 - protein, 12 aa, Mycobacterium tuberculosis
AAGERPESRRQA

SEQ ID NO: 1542699 - protein, 10 aa, Mycobacterium tuberculosis
AAGESGAGVA

SEQ ID NO: 1542700 - protein, 8 aa, Mycobacterium tuberculosis
AAGGCGAI

SEQ ID NO: 1542701 - protein, 8 aa, Mycobacterium tuberculosis
AAGLPRSL

SEQ ID NO: 1542702 - protein, 32 aa, Mycobacterium tuberculosis; identical to SEQ ID NO: 1439878

SEQ ID NO: 1542703 - protein, 8 aa, Mycobacterium tuberculosis
AAGPTLAG

SEQ ID NO: 1542704 - protein, 18 aa, Mycobacterium tuberculosis
AAGQAELSAGQATAAATA

SEQ ID NO: 1542705 - protein, 8 aa, Mycobacterium tuberculosis
AAGQRQQV

SEQ ID NO: 1542706 - protein, 9 aa, Mycobacterium tuberculosis
AAGRYASTE

SEQ ID NO: 1542707 - protein, 10 aa, Mycobacterium tuberculosis
AAGRYASTEA

SEQ ID NO: 1542708 - protein, 57 aa, Mycobacterium tuberculosis
AAGSGGVPAGSAGSAIAPQPSIPDIATGAGGAGGKGGVAVQNPGDGGKGGDGAHGAV

SEQ ID NO: 1542709 - protein, 6 aa, Mycobacterium tuberculosis
AAGSPL

SEQ ID NO: 1542710 - protein, 18 aa, Mycobacterium tuberculosis
AAGTAGRTDPAVPAGGTI

SEQ ID NO: 1542711 - protein, 23 aa, Mycobacterium tuberculosis
AAHGGGEFAPSAQLASRGAADCR

SEQ ID NO: 1542712 - protein, 23 aa, Mycobacterium tuberculosis
AAHGGGRVRPVGSAGQPGAADCR

SEQ ID NO: 1542713 - protein, 4 aa, Mycobacterium tuberculosis
AAHS

SEQ ID NO: 1542714 - protein, 5 aa, Mycobacterium tuberculosis
AAIGG

SEQ ID NO: 1542715 - protein, 5 aa, Mycobacterium tuberculosis
AAIPQ

SEQ ID NO: 1542716 - protein, 21 aa, Mycobacterium tuberculosis
AAIPTASSTPAPPSAPGAAGF

SEQ ID NO: 1542717 - protein, 8 aa, Mycobacterium tuberculosis
AAKGRDRE

SEQ ID NO: 1542718 - protein, 35 aa, Mycobacterium tuberculosis
AALAGTAGGCSATAVSAERAEPAAERAAPVATPRG

SEQ ID NO: 1542719 - protein, 6 aa, Mycobacterium tuberculosis
AALAPT

SEQ ID NO: 1542720 - protein, 21 aa, Mycobacterium tuberculosis
AALASAAPAGPAARAATGGAG

SEQ ID NO: 1542721 - protein, 12 aa, Mycobacterium tuberculosis
AALGSAAGSEAA

SEQ ID NO: 1542722 - protein, 6 aa, Mycobacterium tuberculosis
AALPTE

SEQ ID NO: 1542723 - protein, 11 aa, Mycobacterium tuberculosis
AANAATTAGAA

SEQ ID NO: 1542724 - protein, 7 aa, Mycobacterium tuberculosis
AANEEAA

SEQ ID NO: 1542725 - protein, 5 aa, Mycobacterium tuberculosis
AANPA

SEQ ID NO: 1542726 - protein, 25 aa, Mycobacterium tuberculosis
AAPAAVGAAVGGTGPVSAGLGNAAT

SEQ ID NO: 1542727 - protein, 17 aa, Mycobacterium tuberculosis
AAPAESGGGNGGHGGNG

SEQ ID NO: 1542728 - protein, 8 aa, Mycobacterium tuberculosis
AAPAGAVG

SEQ ID NO: 1542729 - protein, 8 aa, Mycobacterium tuberculosis
AAPAGPGR

SEQ ID NO: 1542730 - protein, 24 aa, Mycobacterium tuberculosis
AAPARHAHPRAAPPQQGPRPVGPH

SEQ ID NO: 1542731 - protein, 16 aa, Mycobacterium tuberculosis
AAPGFGNSTTNPSSGF

SEQ ID NO: 1542732 - protein, 16 aa, Mycobacterium tuberculosis
AAPGFGNSTTSPSSGF

SEQ ID NO: 1542733 - protein, 41 aa, Mycobacterium tuberculosis
AAPGGNGRDGAGVGPRAPGPFDGHPSPARRCRAGPGGFRRG

SEQ ID NO: 1542734 - protein, 16 aa, Mycobacterium tuberculosis
AAPGIGNSTTSPSSGF

SEQ ID NO: 1542735 - protein, 12 aa, Mycobacterium tuberculosis
AAPGNQALGVTL

SEQ ID NO: 1542736 - protein, 21 aa, Mycobacterium tuberculosis
AAPGTHMDTSRSVGPTGKVKA

SEQ ID NO: 1542737 - protein, 16 aa, Mycobacterium tuberculosis
AAPGVGNTTTAPSSGF

SEQ ID NO: 1542738 - protein, 26 aa, Mycobacterium tuberculosis
AAPPPPDPLAGPPGDAGLAPPAPGPA

SEQ ID NO: 1542739 - protein, 11 aa, Mycobacterium tuberculosis
AAPQATAPALS

SEQ ID NO: 1542740 - protein, 8 aa, Mycobacterium tuberculosis
AAPSVPGV

SEQ ID NO: 1542741 - protein, 18 aa, Mycobacterium tuberculosis
AAPVARAGRAHPEVPAGR

SEQ ID NO: 1542742 - protein, 13 aa, Mycobacterium tuberculosis
AAPVTAGAPTGTA

SEQ ID NO: 1542743 - protein, 7 aa, Mycobacterium tuberculosis
AAPWGGR

SEQ ID NO: 1542744 - protein, 11 aa, Mycobacterium tuberculosis
AAQAAAAAAER

SEQ ID NO: 1542745 - protein, 14 aa, Mycobacterium tuberculosis
AAQAEQAAGQAQAA

SEQ ID NO: 1542746 - protein, 15 aa, Mycobacterium tuberculosis
AAQPGSRLYRNGERG

SEQ ID NO: 1542747 - protein, 9 aa, Mycobacterium tuberculosis
AAQRAGDAL

SEQ ID NO: 1542748 - protein, 13 aa, Mycobacterium tuberculosis
AAQSAGAAGQARA

SEQ ID NO: 1542749 - protein, 11 aa, Mycobacterium tuberculosis
AAQTATRDQNV

SEQ ID NO: 1542750 - protein, 14 aa, Mycobacterium tuberculosis
AARAAGAAAQAKAV

SEQ ID NO: 1542751 - protein, 5 aa, Mycobacterium tuberculosis
AARAG

SEQ ID NO: 1542752 - protein, 10 aa, Mycobacterium tuberculosis
AARAGPAAAA

SEQ ID NO: 1542753 - protein, 11 aa, Mycobacterium tuberculosis
AARAGPAAAAA

SEQ ID NO: 1542754 - protein, 10 aa, Mycobacterium tuberculosis
AARDGGAGAV

SEQ ID NO: 1542755 - protein, 4 aa, Mycobacterium tuberculosis
AARG

SEQ ID NO: 1542756 - protein, 55 aa, Mycobacterium tuberculosis; identical to SEQ ID NO: 193570

SEQ ID NO: 1542757 - protein, 4 aa, Mycobacterium tuberculosis
AARR

SEQ ID NO: 1542758 - protein, 11 aa, Mycobacterium tuberculosis
AARRGAGSASV

SEQ ID NO: 1542759 - protein, 6 aa, Mycobacterium tuberculosis
AARSPY

SEQ ID NO: 1542760 - protein, 10 aa, Mycobacterium tuberculosis
AASAAASAPT

SEQ ID NO: 1542761 - protein, 11 aa, Mycobacterium tuberculosis
AASAAPADKAG

SEQ ID NO: 1542762 - protein, 10 aa, Mycobacterium tuberculosis
AASADTGLPI

SEQ ID NO: 1542763 - protein, 14 aa, Mycobacterium tuberculosis
AASAYASAKATNVE

SEQ ID NO: 1542764 - protein, 13 aa, Mycobacterium tuberculosis
AASDPRRDGQAAA

SEQ ID NO: 1542765 - protein, 7 aa, Mycobacterium tuberculosis
AASGAAG

SEQ ID NO: 1542766 - protein, 6 aa, Mycobacterium tuberculosis
AASGVS

SEQ ID NO: 1542767 - protein, 9 aa, Mycobacterium tuberculosis
AASKTAQEH

SEQ ID NO: 1542768 - protein, 8 aa, Mycobacterium tuberculosis
AASKTNPT

SEQ ID NO: 1542769 - protein, 19 aa, Mycobacterium tuberculosis
AASPTGPAIAGESSAVAAG

SEQ ID NO: 1542770 - protein, 24 aa, Mycobacterium tuberculosis
AASQLDNAAPDDVEITDSSAAAEY

SEQ ID NO: 1542771 - protein, 17 aa, Mycobacterium tuberculosis
AATAASAATAATAAAPR

SEQ ID NO: 1542772 - protein, 46 aa, Mycobacterium tuberculosis
AATAATAAPRPAAPAAKGRPASPTQARSQGSAATAASAAPAQHPDH

SEQ ID NO: 1542773 - protein, 9 aa, Mycobacterium tuberculosis
AATAGFSRP

SEQ ID NO: 1542774 - protein, 7 aa, Mycobacterium tuberculosis
AATAGPQ

SEQ ID NO: 1542775 - protein, 5 aa, Mycobacterium tuberculosis
AATEA

SEQ ID NO: 1542776 - protein, 12 aa, Mycobacterium tuberculosis
AATEPNHPAYGA

SEQ ID NO: 1542777 - protein, 8 aa, Mycobacterium tuberculosis
AATNGEEF

SEQ ID NO: 1542778 - protein, 14 aa, Mycobacterium tuberculosis
AAVASGARATPAAA

SEQ ID NO: 1542779 - protein, 23 aa, Mycobacterium tuberculosis
AAVTAATAATAPAPPSRAATAVT

SEQ ID NO: 1542780 - protein, 16 aa, Mycobacterium tuberculosis
ACAPGPAAAVGAGAAE

SEQ ID NO: 1542781 - protein, 22 aa, Mycobacterium tuberculosis
ACSGDGSATRSLTRSPCWSTSH

SEQ ID NO: 1542782 - protein, 17 aa, Mycobacterium tuberculosis
ACSPQKSPQPSSPRLPD

SEQ ID NO: 1542783 - protein, 8 aa, Mycobacterium tuberculosis
ADAEGVTK

SEQ ID NO: 1542784 - protein, 4 aa, Mycobacterium tuberculosis
ADAG

SEQ ID NO: 1542785 - protein, 13 aa, Mycobacterium tuberculosis
ADAGNDDEHGSAL

SEQ ID NO: 1542786 - protein, 5 aa, Mycobacterium tuberculosis
ADCAA

SEQ ID NO: 1542787 - protein, 12 aa, Mycobacterium tuberculosis
ADDAPDQPPQKN

SEQ ID NO: 1542788 - protein, 8 aa, Mycobacterium tuberculosis
ADDTSTVP

SEQ ID NO: 1542789 - protein, 4 aa, Mycobacterium tuberculosis
ADDY

SEQ ID NO: 1542790 - protein, 6 aa, Mycobacterium tuberculosis
ADELST

SEQ ID NO: 1542791 - protein, 6 aa, Mycobacterium tuberculosis
ADEVSA

SEQ ID NO: 1542792 - protein, 8 aa, Mycobacterium tuberculosis
ADGDGEPV

SEQ ID NO: 1542793 - protein, 4 aa, Mycobacterium tuberculosis
ADND

SEQ ID NO: 1542794 - protein, 13 aa, Mycobacterium tuberculosis
ADPAAHPLGTPSG

SEQ ID NO: 1542795 - protein, 7 aa, Mycobacterium tuberculosis
ADPDRAT

SEQ ID NO: 1542796 - protein, 7 aa, Mycobacterium tuberculosis
ADPRLNT

SEQ ID NO: 1542797 - protein, 14 aa, Mycobacterium tuberculosis
ADPTPPGDSQLPAG

SEQ ID NO: 1542798 - protein, 24 aa, Mycobacterium tuberculosis
ADQAKKQNLAADVGATQQVGTQQV

SEQ ID NO: 1542799 - protein, 43 aa, Mycobacterium tuberculosis
ADQEPTPTARAAGPAGPPGAAGPAGPANGQASTASATGATGLP

SEQ ID NO: 1542800 - protein, 44 aa, Mycobacterium tuberculosis
ADQEPTPTARAAGPAGPPGAAGPAGPANGQASTASATGATGLPE

SEQ ID NO: 1542801 - protein, 16 aa, Mycobacterium tuberculosis
ADQQEHRDIRSQLPGQ

SEQ ID NO: 1542802 - protein, 13 aa, Mycobacterium tuberculosis
ADQRTPQQRLGGR

SEQ ID NO: 1542803 - protein, 10 aa, Mycobacterium tuberculosis
ADRLERDPAG

SEQ ID NO: 1542804 - protein, 44 aa, Mycobacterium tuberculosis
ADRPDGDGGRGRSADEFAGSGGDVAGGADGAGGRWSADAGGRWS

SEQ ID NO: 1542805 - protein, 8 aa, Mycobacterium tuberculosis
ADRPDQPL

SEQ ID NO: 1542806 - protein, 13 aa, Mycobacterium tuberculosis
ADRRRRGVDGYRG

SEQ ID NO: 1542807 - protein, 6 aa, Mycobacterium tuberculosis
ADRRYS

SEQ ID NO: 1542808 - protein, 7 aa, Mycobacterium tuberculosis
ADRTDAP

SEQ ID NO: 1542809 - protein, 18 aa, Mycobacterium tuberculosis
ADRTGAGAVSATGGFPER

SEQ ID NO: 1542810 - protein, 5 aa, Mycobacterium tuberculosis
ADRYR

SEQ ID NO: 1542811 - protein, 14 aa, Mycobacterium tuberculosis
ADSAVRKKGNDFAT

SEQ ID NO: 1542812 - protein, 19 aa, Mycobacterium tuberculosis
ADSDRYGGGQGNDLDGAAP

SEQ ID NO: 1542813 - protein, 6 aa, Mycobacterium tuberculosis
ADSGAK

SEQ ID NO: 1542814 - protein, 4 aa, Mycobacterium tuberculosis
ADSQ

SEQ ID NO: 1542815 - protein, 11 aa, Mycobacterium tuberculosis
ADSSRNVKGDS

SEQ ID NO: 1542816 - protein, 6 aa, Mycobacterium tuberculosis
ADTPDK

SEQ ID NO: 1542817 - protein, 58 aa, Mycobacterium tuberculosis
ADTRPAGSADAAVASQPSAVPAGPAGRAGAAGPSGPAMADQPGRPAGTPGLANRPGTA

SEQ ID NO: 1542818 - protein, 4 aa, Mycobacterium tuberculosis
ADTS

SEQ ID NO: 1542819 - protein, 7 aa, Mycobacterium tuberculosis
ADVRSGN

SEQ ID NO: 1542820 - protein, 14 aa, Mycobacterium tuberculosis
AEAAAEQQVQGQQA

SEQ ID NO: 1542821 - protein, 32 aa, Mycobacterium tuberculosis
AEAAATAGAAGAAHPTGAAGAAVAEQLGGRSA

SEQ ID NO: 1542822 - protein, 9 aa, Mycobacterium tuberculosis
AEAGDPAGQ

SEQ ID NO: 1542823 - protein, 11 aa, Mycobacterium tuberculosis
AEATPRTAASV

SEQ ID NO: 1542824 - protein, 7 aa, Mycobacterium tuberculosis
AEAVAGQ

SEQ ID NO: 1542825 - protein, 22 aa, Mycobacterium tuberculosis
AEAYSAADRISSRPQARTSARS

SEQ ID NO: 1542826 - protein, 7 aa, Mycobacterium tuberculosis
AEEAGPV

SEQ ID NO: 1542827 - protein, 6 aa, Mycobacterium tuberculosis
AEETLQ

SEQ ID NO: 1542828 - protein, 6 aa, Mycobacterium tuberculosis
AEGEPE

SEQ ID NO: 1542829 - protein, 7 aa, Mycobacterium tuberculosis
AEGPPGL

SEQ ID NO: 1542830 - protein, 5 aa, Mycobacterium tuberculosis
AEGRV

SEQ ID NO: 1542831 - protein, 8 aa, Mycobacterium tuberculosis
AEHARESA

SEQ ID NO: 1542832 - protein, 18 aa, Mycobacterium tuberculosis
AEHRPGRSTRRLEPRTLP

SEQ ID NO: 1542833 - protein, 9 aa, Mycobacterium tuberculosis
AELGAEGAG

SEQ ID NO: 1542834 - protein, 20 aa, Mycobacterium tuberculosis
AELPAPPSPPAPPAPPPPTP

SEQ ID NO: 1542835 - protein, 7 aa, Mycobacterium tuberculosis
AELSDPL

SEQ ID NO: 1542836 - protein, 14 aa, Mycobacterium tuberculosis
AEPAVTANAADTVA

SEQ ID NO: 1542837 - protein, 13 aa, Mycobacterium tuberculosis
AEPIPATSEATDI

SEQ ID NO: 1542838 - protein, 4 aa, Mycobacterium tuberculosis
AEPK

SEQ ID NO: 1542839 - protein, 24 aa, Mycobacterium tuberculosis
AEPPARGGRCRPPNWKRPSTPGSI

SEQ ID NO: 1542840 - protein, 4 aa, Mycobacterium tuberculosis
AEPQ

SEQ ID NO: 1542841 - protein, 15 aa, Mycobacterium tuberculosis
AEPTRQGRPIREPDR

SEQ ID NO: 1542842 - protein, 8 aa, Mycobacterium tuberculosis
AEPVEPAD

SEQ ID NO: 1542843 - protein, 4 aa, Mycobacterium tuberculosis
AEQD

SEQ ID NO: 1542844 - protein, 47 aa, Mycobacterium tuberculosis
AEQQPALTARTPDTADTPGAGGVGASPAGAAVASANKKGQRAGGAAA

SEQ ID NO: 1542845 - protein, 5 aa, Mycobacterium tuberculosis
AERPA

SEQ ID NO: 1542846 - protein, 25 aa, Mycobacterium tuberculosis
AESHRPRLGGAEEGVARITSAACPV

SEQ ID NO: 1542847 - protein, 31 aa, Mycobacterium tuberculosis; identical to SEQ ID NO: 149562

SEQ ID NO: 1542848 - protein, 14 aa, Mycobacterium tuberculosis
AETRARRRNAQNVA

SEQ ID NO: 1542849 - protein, 6 aa, Mycobacterium tuberculosis
AEVPAA

SEQ ID NO: 1542850 - protein, 10 aa, Mycobacterium tuberculosis
AEVPAAGGPM

SEQ ID NO: 1542851 - protein, 17 aa, Mycobacterium tuberculosis
AFRGGADDGFGAQPDPL

SEQ ID NO: 1542852 - protein, 11 aa, Mycobacterium tuberculosis
AGAAEAMQDAE

SEQ ID NO: 1542853 - protein, 8 aa, Mycobacterium tuberculosis
AGAAGTTV

SEQ ID NO: 1542854 - protein, 8 aa, Mycobacterium tuberculosis
AGAAGVGN

SEQ ID NO: 1542855 - protein, 9 aa, Mycobacterium tuberculosis
AGADDQPRY

SEQ ID NO: 1542856 - protein, 25 aa, Mycobacterium tuberculosis
AGADKSWRGNAEDVGDAGARRARWG

SEQ ID NO: 1542857 - protein, 13 aa, Mycobacterium tuberculosis
AGAGAYASAEAAG

SEQ ID NO: 1542858 - protein, 11 aa, Mycobacterium tuberculosis
AGAGGAGGAGG

SEQ ID NO: 1542859 - protein, 15 aa, Mycobacterium tuberculosis
AGAGSGVANAGTLSS

SEQ ID NO: 1542860 - protein, 9 aa, Mycobacterium tuberculosis
AGAGSLFGP

SEQ ID NO: 1542861 - protein, 18 aa, Mycobacterium tuberculosis
AGAGSYAAAEAASAAPLE

SEQ ID NO: 1542862 - protein, 7 aa, Mycobacterium tuberculosis
AGAQGQV

SEQ ID NO: 1542863 - protein, 9 aa, Mycobacterium tuberculosis
AGARRGKAA

SEQ ID NO: 1542864 - protein, 4 aa, Mycobacterium tuberculosis
AGAS

SEQ ID NO: 1542865 - protein, 6 aa, Mycobacterium tuberculosis
AGASRV

SEQ ID NO: 1542866 - protein, 40 aa, Mycobacterium tuberculosis
AGATRAARSSGTNATVAARAANQPAGPALAAEAPGAPPFA

SEQ ID NO: 1542867 - protein, 10 aa, Mycobacterium tuberculosis
AGAVGGNGQL

SEQ ID NO: 1542868 - protein, 8 aa, Mycobacterium tuberculosis
AGDEPGGA

SEQ ID NO: 1542869 - protein, 13 aa, Mycobacterium tuberculosis
AGDGSKKDCKQNP

SEQ ID NO: 1542870 - protein, 10 aa, Mycobacterium tuberculosis
AGDREPLSGR

SEQ ID NO: 1542871 - protein, 15 aa, Mycobacterium tuberculosis
AGDSNTGFANAGNVN

SEQ ID NO: 1542872 - protein, 4 aa, Mycobacterium tuberculosis
AGEA

SEQ ID NO: 1542873 - protein, 18 aa, Mycobacterium tuberculosis
AGEATPTQRLVALTGRKP

SEQ ID NO: 1542874 - protein, 7 aa, Mycobacterium tuberculosis
AGERGTD

SEQ ID NO: 1542875 - protein, 433 aa, Mycobacterium tuberculosis
AGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGTGGTGGKGGAGGAGGQGGSSGAGGTNGSGGAGGTGGQGGAGGAGGAGADNPTGIGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGL

SEQ ID NO: 1542876 - protein, 22 aa, Mycobacterium tuberculosis
AGGAAGPLGAKKGGQYPIGGDG

SEQ ID NO: 1542877 - protein, 11 aa, Mycobacterium tuberculosis
AGGAGGAGGAT

SEQ ID NO: 1542878 - protein, 51 aa, Mycobacterium tuberculosis
AGGAGGAGGFDDASGPAGLAGPAGCSGPGGGSGGVGGFGDTGGDRRRRRQR

SEQ ID NO: 1542879 - protein, 53 aa, Mycobacterium tuberculosis
AGGAGGAGGFSDTGGTGGAGGAGGLFGPGGGSGGVGGFGDTGGTGGDGGSGGL

SEQ ID NO: 1542880 - protein, 11 aa, Mycobacterium tuberculosis
AGGAGGHGGAA

SEQ ID NO: 1542881 - protein, 7 aa, Mycobacterium tuberculosis
AGGAGQP

SEQ ID NO: 1542882 - protein, 7 aa, Mycobacterium tuberculosis
AGGDCGR

SEQ ID NO: 1542883 - protein, 8 aa, Mycobacterium tuberculosis
AGGGGGIG

SEQ ID NO: 1542884 - protein, 7 aa, Mycobacterium tuberculosis
AGGGGTL

SEQ ID NO: 1542885 - protein, 16 aa, Mycobacterium tuberculosis
AGGGPSQLASMGSQQA

SEQ ID NO: 1542886 - protein, 7 aa, Mycobacterium tuberculosis
AGGGVDV

SEQ ID NO: 1542887 - protein, 31 aa, Mycobacterium tuberculosis
AGGHGGAGGAGGNQTGGVGNGGAGGTGGNAG

SEQ ID NO: 1542888 - protein, 25 aa, Mycobacterium tuberculosis
AGGHGGAGGLGAVTGGVGGAGGAGG

SEQ ID NO: 1542889 - protein, 25 aa, Mycobacterium tuberculosis
AGGHGGAGGPGPIGGVGGHGGVGGA

SEQ ID NO: 1542890 - protein, 25 aa, Mycobacterium tuberculosis
AGGIGGIGGNANGGAGGNGGTGGQL

SEQ ID NO: 1542891 - protein, 25 aa, Mycobacterium tuberculosis
AGGLGGGCSTRSGPTPTPEPASRGV

SEQ ID NO: 1542892 - protein, 10 aa, Mycobacterium tuberculosis
AGGLQPGEEP

SEQ ID NO: 1542893 - protein, 21 aa, Mycobacterium tuberculosis
AGGPDGGGTSRRLRSGPTSSA

SEQ ID NO: 1542894 - protein, 6 aa, Mycobacterium tuberculosis
AGGPVR

SEQ ID NO: 1542895 - protein, 38 aa, Mycobacterium tuberculosis
AGGTGGTGGIGGQNTETGPAASNGGAGGAGGGGRVPGR

SEQ ID NO: 1542896 - protein, 6 aa, Mycobacterium tuberculosis
AGGTGL

SEQ ID NO: 1542897 - protein, 40 aa, Mycobacterium tuberculosis
AGHDDDLTASRPPTTGAQSPQLSYERRPGRRTQSGHRQDH

SEQ ID NO: 1542898 - protein, 130 aa, Mycobacterium tuberculosis
AGHGGNGGNGGNGGNGSAGAGGQGGAGGSAGNGGHGGGATGGDGGNGGNGGNSGNSTGVAGLAGGAAGAGGNGGGISSAAGHGGSGGNGGSGGSGGSGTTGGAGAAGGNGGAGAGGGSLSTGQSGGPRRQ

SEQ ID NO: 1542899 - protein, 130 aa, Mycobacterium tuberculosis
AGHGGNGGNGGNGGNGSAGAGGQGGAGGSAGNGGHGGGATGGDGGNGGNGGNSGNSTGVAGLAGGAAGAGGNGGGTSSAAGHGGSGGNGGSGGSGGSGTTGGAGAAGGNGGAGAGGGSLSTGQSGGPRRQ

SEQ ID NO: 1542900 - protein, 6 aa, Mycobacterium tuberculosis
AGHSRE

SEQ ID NO: 1542901 - protein, 8 aa, Mycobacterium tuberculosis
AGIGGAGG

SEQ ID NO: 1542902 - protein, 29 aa, Mycobacterium tuberculosis
AGIQPSVGAVGSSYDNACREKRSTAYTRP

SEQ ID NO: 1542903 - protein, 16 aa, Mycobacterium tuberculosis
AGKELSGLSSRDYPGA

SEQ ID NO: 1542904 - protein, 12 aa, Mycobacterium tuberculosis
AGKTGTAQLDQP

SEQ ID NO: 1542905 - protein, 17 aa, Mycobacterium tuberculosis
AGNGGIPGGSWAQPGVA

SEQ ID NO: 1542906 - protein, 9 aa, Mycobacterium tuberculosis
AGNLGGSNL

SEQ ID NO: 1542907 - protein, 15 aa, Mycobacterium tuberculosis
AGNMSGSGNFGAGNS

SEQ ID NO: 1542908 - protein, 31 aa, Mycobacterium tuberculosis; identical to SEQ ID NO: 149655

SEQ ID NO: 1542909 - protein, 21 aa, Mycobacterium tuberculosis
AGNTGGAAQCPPQAPGVTRDS

SEQ ID NO: 1542910 - protein, 10 aa, Mycobacterium tuberculosis
AGPQLPTGLQ

SEQ ID NO: 1542911 - protein, 8 aa, Mycobacterium tuberculosis
AGPTTALA

SEQ ID NO: 1542912 - protein, 9 aa, Mycobacterium tuberculosis
AGPWSGPAS

SEQ ID NO: 1542913 - protein, 24 aa, Mycobacterium tuberculosis
AGQGTIRRSGDRAEGTFNSDMGGG

SEQ ID NO: 1542914 - protein, 14 aa, Mycobacterium tuberculosis
AGQPGNDGFSGVAP

SEQ ID NO: 1542915 - protein, 5 aa, Mycobacterium tuberculosis
AGRAV

SEQ ID NO: 1542916 - protein, 16 aa, Mycobacterium tuberculosis
AGRDPKRGPSAPRAPS

SEQ ID NO: 1542917 - protein, 10 aa, Mycobacterium tuberculosis
AGRDQIPYQP

SEQ ID NO: 1542918 - protein, 10 aa, Mycobacterium tuberculosis
AGRGAGKYPT

SEQ ID NO: 1542919 - protein, 13 aa, Mycobacterium tuberculosis
AGRGNLDRRGAAA

SEQ ID NO: 1542920 - protein, 9 aa, Mycobacterium tuberculosis
AGRKAGARL

SEQ ID NO: 1542921 - protein, 26 aa, Mycobacterium tuberculosis
AGRPGEVPPNVPGTPVPIPQEAPPGH

SEQ ID NO: 1542922 - protein, 55 aa, Mycobacterium tuberculosis
AGRPGEVPPNVPGTPVPIPRGSPRGTHAAPRAGAWSGSAPGGARPAGTTGPRAAV

SEQ ID NO: 1542923 - protein, 12 aa, Mycobacterium tuberculosis
AGRQSSQSVPGL

SEQ ID NO: 1542924 - protein, 8 aa, Mycobacterium tuberculosis
AGRRRPGK

SEQ ID NO: 1542925 - protein, 6 aa, Mycobacterium tuberculosis
AGRRTA

SEQ ID NO: 1542926 - protein, 7 aa, Mycobacterium tuberculosis
AGRVATR

SEQ ID NO: 1542927 - protein, 14 aa, Mycobacterium tuberculosis
AGSGTGTGGAGPRY

SEQ ID NO: 1542928 - protein, 7 aa, Mycobacterium tuberculosis
AGSSIPA

SEQ ID NO: 1542929 - protein, 31 aa, Mycobacterium tuberculosis
AGSYNTGSFNAGEANTGGFNPGQCQHGLVEH

SEQ ID NO: 1542930 - protein, 25 aa, Mycobacterium tuberculosis
AGSYNTGSFNAGEANTGGFNPGSVN

SEQ ID NO: 1542931 - protein, 6 aa, Mycobacterium tuberculosis
AGTAGA

SEQ ID NO: 1542932 - protein, 17 aa, Mycobacterium tuberculosis
AGTASNETVAAPAGLTT

SEQ ID NO: 1542933 - protein, 20 aa, Mycobacterium tuberculosis
AGTAVAAAGGGGAQGSKNYK

SEQ ID NO: 1542934 - protein, 10 aa, Mycobacterium tuberculosis
AGTFPARNRP

SEQ ID NO: 1542935 - protein, 42 aa, Mycobacterium tuberculosis; identical to SEQ ID NO: 1425401

SEQ ID NO: 1542936 - protein, 43 aa, Mycobacterium tuberculosis; identical to SEQ ID NO: 1424029

SEQ ID NO: 1542937 - protein, 16 aa, Mycobacterium tuberculosis
AGTGTPAGPPAPFGPD

SEQ ID NO: 1542938 - protein, 18 aa, Mycobacterium tuberculosis
AGTPAGSRRAQPAADNVT

SEQ ID NO: 1542939 - protein, 9 aa, Mycobacterium tuberculosis
AGTRDADMA

SEQ ID NO: 1542940 - protein, 10 aa, Mycobacterium tuberculosis
AGTRDADMAA

SEQ ID NO: 1542941 - protein, 29 aa, Mycobacterium tuberculosis
AGTVGADGTAVAARGTTGTGVSALSASPT

SEQ ID NO: 1542942 - protein, 7 aa, Mycobacterium tuberculosis
AGTYGVT

SEQ ID NO: 1542943 - protein, 42 aa, Mycobacterium tuberculosis; identical to SEQ ID NO: 229008

SEQ ID NO: 1542944 - protein, 50 aa, Mycobacterium tuberculosis
AGWQEGRRGWRGHGRPAPVTPADRQWRGRARDRPQRHPRRRGDGPDHLVG

SEQ ID NO: 1542945 - protein, 13 aa, Mycobacterium tuberculosis
AGYVATTTRVGGP

SEQ ID NO: 1542946 - protein, 17 aa, Mycobacterium tuberculosis
AHDGEHGDRADAAPTSD

SEQ ID NO: 1542947 - protein, 7 aa, Mycobacterium tuberculosis
AHGPPLS

SEQ ID NO: 1542948 - protein, 14 aa, Mycobacterium tuberculosis
AHGQRGAGEAQERI

SEQ ID NO: 1542949 - protein, 4 aa, Mycobacterium tuberculosis
AHGT

SEQ ID NO: 1542950 - protein, 12 aa, Mycobacterium tuberculosis
AHPEFQPRAGSM

SEQ ID NO: 1542951 - protein, 9 aa, Mycobacterium tuberculosis
AHSAANGGV

SEQ ID NO: 1542952 - protein, 10 aa, Mycobacterium tuberculosis
AIGTGRNPRW

SEQ ID NO: 1542953 - protein, 21 aa, Mycobacterium tuberculosis
AINNDGSAKMGYAAPNPAAQA

SEQ ID NO: 1542954 - protein, 5 aa, Mycobacterium tuberculosis
AIPNF

SEQ ID NO: 1542955 - protein, 12 aa, Mycobacterium tuberculosis
AIRSQQSAYASH

SEQ ID NO: 1542956 - protein, 6 aa, Mycobacterium tuberculosis
AISGGA

SEQ ID NO: 1542957 - protein, 8 aa, Mycobacterium tuberculosis
AISKRGAA

SEQ ID NO: 1542958 - protein, 29 aa, Mycobacterium tuberculosis
AITERDGAASGAADTAGATLKGAIGGGAT

SEQ ID NO: 1542959 - protein, 7 aa, Mycobacterium tuberculosis
AITGSGD

SEQ ID NO: 1542960 - protein, 8 aa, Mycobacterium tuberculosis
AITVPGTA

SEQ ID NO: 1542961 - protein, 14 aa, Mycobacterium tuberculosis
AKAAEGEVDADSVR

SEQ ID NO: 1542962 - protein, 8 aa, Mycobacterium tuberculosis
AKAAGLTP

SEQ ID NO: 1542963 - protein, 13 aa, Mycobacterium tuberculosis
AKAEGRDTINGQN

SEQ ID NO: 1542964 - protein, 7 aa, Mycobacterium tuberculosis
AKATSRV

SEQ ID NO: 1542965 - protein, 4 aa, Mycobacterium tuberculosis
AKDA

SEQ ID NO: 1542966 - protein, 13 aa, Mycobacterium tuberculosis
AKDQREQAEPTAP

SEQ ID NO: 1542967 - protein, 8 aa, Mycobacterium tuberculosis
AKELAPGQ

SEQ ID NO: 1542968 - protein, 10 aa, Mycobacterium tuberculosis
AKGGNPQSCG

SEQ ID NO: 1542969 - protein, 11 aa, Mycobacterium tuberculosis
AKGTTLKNART

SEQ ID NO: 1542970 - protein, 9 aa, Mycobacterium tuberculosis
AKIGPDKDI

SEQ ID NO: 1542971 - protein, 7 aa, Mycobacterium tuberculosis
AKQAPGW

SEQ ID NO: 1542972 - protein, 8 aa, Mycobacterium tuberculosis
AKQAPGWR

SEQ ID NO: 1542973 - protein, 11 aa, Mycobacterium tuberculosis
AKRRRTAHSAI

SEQ ID NO: 1542974 - protein, 6 aa, Mycobacterium tuberculosis
AKSIGE

SEQ ID NO: 1542975 - protein, 6 aa, Mycobacterium tuberculosis
AKSVAA

SEQ ID NO: 1542976 - protein, 6 aa, Mycobacterium tuberculosis
ALAEAG

SEQ ID NO: 1542977 - protein, 11 aa, Mycobacterium tuberculosis
ALAPAAADEVS

SEQ ID NO: 1542978 - protein, 9 aa, Mycobacterium tuberculosis
ALARPGTRR

SEQ ID NO: 1542979 - protein, 24 aa, Mycobacterium tuberculosis
ALASGGHSGRRSIAPTPPAPRRAR

SEQ ID NO: 1542980 - protein, 11 aa, Mycobacterium tuberculosis
ALEDGSGQARK

SEQ ID NO: 1542981 - protein, 5 aa, Mycobacterium tuberculosis
ALEPE

SEQ ID NO: 1542982 - protein, 5 aa, Mycobacterium tuberculosis
ALGAA

SEQ ID NO: 1542983 - protein, 15 aa, Mycobacterium tuberculosis
ALGDHSKDIFSTVTN

SEQ ID NO: 1542984 - protein, 6 aa, Mycobacterium tuberculosis
ALPAGL

SEQ ID NO: 1542985 - protein, 5 aa, Mycobacterium tuberculosis
ALPGA

SEQ ID NO: 1542986 - protein, 21 aa, Mycobacterium tuberculosis
ALPGGSSNRFSPAPAPAPIAS

SEQ ID NO: 1542987 - protein, 7 aa, Mycobacterium tuberculosis
ALPPTEP

SEQ ID NO: 1542988 - protein, 21 aa, Mycobacterium tuberculosis
ALPSPDEQAPAKAPPSPYPAR

SEQ ID NO: 1542989 - protein, 12 aa, Mycobacterium tuberculosis
ALQPPGGGLSTF

SEQ ID NO: 1542990 - protein, 7 aa, Mycobacterium tuberculosis
ALRGTAE

SEQ ID NO: 1542991 - protein, 5 aa, Mycobacterium tuberculosis
ALTAD

SEQ ID NO: 1542992 - protein, 15 aa, Mycobacterium tuberculosis
ALTNSLGESKPPQVH

SEQ ID NO: 1542993 - protein, 12 aa, Mycobacterium tuberculosis
ALTTEGADRPTA

SEQ ID NO: 1542994 - protein, 9 aa, Mycobacterium tuberculosis
AMAAAAAPY

SEQ ID NO: 1542995 - protein, 9 aa, Mycobacterium tuberculosis
AMAPAAAPY

SEQ ID NO: 1542996 - protein, 5 aa, Mycobacterium tuberculosis
AMPDP

SEQ ID NO: 1542997 - protein, 6 aa, Mycobacterium tuberculosis
AMPPSS

SEQ ID NO: 1542998 - protein, 4 aa, Mycobacterium tuberculosis
AMPT

SEQ ID NO: 1542999 - protein, 18 aa, Mycobacterium tuberculosis
ANAASNAATAARACPATA

SEQ ID NO: 1543000 - protein, 7 aa, Mycobacterium tuberculosis
ANADAAR

SEQ ID NO: 1543001 - protein, 8 aa, Mycobacterium tuberculosis
ANAGGGNI

SEQ ID NO: 1543002 - protein, 56 aa, Mycobacterium tuberculosis; identical to SEQ ID NO: 229048

SEQ ID NO: 1543003 - protein, 15 aa, Mycobacterium tuberculosis
ANGAPGTGANGGDGG

SEQ ID NO: 1543004 - protein, 19 aa, Mycobacterium tuberculosis
ANGNNGDVNFGGGNTGDFN

SEQ ID NO: 1543005 - protein, 19 aa, Mycobacterium tuberculosis
ANGRQPMPPSRPPPKRLPN

SEQ ID NO: 1543006 - protein, 6 aa, Mycobacterium tuberculosis
ANHDGT

SEQ ID NO: 1543007 - protein, 20 aa, Mycobacterium tuberculosis
ANIGSTINAANAAAALPTTG

SEQ ID NO: 1543008 - protein, 6 aa, Mycobacterium tuberculosis
ANLPPD

SEQ ID NO: 1543009 - protein, 17 aa, Mycobacterium tuberculosis
ANPERAPCGREPPPDLA

SEQ ID NO: 1543010 - protein, 18 aa, Mycobacterium tuberculosis
ANPTRPPANPQALTPPKV

SEQ ID NO: 1543011 - protein, 7 aa, Mycobacterium tuberculosis
ANQIADP

SEQ ID NO: 1543012 - protein, 16 aa, Mycobacterium tuberculosis
ANSASRGQPPACWPRR

SEQ ID NO: 1543013 - protein, 4 aa, Mycobacterium tuberculosis
ANSG

SEQ ID NO: 1543014 - protein, 7 aa, Mycobacterium tuberculosis
ANSGLTP

SEQ ID NO: 1543015 - protein, 13 aa, Mycobacterium tuberculosis
ANSPKPGRAPTGL

SEQ ID NO: 1543016 - protein, 18 aa, Mycobacterium tuberculosis
ANSSTTGDDGWKEMLAPA

SEQ ID NO: 1543017 - protein, 8 aa, Mycobacterium tuberculosis
ANTGNGNI

SEQ ID NO: 1543018 - protein, 8 aa, Mycobacterium tuberculosis
ANTGSGNI

SEQ ID NO: 1543019 - protein, 8 aa, Mycobacterium tuberculosis
ANTGSNNL

SEQ ID NO: 1543020 - protein, 7 aa, Mycobacterium tuberculosis
ANVAPPL

SEQ ID NO: 1543021 - protein, 6 aa, Mycobacterium tuberculosis
ANVGNT

SEQ ID NO: 1543022 - protein, 6 aa, Mycobacterium tuberculosis
ANVGTT

SEQ ID NO: 1543023 - protein, 18 aa, Mycobacterium tuberculosis
APAAAAQAVQTAAQNGVQ

SEQ ID NO: 1543024 - protein, 9 aa, Mycobacterium tuberculosis
APAAALSGR

SEQ ID NO: 1543025 - protein, 18 aa, Mycobacterium tuberculosis
APAAAQAVETAAQNGVQA

SEQ ID NO: 1543026 - protein, 7 aa, Mycobacterium tuberculosis
APAASAV

SEQ ID NO: 1543027 - protein, 17 aa, Mycobacterium tuberculosis
APAATAAPLAKVATAAR

SEQ ID NO: 1543028 - protein, 12 aa, Mycobacterium tuberculosis
APADGPDDAALE

SEQ ID NO: 1543029 - protein, 4 aa, Mycobacterium tuberculosis
APAE

SEQ ID NO: 1543030 - protein, 17 aa, Mycobacterium tuberculosis
APAEASEVSAHAEPAGP

SEQ ID NO: 1543031 - protein, 8 aa, Mycobacterium tuberculosis
APAGDGTV

SEQ ID NO: 1543032 - protein, 6 aa, Mycobacterium tuberculosis
APAGGA

SEQ ID NO: 1543033 - protein, 5 aa, Mycobacterium tuberculosis
APAGY

SEQ ID NO: 1543034 - protein, 8 aa, Mycobacterium tuberculosis
APALPDDL

SEQ ID NO: 1543035 - protein, 12 aa, Mycobacterium tuberculosis
APAPAPAPTDLA

SEQ ID NO: 1543036 - protein, 11 aa, Mycobacterium tuberculosis
APAPTTPSPWT

SEQ ID NO: 1543037 - protein, 5 aa, Mycobacterium tuberculosis
APAPV

SEQ ID NO: 1543038 - protein, 20 aa, Mycobacterium tuberculosis
APAQAPAPAPGSAPVGLPGA

SEQ ID NO: 1543039 - protein, 19 aa, Mycobacterium tuberculosis
APAQAPAQERGSDALSTTC

SEQ ID NO: 1543040 - protein, 14 aa, Mycobacterium tuberculosis
APASLHRGQASQCG

SEQ ID NO: 1543041 - protein, 5 aa, Mycobacterium tuberculosis
APATT

SEQ ID NO: 1543042 - protein, 17 aa, Mycobacterium tuberculosis
APCSGDAANAPPPPSAI

SEQ ID NO: 1543043 - protein, 13 aa, Mycobacterium tuberculosis
APDAQSDNFSGVA

SEQ ID NO: 1543044 - protein, 7 aa, Mycobacterium tuberculosis
APDGGAY

SEQ ID NO: 1543045 - protein, 10 aa, Mycobacterium tuberculosis
APDSERGLAP

SEQ ID NO: 1543046 - protein, 13 aa, Mycobacterium tuberculosis
APDVEAGQIDPLS

SEQ ID NO: 1543047 - protein, 14 aa, Mycobacterium tuberculosis
APDVEAGQIDPLSP

SEQ ID NO: 1543048 - protein, 4 aa, Mycobacterium tuberculosis
APEA

SEQ ID NO: 1543049 - protein, 5 aa, Mycobacterium tuberculosis
APEEM

SEQ ID NO: 1543050 - protein, 13 aa, Mycobacterium tuberculosis
APERRASNGRQQV

SEQ ID NO: 1543051 - protein, 4 aa, Mycobacterium tuberculosis
APET

SEQ ID NO: 1543052 - protein, 33 aa, Mycobacterium tuberculosis; identical to SEQ ID NO: 169263

SEQ ID NO: 1543053 - protein, 37 aa, Mycobacterium tuberculosis
APGAPAAPATRGPLEQAPVGPVATGGRAVAAASASSL

SEQ ID NO: 1543054 - protein, 11 aa, Mycobacterium tuberculosis
APGARCDQPVK

SEQ ID NO: 1543055 - protein, 6 aa, Mycobacterium tuberculosis
APGATP

SEQ ID NO: 1543056 - protein, 11 aa, Mycobacterium tuberculosis
APGDPKTLTSN

SEQ ID NO: 1543057 - protein, 25 aa, Mycobacterium tuberculosis
APGENIASVSNSGDGALANGLPDAH

SEQ ID NO: 1543058 - protein, 13 aa, Mycobacterium tuberculosis
APGFGNSTQMPSS

SEQ ID NO: 1543059 - protein, 14 aa, Mycobacterium tuberculosis
APGPPTVVPPRRRP

SEQ ID NO: 1543060 - protein, 28 aa, Mycobacterium tuberculosis
APGSGSTADGQTPAGGHSVPNSGGRQGY

SEQ ID NO: 1543061 - protein, 34 aa, Mycobacterium tuberculosis
APGYPPTIEPAQPAVSPPTSQDPAGAVRPLSGHP

SEQ ID NO: 1543062 - protein, 33 aa, Mycobacterium tuberculosis
APIPGDTRTGPGGDRGAGLRSRRAVGEGRPTQL

SEQ ID NO: 1543063 - protein, 7 aa, Mycobacterium tuberculosis
APKSYAA

SEQ ID NO: 1543064 - protein, 5 aa, Mycobacterium tuberculosis
APLDE

SEQ ID NO: 1543065 - protein, 10 aa, Mycobacterium tuberculosis
APPANQARAA

SEQ ID NO: 1543066 - protein, 25 aa, Mycobacterium tuberculosis
APPAPPAPPSPRASRPALPPAPPCP

SEQ ID NO: 1543067 - protein, 21 aa, Mycobacterium tuberculosis
APPEPGAGRRRGHLRVLPDPA

SEQ ID NO: 1543068 - protein, 12 aa, Mycobacterium tuberculosis
APPFPPLAPRAV

SEQ ID NO: 1543069 - protein, 8 aa, Mycobacterium tuberculosis
APPGSFNN

SEQ ID NO: 1543070 - protein, 7 aa, Mycobacterium tuberculosis
APPHGNA

SEQ ID NO: 1543071 - protein, 8 aa, Mycobacterium tuberculosis
APPPDPLA

SEQ ID NO: 1543072 - protein, 45 aa, Mycobacterium tuberculosis
APPPPRPAPPQQPPPPPPEVEPPAGVPQSGGAAGSGGPAAMVGAG

SEQ ID NO: 1543073 - protein, 45 aa, Mycobacterium tuberculosis
APPPRRPAPPQQPPPPPPEVEPPAGVPQSGGAAGSGGAGSGGGGG

SEQ ID NO: 1543074 - protein, 4 aa, Mycobacterium tuberculosis
APPS

SEQ ID NO: 1543075 - protein, 33 aa, Mycobacterium tuberculosis
APPSPPAPPPPGAPLPQVPPTPPAPPAPPSPIG

SEQ ID NO: 1543076 - protein, 6 aa, Mycobacterium tuberculosis
APPTGR

SEQ ID NO: 1543077 - protein, 15 aa, Mycobacterium tuberculosis
APPTSVAASADHGES

SEQ ID NO: 1543078 - protein, 5 aa, Mycobacterium tuberculosis
APPVV

SEQ ID NO: 1543079 - protein, 6 aa, Mycobacterium tuberculosis
APQQRP

SEQ ID NO: 1543080 - protein, 15 aa, Mycobacterium tuberculosis
APRGGPGGSGGNAGI

SEQ ID NO: 1543081 - protein, 30 aa, Mycobacterium tuberculosis
APRPTCRRKGRPRPSRRRSPRSRLAGPPRR

SEQ ID NO: 1543082 - protein, 21 aa, Mycobacterium tuberculosis
APRPVTRDAQRAPAPAARARR

SEQ ID NO: 1543083 - protein, 8 aa, Mycobacterium tuberculosis
APRRAGGA

SEQ ID NO: 1543084 - protein, 6 aa, Mycobacterium tuberculosis
APSARF

SEQ ID NO: 1543085 - protein, 8 aa, Mycobacterium tuberculosis
APSPPSVT

SEQ ID NO: 1543086 - protein, 32 aa, Mycobacterium tuberculosis
APTAGAEPTGALPPMTSSGSGPVIGDGDAALR

SEQ ID NO: 1543087 - protein, 5 aa, Mycobacterium tuberculosis
APTDQ

SEQ ID NO: 1543088 - protein, 8 aa, Mycobacterium tuberculosis
APTKDTSV

SEQ ID NO: 1543089 - protein, 5 aa, Mycobacterium tuberculosis
APTQA

SEQ ID NO: 1543090 - protein, 5 aa, Mycobacterium tuberculosis
APTQR

SEQ ID NO: 1543091 - protein, 8 aa, Mycobacterium tuberculosis
APVATAVT

SEQ ID NO: 1543092 - protein, 13 aa, Mycobacterium tuberculosis
APVGDETYDGEVT

SEQ ID NO: 1543093 - protein, 12 aa, Mycobacterium tuberculosis
APVSGGGVSPQA

SEQ ID NO: 1543094 - protein, 11 aa, Mycobacterium tuberculosis
APVSGGVVSPQ

SEQ ID NO: 1543095 - protein, 27 aa, Mycobacterium tuberculosis
APVTTSPAALAGQAAATVSSTVPPLAT

SEQ ID NO: 1543096 - protein, 4 aa, Mycobacterium tuberculosis
APYP

SEQ ID NO: 1543097 - protein, 5 aa, Mycobacterium tuberculosis
AQAAA

SEQ ID NO: 1543098 - protein, 21 aa, Mycobacterium tuberculosis
AQAAEASRAGSPPSPPSPPSL

SEQ ID NO: 1543099 - protein, 8 aa, Mycobacterium tuberculosis
AQAAEQRA

SEQ ID NO: 1543100 - protein, 15 aa, Mycobacterium tuberculosis
AQAASGQARLVGTFE

SEQ ID NO: 1543101 - protein, 15 aa, Mycobacterium tuberculosis
AQAATAVTSPAPASV

SEQ ID NO: 1543102 - protein, 10 aa, Mycobacterium tuberculosis
AQADDYDAPF

SEQ ID NO: 1543103 - protein, 7 aa, Mycobacterium tuberculosis
AQAEHPG

SEQ ID NO: 1543104 - protein, 9 aa, Mycobacterium tuberculosis
AQAPRPAPA

SEQ ID NO: 1543105 - protein, 8 aa, Mycobacterium tuberculosis
AQAVGGLG

SEQ ID NO: 1543106 - protein, 115 aa, Mycobacterium tuberculosis; identical to SEQ ID NO: 1426075

SEQ ID NO: 1543107 - protein, 116 aa, Mycobacterium tuberculosis; identical to SEQ ID NO: 1424633

SEQ ID NO: 1543108 - protein, 7 aa, Mycobacterium tuberculosis
AQEAGRD

SEQ ID NO: 1543109 - protein, 24 aa, Mycobacterium tuberculosis
AQGGSGGLGGFGESTGGDGGLGGA

SEQ ID NO: 1543110 - protein, 36 aa, Mycobacterium tuberculosis; identical to SEQ ID NO: 1366848

SEQ ID NO: 1543111 - protein, 9 aa, Mycobacterium tuberculosis
AQKFSGGEV

SEQ ID NO: 1543112 - protein, 4 aa, Mycobacterium tuberculosis
AQLT

SEQ ID NO: 1543113 - protein, 4 aa, Mycobacterium tuberculosis
AQPL

SEQ ID NO: 1543114 - protein, 9 aa, Mycobacterium tuberculosis
AQQQPDAPA

SEQ ID NO: 1543115 - protein, 8 aa, Mycobacterium tuberculosis
AQQRESFG

SEQ ID NO: 1543116 - protein, 14 aa, Mycobacterium tuberculosis
AQRDATRGSRATLP

SEQ ID NO: 1543117 - protein, 15 aa, Mycobacterium tuberculosis
AQRGRGARKRPTSGW

SEQ ID NO: 1543118 - protein, 8 aa, Mycobacterium tuberculosis
AQRRDPDA

SEQ ID NO: 1543119 - protein, 5 aa, Mycobacterium tuberculosis
AQRTP

SEQ ID NO: 1543120 - protein, 36 aa, Mycobacterium tuberculosis
AQVAPPATGAPAAPAAPAAPAARVPTAASPAAEAAL

SEQ ID NO: 1543121 - protein, 8 aa, Mycobacterium tuberculosis
ARAGGDHR

SEQ ID NO: 1543122 - protein, 6 aa, Mycobacterium tuberculosis
ARAGGL

SEQ ID NO: 1543123 - protein, 9 aa, Mycobacterium tuberculosis
ARARDGGIP

SEQ ID NO: 1543124 - protein, 7 aa, Mycobacterium tuberculosis
ARDRGRQ

SEQ ID NO: 1543125 - protein, 6 aa, Mycobacterium tuberculosis
ARDSNV

SEQ ID NO: 1543126 - protein, 9 aa, Mycobacterium tuberculosis
AREAEAAGY

SEQ ID NO: 1543127 - protein, 8 aa, Mycobacterium tuberculosis
AREARPEL

SEQ ID NO: 1543128 - protein, 17 aa, Mycobacterium tuberculosis
ARGGGIGTLGTTTTEPA

SEQ ID NO: 1543129 - protein, 9 aa, Mycobacterium tuberculosis
ARGGSMSPA

SEQ ID NO: 1543130 - protein, 29 aa, Mycobacterium tuberculosis
ARGGTNSAPGTATESARAPEPAASAPPEA

SEQ ID NO: 1543131 - protein, 8 aa, Mycobacterium tuberculosis
ARGKSGRL

SEQ ID NO: 1543132 - protein, 5 aa, Mycobacterium tuberculosis
ARGNA

SEQ ID NO: 1543133 - protein, 7 aa, Mycobacterium tuberculosis
ARGQSVH

SEQ ID NO: 1543134 - protein, 11 aa, Mycobacterium tuberculosis
ARGYKDVRANT

SEQ ID NO: 1543135 - protein, 11 aa, Mycobacterium tuberculosis
ARGYRGRPELT

SEQ ID NO: 1543136 - protein, 16 aa, Mycobacterium tuberculosis
ARHPRGRGRRPGRRRR

SEQ ID NO: 1543137 - protein, 31 aa, Mycobacterium tuberculosis
ARHRPTGATGSARTARAAGLPRIASTAVAAT

SEQ ID NO: 1543138 - protein, 21 aa, Mycobacterium tuberculosis
ARIGPGTNNAPSAADTTTYAR

SEQ ID NO: 1543139 - protein, 8 aa, Mycobacterium tuberculosis
ARIPAKPA

SEQ ID NO: 1543140 - protein, 14 aa, Mycobacterium tuberculosis
ARLANDPTAPAPDK

SEQ ID NO: 1543141 - protein, 24 aa, Mycobacterium tuberculosis
ARPAATPATTSMPTYTAAQTAAAQ

SEQ ID NO: 1543142 - protein, 21 aa, Mycobacterium tuberculosis
ARPAATPSVPTYTAAETAAAQ

SEQ ID NO: 1543143 - protein, 22 aa, Mycobacterium tuberculosis
ARPAATPSVPTYTAAETAAAQR

SEQ ID NO: 1543144 - protein, 7 aa, Mycobacterium tuberculosis
ARPPGWR

SEQ ID NO: 1543145 - protein, 8 aa, Mycobacterium tuberculosis
ARPSETAT

SEQ ID NO: 1543146 - protein, 6 aa, Mycobacterium tuberculosis
ARPTPW

SEQ ID NO: 1543147 - protein, 6 aa, Mycobacterium tuberculosis
ARQGAG

SEQ ID NO: 1543148 - protein, 31 aa, Mycobacterium tuberculosis
ARRDGQGVDPVGTRRAGRAVAPRPHRWLIAS

SEQ ID NO: 1543149 - protein, 18 aa, Mycobacterium tuberculosis
ARRGGHRRQASTPVGSPC

SEQ ID NO: 1543150 - protein, 19 aa, Mycobacterium tuberculosis
ARRPAQGGHRGPVRRPGRI

SEQ ID NO: 1543151 - protein, 10 aa, Mycobacterium tuberculosis
ARRSAGAHPY

SEQ ID NO: 1543152 - protein, 10 aa, Mycobacterium tuberculosis
ARSAEGDRVG

SEQ ID NO: 1543153 - protein, 4 aa, Mycobacterium tuberculosis
ARSG

SEQ ID NO: 1543154 - protein, 7 aa, Mycobacterium tuberculosis
ARSGKTT

SEQ ID NO: 1543155 - protein, 15 aa, Mycobacterium tuberculosis
ARSHPPNHRSRRRRR

SEQ ID NO: 1543156 - protein, 8 aa, Mycobacterium tuberculosis
ARSRATRR

SEQ ID NO: 1543157 - protein, 8 aa, Mycobacterium tuberculosis
ARTADGIN

SEQ ID NO: 1543158 - protein, 15 aa, Mycobacterium tuberculosis
ARTATPPGTETGAGH

SEQ ID NO: 1543159 - protein, 33 aa, Mycobacterium tuberculosis
ARTGPPSRHRARHRTHGGGAGRGRPDRRRSRRV

SEQ ID NO: 1543160 - protein, 8 aa, Mycobacterium tuberculosis
ARTGVRRP

SEQ ID NO: 1543161 - protein, 4 aa, Mycobacterium tuberculosis
ARTP

SEQ ID NO: 1543162 - protein, 9 aa, Mycobacterium tuberculosis
ARVTTDEEI

SEQ ID NO: 1543163 - protein, 5 aa, Mycobacterium tuberculosis
ASAAP

SEQ ID NO: 1543164 - protein, 8 aa, Mycobacterium tuberculosis
ASAARNSA

SEQ ID NO: 1543165 - protein, 12 aa, Mycobacterium tuberculosis
ASAASAAGEAAV

SEQ ID NO: 1543166 - protein, 12 aa, Mycobacterium tuberculosis
ASADWPARSPVR

SEQ ID NO: 1543167 - protein, 9 aa, Mycobacterium tuberculosis
ASAEATNVE

SEQ ID NO: 1543168 - protein, 4 aa, Mycobacterium tuberculosis
ASAG

SEQ ID NO: 1543169 - protein, 6 aa, Mycobacterium tuberculosis
ASAGIG

SEQ ID NO: 1543170 - protein, 19 aa, Mycobacterium tuberculosis
ASAGSAAANSCRPRGSPRR

SEQ ID NO: 1543171 - protein, 4 aa, Mycobacterium tuberculosis
ASAI

SEQ ID NO: 1543172 - protein, 7 aa, Mycobacterium tuberculosis
ASASSQF

SEQ ID NO: 1543173 - protein, 21 aa, Mycobacterium tuberculosis
ASCRGTSESAAQTEPAAGADC

SEQ ID NO: 1543174 - protein, 13 aa, Mycobacterium tuberculosis
ASDIGNGRGPVDE

SEQ ID NO: 1543175 - protein, 4 aa, Mycobacterium tuberculosis
ASDL

SEQ ID NO: 1543176 - protein, 6 aa, Mycobacterium tuberculosis
ASEGYG

SEQ ID NO: 1543177 - protein, 25 aa, Mycobacterium tuberculosis
ASEPAYPWAPGPPPSPSPVGDASTA

SEQ ID NO: 1543178 - protein, 5 aa, Mycobacterium tuberculosis
ASEPV

SEQ ID NO: 1543179 - protein, 4 aa, Mycobacterium tuberculosis
ASGA

SEQ ID NO: 1543180 - protein, 431 aa, Mycobacterium tuberculosis
ASGAAGNAGVGGAGGQGGDGGAGGAGADADQPGATGGTGFAGGAGGAGGAGGSSGAGGTNGSGGAGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTDGQGGAGGAGGAGADNPTGIGGTGGDGGTGGAAGAGGAGGAAGTGGTGGMVGTTGNAGVGGAGGQGGDGGAGGAGADADQPGATGGTGFAGGAGGAGGAGGAGGSSGAGSTNGSGGAGGTGGQGGAGGAGIS

SEQ ID NO: 1543181 - protein, 498 aa, Mycobacterium tuberculosis
ASGAAGNAGVGGAGGQGGDGGAGGAGADADQPGATGGTGFAGGAGGAGGAGGSSGAGGTNGSGGAGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGKAGGSSSAGGTNSSGSAGGTGRQSGTGGAGGAGADNPTGIGGTGGDGGTGGAAGAGGAGGAAGTGGTGGMIGTTGNAGVGGAGGSSGAGGTNGSGGAGGTDGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGSGGSSCAGGTNGSGGAGGTCG

SEQ ID NO: 1543182 - protein, 323 aa, Mycobacterium tuberculosis
ASGAAGNAGVGGAGGQGGDGGAGGAGADADQPGATGGTGFAGGAGGAGGAGGSSGAGGTNGSGGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGIS

SEQ ID NO: 1543183 - protein, 309 aa, Mycobacterium tuberculosis
ASGAAGNAGVGGAGGQGGDGGAGGAGADAPASTGLTGGTGFAGGAGGAGGAGGSSGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGAGGSSGAGGTNGSGGAGGTGGQGGAGGAGIS

SEQ ID NO: 1543184 - protein, 4 aa, Mycobacterium tuberculosis
ASGG

SEQ ID NO: 1543185 - protein, 7 aa, Mycobacterium tuberculosis
ASGGAGP

SEQ ID NO: 1543186 - protein, 5 aa, Mycobacterium tuberculosis
ASGIS

SEQ ID NO: 1543187 - protein, 34 aa, Mycobacterium tuberculosis
ASGNIGIGNSGSLNSGIGTSGTINAGLGSAGSLN

SEQ ID NO: 1543188 - protein, 10 aa, Mycobacterium tuberculosis
ASGSGKTTIA

SEQ ID NO: 1543189 - protein, 45 aa, Mycobacterium tuberculosis; identical to SEQ ID NO: 170044

SEQ ID NO: 1543190 - protein, 7 aa, Mycobacterium tuberculosis
ASGSRMR

SEQ ID NO: 1543191 - protein, 15 aa, Mycobacterium tuberculosis
ASGTGLGGAGGLGAG

SEQ ID NO: 1543192 - protein, 32 aa, Mycobacterium tuberculosis; identical to SEQ ID NO: 1414976

SEQ ID NO: 1543193 - protein, 4 aa, Mycobacterium tuberculosis
ASPI

SEQ ID NO: 1543194 - protein, 9 aa, Mycobacterium tuberculosis
ASPLRDQPY

SEQ ID NO: 1543195 - protein, 6 aa, Mycobacterium tuberculosis
ASPSVS

SEQ ID NO: 1543196 - protein, 8 aa, Mycobacterium tuberculosis
ASQAGAQL

SEQ ID NO: 1543197 - protein, 6 aa, Mycobacterium tuberculosis
ASRALA

SEQ ID NO: 1543198 - protein, 7 aa, Mycobacterium tuberculosis
ASRGKWD

SEQ ID NO: 1543199 - protein, 38 aa, Mycobacterium tuberculosis
ASRRRGRPRCAGDQDPRASPPAGRACRPGHHAGRRRHR

SEQ ID NO: 1543200 - protein, 7 aa, Mycobacterium tuberculosis
ASRTPRV

SEQ ID NO: 1543201 - protein, 10 aa, Mycobacterium tuberculosis
ASSATSAHAG

SEQ ID NO: 1543202 - protein, 33 aa, Mycobacterium tuberculosis
ASSGSPTAASAESAGPAGPAGCSAQAGKAAAAD

SEQ ID NO: 1543203 - protein, 17 aa, Mycobacterium tuberculosis
ASSKSCSPVAADGLYGL

SEQ ID NO: 1543204 - protein, 5 aa, Mycobacterium tuberculosis
ASSPA

SEQ ID NO: 1543205 - protein, 8 aa, Mycobacterium tuberculosis
ASSPIKGT

SEQ ID NO: 1543206 - protein, 8 aa, Mycobacterium tuberculosis
ASSSQGTI

SEQ ID NO: 1543207 - protein, 6 aa, Mycobacterium tuberculosis
ASTGAT

SEQ ID NO: 1543208 - protein, 6 aa, Mycobacterium tuberculosis
ASTLQA

SEQ ID NO: 1543209 - protein, 15 aa, Mycobacterium tuberculosis
ASTNTSYPGRRPIPR

SEQ ID NO: 1543210 - protein, 30 aa, Mycobacterium tuberculosis
ASTQSSTSAPSPSRTSRFPPWDSTPQPVSP

SEQ ID NO: 1543211 - protein, 16 aa, Mycobacterium tuberculosis
ASVARGPSPQVPPAAP

SEQ ID NO: 1543212 - protein, 8 aa, Mycobacterium tuberculosis
ATAAPADL

SEQ ID NO: 1543213 - protein, 6 aa, Mycobacterium tuberculosis
ATAASV

SEQ ID NO: 1543214 - protein, 27 aa, Mycobacterium tuberculosis
ATAATVTPAAPAALAAPAAPAAPATTA

SEQ ID NO: 1543215 - protein, 8 aa, Mycobacterium tuberculosis
ATADDNTK

SEQ ID NO: 1543216 - protein, 9 aa, Mycobacterium tuberculosis
ATAEDPGGR

SEQ ID NO: 1543217 - protein, 43 aa, Mycobacterium tuberculosis
ATAFSQTTAGVAGGAGGSAGLIGNGGNGGAGGAGAAGGAGGAG

SEQ ID NO: 1543218 - protein, 6 aa, Mycobacterium tuberculosis
ATAGLG

SEQ ID NO: 1543219 - protein, 7 aa, Mycobacterium tuberculosis
ATALADA

SEQ ID NO: 1543220 - protein, 8 aa, Mycobacterium tuberculosis
ATAPRRLS

SEQ ID NO: 1543221 - protein, 26 aa, Mycobacterium tuberculosis
ATAVPSAPTVPAATAATAALPGPPRL

SEQ ID NO: 1543222 - protein, 11 aa, Mycobacterium tuberculosis
ATDARRHTRAE

SEQ ID NO: 1543223 - protein, 6 aa, Mycobacterium tuberculosis
ATEASY

SEQ ID NO: 1543224 - protein, 14 aa, Mycobacterium tuberculosis
ATGAGAGCGRFGRC

SEQ ID NO: 1543225 - protein, 10 aa, Mycobacterium tuberculosis
ATGAGNNGED

SEQ ID NO: 1543226 - protein, 14 aa, Mycobacterium tuberculosis
ATGGAPSAACGSGD

SEQ ID NO: 1543227 - protein, 13 aa, Mycobacterium tuberculosis
ATGGLGGDGGDAG

SEQ ID NO: 1543228 - protein, 23 aa, Mycobacterium tuberculosis
ATGPDGGDPRRPVPALAIATRLG

SEQ ID NO: 1543229 - protein, 6 aa, Mycobacterium tuberculosis
ATHAAG

SEQ ID NO: 1543230 - protein, 6 aa, Mycobacterium tuberculosis
ATHPDV

SEQ ID NO: 1543231 - protein, 18 aa, Mycobacterium tuberculosis
ATLTPSRRGSTWVGRSSA

SEQ ID NO: 1543232 - protein, 10 aa, Mycobacterium tuberculosis
ATNAEGANMD

SEQ ID NO: 1543233 - protein, 7 aa, Mycobacterium tuberculosis
ATNPRAQ

SEQ ID NO: 1543234 - protein, 12 aa, Mycobacterium tuberculosis
ATNREVDPDGAV

SEQ ID NO: 1543235 - protein, 21 aa, Mycobacterium tuberculosis
ATPADLRTAPDTAGRPAEGTE

SEQ ID NO: 1543236 - protein, 18 aa, Mycobacterium tuberculosis
ATPLANPGNLDSRRRAGS

SEQ ID NO: 1543237 - protein, 6 aa, Mycobacterium tuberculosis
ATPPGA

SEQ ID NO: 1543238 - protein, 15 aa, Mycobacterium tuberculosis
ATPQLRGEFSESGAA

SEQ ID NO: 1543239 - protein, 8 aa, Mycobacterium tuberculosis
ATPSEPIA

SEQ ID NO: 1543240 - protein, 11 aa, Mycobacterium tuberculosis
ATQAPDAGAMS

SEQ ID NO: 1543241 - protein, 17 aa, Mycobacterium tuberculosis
ATRAASPGRPTGTTAAA

SEQ ID NO: 1543242 - protein, 4 aa, Mycobacterium tuberculosis
ATRE

SEQ ID NO: 1543243 - protein, 5 aa, Mycobacterium tuberculosis
ATRHH

SEQ ID NO: 1543244 - protein, 7 aa, Mycobacterium tuberculosis
ATSAAPL

SEQ ID NO: 1543245 - protein, 16 aa, Mycobacterium tuberculosis
ATSGFGNSTTSPSSGF

SEQ ID NO: 1543246 - protein, 8 aa, Mycobacterium tuberculosis
ATSGLSGF

SEQ ID NO: 1543247 - protein, 19 aa, Mycobacterium tuberculosis
ATSPPNPDGPPPARAYQSR

SEQ ID NO: 1543248 - protein, 17 aa, Mycobacterium tuberculosis
ATSPPNPDGPPPGPGLP

SEQ ID NO: 1543249 - protein, 14 aa, Mycobacterium tuberculosis
ATSPPNPEGPPPAP

SEQ ID NO: 1543250 - protein, 12 aa, Mycobacterium tuberculosis
ATTLDGTELPAD

SEQ ID NO: 1543251 - protein, 30 aa, Mycobacterium tuberculosis; identical to SEQ ID NO: 170500

SEQ ID NO: 1543252 - protein, 7 aa, Mycobacterium tuberculosis
ATTPNSF

SEQ ID NO: 1543253 - protein, 9 aa, Mycobacterium tuberculosis
ATVAATAAT

SEQ ID NO: 1543254 - protein, 7 aa, Mycobacterium tuberculosis
ATVDAYD

SEQ ID NO: 1543255 - protein, 5 aa, Mycobacterium tuberculosis
ATVGQ

SEQ ID NO: 1543256 - protein, 30 aa, Mycobacterium tuberculosis
ATYSGAGPQGAATTTPPPAGPPPLAAPKND

SEQ ID NO: 1543257 - protein, 7 aa, Mycobacterium tuberculosis
AVAAGTA

SEQ ID NO: 1543258 - protein, 9 aa, Mycobacterium tuberculosis
AVAGRAPGA

SEQ ID NO: 1543259 - protein, 10 aa, Mycobacterium tuberculosis
AVAGRAPGAL

SEQ ID NO: 1543260 - protein, 6 aa, Mycobacterium tuberculosis
AVAPAA

SEQ ID NO: 1543261 - protein, 22 aa, Mycobacterium tuberculosis
AVEAATAGKAVAAGRAVEAEMA

SEQ ID NO: 1543262 - protein, 10 aa, Mycobacterium tuberculosis
AVEPTDQGAR

SEQ ID NO: 1543263 - protein, 12 aa, Mycobacterium tuberculosis
AVGGTGVTSRRP

SEQ ID NO: 1543264 - protein, 66 aa, Mycobacterium tuberculosis
AVPTGPTVAPYQPAGTAVTAGTAGTAGTCEEGARVSPTSAAVPTGPTAAEKETRGRRCPPDPAKTG

SEQ ID NO: 1543265 - protein, 21 aa, Mycobacterium tuberculosis
AVPVSQAPAVEAGQAAGDRRA

SEQ ID NO: 1543266 - protein, 14 aa, Mycobacterium tuberculosis
AVREPSTPGSGIPK

SEQ ID NO: 1543267 - protein, 7 aa, Mycobacterium tuberculosis
AVRPATP

SEQ ID NO: 1543268 - protein, 11 aa, Mycobacterium tuberculosis
AVSAGSRNVAR

SEQ ID NO: 1543269 - protein, 12 aa, Mycobacterium tuberculosis
AVSGETQQKGSQ

SEQ ID NO: 1543270 - protein, 6 aa, Mycobacterium tuberculosis
AVSPQV

SEQ ID NO: 1543271 - protein, 21 aa, Mycobacterium tuberculosis
AVSPYGSGALAGSSLGLDPDA

SEQ ID NO: 1543272 - protein, 9 aa, Mycobacterium tuberculosis
AVSRRRRVT

SEQ ID NO: 1543273 - protein, 25 aa, Mycobacterium tuberculosis
AVSTGAAGTAFAAGPAGSDGQPLGR

SEQ ID NO: 1543274 - protein, 13 aa, Mycobacterium tuberculosis
AYAASKAGVRSLG

SEQ ID NO: 1543275 - protein, 5 aa, Mycobacterium tuberculosis
AYDSP

SEQ ID NO: 1543276 - protein, 5 aa, Mycobacterium tuberculosis
AYGQA

SEQ ID NO: 1543277 - protein, 6 aa, Mycobacterium tuberculosis
AYTNPG

SEQ ID NO: 1543278 - protein, 10 aa, Mycobacterium tuberculosis
AYTSADPVSG

SEQ ID NO: 1543279 - protein, 6 aa, Mycobacterium tuberculosis
CAGSPR

SEQ ID NO: 1543280 - protein, 7 aa, Mycobacterium tuberculosis
CANGPRI

SEQ ID NO: 1543281 - protein, 12 aa, Mycobacterium tuberculosis
CARSPACPLGTD

SEQ ID NO: 1543282 - protein, 12 aa, Mycobacterium tuberculosis
CDEAGRDRSTLQ

SEQ ID NO: 1543283 - protein, 7 aa, Mycobacterium tuberculosis
CDEPATN

SEQ ID NO: 1543284 - protein, 10 aa, Mycobacterium tuberculosis
CDESLPSPRV

SEQ ID NO: 1543285 - protein, 8 aa, Mycobacterium tuberculosis
CGGDGGLS

SEQ ID NO: 1543286 - protein, 33 aa, Mycobacterium tuberculosis
CGGGGGDSRETPPYVPKATTVDATTPAPAAEPL

SEQ ID NO: 1543287 - protein, 24 aa, Mycobacterium tuberculosis
CGGGSWGDDCRPAGIGGLGGRGSR

SEQ ID NO: 1543288 - protein, 31 aa, Mycobacterium tuberculosis
CGGQSGDRSTRVSSSMPAKSCSPATPNPNTI

SEQ ID NO: 1543289 - protein, 6 aa, Mycobacterium tuberculosis
CGSGFG

SEQ ID NO: 1543290 - protein, 14 aa, Mycobacterium tuberculosis
CGSGGGPGRGGQHR

SEQ ID NO: 1543291 - protein, 8 aa, Mycobacterium tuberculosis
CGSSTTRV

SEQ ID NO: 1543292 - protein, 17 aa, Mycobacterium tuberculosis
CGTATVAPAGPPAKGGP

SEQ ID NO: 1543293 - protein, 15 aa, Mycobacterium tuberculosis
CKSGGNWSINTGNGY

SEQ ID NO: 1543294 - protein, 6 aa, Mycobacterium tuberculosis
CNSTRT

SEQ ID NO: 1543295 - protein, 15 aa, Mycobacterium tuberculosis
CPEGGPSGTYLPKRK

SEQ ID NO: 1543296 - protein, 4 aa, Mycobacterium tuberculosis
CPGK

SEQ ID NO: 1543297 - protein, 9 aa, Mycobacterium tuberculosis
CPPAGTGTH

SEQ ID NO: 1543298 - protein, 10 aa, Mycobacterium tuberculosis
CQPGKPGEVG

SEQ ID NO: 1543299 - protein, 17 aa, Mycobacterium tuberculosis
CQPRGPDGLAWCPDTAY

SEQ ID NO: 1543300 - protein, 15 aa, Mycobacterium tuberculosis
CRANSTKAPSSTFPA

SEQ ID NO: 1543301 - protein, 37 aa, Mycobacterium tuberculosis
CRGNGSHDHRHSASTGQLETDPGVAGAAGQGHRRGQL

SEQ ID NO: 1543302 - protein, 9 aa, Mycobacterium tuberculosis
CSAPDRSLG

SEQ ID NO: 1543303 - protein, 17 aa, Mycobacterium tuberculosis
CSARAGPAGPAGPDSGP

SEQ ID NO: 1543304 - protein, 19 aa, Mycobacterium tuberculosis
CSATAGPAAPAATAAAALT

SEQ ID NO: 1543305 - protein, 12 aa, Mycobacterium tuberculosis
CSRPGTEEPDCP

SEQ ID NO: 1543306 - protein, 7 aa, Mycobacterium tuberculosis
CTNRRTD

SEQ ID NO: 1543307 - protein, 14 aa, Mycobacterium tuberculosis
CTTPADSACAPAAA

SEQ ID NO: 1543308 - protein, 4 aa, Mycobacterium tuberculosis
DAAA

SEQ ID NO: 1543309 - protein, 19 aa, Mycobacterium tuberculosis
DAAEGAPRHARENAENELR

SEQ ID NO: 1543310 - protein, 8 aa, Mycobacterium tuberculosis
DAAHAGEY

SEQ ID NO: 1543311 - protein, 7 aa, Mycobacterium tuberculosis
DAARGRM

SEQ ID NO: 1543312 - protein, 9 aa, Mycobacterium tuberculosis
DAASDEMTE

SEQ ID NO: 1543313 - protein, 13 aa, Mycobacterium tuberculosis
DADAVRRRKEYQA

SEQ ID NO: 1543314 - protein, 14 aa, Mycobacterium tuberculosis
DADAVRRRKEYQAQ

SEQ ID NO: 1543315 - protein, 7 aa, Mycobacterium tuberculosis
DAEPPRH

SEQ ID NO: 1543316 - protein, 4 aa, Mycobacterium tuberculosis
DAGD

SEQ ID NO: 1543317 - protein, 15 aa, Mycobacterium tuberculosis
DAGHAARTRYDSFPR

SEQ ID NO: 1543318 - protein, 7 aa, Mycobacterium tuberculosis
DAGSNRE

SEQ ID NO: 1543319 - protein, 38 aa, Mycobacterium tuberculosis; identical to SEQ ID NO: 1421172

SEQ ID NO: 1543320 - protein, 6 aa, Mycobacterium tuberculosis
DAPGVR

SEQ ID NO: 1543321 - protein, 7 aa, Mycobacterium tuberculosis
DAPLRPR

SEQ ID NO: 1543322 - protein, 17 aa, Mycobacterium tuberculosis
DAPPGPCRASRSMPNSA

SEQ ID NO: 1543323 - protein, 14 aa, Mycobacterium tuberculosis
DAPPPAPSAPTTAQ

SEQ ID NO: 1543324 - protein, 9 aa, Mycobacterium tuberculosis
DARDDGAAA

SEQ ID NO: 1543325 - protein, 4 aa, Mycobacterium tuberculosis
DARH

SEQ ID NO: 1543326 - protein, 6 aa, Mycobacterium tuberculosis
DARPGD

SEQ ID NO: 1543327 - protein, 11 aa, Mycobacterium tuberculosis
DASTGGGSNAL

SEQ ID NO: 1543328 - protein, 9 aa, Mycobacterium tuberculosis
DATNSSPDQ

SEQ ID NO: 1543329 - protein, 17 aa, Mycobacterium tuberculosis
DATSEQHSSGQPPQATR

SEQ ID NO: 1543330 - protein, 16 aa, Mycobacterium tuberculosis
DATTCWPSSPTRSAPR

SEQ ID NO: 1543331 - protein, 6 aa, Mycobacterium tuberculosis
DATTPA

SEQ ID NO: 1543332 - protein, 17 aa, Mycobacterium tuberculosis
DCPQHGPVDPLPRRRAD

SEQ ID NO: 1543333 - protein, 10 aa, Mycobacterium tuberculosis
DDAAARELTD

SEQ ID NO: 1543334 - protein, 9 aa, Mycobacterium tuberculosis
DDADRDCAA

SEQ ID NO: 1543335 - protein, 15 aa, Mycobacterium tuberculosis
DDDGTERKDRATQHA

SEQ ID NO: 1543336 - protein, 5 aa, Mycobacterium tuberculosis
DDEPR

SEQ ID NO: 1543337 - protein, 24 aa, Mycobacterium tuberculosis
DDERPEQAREPELRSNRSQREEEL

SEQ ID NO: 1543338 - protein, 11 aa, Mycobacterium tuberculosis
DDGRRAVDAGA

SEQ ID NO: 1543339 - protein, 13 aa, Mycobacterium tuberculosis
DDGTDAAPGSGGA

SEQ ID NO: 1543340 - protein, 6 aa, Mycobacterium tuberculosis
DDNPYP

SEQ ID NO: 1543341 - protein, 5 aa, Mycobacterium tuberculosis
DDPAV

SEQ ID NO: 1543342 - protein, 13 aa, Mycobacterium tuberculosis
DDPPPAGGAPIPS

SEQ ID NO: 1543343 - protein, 6 aa, Mycobacterium tuberculosis
DDSSRQ

SEQ ID NO: 1543344 - protein, 8 aa, Mycobacterium tuberculosis
DDVGGTWR

SEQ ID NO: 1543345 - protein, 8 aa, Mycobacterium tuberculosis
DEGSRTRS

SEQ ID NO: 1543346 - protein, 10 aa, Mycobacterium tuberculosis
DELNQQRDDI

SEQ ID NO: 1543347 - protein, 11 aa, Mycobacterium tuberculosis
DELRPAGDAVR

SEQ ID NO: 1543348 - protein, 9 aa, Mycobacterium tuberculosis
DEPADQPQS

SEQ ID NO: 1543349 - protein, 10 aa, Mycobacterium tuberculosis
DEPADQPQSL

SEQ ID NO: 1543350 - protein, 6 aa, Mycobacterium tuberculosis
DEPATN

SEQ ID NO: 1543351 - protein, 22 aa, Mycobacterium tuberculosis
DESDVDGYQSRSGPGAASSENR

SEQ ID NO: 1543352 - protein, 5 aa, Mycobacterium tuberculosis
DETSD

SEQ ID NO: 1543353 - protein, 7 aa, Mycobacterium tuberculosis
DEVGRGA

SEQ ID NO: 1543354 - protein, 10 aa, Mycobacterium tuberculosis
DEVSRPGSDR

SEQ ID NO: 1543355 - protein, 6 aa, Mycobacterium tuberculosis
DEYSDD

SEQ ID NO: 1543356 - protein, 5 aa, Mycobacterium tuberculosis
DFKRP

SEQ ID NO: 1543357 - protein, 7 aa, Mycobacterium tuberculosis
DFPDRPD

SEQ ID NO: 1543358 - protein, 14 aa, Mycobacterium tuberculosis
DFSPEEQQGSSQIG

SEQ ID NO: 1543359 - protein, 16 aa, Mycobacterium tuberculosis
DGAAGAPGTGQAGGAG

SEQ ID NO: 1543360 - protein, 8 aa, Mycobacterium tuberculosis
DGAASITR

SEQ ID NO: 1543361 - protein, 8 aa, Mycobacterium tuberculosis
DGAGPGSE

SEQ ID NO: 1543362 - protein, 9 aa, Mycobacterium tuberculosis
DGAGPGSEV

SEQ ID NO: 1543363 - protein, 7 aa, Mycobacterium tuberculosis
DGAGTAA

SEQ ID NO: 1543364 - protein, 15 aa, Mycobacterium tuberculosis
DGAHGTAPGQPGGAG

SEQ ID NO: 1543365 - protein, 14 aa, Mycobacterium tuberculosis
DGANATTPGGAGGA

SEQ ID NO: 1543366 - protein, 14 aa, Mycobacterium tuberculosis
DGANGAPGQPRRAR

SEQ ID NO: 1543367 - protein, 16 aa, Mycobacterium tuberculosis
DGANGGPGQDGGPGGL

SEQ ID NO: 1543368 - protein, 15 aa, Mycobacterium tuberculosis
DGANGGPGQDGGPRR

SEQ ID NO: 1543369 - protein, 26 aa, Mycobacterium tuberculosis
DGANGTAENPDGQNGGLLFGNGGNGL

SEQ ID NO: 1543370 - protein, 21 aa, Mycobacterium tuberculosis
DGANGTAENPGRPKRRPAVRQ

SEQ ID NO: 1543371 - protein, 4 aa, Mycobacterium tuberculosis
DGAP

SEQ ID NO: 1543372 - protein, 27 aa, Mycobacterium tuberculosis
DGGAGGAGGIGGAGGVGGGGGAAGPVA

SEQ ID NO: 1543373 - protein, 72 aa, Mycobacterium tuberculosis; identical to SEQ ID NO: 171461

SEQ ID NO: 1543374 - protein, 21 aa, Mycobacterium tuberculosis
DGGAGGAGGSLFGSPGTTGPH

SEQ ID NO: 1543375 - protein, 28 aa, Mycobacterium tuberculosis
DGGAGGNGGDIRGQGGGAGGAGGAGGQL

SEQ ID NO: 1543376 - protein, 12 aa, Mycobacterium tuberculosis
DGGAGGQGGPAV

SEQ ID NO: 1543377 - protein, 21 aa, Mycobacterium tuberculosis
DGGDGGAGDNGGNESGTGVSA

SEQ ID NO: 1543378 - protein, 14 aa, Mycobacterium tuberculosis
DGGDGGAGGITKEG

SEQ ID NO: 1543379 - protein, 17 aa, Mycobacterium tuberculosis
DGGNGECRRTRYRTRRR

SEQ ID NO: 1543380 - protein, 26 aa, Mycobacterium tuberculosis
DGGNGGAGGLGTGPVGATGGIGGPGV

SEQ ID NO: 1543381 - protein, 35 aa, Mycobacterium tuberculosis
DGGNGGAGRTRHRDPSALPGGSAARWSRRRAVRPW

SEQ ID NO: 1543382 - protein, 216 aa, Mycobacterium tuberculosis; identical to SEQ ID NO: 1436315

SEQ ID NO: 1543383 - protein, 42 aa, Mycobacterium tuberculosis
DGGNGYSQTTPGAVGGAGGSAGFIGNGGAGGGGGPPARRRDW

SEQ ID NO: 1543384 - protein, 12 aa, Mycobacterium tuberculosis
DGITPPRAARAI

SEQ ID NO: 1543385 - protein, 6 aa, Mycobacterium tuberculosis
DGKKNK

SEQ ID NO: 1543386 - protein, 7 aa, Mycobacterium tuberculosis
DGNKASF

SEQ ID NO: 1543387 - protein, 8 aa, Mycobacterium tuberculosis
DGPAPDGY

SEQ ID NO: 1543388 - protein, 21 aa, Mycobacterium tuberculosis
DGPGYAGSSPTLGPTKTSSIT

SEQ ID NO: 1543389 - protein, 15 aa, Mycobacterium tuberculosis
DGPHRRREGRPGAAQ

SEQ ID NO: 1543390 - protein, 10 aa, Mycobacterium tuberculosis
DGRSQDNIKA

SEQ ID NO: 1543391 - protein, 12 aa, Mycobacterium tuberculosis
DGSGGASGTAPL

SEQ ID NO: 1543392 - protein, 5 aa, Mycobacterium tuberculosis
DGSMD

SEQ ID NO: 1543393 - protein, 6 aa, Mycobacterium tuberculosis
DGSSHS

SEQ ID NO: 1543394 - protein, 7 aa, Mycobacterium tuberculosis
DGTALRD

SEQ ID NO: 1543395 - protein, 10 aa, Mycobacterium tuberculosis
DGTDAEGVAR

SEQ ID NO: 1543396 - protein, 5 aa, Mycobacterium tuberculosis
DGTGM

SEQ ID NO: 1543397 - protein, 5 aa, Mycobacterium tuberculosis
DGTQT

SEQ ID NO: 1543398 - protein, 6 aa, Mycobacterium tuberculosis
DGTSTF

SEQ ID NO: 1543399 - protein, 12 aa, Mycobacterium tuberculosis
DGVAAGPADPTV

SEQ ID NO: 1543400 - protein, 4 aa, Mycobacterium tuberculosis
DGVE

SEQ ID NO: 1543401 - protein, 6 aa, Mycobacterium tuberculosis
DGVGPV

SEQ ID NO: 1543402 - protein, 4 aa, Mycobacterium tuberculosis
DGWQ

SEQ ID NO: 1543403 - protein, 6 aa, Mycobacterium tuberculosis
DGWQPI

SEQ ID NO: 1543404 - protein, 8 aa, Mycobacterium tuberculosis
DHGGASMA

SEQ ID NO: 1543405 - protein, 7 aa, Mycobacterium tuberculosis
DHGTEIA

SEQ ID NO: 1543406 - protein, 15 aa, Mycobacterium tuberculosis
DHNTGSFNSGDYNTG

SEQ ID NO: 1543407 - protein, 6 aa, Mycobacterium tuberculosis
DHPGYG

SEQ ID NO: 1543408 - protein, 11 aa, Mycobacterium tuberculosis
DHQPPTPASGC

SEQ ID NO: 1543409 - protein, 4 aa, Mycobacterium tuberculosis
DHVA

SEQ ID NO: 1543410 - protein, 8 aa, Mycobacterium tuberculosis
DIDKNTAY

SEQ ID NO: 1543411 - protein, 17 aa, Mycobacterium tuberculosis
DINTGGFNGGNVNTGFG

SEQ ID NO: 1543412 - protein, 32 aa, Mycobacterium tuberculosis; identical to SEQ ID NO: 1369602

SEQ ID NO: 1543413 - protein, 6 aa, Mycobacterium tuberculosis
DLAGIG

SEQ ID NO: 1543414 - protein, 7 aa, Mycobacterium tuberculosis
DLARQKP

SEQ ID NO: 1543415 - protein, 4 aa, Mycobacterium tuberculosis
DLAS

SEQ ID NO: 1543416 - protein, 4 aa, Mycobacterium tuberculosis
DLEG

SEQ ID NO: 1543417 - protein, 78 aa, Mycobacterium tuberculosis
DLGPGRQPSPASVPAQPSATAAITPAAALPPPDPVPAVTSRPVTPSDFGSAPGDGSATPAGVGSAGGFGDAGGTGGLG

SEQ ID NO: 1543418 - protein, 13 aa, Mycobacterium tuberculosis
DLGTEQAETNPYN

SEQ ID NO: 1543419 - protein, 10 aa, Mycobacterium tuberculosis
DLPASGGLYP

SEQ ID NO: 1543420 - protein, 9 aa, Mycobacterium tuberculosis
DLQEDKEPV

SEQ ID NO: 1543421 - protein, 15 aa, Mycobacterium tuberculosis
DLSGPGLRAFIGNRE

SEQ ID NO: 1543422 - protein, 5 aa, Mycobacterium tuberculosis
DNEYT

SEQ ID NO: 1543423 - protein, 11 aa, Mycobacterium tuberculosis
DNGDADGGDGL

SEQ ID NO: 1543424 - protein, 5 aa, Mycobacterium tuberculosis
DNLTG

SEQ ID NO: 1543425 - protein, 4 aa, Mycobacterium tuberculosis
DNPK

SEQ ID NO: 1543426 - protein, 14 aa, Mycobacterium tuberculosis
DNRGDTLLALVDMY

SEQ ID NO: 1543427 - protein, 25 aa, Mycobacterium tuberculosis
DNTTITGSATSAGSAARRTCTRCTS

SEQ ID NO: 1543428 - protein, 6 aa, Mycobacterium tuberculosis
DNTYPG

SEQ ID NO: 1543429 - protein, 10 aa, Mycobacterium tuberculosis
DPADDGPVAT

SEQ ID NO: 1543430 - protein, 6 aa, Mycobacterium tuberculosis
DPDAVG

SEQ ID NO: 1543431 - protein, 11 aa, Mycobacterium tuberculosis
DPDNRRPVDYG

SEQ ID NO: 1543432 - protein, 15 aa, Mycobacterium tuberculosis
DPDQLGRRLDNAKKT

SEQ ID NO: 1543433 - protein, 10 aa, Mycobacterium tuberculosis
DPEGGGPHRT

SEQ ID NO: 1543434 - protein, 7 aa, Mycobacterium tuberculosis
DPEWRST

SEQ ID NO: 1543435 - protein, 5 aa, Mycobacterium tuberculosis
DPFRR

SEQ ID NO: 1543436 - protein, 7 aa, Mycobacterium tuberculosis
DPHSGDI

SEQ ID NO: 1543437 - protein, 17 aa, Mycobacterium tuberculosis
DPHSGDIVNPSGQHGDE

SEQ ID NO: 1543438 - protein, 5 aa, Mycobacterium tuberculosis
DPIGP

SEQ ID NO: 1543439 - protein, 73 aa, Mycobacterium tuberculosis; identical to SEQ ID NO: 1425483

SEQ ID NO: 1543440 - protein, 7 aa, Mycobacterium tuberculosis
DPLPGTV

SEQ ID NO: 1543441 - protein, 10 aa, Mycobacterium tuberculosis
DPLPPTPRRE

SEQ ID NO: 1543442 - protein, 17 aa, Mycobacterium tuberculosis
DPRRQVAAGRADRQGRC

SEQ ID NO: 1543443 - protein, 5 aa, Mycobacterium tuberculosis
DPRTR

SEQ ID NO: 1543444 - protein, 4 aa, Mycobacterium tuberculosis
DPTF

SEQ ID NO: 1543445 - protein, 5 aa, Mycobacterium tuberculosis
DPTFD

SEQ ID NO: 1543446 - protein, 10 aa, Mycobacterium tuberculosis
DPTGKTVVPD

SEQ ID NO: 1543447 - protein, 8 aa, Mycobacterium tuberculosis
DPTTGRED

SEQ ID NO: 1543448 - protein, 13 aa, Mycobacterium tuberculosis
DPVAARPAAQEAR

SEQ ID NO: 1543449 - protein, 21 aa, Mycobacterium tuberculosis
DPVAPAARGPPAAQGSVRTGQ

SEQ ID NO: 1543450 - protein, 31 aa, Mycobacterium tuberculosis; identical to SEQ ID NO: 155566

SEQ ID NO: 1543451 - protein, 15 aa, Mycobacterium tuberculosis
DPYTGDEDPQTAQKI

SEQ ID NO: 1543452 - protein, 5 aa, Mycobacterium tuberculosis
DQAQR

SEQ ID NO: 1543453 - protein, 6 aa, Mycobacterium tuberculosis
DQDPGQ

SEQ ID NO: 1543454 - protein, 7 aa, Mycobacterium tuberculosis
DQKDNLN

SEQ ID NO: 1543455 - protein, 8 aa, Mycobacterium tuberculosis
DQLASAPR

SEQ ID NO: 1543456 - protein, 6 aa, Mycobacterium tuberculosis
DQPDIY

SEQ ID NO: 1543457 - protein, 6 aa, Mycobacterium tuberculosis
DQPGVT

SEQ ID NO: 1543458 - protein, 7 aa, Mycobacterium tuberculosis
DQPRDRA

SEQ ID NO: 1543459 - protein, 4 aa, Mycobacterium tuberculosis
DQQA

SEQ ID NO: 1543460 - protein, 6 aa, Mycobacterium tuberculosis
DQQYGQ

SEQ ID NO: 1543461 - protein, 9 aa, Mycobacterium tuberculosis
DQRPGAGSL

SEQ ID NO: 1543462 - protein, 9 aa, Mycobacterium tuberculosis
DQTDPNAPL

SEQ ID NO: 1543463 - protein, 7 aa, Mycobacterium tuberculosis
DRAGRRR

SEQ ID NO: 1543464 - protein, 5 aa, Mycobacterium tuberculosis
DRDQL

SEQ ID NO: 1543465 - protein, 10 aa, Mycobacterium tuberculosis
DRGSPSRVPA

SEQ ID NO: 1543466 - protein, 10 aa, Mycobacterium tuberculosis
DRGSSMSSKP

SEQ ID NO: 1543467 - protein, 8 aa, Mycobacterium tuberculosis
DRLGAADG

SEQ ID NO: 1543468 - protein, 9 aa, Mycobacterium tuberculosis
DRPGKAKAL

SEQ ID NO: 1543469 - protein, 33 aa, Mycobacterium tuberculosis
DRPTPKKPDAAGSAGPDATEQIGAGTIPFDSDA

SEQ ID NO: 1543470 - protein, 6 aa, Mycobacterium tuberculosis
DRSAAD

SEQ ID NO: 1543471 - protein, 12 aa, Mycobacterium tuberculosis
DRWAPPYAEAGA

SEQ ID NO: 1543472 - protein, 9 aa, Mycobacterium tuberculosis
DRWQRRGSP

SEQ ID NO: 1543473 - protein, 12 aa, Mycobacterium tuberculosis
DSAAAAAGRAAP

SEQ ID NO: 1543474 - protein, 18 aa, Mycobacterium tuberculosis
DSAGSSRRAADPPDACIG

SEQ ID NO: 1543475 - protein, 8 aa, Mycobacterium tuberculosis
DSASEPDR

SEQ ID NO: 1543476 - protein, 10 aa, Mycobacterium tuberculosis
DSDAGGGGHE

SEQ ID NO: 1543477 - protein, 7 aa, Mycobacterium tuberculosis
DSDSPTY

SEQ ID NO: 1543478 - protein, 7 aa, Mycobacterium tuberculosis
DSGDDCP

SEQ ID NO: 1543479 - protein, 12 aa, Mycobacterium tuberculosis
DSGHNTPVVFSQ

SEQ ID NO: 1543480 - protein, 6 aa, Mycobacterium tuberculosis
DSGTHS

SEQ ID NO: 1543481 - protein, 10 aa, Mycobacterium tuberculosis
DSKATNPHAA

SEQ ID NO: 1543482 - protein, 6 aa, Mycobacterium tuberculosis
DSLPQT

SEQ ID NO: 1543483 - protein, 4 aa, Mycobacterium tuberculosis
DSNG

SEQ ID NO: 1543484 - protein, 8 aa, Mycobacterium tuberculosis
DSNPTHAG

SEQ ID NO: 1543485 - protein, 23 aa, Mycobacterium tuberculosis
DSRQSANRRPPNVHYKRSYVLSP

SEQ ID NO: 1543486 - protein, 46 aa, Mycobacterium tuberculosis
DSRRGRRPGVDRGRPAAGTRNRKNDPTGNRAVEDRRPAEPFHQDPG

SEQ ID NO: 1543487 - protein, 4 aa, Mycobacterium tuberculosis
DSTG

SEQ ID NO: 1543488 - protein, 4 aa, Mycobacterium tuberculosis
DSVG

SEQ ID NO: 1543489 - protein, 6 aa, Mycobacterium tuberculosis
DTADEI

SEQ ID NO: 1543490 - protein, 13 aa, Mycobacterium tuberculosis
DTDEQEPADPPRK

SEQ ID NO: 1543491 - protein, 9 aa, Mycobacterium tuberculosis
DTGPDGDTT

SEQ ID NO: 1543492 - protein, 10 aa, Mycobacterium tuberculosis
DTLTQGPQQI

SEQ ID NO: 1543493 - protein, 9 aa, Mycobacterium tuberculosis
DTNPPLAAS

SEQ ID NO: 1543494 - protein, 4 aa, Mycobacterium tuberculosis
DTPE

SEQ ID NO: 1543495 - protein, 5 aa, Mycobacterium tuberculosis
DTQRA

SEQ ID NO: 1543496 - protein, 5 aa, Mycobacterium tuberculosis
DTRPR

SEQ ID NO: 1543497 - protein, 23 aa, Mycobacterium tuberculosis
DVGPDGGGVAGCGGGGDGGRGGP

SEQ ID NO: 1543498 - protein, 35 aa, Mycobacterium tuberculosis; identical to SEQ ID NO: 193934

SEQ ID NO: 1543499 - protein, 45 aa, Mycobacterium tuberculosis; identical to SEQ ID NO: 172701

SEQ ID NO: 1543500 - protein, 35 aa, Mycobacterium tuberculosis
DVTCPNDTAADPNSSASPSHAAAAASNGLDPAPEY

SEQ ID NO: 1543501 - protein, 7 aa, Mycobacterium tuberculosis
DVTGRRP

SEQ ID NO: 1543502 - protein, 8 aa, Mycobacterium tuberculosis
DYPQAKRV

SEQ ID NO: 1543503 - protein, 15 aa, Mycobacterium tuberculosis
DYRTGIGGLNSGTGN

SEQ ID NO: 1543504 - protein, 20 aa, Mycobacterium tuberculosis
EAARGGWQTVSGSRRNAAYQ

SEQ ID NO: 1543505 - protein, 10 aa, Mycobacterium tuberculosis
EAATKRRRGE

SEQ ID NO: 1543506 - protein, 7 aa, Mycobacterium tuberculosis
EADRDGF

SEQ ID NO: 1543507 - protein, 14 aa, Mycobacterium tuberculosis
EADTENDDEHGSAL

SEQ ID NO: 1543508 - protein, 8 aa, Mycobacterium tuberculosis
EAEGGMGP

SEQ ID NO: 1543509 - protein, 6 aa, Mycobacterium tuberculosis
EAEYEK

SEQ ID NO: 1543510 - protein, 16 aa, Mycobacterium tuberculosis
EAGGDGSDGGAGGSGG

SEQ ID NO: 1543511 - protein, 5 aa, Mycobacterium tuberculosis
EAGGL

SEQ ID NO: 1543512 - protein, 7 aa, Mycobacterium tuberculosis
EAGTVNG

SEQ ID NO: 1543513 - protein, 11 aa, Mycobacterium tuberculosis
EANEETGIDPS

SEQ ID NO: 1543514 - protein, 12 aa, Mycobacterium tuberculosis
EAPPAGADTEET

SEQ ID NO: 1543515 - protein, 7 aa, Mycobacterium tuberculosis
EAPSLSQ

SEQ ID NO: 1543516 - protein, 10 aa, Mycobacterium tuberculosis
EARPATGTGC

SEQ ID NO: 1543517 - protein, 4 aa, Mycobacterium tuberculosis
EASE

SEQ ID NO: 1543518 - protein, 6 aa, Mycobacterium tuberculosis
EASGGS

SEQ ID NO: 1543519 - protein, 6 aa, Mycobacterium tuberculosis
EASRRR

SEQ ID NO: 1543520 - protein, 5 aa, Mycobacterium tuberculosis
EATGA

SEQ ID NO: 1543521 - protein, 7 aa, Mycobacterium tuberculosis
EATYEPD

SEQ ID NO: 1543522 - protein, 9 aa, Mycobacterium tuberculosis
ECQGGYNPM

SEQ ID NO: 1543523 - protein, 15 aa, Mycobacterium tuberculosis
EDPGVRPGKGRRKKP

SEQ ID NO: 1543524 - protein, 5 aa, Mycobacterium tuberculosis
EDPPM

SEQ ID NO: 1543525 - protein, 9 aa, Mycobacterium tuberculosis
EEQAGRPRR

SEQ ID NO: 1543526 - protein, 4 aa, Mycobacterium tuberculosis
EERR

SEQ ID NO: 1543527 - protein, 18 aa, Mycobacterium tuberculosis
EESEPEREFEETCEKAIP

SEQ ID NO: 1543528 - protein, 7 aa, Mycobacterium tuberculosis
EFGGPAV

SEQ ID NO: 1543529 - protein, 7 aa, Mycobacterium tuberculosis
EFGTPRS

SEQ ID NO: 1543530 - protein, 6 aa, Mycobacterium tuberculosis
EGAMTP

SEQ ID NO: 1543531 - protein, 6 aa, Mycobacterium tuberculosis
EGDGGW

SEQ ID NO: 1543532 - protein, 13 aa, Mycobacterium tuberculosis
EGDISNTPADGCH

SEQ ID NO: 1543533 - protein, 7 aa, Mycobacterium tuberculosis
EGEGRSV

SEQ ID NO: 1543534 - protein, 23 aa, Mycobacterium tuberculosis
EGKAGAGDAISAGTTRTAVTDRP

SEQ ID NO: 1543535 - protein, 24 aa, Mycobacterium tuberculosis
EGKAGAGDAISAGTTRTAVTDRPA

SEQ ID NO: 1543536 - protein, 5 aa, Mycobacterium tuberculosis
EGKNA

SEQ ID NO: 1543537 - protein, 6 aa, Mycobacterium tuberculosis
EGLTIT

SEQ ID NO: 1543538 - protein, 47 aa, Mycobacterium tuberculosis
EGPGGRARQASRRRGRPRCAGDQDPRASPPAGRACRPGHHAGRRRHR

SEQ ID NO: 1543539 - protein, 4 aa, Mycobacterium tuberculosis
EGPR

SEQ ID NO: 1543540 - protein, 5 aa, Mycobacterium tuberculosis
EGPTV

SEQ ID NO: 1543541 - protein, 5 aa, Mycobacterium tuberculosis
EGRAL

SEQ ID NO: 1543542 - protein, 4 aa, Mycobacterium tuberculosis
EGTA

SEQ ID NO: 1543543 - protein, 4 aa, Mycobacterium tuberculosis
EGTM

SEQ ID NO: 1543544 - protein, 51 aa, Mycobacterium tuberculosis
EGTPEHPGPAVPPGSPCSYTPPADGLPRPWDPLPSANLTQGPFGGPDFPAP

SEQ ID NO: 1543545 - protein, 10 aa, Mycobacterium tuberculosis
EHQPRGPARA

SEQ ID NO: 1543546 - protein, 6 aa, Mycobacterium tuberculosis
EHSTAD

SEQ ID NO: 1543547 - protein, 27 aa, Mycobacterium tuberculosis
EHTEHDDSEIVGEPEAGALVDLSSMDA

SEQ ID NO: 1543548 - protein, 7 aa, Mycobacterium tuberculosis
EIERDGR

SEQ ID NO: 1543549 - protein, 14 aa, Mycobacterium tuberculosis
EKGKPPKVFEDGGQ

SEQ ID NO: 1543550 - protein, 10 aa, Mycobacterium tuberculosis
EKKPKDVETK

SEQ ID NO: 1543551 - protein, 7 aa, Mycobacterium tuberculosis
EKKSLAD

SEQ ID NO: 1543552 - protein, 19 aa, Mycobacterium tuberculosis
ELGQAANSFSSGHRSAGRH

SEQ ID NO: 1543553 - protein, 6 aa, Mycobacterium tuberculosis
ELGSRG

SEQ ID NO: 1543554 - protein, 9 aa, Mycobacterium tuberculosis
ELGTTAASY

SEQ ID NO: 1543555 - protein, 5 aa, Mycobacterium tuberculosis
ELPEV

SEQ ID NO: 1543556 - protein, 6 aa, Mycobacterium tuberculosis
ELPEVP

SEQ ID NO: 1543557 - protein, 11 aa, Mycobacterium tuberculosis
ELPKQGSRTPW

SEQ ID NO: 1543558 - protein, 10 aa, Mycobacterium tuberculosis
ELPSGDAPVQ

SEQ ID NO: 1543559 - protein, 5 aa, Mycobacterium tuberculosis
ELRPG

SEQ ID NO: 1543560 - protein, 55 aa, Mycobacterium tuberculosis
ELSQAAPPARARTPLPVPTPRGERPDDGGHAPHRDRRVNQRRRQVGDRRAQRGVD

SEQ ID NO: 1543561 - protein, 6 aa, Mycobacterium tuberculosis
EMRPTE

SEQ ID NO: 1543562 - protein, 19 aa, Mycobacterium tuberculosis
ENGQPSGSWRLRNATPPTR

SEQ ID NO: 1543563 - protein, 5 aa, Mycobacterium tuberculosis
ENLPW

SEQ ID NO: 1543564 - protein, 9 aa, Mycobacterium tuberculosis
EPAGPTAPH

SEQ ID NO: 1543565 - protein, 5 aa, Mycobacterium tuberculosis
EPAKP

SEQ ID NO: 1543566 - protein, 12 aa, Mycobacterium tuberculosis
EPANSRADDDCA

SEQ ID NO: 1543567 - protein, 4 aa, Mycobacterium tuberculosis
EPAT

SEQ ID NO: 1543568 - protein, 15 aa, Mycobacterium tuberculosis
EPDGTPVPACSRGTL

SEQ ID NO: 1543569 - protein, 5 aa, Mycobacterium tuberculosis
EPDLP

SEQ ID NO: 1543570 - protein, 8 aa, Mycobacterium tuberculosis
EPGRSESQ

SEQ ID NO: 1543571 - protein, 16 aa, Mycobacterium tuberculosis
EPGSGNSTTTTSDPFS

SEQ ID NO: 1543572 - protein, 11 aa, Mycobacterium tuberculosis
EPGSNEPTHRV

SEQ ID NO: 1543573 - protein, 7 aa, Mycobacterium tuberculosis
EPKTGAV

SEQ ID NO: 1543574 - protein, 9 aa, Mycobacterium tuberculosis
EPNTRQIKS

SEQ ID NO: 1543575 - protein, 6 aa, Mycobacterium tuberculosis
EPRFPS

SEQ ID NO: 1543576 - protein, 8 aa, Mycobacterium tuberculosis
EPRTEGGV

SEQ ID NO: 1543577 - protein, 11 aa, Mycobacterium tuberculosis
EPSVTGPRHIS

SEQ ID NO: 1543578 - protein, 7 aa, Mycobacterium tuberculosis
EPTGEGF

SEQ ID NO: 1543579 - protein, 11 aa, Mycobacterium tuberculosis
EPTNPDSAALG

SEQ ID NO: 1543580 - protein, 16 aa, Mycobacterium tuberculosis
EPVRASRGKRSKMTTP

SEQ ID NO: 1543581 - protein, 9 aa, Mycobacterium tuberculosis
EQAAAHPSA

SEQ ID NO: 1543582 - protein, 8 aa, Mycobacterium tuberculosis
EQIPPEAF

SEQ ID NO: 1543583 - protein, 5 aa, Mycobacterium tuberculosis
EQPDS

SEQ ID NO: 1543584 - protein, 10 aa, Mycobacterium tuberculosis
EQPEAGAAGN

SEQ ID NO: 1543585 - protein, 5 aa, Mycobacterium tuberculosis
EQPLP

SEQ ID NO: 1543586 - protein, 8 aa, Mycobacterium tuberculosis
ERADAPLR

SEQ ID NO: 1543587 - protein, 8 aa, Mycobacterium tuberculosis
ERAETPVP

SEQ ID NO: 1543588 - protein, 6 aa, Mycobacterium tuberculosis
ERDETS

SEQ ID NO: 1543589 - protein, 8 aa, Mycobacterium tuberculosis
EREKREAE

SEQ ID NO: 1543590 - protein, 10 aa, Mycobacterium tuberculosis
ERGSADPTVN

SEQ ID NO: 1543591 - protein, 11 aa, Mycobacterium tuberculosis
ERHGLGNDPIS

SEQ ID NO: 1543592 - protein, 9 aa, Mycobacterium tuberculosis
ERNNNDGSV

SEQ ID NO: 1543593 - protein, 24 aa, Mycobacterium tuberculosis
ERPEEKPRNPAQRGDDTGRGTARQ

SEQ ID NO: 1543594 - protein, 4 aa, Mycobacterium tuberculosis
ERPT

SEQ ID NO: 1543595 - protein, 16 aa, Mycobacterium tuberculosis
ERRGRGRRRRRRPSRR

SEQ ID NO: 1543596 - protein, 11 aa, Mycobacterium tuberculosis
ERRQNHAARQR

SEQ ID NO: 1543597 - protein, 13 aa, Mycobacterium tuberculosis
ERSLQTPATRGSA

SEQ ID NO: 1543598 - protein, 9 aa, Mycobacterium tuberculosis
ERTEDGFGQ

SEQ ID NO: 1543599 - protein, 16 aa, Mycobacterium tuberculosis
ERTQKPTKSARFRKLF

SEQ ID NO: 1543600 - protein, 9 aa, Mycobacterium tuberculosis
ERYDSGQRC

SEQ ID NO: 1543601 - protein, 4 aa, Mycobacterium tuberculosis
ESAG

SEQ ID NO: 1543602 - protein, 9 aa, Mycobacterium tuberculosis
ESALTGESL

SEQ ID NO: 1543603 - protein, 9 aa, Mycobacterium tuberculosis
ESGDTPHVA

SEQ ID NO: 1543604 - protein, 8 aa, Mycobacterium tuberculosis
ESGKEHKG

SEQ ID NO: 1543605 - protein, 11 aa, Mycobacterium tuberculosis
ESGLRASAKGY

SEQ ID NO: 1543606 - protein, 25 aa, Mycobacterium tuberculosis
ESIGGSVSAALGKGSSAGSLSVPPD

SEQ ID NO: 1543607 - protein, 18 aa, Mycobacterium tuberculosis
ESLNSSAAASPLSGITGE

SEQ ID NO: 1543608 - protein, 6 aa, Mycobacterium tuberculosis
ESLTPG

SEQ ID NO: 1543609 - protein, 6 aa, Mycobacterium tuberculosis
ESPPGA

SEQ ID NO: 1543610 - protein, 64 aa, Mycobacterium tuberculosis
ESSGHPADGPRNSQHGGLPAAARGAIGGGRSAGCGAARPAGRDAGESARDGGGRRPARRGFSES

SEQ ID NO: 1543611 - protein, 6 aa, Mycobacterium tuberculosis
ETANAT

SEQ ID NO: 1543612 - protein, 5 aa, Mycobacterium tuberculosis
ETAPE

SEQ ID NO: 1543613 - protein, 6 aa, Mycobacterium tuberculosis
ETATAA

SEQ ID NO: 1543614 - protein, 5 aa, Mycobacterium tuberculosis
ETGNS

SEQ ID NO: 1543615 - protein, 5 aa, Mycobacterium tuberculosis
ETPIG

SEQ ID NO: 1543616 - protein, 13 aa, Mycobacterium tuberculosis
EVDDQSRARAALR

SEQ ID NO: 1543617 - protein, 4 aa, Mycobacterium tuberculosis
EVDQ

SEQ ID NO: 1543618 - protein, 7 aa, Mycobacterium tuberculosis
EVPPTSR

SEQ ID NO: 1543619 - protein, 7 aa, Mycobacterium tuberculosis
EVPTGEV

SEQ ID NO: 1543620 - protein, 19 aa, Mycobacterium tuberculosis
EVRGPTGYDGFDVDLRASA

SEQ ID NO: 1543621 - protein, 16 aa, Mycobacterium tuberculosis
EVSGGDCGVVRGPMLR

SEQ ID NO: 1543622 - protein, 16 aa, Mycobacterium tuberculosis
EWRSPADTSPRPLPSG

SEQ ID NO: 1543623 - protein, 107 aa, Mycobacterium tuberculosis; identical to SEQ ID NO: 1420078

SEQ ID NO: 1543624 - protein, 8 aa, Mycobacterium tuberculosis
FANPGLGA

SEQ ID NO: 1543625 - protein, 9 aa, Mycobacterium tuberculosis
FANSGPAVG

SEQ ID NO: 1543626 - protein, 5 aa, Mycobacterium tuberculosis
FANTG

SEQ ID NO: 1543627 - protein, 8 aa, Mycobacterium tuberculosis
FANTGDNN

SEQ ID NO: 1543628 - protein, 7 aa, Mycobacterium tuberculosis
FANTGSY

SEQ ID NO: 1543629 - protein, 13 aa, Mycobacterium tuberculosis
FAPSAAAKKSPLA

SEQ ID NO: 1543630 - protein, 6 aa, Mycobacterium tuberculosis
FATGAG

SEQ ID NO: 1543631 - protein, 8 aa, Mycobacterium tuberculosis
FDAEPDEL

SEQ ID NO: 1543632 - protein, 463 aa, Mycobacterium tuberculosis
FDGGQGGQGGAGGNAGAGGINGAGGAGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGQNGTTGVASEGGAGGQGGDGGDGGEGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 1543633 - protein, 69 aa, Mycobacterium tuberculosis
FDGGQGGQGGAGGNAGAGGINGAGGAGGTGGDGGDGATGAAGLGDNGGVGGDGGAGGAAGNGGNAGVGL

SEQ ID NO: 1543634 - protein, 326 aa, Mycobacterium tuberculosis
FDGGQGGQGGAGGSAGAGGINGAGGAGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGNAGFGAGVPGDGGDGGNAGFGAGVPGDGGIGGTGGAGGAGGGRHRRHRRGR

SEQ ID NO: 1543635 - protein, 682 aa, Mycobacterium tuberculosis
FDGGQGGQGGAGGSAGAGGINGAGGAGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGQNGTTGVASEGGAGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGQNGTTGVASEGGAGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 1543636 - protein, 9 aa, Mycobacterium tuberculosis
FDNPGPSDY

SEQ ID NO: 1543637 - protein, 4 aa, Mycobacterium tuberculosis
FDPE

SEQ ID NO: 1543638 - protein, 46 aa, Mycobacterium tuberculosis
FDSPDPEAEPDVVGGKGGDGGKGGSGLGVGGAGGTGGAGGNGGAGG

SEQ ID NO: 1543639 - protein, 6 aa, Mycobacterium tuberculosis
FGAYGQ

SEQ ID NO: 1543640 - protein, 8 aa, Mycobacterium tuberculosis
FGDPTGRH

SEQ ID NO: 1543641 - protein, 9 aa, Mycobacterium tuberculosis
FGGGNNGTL

SEQ ID NO: 1543642 - protein, 23 aa, Mycobacterium tuberculosis
FGGLGGGSNGTGGAGGAGGTGAT

SEQ ID NO: 1543643 - protein, 10 aa, Mycobacterium tuberculosis
FGNAGGTNVG

SEQ ID NO: 1543644 - protein, 9 aa, Mycobacterium tuberculosis
FGNAGSSNF

SEQ ID NO: 1543645 - protein, 22 aa, Mycobacterium tuberculosis
FGNGGAGGAGLQPGGRNRRGPV

SEQ ID NO: 1543646 - protein, 31 aa, Mycobacterium tuberculosis
FGNGGAGGAGYSPAAGTGAAGEPAAPVEPVA

SEQ ID NO: 1543647 - protein, 39 aa, Mycobacterium tuberculosis
FGNGGAGGAGYSPAAGTGAAGGAGGAGGAGGWLSGNGGA

SEQ ID NO: 1543648 - protein, 41 aa, Mycobacterium tuberculosis
FGNGGAGGAGYSPAAGTGAAGGAGGAGGAGGWLSGNGGAGG

SEQ ID NO: 1543649 - protein, 42 aa, Mycobacterium tuberculosis
FGNGGAGGAGYSPAAGTGAAGGAGGAGGAGGWLSGNGGAGGN

SEQ ID NO: 1543650 - protein, 44 aa, Mycobacterium tuberculosis
FGNGGAGGAGYSPAAGTGAAGGAGGAGGAGGWLSGNGGAGGNGG

SEQ ID NO: 1543651 - protein, 26 aa, Mycobacterium tuberculosis
FGNGGAGGAGYSPAAGTGAAGGAGGW

SEQ ID NO: 1543652 - protein, 30 aa, Mycobacterium tuberculosis
FGNGGAGGAGYSPASGTGAPGGAGGAVGAG

SEQ ID NO: 1543653 - protein, 8 aa, Mycobacterium tuberculosis
FGNGGPAV

SEQ ID NO: 1543654 - protein, 14 aa, Mycobacterium tuberculosis
FGNSGLGRRSASAI

SEQ ID NO: 1543655 - protein, 9 aa, Mycobacterium tuberculosis
FGNSGNNNI

SEQ ID NO: 1543656 - protein, 10 aa, Mycobacterium tuberculosis
FGNTGAQTVG

SEQ ID NO: 1543657 - protein, 9 aa, Mycobacterium tuberculosis
FGNTGNNNI

SEQ ID NO: 1543658 - protein, 10 aa, Mycobacterium tuberculosis
FGNTGTNNVG

SEQ ID NO: 1543659 - protein, 25 aa, Mycobacterium tuberculosis
FGPAPGPAPPPAAPGPPAPPGLGPQ

SEQ ID NO: 1543660 - protein, 22 aa, Mycobacterium tuberculosis
FGSAPANVADRRGPPNLTHPPS

SEQ ID NO: 1543661 - protein, 8 aa, Mycobacterium tuberculosis
FGSPQPGD

SEQ ID NO: 1543662 - protein, 6 aa, Mycobacterium tuberculosis
FGVGGT

SEQ ID NO: 1543663 - protein, 4 aa, Mycobacterium tuberculosis
FGVQ

SEQ ID NO: 1543664 - protein, 6 aa, Mycobacterium tuberculosis
FHDPPW

SEQ ID NO: 1543665 - protein, 16 aa, Mycobacterium tuberculosis
FHPTPGGTRRVVGVTG

SEQ ID NO: 1543666 - protein, 20 aa, Mycobacterium tuberculosis
FNPGSSNTGTFNTGNANTGF

SEQ ID NO: 1543667 - protein, 8 aa, Mycobacterium tuberculosis
FNSGSENV

SEQ ID NO: 1543668 - protein, 7 aa, Mycobacterium tuberculosis
FNSGSGN

SEQ ID NO: 1543669 - protein, 18 aa, Mycobacterium tuberculosis
FNSGSGNIGFGNSGTGNV

SEQ ID NO: 1543670 - protein, 13 aa, Mycobacterium tuberculosis
FNTGFGNGGNTNF

SEQ ID NO: 1543671 - protein, 12 aa, Mycobacterium tuberculosis
FNTGGVNPGTVN

SEQ ID NO: 1543672 - protein, 9 aa, Mycobacterium tuberculosis
FPAAPDTNS

SEQ ID NO: 1543673 - protein, 12 aa, Mycobacterium tuberculosis
FQPGSARSARWP

SEQ ID NO: 1543674 - protein, 4 aa, Mycobacterium tuberculosis
FQRG

SEQ ID NO: 1543675 - protein, 4 aa, Mycobacterium tuberculosis
FRDA

SEQ ID NO: 1543676 - protein, 6 aa, Mycobacterium tuberculosis
FRDETG

SEQ ID NO: 1543677 - protein, 27 aa, Mycobacterium tuberculosis
FRPGGRPAHPGSGDQRAPDRQRGDGRL

SEQ ID NO: 1543678 - protein, 11 aa, Mycobacterium tuberculosis
FSADSRGQFPG

SEQ ID NO: 1543679 - protein, 196 aa, Mycobacterium tuberculosis
FSNGSNGGTGGTGGVGGTGGDGGNAGTGAGDPGKGGTGGTGGTGGSGGAGGSGGANFNGGTGGTGGTGGKGGLNTDGLSSATSGTGGTGGKGGTGGAGDDSAGGTGGTGGAGGNAGAGGLANTGGTAGNAGIGGDGGQGGNGGQGDSGSGLGGQPGFAGGPGGKGGAGGNAGTGGTNGSGAGGAGGQGGAGGAGIS

SEQ ID NO: 1543680 - protein, 198 aa, Mycobacterium tuberculosis
FSNGSNGGTGGTGGVGGTGGDGGNAGTGAGDPGKGGTGGTGGTGGSGGAGGSGGANFNGGTGGTGGTGGKGGLNTDGLSSATSGTGGTGGTGGKGGTGGAGDDSAGGTGGTGGAGGNAGAGGLANTGGTAGNAGIGGDGGQGGNGGQGDSGSGLGGQPGFAGGAGGKGGAGGNAGTGGAIGSGAGGAGVQCGAGGAGI

SEQ ID NO: 1543681 - protein, 200 aa, Mycobacterium tuberculosis
FSNGSNGGTGGTGGVGGTGGDGGNAGTGAGDPGKGGTGGTGGTGGSGGAGGSGGANFNGGTGGTGGTGGTGGKGGMGGIAGDGGPGGDGGNAGVGGKGGTNGNGGSGGTGGTGGAGGNAGAGGLANTGGTAGNAGIGGDGGQGGNGGQGDSGSGLGGQPGFAGGPGGKGGAGGNAGTGGTNGSGAGGAGGQGGAGGAGIS

SEQ ID NO: 1543682 - protein, 10 aa, Mycobacterium tuberculosis
FSTGGKTPLA

SEQ ID NO: 1543683 - protein, 31 aa, Mycobacterium tuberculosis; identical to SEQ ID NO: 1424796

SEQ ID NO: 1543684 - protein, 7 aa, Mycobacterium tuberculosis
FTEGRSA

SEQ ID NO: 1543685 - protein, 20 aa, Mycobacterium tuberculosis
FTPGSPSSGSGGSPGGPGGS

SEQ ID NO: 1543686 - protein, 13 aa, Mycobacterium tuberculosis
FTPSPSAAATPGG

SEQ ID NO: 1543687 - protein, 10 aa, Mycobacterium tuberculosis
FTSGGGAAQR

SEQ ID NO: 1543688 - protein, 6 aa, Mycobacterium tuberculosis
FTTPDR

SEQ ID NO: 1543689 - protein, 30 aa, Mycobacterium tuberculosis
FVGNGGAGGNGQLGSGAVSSAGWDGRQRGL

SEQ ID NO: 1543690 - protein, 10 aa, Mycobacterium tuberculosis
FVPGPSDPTA

SEQ ID NO: 1543691 - protein, 15 aa, Mycobacterium tuberculosis
GAAATARAAVATPAA

SEQ ID NO: 1543692 - protein, 26 aa, Mycobacterium tuberculosis
GAAGAGGAATGDGATGGAGGFGGAGA

SEQ ID NO: 1543693 - protein, 5 aa, Mycobacterium tuberculosis
GAAGV

SEQ ID NO: 1543694 - protein, 17 aa, Mycobacterium tuberculosis
GAANAPAAAAQGAAQGL

SEQ ID NO: 1543695 - protein, 7 aa, Mycobacterium tuberculosis
GAAPDTR

SEQ ID NO: 1543696 - protein, 10 aa, Mycobacterium tuberculosis
GAAPVFPGRT

SEQ ID NO: 1543697 - protein, 16 aa, Mycobacterium tuberculosis
GAASAYASAKATNVEQ

SEQ ID NO: 1543698 - protein, 7 aa, Mycobacterium tuberculosis
GADELST

SEQ ID NO: 1543699 - protein, 22 aa, Mycobacterium tuberculosis
GADGGNGGAGVRHERARRRCGR

SEQ ID NO: 1543700 - protein, 13 aa, Mycobacterium tuberculosis
GADGLPGQNGGAG

SEQ ID NO: 1543701 - protein, 5 aa, Mycobacterium tuberculosis
GADPA

SEQ ID NO: 1543702 - protein, 7 aa, Mycobacterium tuberculosis
GADPSDI

SEQ ID NO: 1543703 - protein, 12 aa, Mycobacterium tuberculosis
GAEGAAARTADR

SEQ ID NO: 1543704 - protein, 6 aa, Mycobacterium tuberculosis
GAEPPQ

SEQ ID NO: 1543705 - protein, 6 aa, Mycobacterium tuberculosis
GAERLP

SEQ ID NO: 1543706 - protein, 7 aa, Mycobacterium tuberculosis
GAGAGMP

SEQ ID NO: 1543707 - protein, 7 aa, Mycobacterium tuberculosis
GAGAGPM

SEQ ID NO: 1543708 - protein, 44 aa, Mycobacterium tuberculosis; identical to SEQ ID NO: 174646

SEQ ID NO: 1543709 - protein, 17 aa, Mycobacterium tuberculosis
GAGAYAAPSRQREQQVP

SEQ ID NO: 1543710 - protein, 22 aa, Mycobacterium tuberculosis
GAGGAGGAGGVGGTGGAGGAGF

SEQ ID NO: 1543711 - protein, 12 aa, Mycobacterium tuberculosis
GAGGAGGHGGAA

SEQ ID NO: 1543712 - protein, 10 aa, Mycobacterium tuberculosis
GAGGAGGTAG

SEQ ID NO: 1543713 - protein, 26 aa, Mycobacterium tuberculosis
GAGGAGGTATGTGGNGGAGGGGGLSS

SEQ ID NO: 1543714 - protein, 8 aa, Mycobacterium tuberculosis
GAGGAGGV

SEQ ID NO: 1543715 - protein, 9 aa, Mycobacterium tuberculosis
GAGGAYAAA

SEQ ID NO: 1543716 - protein, 32 aa, Mycobacterium tuberculosis
GAGGEGGSGGAGGASTDVAGGAGGAGGAGGNA

SEQ ID NO: 1543717 - protein, 8 aa, Mycobacterium tuberculosis
GAGGGASY

SEQ ID NO: 1543718 - protein, 7 aa, Mycobacterium tuberculosis
GAGGGEV

SEQ ID NO: 1543719 - protein, 17 aa, Mycobacterium tuberculosis
GAGGGNGGAGGIGTGGR

SEQ ID NO: 1543720 - protein, 26 aa, Mycobacterium tuberculosis
GAGGHGGAGGLGAVTGGVGGTGGAGG

SEQ ID NO: 1543721 - protein, 14 aa, Mycobacterium tuberculosis
GAGGTGGHGGFADS

SEQ ID NO: 1543722 - protein, 15 aa, Mycobacterium tuberculosis
GAGGTGGSGGAGGNA

SEQ ID NO: 1543723 - protein, 28 aa, Mycobacterium tuberculosis
GAGGTGGSGGHGTPAAVPGGAGGAGGNA

SEQ ID NO: 1543724 - protein, 23 aa, Mycobacterium tuberculosis
GAGGVGGSSEDVGGTGGAGGAGR

SEQ ID NO: 1543725 - protein, 7 aa, Mycobacterium tuberculosis
GAGHRDL

SEQ ID NO: 1543726 - protein, 5 aa, Mycobacterium tuberculosis
GAGQR

SEQ ID NO: 1543727 - protein, 43 aa, Mycobacterium tuberculosis
GAGRPDHVATGDPAQYARAAGTATTGPGRAERNHSTRRRIDHR

SEQ ID NO: 1543728 - protein, 16 aa, Mycobacterium tuberculosis
GAGTASGFGNFGGGAS

SEQ ID NO: 1543729 - protein, 9 aa, Mycobacterium tuberculosis
GAGTGASSK

SEQ ID NO: 1543730 - protein, 6 aa, Mycobacterium tuberculosis
GAGTLE

SEQ ID NO: 1543731 - protein, 11 aa, Mycobacterium tuberculosis
GAKAQARSGEF

SEQ ID NO: 1543732 - protein, 8 aa, Mycobacterium tuberculosis
GAKPAPGT

SEQ ID NO: 1543733 - protein, 7 aa, Mycobacterium tuberculosis
GALGDQR

SEQ ID NO: 1543734 - protein, 13 aa, Mycobacterium tuberculosis
GALGSGVANVGNT

SEQ ID NO: 1543735 - protein, 12 aa, Mycobacterium tuberculosis
GALSTDAGNQGV

SEQ ID NO: 1543736 - protein, 9 aa, Mycobacterium tuberculosis
GANNVGNGN

SEQ ID NO: 1543737 - protein, 14 aa, Mycobacterium tuberculosis
GAPAATAGPAGVAA

SEQ ID NO: 1543738 - protein, 7 aa, Mycobacterium tuberculosis
GAPEAEQ

SEQ ID NO: 1543739 - protein, 8 aa, Mycobacterium tuberculosis
GAPGAREV

SEQ ID NO: 1543740 - protein, 25 aa, Mycobacterium tuberculosis
GAPGSAPREYDTDTSKYTYTGAGGV

SEQ ID NO: 1543741 - protein, 9 aa, Mycobacterium tuberculosis
GAPRNARPV

SEQ ID NO: 1543742 - protein, 7 aa, Mycobacterium tuberculosis
GAPSRPW

SEQ ID NO: 1543743 - protein, 55 aa, Mycobacterium tuberculosis
GAPTPPTPPSPPAPISPALPPAPPLPGNPPMTAAPPAPPTPPLPNAPAAPPAPPL

SEQ ID NO: 1543744 - protein, 23 aa, Mycobacterium tuberculosis
GAQGAARGAGGGALAARGRAGPD

SEQ ID NO: 1543745 - protein, 16 aa, Mycobacterium tuberculosis
GAQLAPRDVDAPLETQ

SEQ ID NO: 1543746 - protein, 8 aa, Mycobacterium tuberculosis
GARSPRLR

SEQ ID NO: 1543747 - protein, 12 aa, Mycobacterium tuberculosis
GARTAAARAQAV

SEQ ID NO: 1543748 - protein, 5 aa, Mycobacterium tuberculosis
GASAA

SEQ ID NO: 1543749 - protein, 8 aa, Mycobacterium tuberculosis
GASAAAEA

SEQ ID NO: 1543750 - protein, 9 aa, Mycobacterium tuberculosis
GASAAAEAL

SEQ ID NO: 1543751 - protein, 9 aa, Mycobacterium tuberculosis
GASPDRRAG

SEQ ID NO: 1543752 - protein, 7 aa, Mycobacterium tuberculosis
GASPRAE

SEQ ID NO: 1543753 - protein, 20 aa, Mycobacterium tuberculosis
GAVPNGDVGVGAVGGPLVVV

SEQ ID NO: 1543754 - protein, 8 aa, Mycobacterium tuberculosis
GAVPPVAS

SEQ ID NO: 1543755 - protein, 14 aa, Mycobacterium tuberculosis
GAWSNDSVSCPRSG

SEQ ID NO: 1543756 - protein, 14 aa, Mycobacterium tuberculosis
GCGAGEGARCSTAD

SEQ ID NO: 1543757 - protein, 15 aa, Mycobacterium tuberculosis
GCPGRERPNPGQPPM

SEQ ID NO: 1543758 - protein, 23 aa, Mycobacterium tuberculosis
GCPRRGRHSTRASSSISGWPMWA

SEQ ID NO: 1543759 - protein, 12 aa, Mycobacterium tuberculosis
GCQGDPSAAELP

SEQ ID NO: 1543760 - protein, 7 aa, Mycobacterium tuberculosis
GCQPGNG

SEQ ID NO: 1543761 - protein, 8 aa, Mycobacterium tuberculosis
GCQPGNGG

SEQ ID NO: 1543762 - protein, 9 aa, Mycobacterium tuberculosis
GCRRGPRRW

SEQ ID NO: 1543763 - protein, 11 aa, Mycobacterium tuberculosis
GCSADSGDRHP

SEQ ID NO: 1543764 - protein, 5 aa, Mycobacterium tuberculosis
GDADY

SEQ ID NO: 1543765 - protein, 13 aa, Mycobacterium tuberculosis
GDAEDGPAATTTW

SEQ ID NO: 1543766 - protein, 32 aa, Mycobacterium tuberculosis; identical to SEQ ID NO: 174975

SEQ ID NO: 1543767 - protein, 12 aa, Mycobacterium tuberculosis
GDAPPSGPGSRA

SEQ ID NO: 1543768 - protein, 18 aa, Mycobacterium tuberculosis
GDDAWDAPSPSALPAAQR

SEQ ID NO: 1543769 - protein, 19 aa, Mycobacterium tuberculosis
GDDPLGATQRITRRSQAAW

SEQ ID NO: 1543770 - protein, 24 aa, Mycobacterium tuberculosis
GDGGAGGTSNNNGGDGGAGGTAGG

SEQ ID NO: 1543771 - protein, 31 aa, Mycobacterium tuberculosis; identical to SEQ ID NO: 175034

SEQ ID NO: 1543772 - protein, 4 aa, Mycobacterium tuberculosis
GDGN

SEQ ID NO: 1543773 - protein, 90 aa, Mycobacterium tuberculosis; identical to SEQ ID NO: 232081

SEQ ID NO: 1543774 - protein, 10 aa, Mycobacterium tuberculosis
GDGTADCDAH

SEQ ID NO: 1543775 - protein, 13 aa, Mycobacterium tuberculosis
GDGTDAAPGSGGA

SEQ ID NO: 1543776 - protein, 18 aa, Mycobacterium tuberculosis
GDGTDAAPGSGGAAGPAA

SEQ ID NO: 1543777 - protein, 17 aa, Mycobacterium tuberculosis
GDGTDAAPGSGGAGGHG

SEQ ID NO: 1543778 - protein, 4 aa, Mycobacterium tuberculosis
GDHQ

SEQ ID NO: 1543779 - protein, 7 aa, Mycobacterium tuberculosis
GDINTGF

SEQ ID NO: 1543780 - protein, 22 aa, Mycobacterium tuberculosis
GDISEPPAAGEEGVTAAPEMGP

SEQ ID NO: 1543781 - protein, 8 aa, Mycobacterium tuberculosis
GDKGEADL

SEQ ID NO: 1543782 - protein, 7 aa, Mycobacterium tuberculosis
GDKTYRR

SEQ ID NO: 1543783 - protein, 4 aa, Mycobacterium tuberculosis
GDLD

SEQ ID NO: 1543784 - protein, 17 aa, Mycobacterium tuberculosis
GDLDPAQLADKFRMAWS

SEQ ID NO: 1543785 - protein, 11 aa, Mycobacterium tuberculosis
GDLGSAAASFS

SEQ ID NO: 1543786 - protein, 36 aa, Mycobacterium tuberculosis; identical to SEQ ID NO: 175084

SEQ ID NO: 1543787 - protein, 26 aa, Mycobacterium tuberculosis
GDNGGDGGNGGMGGAGGAGGPGGAGG

SEQ ID NO: 1543788 - protein, 46 aa, Mycobacterium tuberculosis; identical to SEQ ID NO: 151117

SEQ ID NO: 1543789 - protein, 7 aa, Mycobacterium tuberculosis
GDPAASG

SEQ ID NO: 1543790 - protein, 12 aa, Mycobacterium tuberculosis
GDPDEDAGTAAL

SEQ ID NO: 1543791 - protein, 5 aa, Mycobacterium tuberculosis
GDPNQ

SEQ ID NO: 1543792 - protein, 8 aa, Mycobacterium tuberculosis
GDPRRPVP

SEQ ID NO: 1543793 - protein, 7 aa, Mycobacterium tuberculosis
GDQSGAN

SEQ ID NO: 1543794 - protein, 8 aa, Mycobacterium tuberculosis
GDRGADVE

SEQ ID NO: 1543795 - protein, 13 aa, Mycobacterium tuberculosis
GDRGRAGCHRASD

SEQ ID NO: 1543796 - protein, 13 aa, Mycobacterium tuberculosis
GDRHRAERDAHDA

SEQ ID NO: 1543797 - protein, 7 aa, Mycobacterium tuberculosis
GDRSDQV

SEQ ID NO: 1543798 - protein, 25 aa, Mycobacterium tuberculosis
GDRSGAGRGRDPGHAHRRRRRPHDR

SEQ ID NO: 1543799 - protein, 8 aa, Mycobacterium tuberculosis
GDSAGGNI

SEQ ID NO: 1543800 - protein, 8 aa, Mycobacterium tuberculosis
GDSPERAQ

SEQ ID NO: 1543801 - protein, 8 aa, Mycobacterium tuberculosis
GDTGEPVN

SEQ ID NO: 1543802 - protein, 39 aa, Mycobacterium tuberculosis
GDTNTGFGNAGFTNTGFGNAGSGRFRERRQQQLRVRQLG

SEQ ID NO: 1543803 - protein, 10 aa, Mycobacterium tuberculosis
GDVGPAGPAV

SEQ ID NO: 1543804 - protein, 36 aa, Mycobacterium tuberculosis; identical to SEQ ID NO: 175208

SEQ ID NO: 1543805 - protein, 15 aa, Mycobacterium tuberculosis
GDYNTGVANTGNVNT

SEQ ID NO: 1543806 - protein, 12 aa, Mycobacterium tuberculosis
GEAAERLRRQLV

SEQ ID NO: 1543807 - protein, 8 aa, Mycobacterium tuberculosis
GEDTGMPA

SEQ ID NO: 1543808 - protein, 5 aa, Mycobacterium tuberculosis
GEEPG

SEQ ID NO: 1543809 - protein, 4 aa, Mycobacterium tuberculosis
GEFT

SEQ ID NO: 1543810 - protein, 9 aa, Mycobacterium tuberculosis
GEGPAGPVA

SEQ ID NO: 1543811 - protein, 4 aa, Mycobacterium tuberculosis
GEID

SEQ ID NO: 1543812 - protein, 20 aa, Mycobacterium tuberculosis
GEIEAADAGDCGVRRVEIPA

SEQ ID NO: 1543813 - protein, 7 aa, Mycobacterium tuberculosis
GEPRRSN

SEQ ID NO: 1543814 - protein, 64 aa, Mycobacterium tuberculosis
GEQGGQGGDGGAGGAGGIGGSAGGIGGSQGAGGHGADGGQGGAGGSGRVGGGCAGSGANGGEIG

SEQ ID NO: 1543815 - protein, 137 aa, Mycobacterium tuberculosis
GEQGGQGGDGGAGGAGGIGGSAGGIGGSQGAGGHGGDGGQGGAGGSGGVGGGGAGAGGDGGAGGIGGTGGNGSIGGAAGNGGNGGRGGSGGMATAGSDVGNGGGGGNGGVGVGSAGGAGGTGGDGGAAGAGGAPGHG

SEQ ID NO: 1543816 - protein, 10 aa, Mycobacterium tuberculosis
GERRRAERER

SEQ ID NO: 1543817 - protein, 6 aa, Mycobacterium tuberculosis
GESADH

SEQ ID NO: 1543818 - protein, 8 aa, Mycobacterium tuberculosis
GESAGDQH

SEQ ID NO: 1543819 - protein, 10 aa, Mycobacterium tuberculosis
GETAPTTPYR

SEQ ID NO: 1543820 - protein, 7 aa, Mycobacterium tuberculosis
GFGNGNS

SEQ ID NO: 1543821 - protein, 10 aa, Mycobacterium tuberculosis
GFGNNGNKNI

SEQ ID NO: 1543822 - protein, 10 aa, Mycobacterium tuberculosis
GFGNTGSGNI

SEQ ID NO: 1543823 - protein, 11 aa, Mycobacterium tuberculosis
GFNTPASASPL

SEQ ID NO: 1543824 - protein, 7 aa, Mycobacterium tuberculosis
GFPDSTL

SEQ ID NO: 1543825 - protein, 6 aa, Mycobacterium tuberculosis
GFSAQG

SEQ ID NO: 1543826 - protein, 5 aa, Mycobacterium tuberculosis
GGAAA

SEQ ID NO: 1543827 - protein, 16 aa, Mycobacterium tuberculosis
GGAAPGGFDCSGLVCG

SEQ ID NO: 1543828 - protein, 29 aa, Mycobacterium tuberculosis
GGAGCQAVESGRPAPGADARPGCEPGAAA

SEQ ID NO: 1543829 - protein, 24 aa, Mycobacterium tuberculosis
GGAGGAGGAAPTGNGGAGGNGGDA

SEQ ID NO: 1543830 - protein, 12 aa, Mycobacterium tuberculosis
GGAGGAGGAGGG

SEQ ID NO: 1543831 - protein, 34 aa, Mycobacterium tuberculosis
GGAGGAGGAGVAGAGGFEGTIGAGGVGGAGGAGG

SEQ ID NO: 1543832 - protein, 27 aa, Mycobacterium tuberculosis
GGAGGAGGASTNTTGGAGGAGGDGGNA

SEQ ID NO: 1543833 - protein, 26 aa, Mycobacterium tuberculosis
GGAGGAGTDGGPGATGGTGGHGGVGE

SEQ ID NO: 1543834 - protein, 11 aa, Mycobacterium tuberculosis
GGAGGDGGGAL

SEQ ID NO: 1543835 - protein, 22 aa, Mycobacterium tuberculosis
GGAGGGGGKGGNGAGGGLGGGS

SEQ ID NO: 1543836 - protein, 68 aa, Mycobacterium tuberculosis
GGAGGTGGAGLAGANGVNPTPGPAASTGDSPADVSGIGDQTGGDGGTGGHGTAGTPTGGTGGDGATAT

SEQ ID NO: 1543837 - protein, 75 aa, Mycobacterium tuberculosis
GGAGGTGGAGLAGANGVNPTPGPAASTGDSPADVSGIGDQTGGDGGTGGHGTAGTPTGGTGGDGATATAGSGKAT

SEQ ID NO: 1543838 - protein, 98 aa, Mycobacterium tuberculosis
GGAGGTGGAGLAGANGVNPTPGPAASTGDSPADVSGIGDQTGGDGGTGGHGTAGTPTGGTGGDGATATAGSGKDTGGAGGDGGTAADGGGGGHSCDGG

SEQ ID NO: 1543839 - protein, 56 aa, Mycobacterium tuberculosis
GGAGGTGGAGLAGANGVNPTPGPAASTGDSPADVSGIGDQTGVDGGTGGHGSAGTP

SEQ ID NO: 1543840 - protein, 6 aa, Mycobacterium tuberculosis
GGAGTT

SEQ ID NO: 1543841 - protein, 46 aa, Mycobacterium tuberculosis
GGAGYNSAATPGMAGGNGGNAGLIGNGGTGGSGGAGAPGGAGGSGG

SEQ ID NO: 1543842 - protein, 8 aa, Mycobacterium tuberculosis
GGALGGNN

SEQ ID NO: 1543843 - protein, 9 aa, Mycobacterium tuberculosis
GGASAAAAH

SEQ ID NO: 1543844 - protein, 8 aa, Mycobacterium tuberculosis
GGASTVAS

SEQ ID NO: 1543845 - protein, 24 aa, Mycobacterium tuberculosis
GGDGGNAGNGAMPANGGNGGNAGV

SEQ ID NO: 1543846 - protein, 28 aa, Mycobacterium tuberculosis
GGDGGNGGAGTAIGSNAGDGGAGGDSSA

SEQ ID NO: 1543847 - protein, 8 aa, Mycobacterium tuberculosis
GGDGLSDC

SEQ ID NO: 1543848 - protein, 10 aa, Mycobacterium tuberculosis
GGDHNPIHTN

SEQ ID NO: 1543849 - protein, 6 aa, Mycobacterium tuberculosis
GGDSLS

SEQ ID NO: 1543850 - protein, 4 aa, Mycobacterium tuberculosis
GGEG

SEQ ID NO: 1543851 - protein, 7 aa, Mycobacterium tuberculosis
GGEPTGL

SEQ ID NO: 1543852 - protein, 6 aa, Mycobacterium tuberculosis
GGEPTI

SEQ ID NO: 1543853 - protein, 4 aa, Mycobacterium tuberculosis
GGFG

SEQ ID NO: 1543854 - protein, 18 aa, Mycobacterium tuberculosis
GGFGGQGGNGGQSGLLFG

SEQ ID NO: 1543855 - protein, 11 aa, Mycobacterium tuberculosis
GGGAGGGRGSV

SEQ ID NO: 1543856 - protein, 7 aa, Mycobacterium tuberculosis
GGGEKKT

SEQ ID NO: 1543857 - protein, 8 aa, Mycobacterium tuberculosis
GGGPAVGA

SEQ ID NO: 1543858 - protein, 21 aa, Mycobacterium tuberculosis
GGGQRLGGAERGTRPVGRDQR

SEQ ID NO: 1543859 - protein, 6 aa, Mycobacterium tuberculosis
GGGRPM

SEQ ID NO: 1543860 - protein, 14 aa, Mycobacterium tuberculosis
GGGSWGDDCRPAGI

SEQ ID NO: 1543861 - protein, 4 aa, Mycobacterium tuberculosis
GGGV

SEQ ID NO: 1543862 - protein, 9 aa, Mycobacterium tuberculosis
GGLGGRGSR

SEQ ID NO: 1543863 - protein, 6 aa, Mycobacterium tuberculosis
GGLGPV

SEQ ID NO: 1543864 - protein, 31 aa, Mycobacterium tuberculosis; identical to SEQ ID NO: 229857

SEQ ID NO: 1543865 - protein, 29 aa, Mycobacterium tuberculosis
GGLSGQIGNGSSSGSAIAAGSGGTGDTRC

SEQ ID NO: 1543866 - protein, 6 aa, Mycobacterium tuberculosis
GGNAVD

SEQ ID NO: 1543867 - protein, 38 aa, Mycobacterium tuberculosis
GGNGFTQTTAGVAGGNGGSAGLIGNGGAGAAGGFGGNG

SEQ ID NO: 1543868 - protein, 40 aa, Mycobacterium tuberculosis
GGNGFTQTTAGVAGGQRRQRGVDQQPAGPAASGARAPGTG

SEQ ID NO: 1543869 - protein, 23 aa, Mycobacterium tuberculosis
GGNGGNAGTGFGANTGGNGGDTT

SEQ ID NO: 1543870 - protein, 17 aa, Mycobacterium tuberculosis
GGNGGNGVNGGTGGSGG

SEQ ID NO: 1543871 - protein, 9 aa, Mycobacterium tuberculosis
GGNGGPGGF

SEQ ID NO: 1543872 - protein, 21 aa, Mycobacterium tuberculosis
GGNGGPGGSGGAADIGGNGGA

SEQ ID NO: 1543873 - protein, 11 aa, Mycobacterium tuberculosis
GGNGGVGGTSV

SEQ ID NO: 1543874 - protein, 16 aa, Mycobacterium tuberculosis
GGNGGVGGTSVAAGIG

SEQ ID NO: 1543875 - protein, 15 aa, Mycobacterium tuberculosis
GGNGRVPPASGGDRF

SEQ ID NO: 1543876 - protein, 10 aa, Mycobacterium tuberculosis
GGNNVGGANA

SEQ ID NO: 1543877 - protein, 9 aa, Mycobacterium tuberculosis
GGNSNSGSF

SEQ ID NO: 1543878 - protein, 12 aa, Mycobacterium tuberculosis
GGNVCPGGAATS

SEQ ID NO: 1543879 - protein, 6 aa, Mycobacterium tuberculosis
GGPGAG

SEQ ID NO: 1543880 - protein, 4 aa, Mycobacterium tuberculosis
GGPK

SEQ ID NO: 1543881 - protein, 10 aa, Mycobacterium tuberculosis
GGPKSGKSTA

SEQ ID NO: 1543882 - protein, 4 aa, Mycobacterium tuberculosis
GGPL

SEQ ID NO: 1543883 - protein, 6 aa, Mycobacterium tuberculosis
GGPRAA

SEQ ID NO: 1543884 - protein, 6 aa, Mycobacterium tuberculosis
GGPTTA

SEQ ID NO: 1543885 - protein, 9 aa, Mycobacterium tuberculosis
GGPTTTIDG

SEQ ID NO: 1543886 - protein, 53 aa, Mycobacterium tuberculosis; identical to SEQ ID NO: 229869

SEQ ID NO: 1543887 - protein, 9 aa, Mycobacterium tuberculosis
GGRAGHGGL

SEQ ID NO: 1543888 - protein, 5 aa, Mycobacterium tuberculosis
GGRLS

SEQ ID NO: 1543889 - protein, 6 aa, Mycobacterium tuberculosis
GGRLTS

SEQ ID NO: 1543890 - protein, 7 aa, Mycobacterium tuberculosis
GGRQASA

SEQ ID NO: 1543891 - protein, 14 aa, Mycobacterium tuberculosis
GGRRPYVGPGPGRA

SEQ ID NO: 1543892 - protein, 9 aa, Mycobacterium tuberculosis
GGSARTGEL

SEQ ID NO: 1543893 - protein, 4 aa, Mycobacterium tuberculosis
GGSH

SEQ ID NO: 1543894 - protein, 13 aa, Mycobacterium tuberculosis
GGSRSAPPADDAG

SEQ ID NO: 1543895 - protein, 4 aa, Mycobacterium tuberculosis
GGTD

SEQ ID NO: 1543896 - protein, 4 aa, Mycobacterium tuberculosis
GGTF

SEQ ID NO: 1543897 - protein, 22 aa, Mycobacterium tuberculosis
GGTGGPGERTPAHQCSGDAKSR

SEQ ID NO: 1543898 - protein, 27 aa, Mycobacterium tuberculosis
GGTGGPGGPGGPGGVGGTGGAGGLGGT

SEQ ID NO: 1543899 - protein, 24 aa, Mycobacterium tuberculosis
GGTGGSGGAGGAGSVGNGGAGGNA

SEQ ID NO: 1543900 - protein, 25 aa, Mycobacterium tuberculosis
GGTGGSGGAGLGGDGGAGGAGGNTG

SEQ ID NO: 1543901 - protein, 8 aa, Mycobacterium tuberculosis
GGTGGTGG

SEQ ID NO: 1543902 - protein, 16 aa, Mycobacterium tuberculosis
GGTPGFGNSTTGPSSG

SEQ ID NO: 1543903 - protein, 6 aa, Mycobacterium tuberculosis
GGTTVV

SEQ ID NO: 1543904 - protein, 5 aa, Mycobacterium tuberculosis
GGTVE

SEQ ID NO: 1543905 - protein, 10 aa, Mycobacterium tuberculosis
GGVGGAGGAG

SEQ ID NO: 1543906 - protein, 24 aa, Mycobacterium tuberculosis
GGVGGAGGQSLLGGATGGAGGNAG

SEQ ID NO: 1543907 - protein, 29 aa, Mycobacterium tuberculosis
GGVGGDGGDGSSTQDSGGDGGAGGAGGAG

SEQ ID NO: 1543908 - protein, 23 aa, Mycobacterium tuberculosis
GGVGGSGGAGSSGGAGGAGGAGG

SEQ ID NO: 1543909 - protein, 26 aa, Mycobacterium tuberculosis
GGVGGVGGLGAGAGGAGGAGGTGGRG

SEQ ID NO: 1543910 - protein, 12 aa, Mycobacterium tuberculosis
GGVGTTGGAGGN

SEQ ID NO: 1543911 - protein, 6 aa, Mycobacterium tuberculosis
GGVSSL

SEQ ID NO: 1543912 - protein, 7 aa, Mycobacterium tuberculosis
GGVTGTI

SEQ ID NO: 1543913 - protein, 74 aa, Mycobacterium tuberculosis
GGYGGAGGAGGVFSGGGAGGAGDAIGGSGGAGGTGGLLGGGGGAGGAGGAGGNGGGASNSASIGGDGGSGGAGG

SEQ ID NO: 1543914 - protein, 4 aa, Mycobacterium tuberculosis
GHGA

SEQ ID NO: 1543915 - protein, 44 aa, Mycobacterium tuberculosis; identical to SEQ ID NO: 1427722

SEQ ID NO: 1543916 - protein, 52 aa, Mycobacterium tuberculosis; identical to SEQ ID NO: 1444271

SEQ ID NO: 1543917 - protein, 36 aa, Mycobacterium tuberculosis
GHGGVGGPGIAGAAGTAGLPGGNGANGGSGIIGMPE

SEQ ID NO: 1543918 - protein, 20 aa, Mycobacterium tuberculosis
GHGRGSGDSHNGGATTPPLD

SEQ ID NO: 1543919 - protein, 19 aa, Mycobacterium tuberculosis
GHGRGSGDSHNGGVTTPPL

SEQ ID NO: 1543920 - protein, 4 aa, Mycobacterium tuberculosis
GHPG

SEQ ID NO: 1543921 - protein, 6 aa, Mycobacterium tuberculosis
GHPGCQ

SEQ ID NO: 1543922 - protein, 21 aa, Mycobacterium tuberculosis
GHQGPPASWKPGGRPVTIEPS

SEQ ID NO: 1543923 - protein, 28 aa, Mycobacterium tuberculosis
GHRNRQAAGQNRLAASARTARPGRCRQC

SEQ ID NO: 1543924 - protein, 19 aa, Mycobacterium tuberculosis
GHRQPDSCDQRRRQGIRDR

SEQ ID NO: 1543925 - protein, 8 aa, Mycobacterium tuberculosis
GHTEPAER

SEQ ID NO: 1543926 - protein, 6 aa, Mycobacterium tuberculosis
GHTNTG

SEQ ID NO: 1543927 - protein, 88 aa, Mycobacterium tuberculosis
GHTNTGSFNAGSMNTGDFNSGNVTPATSTPATSTPASSTRAISTPDCSTRSTSRYRTPAGCTRAPTTRATLTPAPSTSGFDNNARDEH

SEQ ID NO: 1543928 - protein, 43 aa, Mycobacterium tuberculosis; identical to SEQ ID NO: 1420172

SEQ ID NO: 1543929 - protein, 18 aa, Mycobacterium tuberculosis
GIDSTGHRGAGHPAQSAA

SEQ ID NO: 1543930 - protein, 25 aa, Mycobacterium tuberculosis
GIGGNTGSFNSGNLNTGFGNAGDLN

SEQ ID NO: 1543931 - protein, 5 aa, Mycobacterium tuberculosis
GIGPV

SEQ ID NO: 1543932 - protein, 24 aa, Mycobacterium tuberculosis
GINGDGGTGGMGGQGGAGGNGWAA

SEQ ID NO: 1543933 - protein, 8 aa, Mycobacterium tuberculosis
GIPKTPEW

SEQ ID NO: 1543934 - protein, 5 aa, Mycobacterium tuberculosis
GIPPS

SEQ ID NO: 1543935 - protein, 21 aa, Mycobacterium tuberculosis
GIPTDQRAGGRVSRAVCRGPN

SEQ ID NO: 1543936 - protein, 4 aa, Mycobacterium tuberculosis
GISR

SEQ ID NO: 1543937 - protein, 7 aa, Mycobacterium tuberculosis
GKDSPMT

SEQ ID NO: 1543938 - protein, 11 aa, Mycobacterium tuberculosis
GKGYPDAGAAP

SEQ ID NO: 1543939 - protein, 5 aa, Mycobacterium tuberculosis
GKLAA

SEQ ID NO: 1543940 - protein, 5 aa, Mycobacterium tuberculosis
GKNGQ

SEQ ID NO: 1543941 - protein, 15 aa, Mycobacterium tuberculosis
GKQSPANPAPSRPLN

SEQ ID NO: 1543942 - protein, 11 aa, Mycobacterium tuberculosis
GKQYSSGGGAV

SEQ ID NO: 1543943 - protein, 18 aa, Mycobacterium tuberculosis
GKRAATPKECRSKDPYVP

SEQ ID NO: 1543944 - protein, 7 aa, Mycobacterium tuberculosis
GKRKPYI

SEQ ID NO: 1543945 - protein, 7 aa, Mycobacterium tuberculosis
GKYGTTV

SEQ ID NO: 1543946 - protein, 4 aa, Mycobacterium tuberculosis
GLAA

SEQ ID NO: 1543947 - protein, 7 aa, Mycobacterium tuberculosis
GLAGTGL

SEQ ID NO: 1543948 - protein, 7 aa, Mycobacterium tuberculosis
GLASPVT

SEQ ID NO: 1543949 - protein, 7 aa, Mycobacterium tuberculosis
GLEPASP

SEQ ID NO: 1543950 - protein, 5 aa, Mycobacterium tuberculosis
GLGAG

SEQ ID NO: 1543951 - protein, 12 aa, Mycobacterium tuberculosis
GLGGAGGKAPFQ

SEQ ID NO: 1543952 - protein, 9 aa, Mycobacterium tuberculosis
GLGGHPRLG

SEQ ID NO: 1543953 - protein, 4 aa, Mycobacterium tuberculosis
GLGI

SEQ ID NO: 1543954 - protein, 11 aa, Mycobacterium tuberculosis
GLGNAGSLASG

SEQ ID NO: 1543955 - protein, 9 aa, Mycobacterium tuberculosis
GLGNAGTLA

SEQ ID NO: 1543956 - protein, 5 aa, Mycobacterium tuberculosis
GLGNS

SEQ ID NO: 1543957 - protein, 11 aa, Mycobacterium tuberculosis
GLGPNPNWDSP

SEQ ID NO: 1543958 - protein, 12 aa, Mycobacterium tuberculosis
GLGSRRRQLANR

SEQ ID NO: 1543959 - protein, 9 aa, Mycobacterium tuberculosis
GLNSGSGNI

SEQ ID NO: 1543960 - protein, 19 aa, Mycobacterium tuberculosis
GLNSGSGNIGFGNSGTGNV

SEQ ID NO: 1543961 - protein, 9 aa, Mycobacterium tuberculosis
GLPADGGDA

SEQ ID NO: 1543962 - protein, 4 aa, Mycobacterium tuberculosis
GLPD

SEQ ID NO: 1543963 - protein, 14 aa, Mycobacterium tuberculosis
GLPGNGGAGGNAGL

SEQ ID NO: 1543964 - protein, 16 aa, Mycobacterium tuberculosis
GLPPGSDYRNRAPKMS

SEQ ID NO: 1543965 - protein, 10 aa, Mycobacterium tuberculosis
GLQTNPNSLS

SEQ ID NO: 1543966 - protein, 4 aa, Mycobacterium tuberculosis
GLRA

SEQ ID NO: 1543967 - protein, 5 aa, Mycobacterium tuberculosis
GLRAR

SEQ ID NO: 1543968 - protein, 4 aa, Mycobacterium tuberculosis
GLRP

SEQ ID NO: 1543969 - protein, 10 aa, Mycobacterium tuberculosis
GLSERGEGVT

SEQ ID NO: 1543970 - protein, 11 aa, Mycobacterium tuberculosis
GLTAGAGGLGN

SEQ ID NO: 1543971 - protein, 49 aa, Mycobacterium tuberculosis; identical to SEQ ID NO: 176335

SEQ ID NO: 1543972 - protein, 6 aa, Mycobacterium tuberculosis
GLTSQQ

SEQ ID NO: 1543973 - protein, 21 aa, Mycobacterium tuberculosis
GLTTKTTVPRTGRSNGRAVAH

SEQ ID NO: 1543974 - protein, 7 aa, Mycobacterium tuberculosis
GLYPPGS

SEQ ID NO: 1543975 - protein, 10 aa, Mycobacterium tuberculosis
GNAGSTNTGL

SEQ ID NO: 1543976 - protein, 4 aa, Mycobacterium tuberculosis
GNAN

SEQ ID NO: 1543977 - protein, 13 aa, Mycobacterium tuberculosis
GNANTGSLNTGSY

SEQ ID NO: 1543978 - protein, 17 aa, Mycobacterium tuberculosis
GNGADGAAGTGQAAGQA

SEQ ID NO: 1543979 - protein, 18 aa, Mycobacterium tuberculosis
GNGANGADGTGAPGGPGG

SEQ ID NO: 1543980 - protein, 18 aa, Mycobacterium tuberculosis
GNGANGAPGTGADGAPGG

SEQ ID NO: 1543981 - protein, 21 aa, Mycobacterium tuberculosis
GNGANGGPGHGGQWCAGRVVA

SEQ ID NO: 1543982 - protein, 18 aa, Mycobacterium tuberculosis
GNGANGQPGTGAPWDPQS

SEQ ID NO: 1543983 - protein, 11 aa, Mycobacterium tuberculosis
GNGATPDSDAP

SEQ ID NO: 1543984 - protein, 27 aa, Mycobacterium tuberculosis
GNGGAGGAGASNQAGTGGAGGNGGAGG

SEQ ID NO: 1543985 - protein, 26 aa, Mycobacterium tuberculosis
GNGGAGGAGGAGGAVGRGGDGGSAGW

SEQ ID NO: 1543986 - protein, 15 aa, Mycobacterium tuberculosis
GNGGAGGAGGDGPGN

SEQ ID NO: 1543987 - protein, 12 aa, Mycobacterium tuberculosis
GNGGAGGAGGFG

SEQ ID NO: 1543988 - protein, 20 aa, Mycobacterium tuberculosis
GNGGAGGAGGPGAGGGTGGL

SEQ ID NO: 1543989 - protein, 14 aa, Mycobacterium tuberculosis
GNGGAGGNGGASGS

SEQ ID NO: 1543990 - protein, 98 aa, Mycobacterium tuberculosis
GNGGAGGNGGTAGQGGDGGTALGAGGIGGDGGTGGAGGTGGTAGTGGGSSMIGGKGGTGGNGGVGGTGGASALTIGNGSSAGAGGAGGAGGTGGTGGY

SEQ ID NO: 1543991 - protein, 33 aa, Mycobacterium tuberculosis
GNGGAGGVGGGGGRGTTAIGGDGGAGGAGGAGG

SEQ ID NO: 1543992 - protein, 11 aa, Mycobacterium tuberculosis
GNGGNGGAGGF

SEQ ID NO: 1543993 - protein, 44 aa, Mycobacterium tuberculosis
GNGGNGGIGQPGGAGGDAGLIGNGGNGGIGGPGATGLAGGAGGV

SEQ ID NO: 1543994 - protein, 23 aa, Mycobacterium tuberculosis
GNGGNGGNAGKAGGTAGAGGAGG

SEQ ID NO: 1543995 - protein, 43 aa, Mycobacterium tuberculosis
GNGGNGGNGGIGQPGGAGGDAGLIGNGGNGGIGGPGGSLRRRS

SEQ ID NO: 1543996 - protein, 12 aa, Mycobacterium tuberculosis
GNGGNGGNVPSG

SEQ ID NO: 1543997 - protein, 57 aa, Mycobacterium tuberculosis
GNGGNGGNVPSGAADAERALTPRLNPQRGVKGAPVGASPHRHPSTCGNGRSTAVGMY

SEQ ID NO: 1543998 - protein, 22 aa, Mycobacterium tuberculosis
GNGGNGGSGAAGQAGGAGGAAG

SEQ ID NO: 1543999 - protein, 55 aa, Mycobacterium tuberculosis
GNGGNGGSGGVNQAGGNGGNAGLWGNGGSGGAGGNATTAGRNGFNGGAGGSGDFA

SEQ ID NO: 1544000 - protein, 38 aa, Mycobacterium tuberculosis
GNGGNGYSATASGVGGGAGGSAGLIGNGGAGGAGGNGG

SEQ ID NO: 1544001 - protein, 29 aa, Mycobacterium tuberculosis
GNGGSGGSGGAGAAGGVGGSGGWLNGNGG

SEQ ID NO: 1544002 - protein, 32 aa, Mycobacterium tuberculosis
GNGGSGGSGGAGAAGGVGGSGGWLNGNGGAGG

SEQ ID NO: 1544003 - protein, 4 aa, Mycobacterium tuberculosis
GNGN

SEQ ID NO: 1544004 - protein, 26 aa, Mycobacterium tuberculosis
GNGNFGIGNSGNFNTGGWNSGHGNTG

SEQ ID NO: 1544005 - protein, 15 aa, Mycobacterium tuberculosis
GNGNVGIGNTGTANF

SEQ ID NO: 1544006 - protein, 4 aa, Mycobacterium tuberculosis
GNGT

SEQ ID NO: 1544007 - protein, 18 aa, Mycobacterium tuberculosis
GNGTNGGPGTGEAGGPGG

SEQ ID NO: 1544008 - protein, 4 aa, Mycobacterium tuberculosis
GNHS

SEQ ID NO: 1544009 - protein, 15 aa, Mycobacterium tuberculosis
GNNNIGMGNSGNGVG

SEQ ID NO: 1544010 - protein, 5 aa, Mycobacterium tuberculosis
GNNQI

SEQ ID NO: 1544011 - protein, 6 aa, Mycobacterium tuberculosis
GNNQVG

SEQ ID NO: 1544012 - protein, 11 aa, Mycobacterium tuberculosis
GNPADSGKIRG

SEQ ID NO: 1544013 - protein, 38 aa, Mycobacterium tuberculosis
GNPGNGGVGGIGGDAAAGGAGGAGGNGGAGGAGGTAGL

SEQ ID NO: 1544014 - protein, 33 aa, Mycobacterium tuberculosis
GNPGNGGVGGIGGDAAAGGAGGAGGNGGAGGNG

SEQ ID NO: 1544015 - protein, 5 aa, Mycobacterium tuberculosis
GNSGL

SEQ ID NO: 1544016 - protein, 4 aa, Mycobacterium tuberculosis
GNST

SEQ ID NO: 1544017 - protein, 7 aa, Mycobacterium tuberculosis
GNTAGQM

SEQ ID NO: 1544018 - protein, 24 aa, Mycobacterium tuberculosis
GNTGGDCVQNPAPDPSTPGDPRGW

SEQ ID NO: 1544019 - protein, 10 aa, Mycobacterium tuberculosis
GNTGMDDPKG

SEQ ID NO: 1544020 - protein, 8 aa, Mycobacterium tuberculosis
GNTGNGNI

SEQ ID NO: 1544021 - protein, 8 aa, Mycobacterium tuberculosis
GNTGNNNI

SEQ ID NO: 1544022 - protein, 18 aa, Mycobacterium tuberculosis
GNTGSGNFGFGNTGNNNI

SEQ ID NO: 1544023 - protein, 39 aa, Mycobacterium tuberculosis; identical to SEQ ID NO: 194191

SEQ ID NO: 1544024 - protein, 7 aa, Mycobacterium tuberculosis
GNTYRSP

SEQ ID NO: 1544025 - protein, 10 aa, Mycobacterium tuberculosis
GNVGAGSSGW

SEQ ID NO: 1544026 - protein, 7 aa, Mycobacterium tuberculosis
GNVGGQN

SEQ ID NO: 1544027 - protein, 5 aa, Mycobacterium tuberculosis
GNVGN

SEQ ID NO: 1544028 - protein, 7 aa, Mycobacterium tuberculosis
GNVGTGN

SEQ ID NO: 1544029 - protein, 36 aa, Mycobacterium tuberculosis; identical to SEQ ID NO: 1418409

SEQ ID NO: 1544030 - protein, 14 aa, Mycobacterium tuberculosis
GNVNTGAFNSGSFN

SEQ ID NO: 1544031 - protein, 16 aa, Mycobacterium tuberculosis
GNYNTGIGNSGVASTG

SEQ ID NO: 1544032 - protein, 17 aa, Mycobacterium tuberculosis
GNYNTGVGNAGTASTGL

SEQ ID NO: 1544033 - protein, 4 aa, Mycobacterium tuberculosis
GPAA

SEQ ID NO: 1544034 - protein, 5 aa, Mycobacterium tuberculosis
GPAAA

SEQ ID NO: 1544035 - protein, 11 aa, Mycobacterium tuberculosis
GPAAAPAAAVT

SEQ ID NO: 1544036 - protein, 5 aa, Mycobacterium tuberculosis
GPAAS

SEQ ID NO: 1544037 - protein, 38 aa, Mycobacterium tuberculosis; identical to SEQ ID NO: 194193

SEQ ID NO: 1544038 - protein, 36 aa, Mycobacterium tuberculosis
GPASATGSEQPGGPPPVPTSPTGYRRDPPGPRQAPP

SEQ ID NO: 1544039 - protein, 6 aa, Mycobacterium tuberculosis
GPASTN

SEQ ID NO: 1544040 - protein, 7 aa, Mycobacterium tuberculosis
GPASYTG

SEQ ID NO: 1544041 - protein, 29 aa, Mycobacterium tuberculosis
GPCATSGWPTPAPATSGSGWWGTTSPASG

SEQ ID NO: 1544042 - protein, 5 aa, Mycobacterium tuberculosis
GPDDV

SEQ ID NO: 1544043 - protein, 11 aa, Mycobacterium tuberculosis
GPDGNYGEPEE

SEQ ID NO: 1544044 - protein, 6 aa, Mycobacterium tuberculosis
GPGGGL

SEQ ID NO: 1544045 - protein, 10 aa, Mycobacterium tuberculosis
GPGGSLTGSA

SEQ ID NO: 1544046 - protein, 8 aa, Mycobacterium tuberculosis
GPGPTVDT

SEQ ID NO: 1544047 - protein, 54 aa, Mycobacterium tuberculosis; identical to SEQ ID NO: 151391

SEQ ID NO: 1544048 - protein, 13 aa, Mycobacterium tuberculosis
GPHTDQTLDGPGL

SEQ ID NO: 1544049 - protein, 6 aa, Mycobacterium tuberculosis
GPKDQI

SEQ ID NO: 1544050 - protein, 13 aa, Mycobacterium tuberculosis
GPKTGEKVAAVLA

SEQ ID NO: 1544051 - protein, 8 aa, Mycobacterium tuberculosis
GPNTPRGR

SEQ ID NO: 1544052 - protein, 14 aa, Mycobacterium tuberculosis
GPPLGPPGAKFPSG

SEQ ID NO: 1544053 - protein, 10 aa, Mycobacterium tuberculosis
GPQQGRGLGG

SEQ ID NO: 1544054 - protein, 21 aa, Mycobacterium tuberculosis
GPRASPSVAGGGAVGGVQTPQ

SEQ ID NO: 1544055 - protein, 32 aa, Mycobacterium tuberculosis
GPRRPPGGDRRGAGGPRPVPATGPKQAVPTGA

SEQ ID NO: 1544056 - protein, 7 aa, Mycobacterium tuberculosis
GPRTGPH

SEQ ID NO: 1544057 - protein, 6 aa, Mycobacterium tuberculosis
GPSAES

SEQ ID NO: 1544058 - protein, 15 aa, Mycobacterium tuberculosis
GPTAGTGTPTGDYGI

SEQ ID NO: 1544059 - protein, 5 aa, Mycobacterium tuberculosis
GPTLD

SEQ ID NO: 1544060 - protein, 5 aa, Mycobacterium tuberculosis
GPTTA

SEQ ID NO: 1544061 - protein, 5 aa, Mycobacterium tuberculosis
GPTTT

SEQ ID NO: 1544062 - protein, 5 aa, Mycobacterium tuberculosis
GPTTV

SEQ ID NO: 1544063 - protein, 4 aa, Mycobacterium tuberculosis
GPTV

SEQ ID NO: 1544064 - protein, 11 aa, Mycobacterium tuberculosis
GPVGPAATPGC

SEQ ID NO: 1544065 - protein, 8 aa, Mycobacterium tuberculosis
GQAGGAVT

SEQ ID NO: 1544066 - protein, 10 aa, Mycobacterium tuberculosis
GQEARAAEEE

SEQ ID NO: 1544067 - protein, 13 aa, Mycobacterium tuberculosis
GQEATPEPPSALN

SEQ ID NO: 1544068 - protein, 425 aa, Mycobacterium tuberculosis; identical to SEQ ID NO: 1444742

SEQ ID NO: 1544069 - protein, 6 aa, Mycobacterium tuberculosis
GQGGTI

SEQ ID NO: 1544070 - protein, 24 aa, Mycobacterium tuberculosis
GQHHRQGRSRPTEMSSRCRDWAAV

SEQ ID NO: 1544071 - protein, 11 aa, Mycobacterium tuberculosis
GQMAGAGYGDG

SEQ ID NO: 1544072 - protein, 9 aa, Mycobacterium tuberculosis
GQNTPAIAA

SEQ ID NO: 1544073 - protein, 18 aa, Mycobacterium tuberculosis
GQPWTPASRSALAGPPRV

SEQ ID NO: 1544074 - protein, 5 aa, Mycobacterium tuberculosis
GQRLP

SEQ ID NO: 1544075 - protein, 7 aa, Mycobacterium tuberculosis
GQTDTAA

SEQ ID NO: 1544076 - protein, 12 aa, Mycobacterium tuberculosis
GQTTSTEDAEGQ

SEQ ID NO: 1544077 - protein, 14 aa, Mycobacterium tuberculosis
GRADAGAPSVPRDH

SEQ ID NO: 1544078 - protein, 21 aa, Mycobacterium tuberculosis
GRAGKAAAAHAAAAGRSRAIS

SEQ ID NO: 1544079 - protein, 28 aa, Mycobacterium tuberculosis
GRAGKAAAAHAAAAGRSRAISSATWPEP

SEQ ID NO: 1544080 - protein, 18 aa, Mycobacterium tuberculosis
GRATAGPDPLGRSRTAAA

SEQ ID NO: 1544081 - protein, 6 aa, Mycobacterium tuberculosis
GRATGS

SEQ ID NO: 1544082 - protein, 15 aa, Mycobacterium tuberculosis
GRDPEQSFSATDLMH

SEQ ID NO: 1544083 - protein, 15 aa, Mycobacterium tuberculosis
GRDPEQSFSATDLMR

SEQ ID NO: 1544084 - protein, 6 aa, Mycobacterium tuberculosis
GREAAA

SEQ ID NO: 1544085 - protein, 8 aa, Mycobacterium tuberculosis
GREANADR

SEQ ID NO: 1544086 - protein, 10 aa, Mycobacterium tuberculosis
GREGGSAPTA

SEQ ID NO: 1544087 - protein, 26 aa, Mycobacterium tuberculosis
GREGRTEVPAGPLADPVNGQPRPAAL

SEQ ID NO: 1544088 - protein, 4 aa, Mycobacterium tuberculosis
GREL

SEQ ID NO: 1544089 - protein, 55 aa, Mycobacterium tuberculosis
GRERGSGGSGNLTGGAGGAGGNAGTLATGDGGAGGTGGASRSGGFGGAGGAGGDA

SEQ ID NO: 1544090 - protein, 5 aa, Mycobacterium tuberculosis
GRGDG

SEQ ID NO: 1544091 - protein, 8 aa, Mycobacterium tuberculosis
GRGGANPH

SEQ ID NO: 1544092 - protein, 33 aa, Mycobacterium tuberculosis
GRGIPTGNLPDGRCRGTRAGRRAGRQFPARRPA

SEQ ID NO: 1544093 - protein, 5 aa, Mycobacterium tuberculosis
GRGPL

SEQ ID NO: 1544094 - protein, 25 aa, Mycobacterium tuberculosis
GRHAGRSGSGPDRRRATPSWRGVRF

SEQ ID NO: 1544095 - protein, 7 aa, Mycobacterium tuberculosis
GRHGGRR

SEQ ID NO: 1544096 - protein, 14 aa, Mycobacterium tuberculosis
GRKCDARDGGSAAG

SEQ ID NO: 1544097 - protein, 8 aa, Mycobacterium tuberculosis
GRKVQGSA

SEQ ID NO: 1544098 - protein, 8 aa, Mycobacterium tuberculosis
GRPAPTDG

SEQ ID NO: 1544099 - protein, 7 aa, Mycobacterium tuberculosis
GRPDPTQ

SEQ ID NO: 1544100 - protein, 9 aa, Mycobacterium tuberculosis
GRPERRNAG

SEQ ID NO: 1544101 - protein, 12 aa, Mycobacterium tuberculosis
GRPLIGNGTNGA

SEQ ID NO: 1544102 - protein, 13 aa, Mycobacterium tuberculosis
GRPTHREHYAGKD

SEQ ID NO: 1544103 - protein, 12 aa, Mycobacterium tuberculosis
GRPVTGAAVAAA

SEQ ID NO: 1544104 - protein, 18 aa, Mycobacterium tuberculosis
GRRAASGADGRRSGLHPA

SEQ ID NO: 1544105 - protein, 5 aa, Mycobacterium tuberculosis
GRRCR

SEQ ID NO: 1544106 - protein, 14 aa, Mycobacterium tuberculosis
GRRDRQRHVGTRSA

SEQ ID NO: 1544107 - protein, 15 aa, Mycobacterium tuberculosis
GRRDRQRHVGTRSAQ

SEQ ID NO: 1544108 - protein, 9 aa, Mycobacterium tuberculosis
GRRGGGAAS

SEQ ID NO: 1544109 - protein, 21 aa, Mycobacterium tuberculosis
GRRQQGVGNQVPPSPRGEGAE

SEQ ID NO: 1544110 - protein, 8 aa, Mycobacterium tuberculosis
GRRRGRPE

SEQ ID NO: 1544111 - protein, 7 aa, Mycobacterium tuberculosis
GRSATEV

SEQ ID NO: 1544112 - protein, 7 aa, Mycobacterium tuberculosis
GRTLRGA

SEQ ID NO: 1544113 - protein, 5 aa, Mycobacterium tuberculosis
GRWPR

SEQ ID NO: 1544114 - protein, 5 aa, Mycobacterium tuberculosis
GSAAA

SEQ ID NO: 1544115 - protein, 11 aa, Mycobacterium tuberculosis
GSAAPVFPGRT

SEQ ID NO: 1544116 - protein, 13 aa, Mycobacterium tuberculosis
GSAARARSVAQPR

SEQ ID NO: 1544117 - protein, 9 aa, Mycobacterium tuberculosis
GSAGSGHQQ

SEQ ID NO: 1544118 - protein, 11 aa, Mycobacterium tuberculosis
GSAKQAERSYG

SEQ ID NO: 1544119 - protein, 27 aa, Mycobacterium tuberculosis
GSARHRAPRPHRTAPAGFPASRYRPRR

SEQ ID NO: 1544120 - protein, 13 aa, Mycobacterium tuberculosis
GSGGAGGEGGAAL

SEQ ID NO: 1544121 - protein, 183 aa, Mycobacterium tuberculosis; identical to SEQ ID NO: 177158

SEQ ID NO: 1544122 - protein, 25 aa, Mycobacterium tuberculosis
GSGGAGGSGGTGTLSGGRGGAGGKR

SEQ ID NO: 1544123 - protein, 29 aa, Mycobacterium tuberculosis
GSGGFGGAGGAAAGVGTTGGVGGSGGVGG

SEQ ID NO: 1544124 - protein, 31 aa, Mycobacterium tuberculosis; identical to SEQ ID NO: 1426235

SEQ ID NO: 1544125 - protein, 17 aa, Mycobacterium tuberculosis
GSGGNGGSGLAAPPEGR

SEQ ID NO: 1544126 - protein, 7 aa, Mycobacterium tuberculosis
GSGKSQT

SEQ ID NO: 1544127 - protein, 5 aa, Mycobacterium tuberculosis
GSGNF

SEQ ID NO: 1544128 - protein, 7 aa, Mycobacterium tuberculosis
GSGNFGI

SEQ ID NO: 1544129 - protein, 27 aa, Mycobacterium tuberculosis
GSGNIGGTNVGSGNVGGTNLGSGNYGS

SEQ ID NO: 1544130 - protein, 29 aa, Mycobacterium tuberculosis
GSGNIGSYNLGGGNTGDLNPDSGNTGTLN

SEQ ID NO: 1544131 - protein, 8 aa, Mycobacterium tuberculosis
GSGNQGDI

SEQ ID NO: 1544132 - protein, 21 aa, Mycobacterium tuberculosis
GSGNTGSNNIGFGNTGSGNFG

SEQ ID NO: 1544133 - protein, 30 aa, Mycobacterium tuberculosis; identical to SEQ ID NO: 1424248

SEQ ID NO: 1544134 - protein, 35 aa, Mycobacterium tuberculosis; identical to SEQ ID NO: 194250

SEQ ID NO: 1544135 - protein, 5 aa, Mycobacterium tuberculosis
GSGQI

SEQ ID NO: 1544136 - protein, 10 aa, Mycobacterium tuberculosis
GSGVANVGNT

SEQ ID NO: 1544137 - protein, 6 aa, Mycobacterium tuberculosis
GSGVTN

SEQ ID NO: 1544138 - protein, 6 aa, Mycobacterium tuberculosis
GSMAAR

SEQ ID NO: 1544139 - protein, 7 aa, Mycobacterium tuberculosis
GSNNVGV

SEQ ID NO: 1544140 - protein, 17 aa, Mycobacterium tuberculosis
GSNSPASSPAGPTQGAQ

SEQ ID NO: 1544141 - protein, 9 aa, Mycobacterium tuberculosis
GSPASEAAT

SEQ ID NO: 1544142 - protein, 7 aa, Mycobacterium tuberculosis
GSPASTV

SEQ ID NO: 1544143 - protein, 6 aa, Mycobacterium tuberculosis
GSPDRV

SEQ ID NO: 1544144 - protein, 6 aa, Mycobacterium tuberculosis
GSPGRR

SEQ ID NO: 1544145 - protein, 5 aa, Mycobacterium tuberculosis
GSQMG

SEQ ID NO: 1544146 - protein, 16 aa, Mycobacterium tuberculosis
GSQVSAANAAAAMPDD

SEQ ID NO: 1544147 - protein, 6 aa, Mycobacterium tuberculosis
GSQWAG

SEQ ID NO: 1544148 - protein, 27 aa, Mycobacterium tuberculosis
GSSAERSSGFGNSGELSTGIGNSGQLS

SEQ ID NO: 1544149 - protein, 34 aa, Mycobacterium tuberculosis
GSSCPPDQPAGSAAAAGGPAGAAGTASATSAPHA

SEQ ID NO: 1544150 - protein, 10 aa, Mycobacterium tuberculosis
GSSGKTSTKD

SEQ ID NO: 1544151 - protein, 16 aa, Mycobacterium tuberculosis
GSSISAANAAAAAPTT

SEQ ID NO: 1544152 - protein, 12 aa, Mycobacterium tuberculosis
GSSTTTSSRGAG

SEQ ID NO: 1544153 - protein, 10 aa, Mycobacterium tuberculosis
GSTAADVRPD

SEQ ID NO: 1544154 - protein, 11 aa, Mycobacterium tuberculosis
GSVGQDATNLA

SEQ ID NO: 1544155 - protein, 11 aa, Mycobacterium tuberculosis
GSVNRGNAAQA

SEQ ID NO: 1544156 - protein, 36 aa, Mycobacterium tuberculosis
GSYHDARDRHHHDSDERPDRGADRDDRRIHNRFDPD

SEQ ID NO: 1544157 - protein, 17 aa, Mycobacterium tuberculosis
GSYSTGVGNAGTASTGL

SEQ ID NO: 1544158 - protein, 8 aa, Mycobacterium tuberculosis
GTAAGADA

SEQ ID NO: 1544159 - protein, 13 aa, Mycobacterium tuberculosis
GTAPAAGDPNAPY

SEQ ID NO: 1544160 - protein, 6 aa, Mycobacterium tuberculosis
GTASTV

SEQ ID NO: 1544161 - protein, 4 aa, Mycobacterium tuberculosis
GTAT

SEQ ID NO: 1544162 - protein, 6 aa, Mycobacterium tuberculosis
GTATDL

SEQ ID NO: 1544163 - protein, 41 aa, Mycobacterium tuberculosis; identical to SEQ ID NO: 177392

SEQ ID NO: 1544164 - protein, 4 aa, Mycobacterium tuberculosis
GTEA

SEQ ID NO: 1544165 - protein, 9 aa, Mycobacterium tuberculosis
GTGEPPGVG

SEQ ID NO: 1544166 - protein, 10 aa, Mycobacterium tuberculosis
GTGEPPGVGG

SEQ ID NO: 1544167 - protein, 22 aa, Mycobacterium tuberculosis
GTGGAGGAGGAGAAGGAGGSGG

SEQ ID NO: 1544168 - protein, 27 aa, Mycobacterium tuberculosis
GTGGAGGAGGSSTVGDGEAGGAGGSGG

SEQ ID NO: 1544169 - protein, 18 aa, Mycobacterium tuberculosis
GTGGAGGTGGDGGAGGAA

SEQ ID NO: 1544170 - protein, 18 aa, Mycobacterium tuberculosis
GTGGAGGTGGDGGAGGAG

SEQ ID NO: 1544171 - protein, 45 aa, Mycobacterium tuberculosis
GTGGAGGTGGDGGAGGAGDSPNSGANGARGGDGGNGAAGGAGAGC

SEQ ID NO: 1544172 - protein, 34 aa, Mycobacterium tuberculosis
GTGGAGGTGGDGGAGGAGDSPNSGANGARGRRRR

SEQ ID NO: 1544173 - protein, 12 aa, Mycobacterium tuberculosis
GTGGGRRQWRTG

SEQ ID NO: 1544174 - protein, 12 aa, Mycobacterium tuberculosis
GTGHGAMSVTVS

SEQ ID NO: 1544175 - protein, 5 aa, Mycobacterium tuberculosis
GTGNF

SEQ ID NO: 1544176 - protein, 27 aa, Mycobacterium tuberculosis
GTGNFGIGNSGRFNTGIGNSGTASTGL

SEQ ID NO: 1544177 - protein, 16 aa, Mycobacterium tuberculosis
GTGNFGIGNTGTGNFG

SEQ ID NO: 1544178 - protein, 4 aa, Mycobacterium tuberculosis
GTGQ

SEQ ID NO: 1544179 - protein, 5 aa, Mycobacterium tuberculosis
GTGQI

SEQ ID NO: 1544180 - protein, 9 aa, Mycobacterium tuberculosis
GTGTPLGDP

SEQ ID NO: 1544181 - protein, 20 aa, Mycobacterium tuberculosis
GTIPKTPSGKLRRANSVTLV

SEQ ID NO: 1544182 - protein, 6 aa, Mycobacterium tuberculosis
GTLPGI

SEQ ID NO: 1544183 - protein, 21 aa, Mycobacterium tuberculosis
GTLRTGSRGCCSKEDAADARR

SEQ ID NO: 1544184 - protein, 9 aa, Mycobacterium tuberculosis
GTPAAVSGI

SEQ ID NO: 1544185 - protein, 7 aa, Mycobacterium tuberculosis
GTPAFGS

SEQ ID NO: 1544186 - protein, 5 aa, Mycobacterium tuberculosis
GTPDA

SEQ ID NO: 1544187 - protein, 5 aa, Mycobacterium tuberculosis
GTPTR

SEQ ID NO: 1544188 - protein, 4 aa, Mycobacterium tuberculosis
GTSI

SEQ ID NO: 1544189 - protein, 5 aa, Mycobacterium tuberculosis
GTSRY

SEQ ID NO: 1544190 - protein, 12 aa, Mycobacterium tuberculosis
GTSTTTPPPGGS

SEQ ID NO: 1544191 - protein, 18 aa, Mycobacterium tuberculosis
GTTANTAGLAGAEAAGLA

SEQ ID NO: 1544192 - protein, 9 aa, Mycobacterium tuberculosis
GTTLKNART

SEQ ID NO: 1544193 - protein, 17 aa, Mycobacterium tuberculosis
GTTPPQRRQVLAGRRTK

SEQ ID NO: 1544194 - protein, 4 aa, Mycobacterium tuberculosis
GTVF

SEQ ID NO: 1544195 - protein, 12 aa, Mycobacterium tuberculosis
GTVKSEDQIPDE

SEQ ID NO: 1544196 - protein, 9 aa, Mycobacterium tuberculosis
GTVQARPRS

SEQ ID NO: 1544197 - protein, 4 aa, Mycobacterium tuberculosis
GVAP

SEQ ID NO: 1544198 - protein, 32 aa, Mycobacterium tuberculosis; identical to SEQ ID NO: 1421377

SEQ ID NO: 1544199 - protein, 16 aa, Mycobacterium tuberculosis
GVDDERNRRHQFPPRH

SEQ ID NO: 1544200 - protein, 6 aa, Mycobacterium tuberculosis
GVEELG

SEQ ID NO: 1544201 - protein, 5 aa, Mycobacterium tuberculosis
GVEQG

SEQ ID NO: 1544202 - protein, 7 aa, Mycobacterium tuberculosis
GVGGAGG

SEQ ID NO: 1544203 - protein, 24 aa, Mycobacterium tuberculosis
GVGGAGGIGSADGGLGGGGGNGRF

SEQ ID NO: 1544204 - protein, 19 aa, Mycobacterium tuberculosis
GVGGLGGAGAAGGNGGAGG

SEQ ID NO: 1544205 - protein, 9 aa, Mycobacterium tuberculosis
GVHPNDAGH

SEQ ID NO: 1544206 - protein, 17 aa, Mycobacterium tuberculosis
GVPAADAGGRDAASEQI

SEQ ID NO: 1544207 - protein, 6 aa, Mycobacterium tuberculosis
GVPAGA

SEQ ID NO: 1544208 - protein, 18 aa, Mycobacterium tuberculosis
GVPARNEPPSDPSAPIPG

SEQ ID NO: 1544209 - protein, 15 aa, Mycobacterium tuberculosis
GVPGPGYVAGAGTSV

SEQ ID NO: 1544210 - protein, 9 aa, Mycobacterium tuberculosis
GVPQPPLAD

SEQ ID NO: 1544211 - protein, 29 aa, Mycobacterium tuberculosis
GVQPGPRLPNVDAGGDFVESTDGLTDCDG

SEQ ID NO: 1544212 - protein, 30 aa, Mycobacterium tuberculosis; identical to SEQ ID NO: 1368288

SEQ ID NO: 1544213 - protein, 12 aa, Mycobacterium tuberculosis
GVRPPTRTVRGL

SEQ ID NO: 1544214 - protein, 19 aa, Mycobacterium tuberculosis
GVRSRSDAAGTKSSFRTGD

SEQ ID NO: 1544215 - protein, 9 aa, Mycobacterium tuberculosis
GVSATPETL

SEQ ID NO: 1544216 - protein, 12 aa, Mycobacterium tuberculosis
GVSGGERPNVGV

SEQ ID NO: 1544217 - protein, 7 aa, Mycobacterium tuberculosis
GVTAESI

SEQ ID NO: 1544218 - protein, 8 aa, Mycobacterium tuberculosis
GVTKDASM

SEQ ID NO: 1544219 - protein, 8 aa, Mycobacterium tuberculosis
GVTPTECG

SEQ ID NO: 1544220 - protein, 11 aa, Mycobacterium tuberculosis
GVVNGGTGATL

SEQ ID NO: 1544221 - protein, 22 aa, Mycobacterium tuberculosis
GYDKSWADGRGGVAGGSPSSRR

SEQ ID NO: 1544222 - protein, 13 aa, Mycobacterium tuberculosis
GYLNGDSRASGWI

SEQ ID NO: 1544223 - protein, 8 aa, Mycobacterium tuberculosis
GYPASTPV

SEQ ID NO: 1544224 - protein, 23 aa, Mycobacterium tuberculosis
GYPPSDGPPRRGQAYTGTDRQVR

SEQ ID NO: 1544225 - protein, 5 aa, Mycobacterium tuberculosis
GYPRR

SEQ ID NO: 1544226 - protein, 17 aa, Mycobacterium tuberculosis
GYTAGQVRNRESGDPFT

SEQ ID NO: 1544227 - protein, 27 aa, Mycobacterium tuberculosis
HAGRPEWRPRPRRQPARRSRPSPRPRR

SEQ ID NO: 1544228 - protein, 13 aa, Mycobacterium tuberculosis
HANTGLANAGTFG

SEQ ID NO: 1544229 - protein, 9 aa, Mycobacterium tuberculosis
HASDTDTIR

SEQ ID NO: 1544230 - protein, 7 aa, Mycobacterium tuberculosis
HASVPPS

SEQ ID NO: 1544231 - protein, 4 aa, Mycobacterium tuberculosis
HATH

SEQ ID NO: 1544232 - protein, 31 aa, Mycobacterium tuberculosis; identical to SEQ ID NO: 1427814

SEQ ID NO: 1544233 - protein, 9 aa, Mycobacterium tuberculosis
HDNDGSGAA

SEQ ID NO: 1544234 - protein, 7 aa, Mycobacterium tuberculosis
HDPLRDD

SEQ ID NO: 1544235 - protein, 12 aa, Mycobacterium tuberculosis
HDPRSREQRRAD

SEQ ID NO: 1544236 - protein, 13 aa, Mycobacterium tuberculosis
HDPRSREQRRADA

SEQ ID NO: 1544237 - protein, 16 aa, Mycobacterium tuberculosis
HEAAGAAVRAAEQRGV

SEQ ID NO: 1544238 - protein, 9 aa, Mycobacterium tuberculosis
HEDDSFDEE

SEQ ID NO: 1544239 - protein, 9 aa, Mycobacterium tuberculosis
HEDPSGPVI

SEQ ID NO: 1544240 - protein, 4 aa, Mycobacterium tuberculosis
HELR

SEQ ID NO: 1544241 - protein, 5 aa, Mycobacterium tuberculosis
HESNT

SEQ ID NO: 1544242 - protein, 6 aa, Mycobacterium tuberculosis
HESRPL

SEQ ID NO: 1544243 - protein, 17 aa, Mycobacterium tuberculosis
HGAPGTGQPGGARGVVV

SEQ ID NO: 1544244 - protein, 13 aa, Mycobacterium tuberculosis
HGAPGTGQRGGAG

SEQ ID NO: 1544245 - protein, 27 aa, Mycobacterium tuberculosis
HGGAGGAGGIGSAVGGLGGGGGNGRSW

SEQ ID NO: 1544246 - protein, 17 aa, Mycobacterium tuberculosis
HGGAGGAGGLGKAGCTG

SEQ ID NO: 1544247 - protein, 8 aa, Mycobacterium tuberculosis
HGGISGRY

SEQ ID NO: 1544248 - protein, 24 aa, Mycobacterium tuberculosis
HGGNGGAGGSNAAGAGGVGGAGGA

SEQ ID NO: 1544249 - protein, 52 aa, Mycobacterium tuberculosis
HGGSGGVGGAGGAGGQASPGAPGPPSQPGGAGGAGGAGGRGGDGGSAGWLSG

SEQ ID NO: 1544250 - protein, 10 aa, Mycobacterium tuberculosis
HGGTGGAGRH

SEQ ID NO: 1544251 - protein, 12 aa, Mycobacterium tuberculosis
HGGTNTRELPSA

SEQ ID NO: 1544252 - protein, 5 aa, Mycobacterium tuberculosis
HGGVR

SEQ ID NO: 1544253 - protein, 4 aa, Mycobacterium tuberculosis
HGHR

SEQ ID NO: 1544254 - protein, 9 aa, Mycobacterium tuberculosis
HGNRQRAHY

SEQ ID NO: 1544255 - protein, 6 aa, Mycobacterium tuberculosis
HGQQYQ

SEQ ID NO: 1544256 - protein, 6 aa, Mycobacterium tuberculosis
HGRGGF

SEQ ID NO: 1544257 - protein, 19 aa, Mycobacterium tuberculosis
HGSNTRAKRGRTGQGGRGG

SEQ ID NO: 1544258 - protein, 11 aa, Mycobacterium tuberculosis
HGTDPAAAVGL

SEQ ID NO: 1544259 - protein, 34 aa, Mycobacterium tuberculosis
HHGDGTGRSRPDSRQGLSASASPRVCSPARAPSP

SEQ ID NO: 1544260 - protein, 4 aa, Mycobacterium tuberculosis
HHGV

SEQ ID NO: 1544261 - protein, 26 aa, Mycobacterium tuberculosis
HHSRPDRRTSGPRYARVGRGDQRNRA

SEQ ID NO: 1544262 - protein, 14 aa, Mycobacterium tuberculosis
HLDSTRAVSPLQAA

SEQ ID NO: 1544263 - protein, 26 aa, Mycobacterium tuberculosis
HNAQRLGNTPSTPPTTTKKAPQAGLT

SEQ ID NO: 1544264 - protein, 6 aa, Mycobacterium tuberculosis
HNPSLH

SEQ ID NO: 1544265 - protein, 16 aa, Mycobacterium tuberculosis
HNSGGFNSENQRSGFG

SEQ ID NO: 1544266 - protein, 18 aa, Mycobacterium tuberculosis
HPAGVGSDIPADAGGQLG

SEQ ID NO: 1544267 - protein, 24 aa, Mycobacterium tuberculosis
HPDPTALASVPGSRRQWERDPHDP

SEQ ID NO: 1544268 - protein, 13 aa, Mycobacterium tuberculosis
HPELPAAGTSAGR

SEQ ID NO: 1544269 - protein, 12 aa, Mycobacterium tuberculosis
HPHKGTAPRFSN

SEQ ID NO: 1544270 - protein, 13 aa, Mycobacterium tuberculosis
HPIPAEPADQLVN

SEQ ID NO: 1544271 - protein, 24 aa, Mycobacterium tuberculosis
HPPAAPSPPTIGHTREELDPPWPP

SEQ ID NO: 1544272 - protein, 8 aa, Mycobacterium tuberculosis
HPPKSPNA

SEQ ID NO: 1544273 - protein, 6 aa, Mycobacterium tuberculosis
HPQPSL

SEQ ID NO: 1544274 - protein, 9 aa, Mycobacterium tuberculosis
HQESQSIAR

SEQ ID NO: 1544275 - protein, 11 aa, Mycobacterium tuberculosis
HQHGREDGRRQ

SEQ ID NO: 1544276 - protein, 6 aa, Mycobacterium tuberculosis
HQRGGP

SEQ ID NO: 1544277 - protein, 10 aa, Mycobacterium tuberculosis
HQVTDDDVAA

SEQ ID NO: 1544278 - protein, 12 aa, Mycobacterium tuberculosis
HRAKRRSCAAQA

SEQ ID NO: 1544279 - protein, 13 aa, Mycobacterium tuberculosis
HRCGGRADVGHSA

SEQ ID NO: 1544280 - protein, 9 aa, Mycobacterium tuberculosis
HRGPDRGRR

SEQ ID NO: 1544281 - protein, 5 aa, Mycobacterium tuberculosis
HRPEV

SEQ ID NO: 1544282 - protein, 11 aa, Mycobacterium tuberculosis
HRQRRRAQPGV

SEQ ID NO: 1544283 - protein, 17 aa, Mycobacterium tuberculosis
HRRPATGPIQHRRQDPA

SEQ ID NO: 1544284 - protein, 6 aa, Mycobacterium tuberculosis
HRRSPG

SEQ ID NO: 1544285 - protein, 23 aa, Mycobacterium tuberculosis
HRSAATAAAVSEYSSAESLAGAA

SEQ ID NO: 1544286 - protein, 13 aa, Mycobacterium tuberculosis
HRSGSLGGQDPRH

SEQ ID NO: 1544287 - protein, 8 aa, Mycobacterium tuberculosis
HSDPANYG

SEQ ID NO: 1544288 - protein, 6 aa, Mycobacterium tuberculosis
HSDQLA

SEQ ID NO: 1544289 - protein, 34 aa, Mycobacterium tuberculosis
HSGAHGAMGSGGEGGAGGGGGARGEAGAGGGTST

SEQ ID NO: 1544290 - protein, 12 aa, Mycobacterium tuberculosis
HSGTSAGTSGTA

SEQ ID NO: 1544291 - protein, 26 aa, Mycobacterium tuberculosis
HSMGSARPGDFGAPTAVAPPVPEHGT

SEQ ID NO: 1544292 - protein, 9 aa, Mycobacterium tuberculosis
HSPKHPPDL

SEQ ID NO: 1544293 - protein, 17 aa, Mycobacterium tuberculosis
HSRVPGQLSRRRGASAR

SEQ ID NO: 1544294 - protein, 9 aa, Mycobacterium tuberculosis
HSSAPAAAT

SEQ ID NO: 1544295 - protein, 6 aa, Mycobacterium tuberculosis
HSTAGA

SEQ ID NO: 1544296 - protein, 5 aa, Mycobacterium tuberculosis
HTGAR

SEQ ID NO: 1544297 - protein, 9 aa, Mycobacterium tuberculosis
HTGCAGGQG

SEQ ID NO: 1544298 - protein, 19 aa, Mycobacterium tuberculosis
HTGDQARCEHNPGAHTGEG

SEQ ID NO: 1544299 - protein, 13 aa, Mycobacterium tuberculosis
HTVGGTAGPERNS

SEQ ID NO: 1544300 - protein, 17 aa, Mycobacterium tuberculosis
HVAAGGRRLGPFRRADV

SEQ ID NO: 1544301 - protein, 4 aa, Mycobacterium tuberculosis
HVAD

SEQ ID NO: 1544302 - protein, 5 aa, Mycobacterium tuberculosis
HYRSG

SEQ ID NO: 1544303 - protein, 13 aa, Mycobacterium tuberculosis
IAAANAAAAANTT

SEQ ID NO: 1544304 - protein, 10 aa, Mycobacterium tuberculosis
IADASPPDMR

SEQ ID NO: 1544305 - protein, 21 aa, Mycobacterium tuberculosis
IAGGPADAAVTASAADAARAA

SEQ ID NO: 1544306 - protein, 18 aa, Mycobacterium tuberculosis
IAGTSPTAGTASAAGAPV

SEQ ID NO: 1544307 - protein, 9 aa, Mycobacterium tuberculosis
IAPAPDAVT

SEQ ID NO: 1544308 - protein, 11 aa, Mycobacterium tuberculosis
IAPGIGSATQV

SEQ ID NO: 1544309 - protein, 8 aa, Mycobacterium tuberculosis
IATNPRAQ

SEQ ID NO: 1544310 - protein, 6 aa, Mycobacterium tuberculosis
IDRDQL

SEQ ID NO: 1544311 - protein, 5 aa, Mycobacterium tuberculosis
IDRSQ

SEQ ID NO: 1544312 - protein, 31 aa, Mycobacterium tuberculosis; identical to SEQ ID NO: 1425644

SEQ ID NO: 1544313 - protein, 18 aa, Mycobacterium tuberculosis
IEAEPGARTASANWLNVR

SEQ ID NO: 1544314 - protein, 9 aa, Mycobacterium tuberculosis
IEQPAQPAF

SEQ ID NO: 1544315 - protein, 140 aa, Mycobacterium tuberculosis
IGAGGDGGVGGVGAPGTNGMNPPPNQTSQAANGSPGANNGAGSGGAGLPGNPGAVPGRAGGAGGLGGSGSDTSEGPVTGGNGGNGGDGGPGAPGGNGAPGGIGVNTGTGWAYGGNGGNGGDGGAGARERRRGQRGQRPSV

SEQ ID NO: 1544316 - protein, 7 aa, Mycobacterium tuberculosis
IGAGSGI

SEQ ID NO: 1544317 - protein, 7 aa, Mycobacterium tuberculosis
IGGAPAS

SEQ ID NO: 1544318 - protein, 6 aa, Mycobacterium tuberculosis
IGGEEA

SEQ ID NO: 1544319 - protein, 75 aa, Mycobacterium tuberculosis
IGGGGGAGGAGGVFSGGGAGGAGDAIGGSGGAGGTGGLLGGGGGAGGAGGAGGNGGGASNSASIGGDGGSGGAGG

SEQ ID NO: 1544320 - protein, 21 aa, Mycobacterium tuberculosis
IGGGGGVGAMAAGGAGLVGLA

SEQ ID NO: 1544321 - protein, 7 aa, Mycobacterium tuberculosis
IGGPNTA

SEQ ID NO: 1544322 - protein, 4 aa, Mycobacterium tuberculosis
IGGR

SEQ ID NO: 1544323 - protein, 515 aa, Mycobacterium tuberculosis
IGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGQNGTTGVASEGGAGGQGGDGGDGGEGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGNGGSPGTDG

SEQ ID NO: 1544324 - protein, 19 aa, Mycobacterium tuberculosis
IGNGGNSGGGVNRGTVDDG

SEQ ID NO: 1544325 - protein, 30 aa, Mycobacterium tuberculosis; identical to SEQ ID NO: 1427849

SEQ ID NO: 1544326 - protein, 11 aa, Mycobacterium tuberculosis
IGNSGSTSTGL

SEQ ID NO: 1544327 - protein, 4 aa, Mycobacterium tuberculosis
IGPK

SEQ ID NO: 1544328 - protein, 8 aa, Mycobacterium tuberculosis
IGQTGMPS

SEQ ID NO: 1544329 - protein, 5 aa, Mycobacterium tuberculosis
IGSES

SEQ ID NO: 1544330 - protein, 15 aa, Mycobacterium tuberculosis
IGSPSPESPLPTIPA

SEQ ID NO: 1544331 - protein, 6 aa, Mycobacterium tuberculosis
IGTAAT

SEQ ID NO: 1544332 - protein, 7 aa, Mycobacterium tuberculosis
IGTEATA

SEQ ID NO: 1544333 - protein, 27 aa, Mycobacterium tuberculosis
IGTGRTQGGGVESVSAGAAATAGTALA

SEQ ID NO: 1544334 - protein, 8 aa, Mycobacterium tuberculosis
IKPGKDAH

SEQ ID NO: 1544335 - protein, 23 aa, Mycobacterium tuberculosis
IKQAEGQKQAHGSWPPRAPSRPR

SEQ ID NO: 1544336 - protein, 10 aa, Mycobacterium tuberculosis
INDPTSSAQI

SEQ ID NO: 1544337 - protein, 9 aa, Mycobacterium tuberculosis
INGNGSRIQ

SEQ ID NO: 1544338 - protein, 6 aa, Mycobacterium tuberculosis
IPAATA

SEQ ID NO: 1544339 - protein, 6 aa, Mycobacterium tuberculosis
IPADAR

SEQ ID NO: 1544340 - protein, 18 aa, Mycobacterium tuberculosis
IPAGTQGRRRASTATGTR

SEQ ID NO: 1544341 - protein, 11 aa, Mycobacterium tuberculosis
IPAPEADPPYD

SEQ ID NO: 1544342 - protein, 12 aa, Mycobacterium tuberculosis
IPAPEADPPYDH

SEQ ID NO: 1544343 - protein, 18 aa, Mycobacterium tuberculosis
IPGGPGYFNSSTAPSSGF

SEQ ID NO: 1544344 - protein, 8 aa, Mycobacterium tuberculosis
IPGPTNPQ

SEQ ID NO: 1544345 - protein, 4 aa, Mycobacterium tuberculosis
IPPA

SEQ ID NO: 1544346 - protein, 10 aa, Mycobacterium tuberculosis
IPPAPTGGDA

SEQ ID NO: 1544347 - protein, 6 aa, Mycobacterium tuberculosis
IPPNGQ

SEQ ID NO: 1544348 - protein, 5 aa, Mycobacterium tuberculosis
IPPTG

SEQ ID NO: 1544349 - protein, 25 aa, Mycobacterium tuberculosis
IPSPQPLKSGDTIGLKNSSAYPTVE

SEQ ID NO: 1544350 - protein, 6 aa, Mycobacterium tuberculosis
IPTGGP

SEQ ID NO: 1544351 - protein, 10 aa, Mycobacterium tuberculosis
IPTGTTGAAL

SEQ ID NO: 1544352 - protein, 9 aa, Mycobacterium tuberculosis
IRAAPDQSR

SEQ ID NO: 1544353 - protein, 20 aa, Mycobacterium tuberculosis
IRESASQALPGLLERLPALL

SEQ ID NO: 1544354 - protein, 6 aa, Mycobacterium tuberculosis
IRPEPD

SEQ ID NO: 1544355 - protein, 13 aa, Mycobacterium tuberculosis
IRSGPGPCRDHYR

SEQ ID NO: 1544356 - protein, 8 aa, Mycobacterium tuberculosis
IRSRNSTD

SEQ ID NO: 1544357 - protein, 7 aa, Mycobacterium tuberculosis
ISAPDNP

SEQ ID NO: 1544358 - protein, 9 aa, Mycobacterium tuberculosis
ISGASTARR

SEQ ID NO: 1544359 - protein, 4 aa, Mycobacterium tuberculosis
ISGR

SEQ ID NO: 1544360 - protein, 10 aa, Mycobacterium tuberculosis
ISKTATTDCT

SEQ ID NO: 1544361 - protein, 13 aa, Mycobacterium tuberculosis
ISPTPRPASVITI

SEQ ID NO: 1544362 - protein, 40 aa, Mycobacterium tuberculosis
ISRTGRNCSLDGTARNDRNRRRGGSGAMTTEGSDESMSAC

SEQ ID NO: 1544363 - protein, 12 aa, Mycobacterium tuberculosis
ISSPSDPTANPI

SEQ ID NO: 1544364 - protein, 17 aa, Mycobacterium tuberculosis
ISSSTGPKSHVSGSTNA

SEQ ID NO: 1544365 - protein, 11 aa, Mycobacterium tuberculosis
ISTSPSSSTFP

SEQ ID NO: 1544366 - protein, 12 aa, Mycobacterium tuberculosis
ITARRQDALGRN

SEQ ID NO: 1544367 - protein, 44 aa, Mycobacterium tuberculosis
ITGNPGDPRYPYRPEPPAPPPGGRRPARPRSSRETNRDNETQTC

SEQ ID NO: 1544368 - protein, 24 aa, Mycobacterium tuberculosis
ITGNPGDPRYPYRPEPPAQQPGDQ

SEQ ID NO: 1544369 - protein, 12 aa, Mycobacterium tuberculosis
ITNPANRHAAER

SEQ ID NO: 1544370 - protein, 17 aa, Mycobacterium tuberculosis
ITPATRNSAGFAAPAAV

SEQ ID NO: 1544371 - protein, 23 aa, Mycobacterium tuberculosis
ITRGSASSGRSRQRPGCDATEPP

SEQ ID NO: 1544372 - protein, 5 aa, Mycobacterium tuberculosis
IVEPG

SEQ ID NO: 1544373 - protein, 7 aa, Mycobacterium tuberculosis
KAAGRPD

SEQ ID NO: 1544374 - protein, 8 aa, Mycobacterium tuberculosis
KAATGGVG

SEQ ID NO: 1544375 - protein, 6 aa, Mycobacterium tuberculosis
KAEFDG

SEQ ID NO: 1544376 - protein, 162 aa, Mycobacterium tuberculosis
KAGNGGAGGNGGNVGVAGQGGAGGKGAIPAMKGATGADGTAPTSGGDGGNGGNGGAGGAGGTLAGHGGNGGKGGNGGQGGIGGAGERGADGAGPNANGANGENGGSGGNGGDGGAGGNGGAGGKAQAAGYTDGATGTGGDGGNGGDGGKAGDGGAGENGLNS

SEQ ID NO: 1544377 - protein, 7 aa, Mycobacterium tuberculosis
KAGPEIR

SEQ ID NO: 1544378 - protein, 8 aa, Mycobacterium tuberculosis
KAGPEIRS

SEQ ID NO: 1544379 - protein, 12 aa, Mycobacterium tuberculosis
KAGVPGADPSEW

SEQ ID NO: 1544380 - protein, 7 aa, Mycobacterium tuberculosis
KAPPPIA

SEQ ID NO: 1544381 - protein, 8 aa, Mycobacterium tuberculosis
KAPSQEDH

SEQ ID NO: 1544382 - protein, 14 aa, Mycobacterium tuberculosis
KAQSMSATKSKGLR

SEQ ID NO: 1544383 - protein, 10 aa, Mycobacterium tuberculosis
KDDKAGETVG

SEQ ID NO: 1544384 - protein, 9 aa, Mycobacterium tuberculosis
KDGTLGGPN

SEQ ID NO: 1544385 - protein, 8 aa, Mycobacterium tuberculosis
KDGTNSLD

SEQ ID NO: 1544386 - protein, 9 aa, Mycobacterium tuberculosis
KDLQPQNSR

SEQ ID NO: 1544387 - protein, 31 aa, Mycobacterium tuberculosis
KDPPRPRPPAQSPAPPSAPVADQGGDPATPG

SEQ ID NO: 1544388 - protein, 6 aa, Mycobacterium tuberculosis
KEFAGR

SEQ ID NO: 1544389 - protein, 6 aa, Mycobacterium tuberculosis
KEFDET

SEQ ID NO: 1544390 - protein, 4 aa, Mycobacterium tuberculosis
KEFT

SEQ ID NO: 1544391 - protein, 15 aa, Mycobacterium tuberculosis
KFSPRTSGGDPQLAQ

SEQ ID NO: 1544392 - protein, 9 aa, Mycobacterium tuberculosis
KGEAGADSF

SEQ ID NO: 1544393 - protein, 15 aa, Mycobacterium tuberculosis
KGGAGGTGGRGGAAG

SEQ ID NO: 1544394 - protein, 15 aa, Mycobacterium tuberculosis
KGQQPAGPGLRARLP

SEQ ID NO: 1544395 - protein, 17 aa, Mycobacterium tuberculosis
KGTDTGQACQNQMSDPA

SEQ ID NO: 1544396 - protein, 4 aa, Mycobacterium tuberculosis
KGYD

SEQ ID NO: 1544397 - protein, 10 aa, Mycobacterium tuberculosis
KGYSTPAHSR

SEQ ID NO: 1544398 - protein, 6 aa, Mycobacterium tuberculosis
KIDDEG

SEQ ID NO: 1544399 - protein, 220 aa, Mycobacterium tuberculosis
KKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKRKKKKKKGGGRGGGGGGGGGGGKKKQKEKKKKKKKKKKKKKKGGRQSKKQIRKKQGGQW

SEQ ID NO: 1544400 - protein, 289 aa, Mycobacterium tuberculosis
KKKTNKKKKKKKKKKKKKKKKKKKKKKKKKKKKQNKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKNKKKKKKKKKKGGGGRGGGAGGGGGGGGGGGGGGGEGGGGGGGKKKKKKKKKKKKKKKKKKKKKKKKKKKKKKEKKKKKKKQKKKKGKGGGWGGGGGGGGGGGGGGGEGGDKEGGGGEGPPAPPPAPPPPTPNPPAPPPTPPPPAR

SEQ ID NO: 1544401 - protein, 122 aa, Mycobacterium tuberculosis
KKRKKKKKKKKKNKKKKKKKKNKKKKKKKKKKKKKKKKKKKKKKKKKKKKKKKKKKKKKKKKKKKKKIKKKKKKKKKKKKKKKKKKKKKKKKKKKKKKKKKKKKKKKKKKKKKKKKKKKKRK

SEQ ID NO: 1544402 - protein, 8 aa, Mycobacterium tuberculosis
KLAPSRPQ

SEQ ID NO: 1544403 - protein, 7 aa, Mycobacterium tuberculosis
KLEREPE

SEQ ID NO: 1544404 - protein, 9 aa, Mycobacterium tuberculosis
KLGSSGGVL

SEQ ID NO: 1544405 - protein, 32 aa, Mycobacterium tuberculosis
KNKKYKKKKKKRKKKTKIKKKKKKKKKKKKKI

SEQ ID NO: 1544406 - protein, 6 aa, Mycobacterium tuberculosis
KPAPVI

SEQ ID NO: 1544407 - protein, 7 aa, Mycobacterium tuberculosis
KPELDRD

SEQ ID NO: 1544408 - protein, 5 aa, Mycobacterium tuberculosis
KPFGL

SEQ ID NO: 1544409 - protein, 4 aa, Mycobacterium tuberculosis
KPGA

SEQ ID NO: 1544410 - protein, 30 aa, Mycobacterium tuberculosis
KPRRQRPSRQRRQRRQRRRGWGRRRRHRRR

SEQ ID NO: 1544411 - protein, 8 aa, Mycobacterium tuberculosis
KQRRDGQR

SEQ ID NO: 1544412 - protein, 13 aa, Mycobacterium tuberculosis
KQRWPDDPTSHAY

SEQ ID NO: 1544413 - protein, 8 aa, Mycobacterium tuberculosis
KQVEPTPG

SEQ ID NO: 1544414 - protein, 14 aa, Mycobacterium tuberculosis
KRGEGKGANDLLPP

SEQ ID NO: 1544415 - protein, 5 aa, Mycobacterium tuberculosis
KRNLP

SEQ ID NO: 1544416 - protein, 12 aa, Mycobacterium tuberculosis
KRRGDGVSDTAL

SEQ ID NO: 1544417 - protein, 7 aa, Mycobacterium tuberculosis
KRRTSQN

SEQ ID NO: 1544418 - protein, 9 aa, Mycobacterium tuberculosis
KRTETPRTT

SEQ ID NO: 1544419 - protein, 22 aa, Mycobacterium tuberculosis
KSGAAGVAERKQDPLTPAARDE

SEQ ID NO: 1544420 - protein, 8 aa, Mycobacterium tuberculosis
KSGFGPEY

SEQ ID NO: 1544421 - protein, 8 aa, Mycobacterium tuberculosis
KSMGDSEF

SEQ ID NO: 1544422 - protein, 14 aa, Mycobacterium tuberculosis
KSPAAELSMSGTAI

SEQ ID NO: 1544423 - protein, 7 aa, Mycobacterium tuberculosis
KTAGDRR

SEQ ID NO: 1544424 - protein, 11 aa, Mycobacterium tuberculosis
KTGEAEFPGGS

SEQ ID NO: 1544425 - protein, 12 aa, Mycobacterium tuberculosis
KTTNATQVRRGP

SEQ ID NO: 1544426 - protein, 10 aa, Mycobacterium tuberculosis
LAAAATSTTC

SEQ ID NO: 1544427 - protein, 11 aa, Mycobacterium tuberculosis
LADDGQGPEVC

SEQ ID NO: 1544428 - protein, 13 aa, Mycobacterium tuberculosis
LAESPTGSPNPTM

SEQ ID NO: 1544429 - protein, 5 aa, Mycobacterium tuberculosis
LAETS

SEQ ID NO: 1544430 - protein, 19 aa, Mycobacterium tuberculosis
LAGGPADIGGGNRRGRRCR

SEQ ID NO: 1544431 - protein, 12 aa, Mycobacterium tuberculosis
LAGPAAAAATVG

SEQ ID NO: 1544432 - protein, 18 aa, Mycobacterium tuberculosis
LAGPGGSRRRVRWGGVAT

SEQ ID NO: 1544433 - protein, 5 aa, Mycobacterium tuberculosis
LAGPR

SEQ ID NO: 1544434 - protein, 4 aa, Mycobacterium tuberculosis
LAGQ

SEQ ID NO: 1544435 - protein, 7 aa, Mycobacterium tuberculosis
LAGTSAG

SEQ ID NO: 1544436 - protein, 23 aa, Mycobacterium tuberculosis
LAPDSKTGRPWNSTPEDSNYDPC

SEQ ID NO: 1544437 - protein, 11 aa, Mycobacterium tuberculosis
LAPPASARCPD

SEQ ID NO: 1544438 - protein, 15 aa, Mycobacterium tuberculosis
LARSGGDGDGRRGSP

SEQ ID NO: 1544439 - protein, 4 aa, Mycobacterium tuberculosis
LASE

SEQ ID NO: 1544440 - protein, 4 aa, Mycobacterium tuberculosis
LASG

SEQ ID NO: 1544441 - protein, 11 aa, Mycobacterium tuberculosis
LASSPTGPAIT

SEQ ID NO: 1544442 - protein, 17 aa, Mycobacterium tuberculosis
LDADRNGESAQRLCADV

SEQ ID NO: 1544443 - protein, 8 aa, Mycobacterium tuberculosis
LDAQTNPV

SEQ ID NO: 1544444 - protein, 11 aa, Mycobacterium tuberculosis
LDDGASGSLDE

SEQ ID NO: 1544445 - protein, 12 aa, Mycobacterium tuberculosis
LDDSKKLSEQAR

SEQ ID NO: 1544446 - protein, 18 aa, Mycobacterium tuberculosis
LDEAPSPTLSGPRAPTPR

SEQ ID NO: 1544447 - protein, 7 aa, Mycobacterium tuberculosis
LDGRTNE

SEQ ID NO: 1544448 - protein, 11 aa, Mycobacterium tuberculosis
LDTQSGAARPV

SEQ ID NO: 1544449 - protein, 5 aa, Mycobacterium tuberculosis
LEDTI

SEQ ID NO: 1544450 - protein, 5 aa, Mycobacterium tuberculosis
LEGAG

SEQ ID NO: 1544451 - protein, 7 aa, Mycobacterium tuberculosis
LEQRGSC

SEQ ID NO: 1544452 - protein, 10 aa, Mycobacterium tuberculosis
LETQDGPRLS

SEQ ID NO: 1544453 - protein, 9 aa, Mycobacterium tuberculosis
LGADDDTAI

SEQ ID NO: 1544454 - protein, 11 aa, Mycobacterium tuberculosis
LGAGGRCDSAS

SEQ ID NO: 1544455 - protein, 6 aa, Mycobacterium tuberculosis
LGASQA

SEQ ID NO: 1544456 - protein, 46 aa, Mycobacterium tuberculosis
LGATPPLSAPQSCGNPAPAAPRDKPPPFSRTDAGPHRGGAGGPPGF

SEQ ID NO: 1544457 - protein, 13 aa, Mycobacterium tuberculosis
LGDRSRSVSLSGT

SEQ ID NO: 1544458 - protein, 4 aa, Mycobacterium tuberculosis
LGDS

SEQ ID NO: 1544459 - protein, 11 aa, Mycobacterium tuberculosis
LGEDARSQHID

SEQ ID NO: 1544460 - protein, 10 aa, Mycobacterium tuberculosis
LGEDGPTHQP

SEQ ID NO: 1544461 - protein, 6 aa, Mycobacterium tuberculosis
LGESAA

SEQ ID NO: 1544462 - protein, 9 aa, Mycobacterium tuberculosis
LGFGNAGSY

SEQ ID NO: 1544463 - protein, 8 aa, Mycobacterium tuberculosis
LGGATETA

SEQ ID NO: 1544464 - protein, 18 aa, Mycobacterium tuberculosis
LGGGAQAAGGNGGAGGVG

SEQ ID NO: 1544465 - protein, 8 aa, Mycobacterium tuberculosis
LGGGGEES

SEQ ID NO: 1544466 - protein, 42 aa, Mycobacterium tuberculosis
LGGGGGAGGVGGTGGIGGIGGAGGNGGAGGAGTTTGGGATIG

SEQ ID NO: 1544467 - protein, 14 aa, Mycobacterium tuberculosis
LGGGNTGNANLGGG

SEQ ID NO: 1544468 - protein, 13 aa, Mycobacterium tuberculosis
LGGNGGDGGDGGG

SEQ ID NO: 1544469 - protein, 7 aa, Mycobacterium tuberculosis
LGGSNFG

SEQ ID NO: 1544470 - protein, 8 aa, Mycobacterium tuberculosis
LGLQPGGQ

SEQ ID NO: 1544471 - protein, 9 aa, Mycobacterium tuberculosis
LGNAGSGSW

SEQ ID NO: 1544472 - protein, 10 aa, Mycobacterium tuberculosis
LGNTGSTNTG

SEQ ID NO: 1544473 - protein, 11 aa, Mycobacterium tuberculosis
LGNTGSTNTGF

SEQ ID NO: 1544474 - protein, 4 aa, Mycobacterium tuberculosis
LGNV

SEQ ID NO: 1544475 - protein, 4 aa, Mycobacterium tuberculosis
LGPA

SEQ ID NO: 1544476 - protein, 36 aa, Mycobacterium tuberculosis
LGPAPGPAPSPAAQGPPAPPGPGRSCRPRSSTPAHR

SEQ ID NO: 1544477 - protein, 19 aa, Mycobacterium tuberculosis
LGPAPLSADVPERHFDFGS

SEQ ID NO: 1544478 - protein, 12 aa, Mycobacterium tuberculosis
LGPARNLSTDPD

SEQ ID NO: 1544479 - protein, 4 aa, Mycobacterium tuberculosis
LGPG

SEQ ID NO: 1544480 - protein, 12 aa, Mycobacterium tuberculosis
LGPGPVTTGAAA

SEQ ID NO: 1544481 - protein, 15 aa, Mycobacterium tuberculosis
LGPGPVTTGRGGRTA

SEQ ID NO: 1544482 - protein, 13 aa, Mycobacterium tuberculosis
LGQPGAYTDFGNG

SEQ ID NO: 1544483 - protein, 32 aa, Mycobacterium tuberculosis
LGRGQPRQPQPRRWQPRRAEPGVGQPRGRQRR

SEQ ID NO: 1544484 - protein, 12 aa, Mycobacterium tuberculosis
LGRHPGSQGDFG

SEQ ID NO: 1544485 - protein, 10 aa, Mycobacterium tuberculosis
LGRQSEEGSG

SEQ ID NO: 1544486 - protein, 11 aa, Mycobacterium tuberculosis
LGSGGANAAHR

SEQ ID NO: 1544487 - protein, 9 aa, Mycobacterium tuberculosis
LGSGNQGDI

SEQ ID NO: 1544488 - protein, 5 aa, Mycobacterium tuberculosis
LGSGV

SEQ ID NO: 1544489 - protein, 11 aa, Mycobacterium tuberculosis
LGSNNAGFGNT

SEQ ID NO: 1544490 - protein, 17 aa, Mycobacterium tuberculosis
LGSQLGSSLGSSGLGAG

SEQ ID NO: 1544491 - protein, 14 aa, Mycobacterium tuberculosis
LGSSLGSSGLGGGV

SEQ ID NO: 1544492 - protein, 8 aa, Mycobacterium tuberculosis
LGSTGGLQ

SEQ ID NO: 1544493 - protein, 9 aa, Mycobacterium tuberculosis
LKDPPYRLK

SEQ ID NO: 1544494 - protein, 8 aa, Mycobacterium tuberculosis
LKQADGGR

SEQ ID NO: 1544495 - protein, 18 aa, Mycobacterium tuberculosis
LNDDTGSDGSTPQDRAHA

SEQ ID NO: 1544496 - protein, 13 aa, Mycobacterium tuberculosis
LNDRRQRRYRRQR

SEQ ID NO: 1544497 - protein, 15 aa, Mycobacterium tuberculosis
LNGCSSSASHRGPLN

SEQ ID NO: 1544498 - protein, 59 aa, Mycobacterium tuberculosis
LNGGNGGNGGIGGNGGSAAGTGGDGGKGGNGGAGANGQDFSASANGANGGQGGNGGNVG

SEQ ID NO: 1544499 - protein, 6 aa, Mycobacterium tuberculosis
LNPDTG

SEQ ID NO: 1544500 - protein, 11 aa, Mycobacterium tuberculosis
LNPRSELPSWG

SEQ ID NO: 1544501 - protein, 7 aa, Mycobacterium tuberculosis
LNSGSGN

SEQ ID NO: 1544502 - protein, 8 aa, Mycobacterium tuberculosis
LNSGSGNI

SEQ ID NO: 1544503 - protein, 18 aa, Mycobacterium tuberculosis
LNSGSGNIGFGNSGTGNV

SEQ ID NO: 1544504 - protein, 7 aa, Mycobacterium tuberculosis
LNSGTGN

SEQ ID NO: 1544505 - protein, 17 aa, Mycobacterium tuberculosis
LNSGTGNIGFGNSGNNN

SEQ ID NO: 1544506 - protein, 7 aa, Mycobacterium tuberculosis
LNSRDEA

SEQ ID NO: 1544507 - protein, 9 aa, Mycobacterium tuberculosis
LNTGYGNSG

SEQ ID NO: 1544508 - protein, 10 aa, Mycobacterium tuberculosis
LNTGYGNSGF

SEQ ID NO: 1544509 - protein, 12 aa, Mycobacterium tuberculosis
LPAALSDPTETA

SEQ ID NO: 1544510 - protein, 19 aa, Mycobacterium tuberculosis
LPAEEAAEAASALGGETAL

SEQ ID NO: 1544511 - protein, 5 aa, Mycobacterium tuberculosis
LPAGS

SEQ ID NO: 1544512 - protein, 5 aa, Mycobacterium tuberculosis
LPDGL

SEQ ID NO: 1544513 - protein, 25 aa, Mycobacterium tuberculosis
LPDGTPVSSGEGGGVRVGGGGAYQP

SEQ ID NO: 1544514 - protein, 15 aa, Mycobacterium tuberculosis
LPDQPDRHPKTLADP

SEQ ID NO: 1544515 - protein, 6 aa, Mycobacterium tuberculosis
LPDRQR

SEQ ID NO: 1544516 - protein, 4 aa, Mycobacterium tuberculosis
LPED

SEQ ID NO: 1544517 - protein, 6 aa, Mycobacterium tuberculosis
LPEEPE

SEQ ID NO: 1544518 - protein, 28 aa, Mycobacterium tuberculosis
LPEPDPQPADAPAARRRHRGARRNAPSL

SEQ ID NO: 1544519 - protein, 28 aa, Mycobacterium tuberculosis
LPEPDPQPADAPPPGDVTEAPAETPQVS

SEQ ID NO: 1544520 - protein, 7 aa, Mycobacterium tuberculosis
LPESDPA

SEQ ID NO: 1544521 - protein, 20 aa, Mycobacterium tuberculosis
LPGGGFGHGYSSNGVGNPPL

SEQ ID NO: 1544522 - protein, 8 aa, Mycobacterium tuberculosis
LPGGPRAQ

SEQ ID NO: 1544523 - protein, 16 aa, Mycobacterium tuberculosis
LPGPRPDQPRRRVWRL

SEQ ID NO: 1544524 - protein, 18 aa, Mycobacterium tuberculosis
LPGRSVGRRIEGTGTEVG

SEQ ID NO: 1544525 - protein, 8 aa, Mycobacterium tuberculosis
LPHRPPSM

SEQ ID NO: 1544526 - protein, 32 aa, Mycobacterium tuberculosis
LPLPPNARRVEDPGDEHEPGRSSKTRGFRGPR

SEQ ID NO: 1544527 - protein, 6 aa, Mycobacterium tuberculosis
LPPASV

SEQ ID NO: 1544528 - protein, 11 aa, Mycobacterium tuberculosis
LPPGATPTTTL

SEQ ID NO: 1544529 - protein, 5 aa, Mycobacterium tuberculosis
LPPNT

SEQ ID NO: 1544530 - protein, 5 aa, Mycobacterium tuberculosis
LPPRD

SEQ ID NO: 1544531 - protein, 9 aa, Mycobacterium tuberculosis
LPPSPAGAV

SEQ ID NO: 1544532 - protein, 8 aa, Mycobacterium tuberculosis
LPQGNNPV

SEQ ID NO: 1544533 - protein, 20 aa, Mycobacterium tuberculosis
LPSETTVDPTQLSDVDRDRA

SEQ ID NO: 1544534 - protein, 4 aa, Mycobacterium tuberculosis
LPSR

SEQ ID NO: 1544535 - protein, 7 aa, Mycobacterium tuberculosis
LPSVPRR

SEQ ID NO: 1544536 - protein, 4 aa, Mycobacterium tuberculosis
LPTR

SEQ ID NO: 1544537 - protein, 8 aa, Mycobacterium tuberculosis
LPTSTKDG

SEQ ID NO: 1544538 - protein, 5 aa, Mycobacterium tuberculosis
LPVGE

SEQ ID NO: 1544539 - protein, 6 aa, Mycobacterium tuberculosis
LQGNLD

SEQ ID NO: 1544540 - protein, 10 aa, Mycobacterium tuberculosis
LQGREGPVPI

SEQ ID NO: 1544541 - protein, 8 aa, Mycobacterium tuberculosis
LQPDDPRA

SEQ ID NO: 1544542 - protein, 4 aa, Mycobacterium tuberculosis
LQSA

SEQ ID NO: 1544543 - protein, 6 aa, Mycobacterium tuberculosis
LRASTR

SEQ ID NO: 1544544 - protein, 4 aa, Mycobacterium tuberculosis
LRES

SEQ ID NO: 1544545 - protein, 6 aa, Mycobacterium tuberculosis
LRGNPT

SEQ ID NO: 1544546 - protein, 20 aa, Mycobacterium tuberculosis
LRGPNGKLGAPVGDQTVDGD

SEQ ID NO: 1544547 - protein, 5 aa, Mycobacterium tuberculosis
LRGSR

SEQ ID NO: 1544548 - protein, 7 aa, Mycobacterium tuberculosis
LRPPRTP

SEQ ID NO: 1544549 - protein, 6 aa, Mycobacterium tuberculosis
LRPRPE

SEQ ID NO: 1544550 - protein, 16 aa, Mycobacterium tuberculosis
LRSERRGQRAAVGRPV

SEQ ID NO: 1544551 - protein, 10 aa, Mycobacterium tuberculosis
LRSNPEDDRA

SEQ ID NO: 1544552 - protein, 11 aa, Mycobacterium tuberculosis
LRSNPEDDRSE

SEQ ID NO: 1544553 - protein, 17 aa, Mycobacterium tuberculosis
LSAGGADAAVAVTRTLI

SEQ ID NO: 1544554 - protein, 9 aa, Mycobacterium tuberculosis
LSAGTGTGI

SEQ ID NO: 1544555 - protein, 13 aa, Mycobacterium tuberculosis
LSFPTSAAPGWSA

SEQ ID NO: 1544556 - protein, 25 aa, Mycobacterium tuberculosis
LSGGSYQNLETSASPDLATAVNIFL

SEQ ID NO: 1544557 - protein, 8 aa, Mycobacterium tuberculosis
LSGGTGAV

SEQ ID NO: 1544558 - protein, 31 aa, Mycobacterium tuberculosis
LSGLSGGDGGAGGAGGAGGAGGAGGAGGTGG

SEQ ID NO: 1544559 - protein, 44 aa, Mycobacterium tuberculosis
LSGNGGAGGNGGTGASGADGGGGLPPVPASPGCKGGGGCAGVYN

SEQ ID NO: 1544560 - protein, 35 aa, Mycobacterium tuberculosis
LSGNGGAGGNGGTGASGADGGGGLPPVPASPGGNG

SEQ ID NO: 1544561 - protein, 4 aa, Mycobacterium tuberculosis
LSGP

SEQ ID NO: 1544562 - protein, 11 aa, Mycobacterium tuberculosis
LSGVSAAGTTL

SEQ ID NO: 1544563 - protein, 9 aa, Mycobacterium tuberculosis
LSNAGSNNW

SEQ ID NO: 1544564 - protein, 5 aa, Mycobacterium tuberculosis
LSNKE

SEQ ID NO: 1544565 - protein, 18 aa, Mycobacterium tuberculosis
LSPAPSPRPPATSTEGAS

SEQ ID NO: 1544566 - protein, 7 aa, Mycobacterium tuberculosis
LSPATGA

SEQ ID NO: 1544567 - protein, 9 aa, Mycobacterium tuberculosis
LSPDAIPAE

SEQ ID NO: 1544568 - protein, 8 aa, Mycobacterium tuberculosis
LSPFGDGT

SEQ ID NO: 1544569 - protein, 29 aa, Mycobacterium tuberculosis
LSPPSQTTNPGGLAAQSAAVGSAAATAAV

SEQ ID NO: 1544570 - protein, 11 aa, Mycobacterium tuberculosis
LSRQAEQTTEA

SEQ ID NO: 1544571 - protein, 13 aa, Mycobacterium tuberculosis
LSRSNDPTDPFMP

SEQ ID NO: 1544572 - protein, 15 aa, Mycobacterium tuberculosis
LSVEQTSELDDGRRR

SEQ ID NO: 1544573 - protein, 14 aa, Mycobacterium tuberculosis
LSVPQGRRRPGPAP

SEQ ID NO: 1544574 - protein, 8 aa, Mycobacterium tuberculosis
LTAPEGTP

SEQ ID NO: 1544575 - protein, 14 aa, Mycobacterium tuberculosis
LTEQSARQDAAEQA

SEQ ID NO: 1544576 - protein, 6 aa, Mycobacterium tuberculosis
LTGLPP

SEQ ID NO: 1544577 - protein, 13 aa, Mycobacterium tuberculosis
LTGRQGRAGCSQI

SEQ ID NO: 1544578 - protein, 5 aa, Mycobacterium tuberculosis
LTGTH

SEQ ID NO: 1544579 - protein, 11 aa, Mycobacterium tuberculosis
LTNSGGGFGGV

SEQ ID NO: 1544580 - protein, 4 aa, Mycobacterium tuberculosis
LTPS

SEQ ID NO: 1544581 - protein, 32 aa, Mycobacterium tuberculosis; identical to SEQ ID NO: 194492

SEQ ID NO: 1544582 - protein, 13 aa, Mycobacterium tuberculosis
LTSAGQPSKFSMP

SEQ ID NO: 1544583 - protein, 18 aa, Mycobacterium tuberculosis
LTSGAVSSLGRDGATSGQ

SEQ ID NO: 1544584 - protein, 15 aa, Mycobacterium tuberculosis
LTSGGGAYAAAEAAA

SEQ ID NO: 1544585 - protein, 19 aa, Mycobacterium tuberculosis
LTSGGGAYAAAEAAATSPL

SEQ ID NO: 1544586 - protein, 18 aa, Mycobacterium tuberculosis
LTTDNQMSYNDSRAEGTR

SEQ ID NO: 1544587 - protein, 5 aa, Mycobacterium tuberculosis
LYGPD

SEQ ID NO: 1544588 - protein, 38 aa, Mycobacterium tuberculosis; identical to SEQ ID NO: 192837

SEQ ID NO: 1544589 - protein, 7 aa, Mycobacterium tuberculosis
MAEGPGS

SEQ ID NO: 1544590 - protein, 10 aa, Mycobacterium tuberculosis
MAGSRCPAKG

SEQ ID NO: 1544591 - protein, 11 aa, Mycobacterium tuberculosis
MEPKSAATEAY

SEQ ID NO: 1544592 - protein, 11 aa, Mycobacterium tuberculosis
MGGDGGDGGEA

SEQ ID NO: 1544593 - protein, 4 aa, Mycobacterium tuberculosis
MGQR

SEQ ID NO: 1544594 - protein, 7 aa, Mycobacterium tuberculosis
MKGPTEQ

SEQ ID NO: 1544595 - protein, 15 aa, Mycobacterium tuberculosis
MPEQTAAAVSRSGRQ

SEQ ID NO: 1544596 - protein, 12 aa, Mycobacterium tuberculosis
MPESDDSPSEKE

SEQ ID NO: 1544597 - protein, 13 aa, Mycobacterium tuberculosis
MPESGDSPSEKEL

SEQ ID NO: 1544598 - protein, 12 aa, Mycobacterium tuberculosis
MPGAGGNGGNAN

SEQ ID NO: 1544599 - protein, 5 aa, Mycobacterium tuberculosis
MPGPL

SEQ ID NO: 1544600 - protein, 11 aa, Mycobacterium tuberculosis
MPNDEGGNSRL

SEQ ID NO: 1544601 - protein, 18 aa, Mycobacterium tuberculosis
MQNDNSRRILGRRPQLTS

SEQ ID NO: 1544602 - protein, 4 aa, Mycobacterium tuberculosis
MQRR

SEQ ID NO: 1544603 - protein, 8 aa, Mycobacterium tuberculosis
MSGSATRA

SEQ ID NO: 1544604 - protein, 7 aa, Mycobacterium tuberculosis
MSGTDSN

SEQ ID NO: 1544605 - protein, 28 aa, Mycobacterium tuberculosis
MSPCSSDSQAPSFADQPPAGPPGAPVPG

SEQ ID NO: 1544606 - protein, 11 aa, Mycobacterium tuberculosis
MTTLPGGDAPA

SEQ ID NO: 1544607 - protein, 30 aa, Mycobacterium tuberculosis
MTTLPGGDVPAAGVPGLPGMPASGAGRAGV

SEQ ID NO: 1544608 - protein, 9 aa, Mycobacterium tuberculosis
NAAAAVPTS

SEQ ID NO: 1544609 - protein, 47 aa, Mycobacterium tuberculosis
NAANAAAAAPTTGCASGRRGRGVGGDGGAVRRARPGVPEAQRPGGGV

SEQ ID NO: 1544610 - protein, 8 aa, Mycobacterium tuberculosis
NAATARAT

SEQ ID NO: 1544611 - protein, 17 aa, Mycobacterium tuberculosis
NADRDALSGPAVAASTA

SEQ ID NO: 1544612 - protein, 8 aa, Mycobacterium tuberculosis
NAFEDPAE

SEQ ID NO: 1544613 - protein, 13 aa, Mycobacterium tuberculosis
NAGADADGPVATT

SEQ ID NO: 1544614 - protein, 27 aa, Mycobacterium tuberculosis
NAGSGGTGGFGDTDGGAGGAGGDAGWL

SEQ ID NO: 1544615 - protein, 8 aa, Mycobacterium tuberculosis
NALDNPEP

SEQ ID NO: 1544616 - protein, 120 aa, Mycobacterium tuberculosis; identical to SEQ ID NO: 181058

SEQ ID NO: 1544617 - protein, 4 aa, Mycobacterium tuberculosis
NAPA

SEQ ID NO: 1544618 - protein, 7 aa, Mycobacterium tuberculosis
NAPAIAA

SEQ ID NO: 1544619 - protein, 14 aa, Mycobacterium tuberculosis
NAPTQALLGRPLIG

SEQ ID NO: 1544620 - protein, 10 aa, Mycobacterium tuberculosis
NAPTQTLTGR

SEQ ID NO: 1544621 - protein, 10 aa, Mycobacterium tuberculosis
NAQAAPAKYP

SEQ ID NO: 1544622 - protein, 28 aa, Mycobacterium tuberculosis
NAQAAPASTQPGSSGCSPAATTSRPPTV

SEQ ID NO: 1544623 - protein, 18 aa, Mycobacterium tuberculosis
NAQSQHSSSNNSGGADPV

SEQ ID NO: 1544624 - protein, 8 aa, Mycobacterium tuberculosis
NARRRQRR

SEQ ID NO: 1544625 - protein, 11 aa, Mycobacterium tuberculosis
NASGRSPSAWT

SEQ ID NO: 1544626 - protein, 4 aa, Mycobacterium tuberculosis
NASM

SEQ ID NO: 1544627 - protein, 6 aa, Mycobacterium tuberculosis
NASPVA

SEQ ID NO: 1544628 - protein, 5 aa, Mycobacterium tuberculosis
NATEA

SEQ ID NO: 1544629 - protein, 7 aa, Mycobacterium tuberculosis
NATGQWA

SEQ ID NO: 1544630 - protein, 7 aa, Mycobacterium tuberculosis
NATQPVP

SEQ ID NO: 1544631 - protein, 12 aa, Mycobacterium tuberculosis
NCRPGPDEPFDQ

SEQ ID NO: 1544632 - protein, 11 aa, Mycobacterium tuberculosis
NDDNQPGAPNR

SEQ ID NO: 1544633 - protein, 5 aa, Mycobacterium tuberculosis
NDEVT

SEQ ID NO: 1544634 - protein, 8 aa, Mycobacterium tuberculosis
NDGEPPRH

SEQ ID NO: 1544635 - protein, 13 aa, Mycobacterium tuberculosis
NDGTPIPDQVDSV

SEQ ID NO: 1544636 - protein, 8 aa, Mycobacterium tuberculosis
NDLPESGV

SEQ ID NO: 1544637 - protein, 7 aa, Mycobacterium tuberculosis
NDPNRHL

SEQ ID NO: 1544638 - protein, 6 aa, Mycobacterium tuberculosis
NDPPED

SEQ ID NO: 1544639 - protein, 4 aa, Mycobacterium tuberculosis
NDPR

SEQ ID NO: 1544640 - protein, 31 aa, Mycobacterium tuberculosis
NECGKDGRVADTVPRERPDPYRRASPTSHRR

SEQ ID NO: 1544641 - protein, 7 aa, Mycobacterium tuberculosis
NEHTAEL

SEQ ID NO: 1544642 - protein, 7 aa, Mycobacterium tuberculosis
NESDTAI

SEQ ID NO: 1544643 - protein, 11 aa, Mycobacterium tuberculosis
NETDGGFGPSS

SEQ ID NO: 1544644 - protein, 17 aa, Mycobacterium tuberculosis
NGADGAPGTGQPGGPGG

SEQ ID NO: 1544645 - protein, 11 aa, Mycobacterium tuberculosis
NGADGTAANTQ

SEQ ID NO: 1544646 - protein, 17 aa, Mycobacterium tuberculosis
NGANGAPGTGANGGPGG

SEQ ID NO: 1544647 - protein, 17 aa, Mycobacterium tuberculosis
NGANGAPGTGQAGGAGG

SEQ ID NO: 1544648 - protein, 17 aa, Mycobacterium tuberculosis
NGANGKPGTGQDGGGGG

SEQ ID NO: 1544649 - protein, 6 aa, Mycobacterium tuberculosis
NGCGAP

SEQ ID NO: 1544650 - protein, 10 aa, Mycobacterium tuberculosis
NGDRADAAQH

SEQ ID NO: 1544651 - protein, 10 aa, Mycobacterium tuberculosis
NGEETRSLDS

SEQ ID NO: 1544652 - protein, 10 aa, Mycobacterium tuberculosis
NGEETRSLNS

SEQ ID NO: 1544653 - protein, 4 aa, Mycobacterium tuberculosis
NGET

SEQ ID NO: 1544654 - protein, 33 aa, Mycobacterium tuberculosis
NGGAAGAGGNGGNNTSAGTGGVEASGGTGGNAG

SEQ ID NO: 1544655 - protein, 18 aa, Mycobacterium tuberculosis
NGGAGAPGAAGMPGEKGS

SEQ ID NO: 1544656 - protein, 74 aa, Mycobacterium tuberculosis; identical to SEQ ID NO: 181287

SEQ ID NO: 1544657 - protein, 25 aa, Mycobacterium tuberculosis
NGGAGGAGGVGGDGGKGGAGDPSFA

SEQ ID NO: 1544658 - protein, 38 aa, Mycobacterium tuberculosis; identical to SEQ ID NO: 181290

SEQ ID NO: 1544659 - protein, 10 aa, Mycobacterium tuberculosis
NGGAGGIGGI

SEQ ID NO: 1544660 - protein, 15 aa, Mycobacterium tuberculosis
NGGAGGNGATGGTGV

SEQ ID NO: 1544661 - protein, 116 aa, Mycobacterium tuberculosis; identical to SEQ ID NO: 232848

SEQ ID NO: 1544662 - protein, 28 aa, Mycobacterium tuberculosis
NGGAGGPGGPTDVPAGTGGAGGAGGDAP

SEQ ID NO: 1544663 - protein, 51 aa, Mycobacterium tuberculosis; identical to SEQ ID NO: 1372163

SEQ ID NO: 1544664 - protein, 16 aa, Mycobacterium tuberculosis
NGGAGGSGAAGVNGGA

SEQ ID NO: 1544665 - protein, 26 aa, Mycobacterium tuberculosis
NGGAGGSGAAGVNGGAGGNGGAGGLI

SEQ ID NO: 1544666 - protein, 27 aa, Mycobacterium tuberculosis
NGGAGGSGAAGVNGGAGGNGGAGGLIG

SEQ ID NO: 1544667 - protein, 57 aa, Mycobacterium tuberculosis; identical to SEQ ID NO: 181300

SEQ ID NO: 1544668 - protein, 23 aa, Mycobacterium tuberculosis
NGGAGGSGAPGAGAGGNGGAGGL

SEQ ID NO: 1544669 - protein, 21 aa, Mycobacterium tuberculosis
NGGAGGSGAPGQAGGPGGAAG

SEQ ID NO: 1544670 - protein, 21 aa, Mycobacterium tuberculosis
NGGAGGSGAPGQVGGAGGAAG

SEQ ID NO: 1544671 - protein, 49 aa, Mycobacterium tuberculosis
NGGAGGSGAVGVNGGAGGTAAPADSSTTAAPAALAGSPAVVSPGTGGVG

SEQ ID NO: 1544672 - protein, 32 aa, Mycobacterium tuberculosis
NGGAGGVGGGGGRGTTAIGGDRGAGGAGGAGG

SEQ ID NO: 1544673 - protein, 20 aa, Mycobacterium tuberculosis
NGGFGGAGGLGAAGGVGGAA

SEQ ID NO: 1544674 - protein, 20 aa, Mycobacterium tuberculosis
NGGFGSGGGPGAAGGAGGLG

SEQ ID NO: 1544675 - protein, 20 aa, Mycobacterium tuberculosis
NGGFGSGGGPGAAGGNGGAG

SEQ ID NO: 1544676 - protein, 26 aa, Mycobacterium tuberculosis
NGGGGGAGGNGGAGNDGTPGNGGGGG

SEQ ID NO: 1544677 - protein, 5 aa, Mycobacterium tuberculosis
NGGHT

SEQ ID NO: 1544678 - protein, 21 aa, Mycobacterium tuberculosis
NGGNGAAGGFGQTGGSGGAAG

SEQ ID NO: 1544679 - protein, 30 aa, Mycobacterium tuberculosis
NGGNGAAGGFGQTGGSGGAAGLIGNGGNGG

SEQ ID NO: 1544680 - protein, 51 aa, Mycobacterium tuberculosis
NGGNGAAGGFGQTGGSGGAAGLIGNGGNGGAGGTGAAGGAGGNGGWLWGNG

SEQ ID NO: 1544681 - protein, 38 aa, Mycobacterium tuberculosis
NGGNGAAGGFGQTGGSGGAAGLIGNGGNGGAGGTGAPA

SEQ ID NO: 1544682 - protein, 20 aa, Mycobacterium tuberculosis
NGGNGAAGGFGRPAAAEARP

SEQ ID NO: 1544683 - protein, 36 aa, Mycobacterium tuberculosis
NGGNGFSQTTAGLTGGTGGSAGLIGNGGNEGAGGSR

SEQ ID NO: 1544684 - protein, 48 aa, Mycobacterium tuberculosis
NGGNGFSQTTAGLTGGTGGSAGLIGNGGNGGAGGAGANGGKGGKCGWS

SEQ ID NO: 1544685 - protein, 24 aa, Mycobacterium tuberculosis
NGGNGGAGDAAHPNGGNGGDAGNV

SEQ ID NO: 1544686 - protein, 10 aa, Mycobacterium tuberculosis
NGGNGGIGGN

SEQ ID NO: 1544687 - protein, 28 aa, Mycobacterium tuberculosis
NGGNGGLGGDGDGGTGGGHGGNGGIPVP

SEQ ID NO: 1544688 - protein, 71 aa, Mycobacterium tuberculosis
NGGNGGNGAAGGNGAIGGTGGAGGVPANQGGNSALGTQPVGGDGGDGGNGGTGGTGGRGGDGGSGGAGGAS

SEQ ID NO: 1544689 - protein, 17 aa, Mycobacterium tuberculosis
NGGNGGNGGNGAAGGNG

SEQ ID NO: 1544690 - protein, 18 aa, Mycobacterium tuberculosis
NGGNGGSGAAGQVGGPGG

SEQ ID NO: 1544691 - protein, 30 aa, Mycobacterium tuberculosis
NGGNGGSGAAGQVGGPGGAAGLFGNGGSGG

SEQ ID NO: 1544692 - protein, 49 aa, Mycobacterium tuberculosis; identical to SEQ ID NO: 181330

SEQ ID NO: 1544693 - protein, 21 aa, Mycobacterium tuberculosis
NGGNGGSGAPGQTGGAGGAAG

SEQ ID NO: 1544694 - protein, 47 aa, Mycobacterium tuberculosis
NGGNGGSGGVDQAGGNGGAAGLIGNGGSGSVGGPGIAGSAGGAGGAG

SEQ ID NO: 1544695 - protein, 57 aa, Mycobacterium tuberculosis
NGGNGGSGGVGGAGGVGGAGGDGGNGGSGGNASTFGDENSIGGAGGTGGNGGNGATA

SEQ ID NO: 1544696 - protein, 22 aa, Mycobacterium tuberculosis
NGGNGGSGVAGVGGPGGSGGAA

SEQ ID NO: 1544697 - protein, 44 aa, Mycobacterium tuberculosis
NGGNGGTSTTAGVAGGNGGAAGLIGNGGAGGGGGAGAAGGNGGA

SEQ ID NO: 1544698 - protein, 24 aa, Mycobacterium tuberculosis
NGGNGRSRRRRPPQRRQRRGCRNV

SEQ ID NO: 1544699 - protein, 28 aa, Mycobacterium tuberculosis
NGGTGGAGGAAGATLVGGTGGVGGATGL

SEQ ID NO: 1544700 - protein, 10 aa, Mycobacterium tuberculosis
NGGTGGERWR

SEQ ID NO: 1544701 - protein, 23 aa, Mycobacterium tuberculosis
NGGTGGRQRLSRDRPRRGTRVYW

SEQ ID NO: 1544702 - protein, 12 aa, Mycobacterium tuberculosis
NGKLEALGSIPH

SEQ ID NO: 1544703 - protein, 14 aa, Mycobacterium tuberculosis
NGNVGFGNSGLGAG

SEQ ID NO: 1544704 - protein, 11 aa, Mycobacterium tuberculosis
NGRTAAPSTEA

SEQ ID NO: 1544705 - protein, 12 aa, Mycobacterium tuberculosis
NGSTTFSAPSES

SEQ ID NO: 1544706 - protein, 21 aa, Mycobacterium tuberculosis
NGSTTPETPWRPRLPAAPWHR

SEQ ID NO: 1544707 - protein, 14 aa, Mycobacterium tuberculosis
NGVGGLGGQGGQGA

SEQ ID NO: 1544708 - protein, 4 aa, Mycobacterium tuberculosis
NGYT

SEQ ID NO: 1544709 - protein, 4 aa, Mycobacterium tuberculosis
NIGG

SEQ ID NO: 1544710 - protein, 6 aa, Mycobacterium tuberculosis
NKASTN

SEQ ID NO: 1544711 - protein, 5 aa, Mycobacterium tuberculosis
NLGAQ

SEQ ID NO: 1544712 - protein, 6 aa, Mycobacterium tuberculosis
NLGDGN

SEQ ID NO: 1544713 - protein, 5 aa, Mycobacterium tuberculosis
NLGNT

SEQ ID NO: 1544714 - protein, 11 aa, Mycobacterium tuberculosis
NLGRAASVGSL

SEQ ID NO: 1544715 - protein, 7 aa, Mycobacterium tuberculosis
NLGSGNV

SEQ ID NO: 1544716 - protein, 25 aa, Mycobacterium tuberculosis
NNGAGGNGGHGGNPGVGGAGGAGGL

SEQ ID NO: 1544717 - protein, 4 aa, Mycobacterium tuberculosis
NNGS

SEQ ID NO: 1544718 - protein, 6 aa, Mycobacterium tuberculosis
NNNFGF

SEQ ID NO: 1544719 - protein, 13 aa, Mycobacterium tuberculosis
NNSSTPQSQGPIS

SEQ ID NO: 1544720 - protein, 42 aa, Mycobacterium tuberculosis
NNTGIGNSATNAAFTTTSGVANSGDNSSGGFNAGNDQSGFFD

SEQ ID NO: 1544721 - protein, 34 aa, Mycobacterium tuberculosis
NPAATTIPGRQKISSTRQSRGRATAAVRSLRKTA

SEQ ID NO: 1544722 - protein, 5 aa, Mycobacterium tuberculosis
NPAGW

SEQ ID NO: 1544723 - protein, 16 aa, Mycobacterium tuberculosis
NPAVDPASGAATVASR

SEQ ID NO: 1544724 - protein, 9 aa, Mycobacterium tuberculosis
NPGAAAHSQ

SEQ ID NO: 1544725 - protein, 47 aa, Mycobacterium tuberculosis; identical to SEQ ID NO: 1420484

SEQ ID NO: 1544726 - protein, 5 aa, Mycobacterium tuberculosis
NPIEY

SEQ ID NO: 1544727 - protein, 21 aa, Mycobacterium tuberculosis
NPNALSNDSGTSSLAHGSTGQ

SEQ ID NO: 1544728 - protein, 22 aa, Mycobacterium tuberculosis
NPPANTTSPTAGQSLDSHDRQL

SEQ ID NO: 1544729 - protein, 19 aa, Mycobacterium tuberculosis
NPTAAMSQDELSGRVAALT

SEQ ID NO: 1544730 - protein, 7 aa, Mycobacterium tuberculosis
NPTLPVP

SEQ ID NO: 1544731 - protein, 15 aa, Mycobacterium tuberculosis
NPTQLDPAGRTSDAV

SEQ ID NO: 1544732 - protein, 9 aa, Mycobacterium tuberculosis
NQAGSQYFP

SEQ ID NO: 1544733 - protein, 9 aa, Mycobacterium tuberculosis
NQAVTPAAR

SEQ ID NO: 1544734 - protein, 8 aa, Mycobacterium tuberculosis
NQGGLNAG

SEQ ID NO: 1544735 - protein, 10 aa, Mycobacterium tuberculosis
NRDGSDAMST

SEQ ID NO: 1544736 - protein, 10 aa, Mycobacterium tuberculosis
NRDPAQFEAP

SEQ ID NO: 1544737 - protein, 5 aa, Mycobacterium tuberculosis
NRGSD

SEQ ID NO: 1544738 - protein, 20 aa, Mycobacterium tuberculosis
NRLGGQHGSIPISGTSYAAP

SEQ ID NO: 1544739 - protein, 26 aa, Mycobacterium tuberculosis
NRPGGPGGPGGPGGPGGPGGPGGPGR

SEQ ID NO: 1544740 - protein, 14 aa, Mycobacterium tuberculosis
NRPGMSGDSSSWKG

SEQ ID NO: 1544741 - protein, 17 aa, Mycobacterium tuberculosis
NRSVPNGVAAGSPEERA

SEQ ID NO: 1544742 - protein, 10 aa, Mycobacterium tuberculosis
NRTHSADSRA

SEQ ID NO: 1544743 - protein, 9 aa, Mycobacterium tuberculosis
NRTPPKTQA

SEQ ID NO: 1544744 - protein, 6 aa, Mycobacterium tuberculosis
NRYDGR

SEQ ID NO: 1544745 - protein, 17 aa, Mycobacterium tuberculosis
NSGAGSASGFGNFGGAA

SEQ ID NO: 1544746 - protein, 6 aa, Mycobacterium tuberculosis
NSGAPV

SEQ ID NO: 1544747 - protein, 58 aa, Mycobacterium tuberculosis; identical to SEQ ID NO: 181741

SEQ ID NO: 1544748 - protein, 20 aa, Mycobacterium tuberculosis
NSGGFNTGIGNAGSTNTGVF

SEQ ID NO: 1544749 - protein, 4 aa, Mycobacterium tuberculosis
NSGI

SEQ ID NO: 1544750 - protein, 9 aa, Mycobacterium tuberculosis
NSGLANVGN

SEQ ID NO: 1544751 - protein, 5 aa, Mycobacterium tuberculosis
NSGPI

SEQ ID NO: 1544752 - protein, 31 aa, Mycobacterium tuberculosis; identical to SEQ ID NO: 181758

SEQ ID NO: 1544753 - protein, 19 aa, Mycobacterium tuberculosis
NSGSFNTGLGNTGSTNTGL

SEQ ID NO: 1544754 - protein, 16 aa, Mycobacterium tuberculosis
NSGSGNLGFGNSGNGN

SEQ ID NO: 1544755 - protein, 12 aa, Mycobacterium tuberculosis
NSGSNDSGLRNT

SEQ ID NO: 1544756 - protein, 6 aa, Mycobacterium tuberculosis
NSGTAI

SEQ ID NO: 1544757 - protein, 6 aa, Mycobacterium tuberculosis
NSGTGN

SEQ ID NO: 1544758 - protein, 8 aa, Mycobacterium tuberculosis
NSLANGGR

SEQ ID NO: 1544759 - protein, 16 aa, Mycobacterium tuberculosis
NSRPALPLAPPASPVP

SEQ ID NO: 1544760 - protein, 7 aa, Mycobacterium tuberculosis
NSSRSQR

SEQ ID NO: 1544761 - protein, 13 aa, Mycobacterium tuberculosis
NSTKAPSSTFPAA

SEQ ID NO: 1544762 - protein, 4 aa, Mycobacterium tuberculosis
NSTR

SEQ ID NO: 1544763 - protein, 5 aa, Mycobacterium tuberculosis
NSTRT

SEQ ID NO: 1544764 - protein, 6 aa, Mycobacterium tuberculosis
NTAGQM

SEQ ID NO: 1544765 - protein, 10 aa, Mycobacterium tuberculosis
NTDAVPGLSD

SEQ ID NO: 1544766 - protein, 4 aa, Mycobacterium tuberculosis
NTED

SEQ ID NO: 1544767 - protein, 10 aa, Mycobacterium tuberculosis
NTFTTDPANL

SEQ ID NO: 1544768 - protein, 28 aa, Mycobacterium tuberculosis
NTGFGNSGSLNTGMGNAGGVNTGFGNGG

SEQ ID NO: 1544769 - protein, 12 aa, Mycobacterium tuberculosis
NTGFGSAGNGNV

SEQ ID NO: 1544770 - protein, 20 aa, Mycobacterium tuberculosis
NTGGGGGSGFANVGAGTSGW

SEQ ID NO: 1544771 - protein, 14 aa, Mycobacterium tuberculosis
NTGIANPGSYNTGS

SEQ ID NO: 1544772 - protein, 15 aa, Mycobacterium tuberculosis
NTGLANAGSYNTGSL

SEQ ID NO: 1544773 - protein, 23 aa, Mycobacterium tuberculosis
NTGLANAGSYNTGSLNAGNTNTG

SEQ ID NO: 1544774 - protein, 15 aa, Mycobacterium tuberculosis
NTGNGNSGFSNAGPA

SEQ ID NO: 1544775 - protein, 7 aa, Mycobacterium tuberculosis
NTGNNNI

SEQ ID NO: 1544776 - protein, 6 aa, Mycobacterium tuberculosis
NTGSAN

SEQ ID NO: 1544777 - protein, 11 aa, Mycobacterium tuberculosis
NTPAIAATEAQ

SEQ ID NO: 1544778 - protein, 13 aa, Mycobacterium tuberculosis
NTSTSDLATPAFN

SEQ ID NO: 1544779 - protein, 12 aa, Mycobacterium tuberculosis
NTSTSNLATPAF

SEQ ID NO: 1544780 - protein, 7 aa, Mycobacterium tuberculosis
NVGDGNL

SEQ ID NO: 1544781 - protein, 6 aa, Mycobacterium tuberculosis
NVGSDS

SEQ ID NO: 1544782 - protein, 6 aa, Mycobacterium tuberculosis
NVGTGN

SEQ ID NO: 1544783 - protein, 19 aa, Mycobacterium tuberculosis
NVPASPGFGNSTTAPSSGF

SEQ ID NO: 1544784 - protein, 6 aa, Mycobacterium tuberculosis
NVPSAC

SEQ ID NO: 1544785 - protein, 7 aa, Mycobacterium tuberculosis
NVPSITA

SEQ ID NO: 1544786 - protein, 11 aa, Mycobacterium tuberculosis
NWGDSGRRSTI

SEQ ID NO: 1544787 - protein, 7 aa, Mycobacterium tuberculosis
NYRTGSV

SEQ ID NO: 1544788 - protein, 18 aa, Mycobacterium tuberculosis
PAAAEVPGFEGSAGQGGA

SEQ ID NO: 1544789 - protein, 19 aa, Mycobacterium tuberculosis
PAAARAAVNPQALNTGLGD

SEQ ID NO: 1544790 - protein, 10 aa, Mycobacterium tuberculosis
PAAATGAPTG

SEQ ID NO: 1544791 - protein, 13 aa, Mycobacterium tuberculosis
PAAATGAPTGGGV

SEQ ID NO: 1544792 - protein, 4 aa, Mycobacterium tuberculosis
PAAL

SEQ ID NO: 1544793 - protein, 25 aa, Mycobacterium tuberculosis
PAAPAPPTPPTPPAPPSPPLPIHSP

SEQ ID NO: 1544794 - protein, 18 aa, Mycobacterium tuberculosis
PAAPPPLPTPFAPQRPHN

SEQ ID NO: 1544795 - protein, 15 aa, Mycobacterium tuberculosis
PAARPAPHFCDVRCS

SEQ ID NO: 1544796 - protein, 19 aa, Mycobacterium tuberculosis
PAARSARVTSLQRGGAFGE

SEQ ID NO: 1544797 - protein, 41 aa, Mycobacterium tuberculosis
PAATAGCSTATAASAGAAATAASRRPGTSGGDGGIGGAGGI

SEQ ID NO: 1544798 - protein, 69 aa, Mycobacterium tuberculosis
PAATASPAGPAVPGGTGGFPGNGNAGGNGGPGGASEDGDNGNAGSGATGGTGGNGGTGGDGGAAGLGGV

SEQ ID NO: 1544799 - protein, 8 aa, Mycobacterium tuberculosis
PADANETA

SEQ ID NO: 1544800 - protein, 8 aa, Mycobacterium tuberculosis
PADPRDPD

SEQ ID NO: 1544801 - protein, 23 aa, Mycobacterium tuberculosis
PAEKAGRVTKVSSSGPNSTPLPA

SEQ ID NO: 1544802 - protein, 10 aa, Mycobacterium tuberculosis
PAERADMPRT

SEQ ID NO: 1544803 - protein, 10 aa, Mycobacterium tuberculosis
PAFTGQPTDA

SEQ ID NO: 1544804 - protein, 47 aa, Mycobacterium tuberculosis
PAGASNGLSAVGAGGALAAAATTSSGTTRTAGPALATGSTVARHRPR

SEQ ID NO: 1544805 - protein, 72 aa, Mycobacterium tuberculosis
PAGASNGLSAVGAGGALAAAATTSSGTTRTAGPALATGSTVARHRPTGATGSARTARAAGLPRIASTAVAAT

SEQ ID NO: 1544806 - protein, 38 aa, Mycobacterium tuberculosis
PAGLAGPAGCSARAGGFGRRPVASATPVGPAATAESGG

SEQ ID NO: 1544807 - protein, 13 aa, Mycobacterium tuberculosis
PAGLLGGSGYQNF

SEQ ID NO: 1544808 - protein, 10 aa, Mycobacterium tuberculosis
PAGSQLSTKL

SEQ ID NO: 1544809 - protein, 12 aa, Mycobacterium tuberculosis
PAHPARRRRVGT

SEQ ID NO: 1544810 - protein, 10 aa, Mycobacterium tuberculosis
PAKSVAAAAS

SEQ ID NO: 1544811 - protein, 9 aa, Mycobacterium tuberculosis
PALAGGPTA

SEQ ID NO: 1544812 - protein, 7 aa, Mycobacterium tuberculosis
PALPDDL

SEQ ID NO: 1544813 - protein, 5 aa, Mycobacterium tuberculosis
PALRE

SEQ ID NO: 1544814 - protein, 6 aa, Mycobacterium tuberculosis
PAMSTS

SEQ ID NO: 1544815 - protein, 13 aa, Mycobacterium tuberculosis
PANAKCSPPLRQR

SEQ ID NO: 1544816 - protein, 7 aa, Mycobacterium tuberculosis
PANGAVP

SEQ ID NO: 1544817 - protein, 23 aa, Mycobacterium tuberculosis
PANRVNAAARDAENISDSNSGYP

SEQ ID NO: 1544818 - protein, 12 aa, Mycobacterium tuberculosis
PAPFEPVADTIA

SEQ ID NO: 1544819 - protein, 22 aa, Mycobacterium tuberculosis
PAPITPPASAAPAVTAAPAVAP

SEQ ID NO: 1544820 - protein, 43 aa, Mycobacterium tuberculosis
PAPLGEPLPAAPADPAPPADLAPPAPADLAPPAPADLAPPAPA

SEQ ID NO: 1544821 - protein, 51 aa, Mycobacterium tuberculosis
PAPLGEPLPAAPADPAPPADLAPPAPADLAPPAPADLAPPAPADLAPPGKL

SEQ ID NO: 1544822 - protein, 56 aa, Mycobacterium tuberculosis
PAPLGEPLPAAPADPAPPADLAPPAPADLAPPAPADLAPPAPADLAPPVELAVNDL

SEQ ID NO: 1544823 - protein, 77 aa, Mycobacterium tuberculosis
PAPLGEPLPAAPAELAPPADLAPASADLAPPAPADLAPPAPAELAPPAPADLAPPAAVNEQTAPGRSARHSSRRPGW

SEQ ID NO: 1544824 - protein, 74 aa, Mycobacterium tuberculosis; identical to SEQ ID NO: 1366250

SEQ ID NO: 1544825 - protein, 24 aa, Mycobacterium tuberculosis
PAPPVPPAPPAPRSPPWPPGPRHL

SEQ ID NO: 1544826 - protein, 17 aa, Mycobacterium tuberculosis
PAPQAPQSASGEMLPSG

SEQ ID NO: 1544827 - protein, 4 aa, Mycobacterium tuberculosis
PAQT

SEQ ID NO: 1544828 - protein, 4 aa, Mycobacterium tuberculosis
PARA

SEQ ID NO: 1544829 - protein, 4 aa, Mycobacterium tuberculosis
PARL

SEQ ID NO: 1544830 - protein, 4 aa, Mycobacterium tuberculosis
PARM

SEQ ID NO: 1544831 - protein, 8 aa, Mycobacterium tuberculosis
PASPGSTM

SEQ ID NO: 1544832 - protein, 8 aa, Mycobacterium tuberculosis
PASQDVPA

SEQ ID NO: 1544833 - protein, 9 aa, Mycobacterium tuberculosis
PATGANAVE

SEQ ID NO: 1544834 - protein, 40 aa, Mycobacterium tuberculosis
PATPSSACTSTPCRKPARPARGSSPGRGSNGSCTAPGGPM

SEQ ID NO: 1544835 - protein, 18 aa, Mycobacterium tuberculosis
PATVQPPTQEVAAAPNIS

SEQ ID NO: 1544836 - protein, 4 aa, Mycobacterium tuberculosis
PAVA

SEQ ID NO: 1544837 - protein, 32 aa, Mycobacterium tuberculosis
PAVPDRRRLADAKDRRPAGPSLTQRRPFATPS

SEQ ID NO: 1544838 - protein, 22 aa, Mycobacterium tuberculosis
PAVPPGSPCSYTPPADGLPRPW

SEQ ID NO: 1544839 - protein, 6 aa, Mycobacterium tuberculosis
PCHTPA

SEQ ID NO: 1544840 - protein, 5 aa, Mycobacterium tuberculosis
PCRPV

SEQ ID NO: 1544841 - protein, 16 aa, Mycobacterium tuberculosis
PDDRRKANRRDRGLDR

SEQ ID NO: 1544842 - protein, 5 aa, Mycobacterium tuberculosis
PDEND

SEQ ID NO: 1544843 - protein, 7 aa, Mycobacterium tuberculosis
PDGPLTG

SEQ ID NO: 1544844 - protein, 5 aa, Mycobacterium tuberculosis
PDGSW

SEQ ID NO: 1544845 - protein, 18 aa, Mycobacterium tuberculosis
PDIAPPAAGNQLARTAEC

SEQ ID NO: 1544846 - protein, 6 aa, Mycobacterium tuberculosis
PDIQQQ

SEQ ID NO: 1544847 - protein, 11 aa, Mycobacterium tuberculosis
PDPAPRGSAPA

SEQ ID NO: 1544848 - protein, 9 aa, Mycobacterium tuberculosis
PDPDWDGRT

SEQ ID NO: 1544849 - protein, 18 aa, Mycobacterium tuberculosis
PDRESAYASPRIGQPVGS

SEQ ID NO: 1544850 - protein, 14 aa, Mycobacterium tuberculosis
PDRYRDDSAARGGP

SEQ ID NO: 1544851 - protein, 16 aa, Mycobacterium tuberculosis
PDRYRDDSAARGGPMM

SEQ ID NO: 1544852 - protein, 4 aa, Mycobacterium tuberculosis
PDSS

SEQ ID NO: 1544853 - protein, 6 aa, Mycobacterium tuberculosis
PDTNSG

SEQ ID NO: 1544854 - protein, 17 aa, Mycobacterium tuberculosis
PDWGPPPGEDPVTSTVP

SEQ ID NO: 1544855 - protein, 6 aa, Mycobacterium tuberculosis
PDYDLG

SEQ ID NO: 1544856 - protein, 4 aa, Mycobacterium tuberculosis
PDYE

SEQ ID NO: 1544857 - protein, 18 aa, Mycobacterium tuberculosis
PDYGPPGGPLGDPSRRTS

SEQ ID NO: 1544858 - protein, 13 aa, Mycobacterium tuberculosis
PEAGPGDGGVPDD

SEQ ID NO: 1544859 - protein, 6 aa, Mycobacterium tuberculosis
PEATRR

SEQ ID NO: 1544860 - protein, 8 aa, Mycobacterium tuberculosis
PEAVHEPS

SEQ ID NO: 1544861 - protein, 14 aa, Mycobacterium tuberculosis
PEERTALADPGPVP

SEQ ID NO: 1544862 - protein, 15 aa, Mycobacterium tuberculosis
PEGGQRQAVVAIRHR

SEQ ID NO: 1544863 - protein, 12 aa, Mycobacterium tuberculosis
PEHPYPAGIDDS

SEQ ID NO: 1544864 - protein, 8 aa, Mycobacterium tuberculosis
PEPAAPTE

SEQ ID NO: 1544865 - protein, 13 aa, Mycobacterium tuberculosis
PEPSCPKGADDDQ

SEQ ID NO: 1544866 - protein, 13 aa, Mycobacterium tuberculosis
PEQSGSVGERAAR

SEQ ID NO: 1544867 - protein, 11 aa, Mycobacterium tuberculosis
PEYSAPECTDP

SEQ ID NO: 1544868 - protein, 5 aa, Mycobacterium tuberculosis
PFATR

SEQ ID NO: 1544869 - protein, 20 aa, Mycobacterium tuberculosis
PFGPRSTPVRSAPTLESPER

SEQ ID NO: 1544870 - protein, 4 aa, Mycobacterium tuberculosis
PFGQ

SEQ ID NO: 1544871 - protein, 7 aa, Mycobacterium tuberculosis
PFPAPTQ

SEQ ID NO: 1544872 - protein, 12 aa, Mycobacterium tuberculosis
PGAAIGAVTARR

SEQ ID NO: 1544873 - protein, 20 aa, Mycobacterium tuberculosis
PGALGAGAEGANKDKPVEKR

SEQ ID NO: 1544874 - protein, 6 aa, Mycobacterium tuberculosis
PGASSV

SEQ ID NO: 1544875 - protein, 5 aa, Mycobacterium tuberculosis
PGAYN

SEQ ID NO: 1544876 - protein, 7 aa, Mycobacterium tuberculosis
PGDVATA

SEQ ID NO: 1544877 - protein, 14 aa, Mycobacterium tuberculosis
PGFGNTTGAPSSGF

SEQ ID NO: 1544878 - protein, 14 aa, Mycobacterium tuberculosis
PGFGNTTTAPSSGF

SEQ ID NO: 1544879 - protein, 5 aa, Mycobacterium tuberculosis
PGGEG

SEQ ID NO: 1544880 - protein, 14 aa, Mycobacterium tuberculosis
PGGLYGTAGDNDGR

SEQ ID NO: 1544881 - protein, 6 aa, Mycobacterium tuberculosis
PGGQTQ

SEQ ID NO: 1544882 - protein, 10 aa, Mycobacterium tuberculosis
PGGRAPKPGE

SEQ ID NO: 1544883 - protein, 9 aa, Mycobacterium tuberculosis
PGHARCPSG

SEQ ID NO: 1544884 - protein, 5 aa, Mycobacterium tuberculosis
PGHTE

SEQ ID NO: 1544885 - protein, 4 aa, Mycobacterium tuberculosis
PGIA

SEQ ID NO: 1544886 - protein, 41 aa, Mycobacterium tuberculosis
PGIGAPSWTADYGSEPSTTTTTSISPPTAADTQRAETTTSD

SEQ ID NO: 1544887 - protein, 12 aa, Mycobacterium tuberculosis
PGIGTKQPRDVP

SEQ ID NO: 1544888 - protein, 17 aa, Mycobacterium tuberculosis
PGLAGPDSRVSTFSAAD

SEQ ID NO: 1544889 - protein, 23 aa, Mycobacterium tuberculosis
PGLAGPDSRVSTFSGRQPGDFLD

SEQ ID NO: 1544890 - protein, 4 aa, Mycobacterium tuberculosis
PGLP

SEQ ID NO: 1544891 - protein, 8 aa, Mycobacterium tuberculosis
PGLPGLPS

SEQ ID NO: 1544892 - protein, 16 aa, Mycobacterium tuberculosis
PGLSQPSDVLPADDGA

SEQ ID NO: 1544893 - protein, 4 aa, Mycobacterium tuberculosis
PGMA

SEQ ID NO: 1544894 - protein, 10 aa, Mycobacterium tuberculosis
PGMPRDTPYS

SEQ ID NO: 1544895 - protein, 34 aa, Mycobacterium tuberculosis; identical to SEQ ID NO: 1426350

SEQ ID NO: 1544896 - protein, 31 aa, Mycobacterium tuberculosis; identical to SEQ ID NO: 182676

SEQ ID NO: 1544897 - protein, 4 aa, Mycobacterium tuberculosis
PGPH

SEQ ID NO: 1544898 - protein, 10 aa, Mycobacterium tuberculosis
PGPHRRTQRS

SEQ ID NO: 1544899 - protein, 43 aa, Mycobacterium tuberculosis
PGPPPVPPAPRAAAPAPASAAPAAAAAPAPASGFGADAPPTQD

SEQ ID NO: 1544900 - protein, 11 aa, Mycobacterium tuberculosis
PGQAPPLGAEG

SEQ ID NO: 1544901 - protein, 13 aa, Mycobacterium tuberculosis
PGRPAGRRLPTRP

SEQ ID NO: 1544902 - protein, 6 aa, Mycobacterium tuberculosis
PGRQQT

SEQ ID NO: 1544903 - protein, 7 aa, Mycobacterium tuberculosis
PGSHQDN

SEQ ID NO: 1544904 - protein, 16 aa, Mycobacterium tuberculosis
PGTAALTRRAKRASRL

SEQ ID NO: 1544905 - protein, 9 aa, Mycobacterium tuberculosis
PGTRSANRE

SEQ ID NO: 1544906 - protein, 12 aa, Mycobacterium tuberculosis
PGTVRRTDPPPS

SEQ ID NO: 1544907 - protein, 6 aa, Mycobacterium tuberculosis
PGVKPH

SEQ ID NO: 1544908 - protein, 8 aa, Mycobacterium tuberculosis
PHLPPPTR

SEQ ID NO: 1544909 - protein, 19 aa, Mycobacterium tuberculosis
PHPAEPRRQRHCRPYPDQR

SEQ ID NO: 1544910 - protein, 5 aa, Mycobacterium tuberculosis
PHPID

SEQ ID NO: 1544911 - protein, 56 aa, Mycobacterium tuberculosis
PIASTRARVQRARGQVAQRAHRRGTGSTQPRRTDVNPARTNTQDTPEVMRLGERLN

SEQ ID NO: 1544912 - protein, 10 aa, Mycobacterium tuberculosis
PIGDATSRAT

SEQ ID NO: 1544913 - protein, 12 aa, Mycobacterium tuberculosis
PIGSAAAPAVGA

SEQ ID NO: 1544914 - protein, 18 aa, Mycobacterium tuberculosis
PIPAKSAAAATTSSGETI

SEQ ID NO: 1544915 - protein, 4 aa, Mycobacterium tuberculosis
PIPG

SEQ ID NO: 1544916 - protein, 25 aa, Mycobacterium tuberculosis
PIPGITPAAPAAAAVPASVPGVPSA

SEQ ID NO: 1544917 - protein, 5 aa, Mycobacterium tuberculosis
PKERV

SEQ ID NO: 1544918 - protein, 9 aa, Mycobacterium tuberculosis
PKLADDSLT

SEQ ID NO: 1544919 - protein, 15 aa, Mycobacterium tuberculosis
PKNRVADSRACSAAR

SEQ ID NO: 1544920 - protein, 15 aa, Mycobacterium tuberculosis
PKVPAAPPDSPASLE

SEQ ID NO: 1544921 - protein, 53 aa, Mycobacterium tuberculosis
PKVPAAPSRPTGPTGAEQQAGLATRPAGPAVSGGSGSAGPASAAFAKSSRPRW

SEQ ID NO: 1544922 - protein, 12 aa, Mycobacterium tuberculosis
PLDDGASGSLDE

SEQ ID NO: 1544923 - protein, 7 aa, Mycobacterium tuberculosis
PLPLEND

SEQ ID NO: 1544924 - protein, 33 aa, Mycobacterium tuberculosis; identical to SEQ ID NO: 1366681

SEQ ID NO: 1544925 - protein, 4 aa, Mycobacterium tuberculosis
PLPP

SEQ ID NO: 1544926 - protein, 4 aa, Mycobacterium tuberculosis
PLQA

SEQ ID NO: 1544927 - protein, 7 aa, Mycobacterium tuberculosis
PLRGSKA

SEQ ID NO: 1544928 - protein, 4 aa, Mycobacterium tuberculosis
PLRP

SEQ ID NO: 1544929 - protein, 10 aa, Mycobacterium tuberculosis
PLRPGPPPTV

SEQ ID NO: 1544930 - protein, 9 aa, Mycobacterium tuberculosis
PLSAPAGRL

SEQ ID NO: 1544931 - protein, 7 aa, Mycobacterium tuberculosis
PLTAPGS

SEQ ID NO: 1544932 - protein, 12 aa, Mycobacterium tuberculosis
PMADRAKTAGPG

SEQ ID NO: 1544933 - protein, 7 aa, Mycobacterium tuberculosis
PNAAGTA

SEQ ID NO: 1544934 - protein, 8 aa, Mycobacterium tuberculosis
PNAAPGTT

SEQ ID NO: 1544935 - protein, 14 aa, Mycobacterium tuberculosis
PNAHTAHPPRADEL

SEQ ID NO: 1544936 - protein, 60 aa, Mycobacterium tuberculosis; identical to SEQ ID NO: 1372325

SEQ ID NO: 1544937 - protein, 7 aa, Mycobacterium tuberculosis
PNDLPDS

SEQ ID NO: 1544938 - protein, 37 aa, Mycobacterium tuberculosis
PNPPKPAGTAVADQPARPTGSAHTAGAGGVAPAGPAI

SEQ ID NO: 1544939 - protein, 20 aa, Mycobacterium tuberculosis
PNPVEESSPRGPGPICQNYT

SEQ ID NO: 1544940 - protein, 10 aa, Mycobacterium tuberculosis
PNRVGPRKRP

SEQ ID NO: 1544941 - protein, 6 aa, Mycobacterium tuberculosis
PNVPSA

SEQ ID NO: 1544942 - protein, 9 aa, Mycobacterium tuberculosis
PPAADPVSL

SEQ ID NO: 1544943 - protein, 4 aa, Mycobacterium tuberculosis
PPAM

SEQ ID NO: 1544944 - protein, 7 aa, Mycobacterium tuberculosis
PPAQADL

SEQ ID NO: 1544945 - protein, 5 aa, Mycobacterium tuberculosis
PPEIN

SEQ ID NO: 1544946 - protein, 5 aa, Mycobacterium tuberculosis
PPERR

SEQ ID NO: 1544947 - protein, 9 aa, Mycobacterium tuberculosis
PPGATGVQA

SEQ ID NO: 1544948 - protein, 4 aa, Mycobacterium tuberculosis
PPGI

SEQ ID NO: 1544949 - protein, 8 aa, Mycobacterium tuberculosis
PPGPAAVA

SEQ ID NO: 1544950 - protein, 7 aa, Mycobacterium tuberculosis
PPGPFPR

SEQ ID NO: 1544951 - protein, 7 aa, Mycobacterium tuberculosis
PPGPQHP

SEQ ID NO: 1544952 - protein, 5 aa, Mycobacterium tuberculosis
PPGYG

SEQ ID NO: 1544953 - protein, 4 aa, Mycobacterium tuberculosis
PPLP

SEQ ID NO: 1544954 - protein, 8 aa, Mycobacterium tuberculosis
PPLPPLPN

SEQ ID NO: 1544955 - protein, 16 aa, Mycobacterium tuberculosis
PPNAPPGARTQPLEPF

SEQ ID NO: 1544956 - protein, 5 aa, Mycobacterium tuberculosis
PPNRD

SEQ ID NO: 1544957 - protein, 22 aa, Mycobacterium tuberculosis
PPNWAGASPSLAPTVGSASAPL

SEQ ID NO: 1544958 - protein, 158 aa, Mycobacterium tuberculosis
PPSPPAPPAPNSPPAPPVPPAPPVPPDPPAPPAPPLANSPPAPPVPPTPPVPPDPAPPPVPPTPPLANNPPAPPVPPAPPVPVDANPPNPPLPPLANSPPAPPAPPAPPAAPEPPEPPAPPAPPAPNSRAAPPAPPAPQMTSATAESPPGPAARPTPI

SEQ ID NO: 1544959 - protein, 13 aa, Mycobacterium tuberculosis
PPTPANGPIPAVP

SEQ ID NO: 1544960 - protein, 17 aa, Mycobacterium tuberculosis
PPTPGFGNTTATPSSGF

SEQ ID NO: 1544961 - protein, 4 aa, Mycobacterium tuberculosis
PPTV

SEQ ID NO: 1544962 - protein, 5 aa, Mycobacterium tuberculosis
PPTWE

SEQ ID NO: 1544963 - protein, 11 aa, Mycobacterium tuberculosis
PPVTAGPAEPV

SEQ ID NO: 1544964 - protein, 4 aa, Mycobacterium tuberculosis
PQDL

SEQ ID NO: 1544965 - protein, 5 aa, Mycobacterium tuberculosis
PQNRD

SEQ ID NO: 1544966 - protein, 4 aa, Mycobacterium tuberculosis
PQPV

SEQ ID NO: 1544967 - protein, 14 aa, Mycobacterium tuberculosis
PQRHTRGGPARPNP

SEQ ID NO: 1544968 - protein, 9 aa, Mycobacterium tuberculosis
PQSAAGAAL

SEQ ID NO: 1544969 - protein, 12 aa, Mycobacterium tuberculosis
PQSRYDDAAAFF

SEQ ID NO: 1544970 - protein, 18 aa, Mycobacterium tuberculosis
PQYSNPEPAGTATITGYR

SEQ ID NO: 1544971 - protein, 34 aa, Mycobacterium tuberculosis
PRAGTTGIGGLPGCRGGVRPRNRRTTWPRSGRPS

SEQ ID NO: 1544972 - protein, 9 aa, Mycobacterium tuberculosis
PRASAGVTG

SEQ ID NO: 1544973 - protein, 9 aa, Mycobacterium tuberculosis
PRCSGRTGC

SEQ ID NO: 1544974 - protein, 4 aa, Mycobacterium tuberculosis
PRGI

SEQ ID NO: 1544975 - protein, 10 aa, Mycobacterium tuberculosis
PRGPRGDLAS

SEQ ID NO: 1544976 - protein, 12 aa, Mycobacterium tuberculosis
PRLAPGAPGGTV

SEQ ID NO: 1544977 - protein, 7 aa, Mycobacterium tuberculosis
PRPAIDG

SEQ ID NO: 1544978 - protein, 10 aa, Mycobacterium tuberculosis
PRRGRSKRHR

SEQ ID NO: 1544979 - protein, 8 aa, Mycobacterium tuberculosis
PRRRTDRR

SEQ ID NO: 1544980 - protein, 31 aa, Mycobacterium tuberculosis
PRRSSGRPRARSTGRKSLPSSSLPTAATRCW

SEQ ID NO: 1544981 - protein, 15 aa, Mycobacterium tuberculosis
PRSGQVPRTTTAPRV

SEQ ID NO: 1544982 - protein, 8 aa, Mycobacterium tuberculosis
PRSTHHRQ

SEQ ID NO: 1544983 - protein, 351 aa, Mycobacterium tuberculosis
PRYGSASKDVQQQLPAGSPVKKKKKKKKKKKKKKKKKKKKKKKKKKKKKKKKKKKKKKKKKKKKKKKKKKKKKKKKKKKKKKKKKKKKKKKKKNKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKRGREGGGGGGGGGGGGGGGGGGGRGGKKKKKKKKKKKKRKKKKKGEGGGGGGGGEGGGGPPKKKNKRKKKKKKNKKKKKKKKKKKKKKKTKKKKKKKKKKKREGGGGGWGGPPPSRTGSNPLD

SEQ ID NO: 1544984 - protein, 15 aa, Mycobacterium tuberculosis
PSAAAADDLFANSVR

SEQ ID NO: 1544985 - protein, 9 aa, Mycobacterium tuberculosis
PSAGPATLS

SEQ ID NO: 1544986 - protein, 6 aa, Mycobacterium tuberculosis
PSAGRD

SEQ ID NO: 1544987 - protein, 15 aa, Mycobacterium tuberculosis
PSAPVAPRVTTEPVT

SEQ ID NO: 1544988 - protein, 14 aa, Mycobacterium tuberculosis
PSDPTNDANATQPP

SEQ ID NO: 1544989 - protein, 22 aa, Mycobacterium tuberculosis
PSGRALESRPGVGSSPGPSGLP

SEQ ID NO: 1544990 - protein, 27 aa, Mycobacterium tuberculosis
PSHRQGGQRRRVRRRPARDRLVPRRAG

SEQ ID NO: 1544991 - protein, 23 aa, Mycobacterium tuberculosis
PSIADQVKESADSYNASAGPVGD

SEQ ID NO: 1544992 - protein, 43 aa, Mycobacterium tuberculosis; identical to SEQ ID NO: 1367109

SEQ ID NO: 1544993 - protein, 18 aa, Mycobacterium tuberculosis
PSLGPGAARTSTVLPDPA

SEQ ID NO: 1544994 - protein, 9 aa, Mycobacterium tuberculosis
PSLPAALGG

SEQ ID NO: 1544995 - protein, 6 aa, Mycobacterium tuberculosis
PSPEPW

SEQ ID NO: 1544996 - protein, 10 aa, Mycobacterium tuberculosis
PSSGNGDAAY

SEQ ID NO: 1544997 - protein, 10 aa, Mycobacterium tuberculosis
PSTCARGGTV

SEQ ID NO: 1544998 - protein, 13 aa, Mycobacterium tuberculosis
PSTLSVGDDSMRA

SEQ ID NO: 1544999 - protein, 11 aa, Mycobacterium tuberculosis
PSVTTPKPGCG

SEQ ID NO: 1545000 - protein, 19 aa, Mycobacterium tuberculosis
PTAQAAPVPAEPADTETER

SEQ ID NO: 1545001 - protein, 34 aa, Mycobacterium tuberculosis
PTAVPAGAPVAPAAPSPPSPPRPSLPPSPASLPP

SEQ ID NO: 1545002 - protein, 4 aa, Mycobacterium tuberculosis
PTES

SEQ ID NO: 1545003 - protein, 4 aa, Mycobacterium tuberculosis
PTLP

SEQ ID NO: 1545004 - protein, 5 aa, Mycobacterium tuberculosis
PTNFA

SEQ ID NO: 1545005 - protein, 10 aa, Mycobacterium tuberculosis
PTNTGPRETL

SEQ ID NO: 1545006 - protein, 5 aa, Mycobacterium tuberculosis
PTPRT

SEQ ID NO: 1545007 - protein, 12 aa, Mycobacterium tuberculosis
PTPSATATASTA

SEQ ID NO: 1545008 - protein, 6 aa, Mycobacterium tuberculosis
PTRAYG

SEQ ID NO: 1545009 - protein, 7 aa, Mycobacterium tuberculosis
PTRPAFP

SEQ ID NO: 1545010 - protein, 12 aa, Mycobacterium tuberculosis
PTRSSSPPVRRR

SEQ ID NO: 1545011 - protein, 10 aa, Mycobacterium tuberculosis
PTSAGSADIS

SEQ ID NO: 1545012 - protein, 5 aa, Mycobacterium tuberculosis
PTSPI

SEQ ID NO: 1545013 - protein, 7 aa, Mycobacterium tuberculosis
PTSSAHI

SEQ ID NO: 1545014 - protein, 8 aa, Mycobacterium tuberculosis
PTTLPGSG

SEQ ID NO: 1545015 - protein, 15 aa, Mycobacterium tuberculosis
PTTLPGSGFHDPPWS

SEQ ID NO: 1545016 - protein, 11 aa, Mycobacterium tuberculosis
PVAAGAAAEAD

SEQ ID NO: 1545017 - protein, 10 aa, Mycobacterium tuberculosis
PVAGRSEANL

SEQ ID NO: 1545018 - protein, 12 aa, Mycobacterium tuberculosis
PVDPKRRPLITK

SEQ ID NO: 1545019 - protein, 5 aa, Mycobacterium tuberculosis
PVDVD

SEQ ID NO: 1545020 - protein, 7 aa, Mycobacterium tuberculosis
PVFPGRT

SEQ ID NO: 1545021 - protein, 24 aa, Mycobacterium tuberculosis
PVPPAVPAAPAAKPTSPTASATMP

SEQ ID NO: 1545022 - protein, 6 aa, Mycobacterium tuberculosis
PVPPQT

SEQ ID NO: 1545023 - protein, 49 aa, Mycobacterium tuberculosis
PVRPAGKAGPAVAAASTAPPAPTAPRASTVPPAAKATTATPAESGFTES

SEQ ID NO: 1545024 - protein, 10 aa, Mycobacterium tuberculosis
PVSTSDPLCD

SEQ ID NO: 1545025 - protein, 10 aa, Mycobacterium tuberculosis
PVVPGANDNL

SEQ ID NO: 1545026 - protein, 18 aa, Mycobacterium tuberculosis
PYAQRSSLEGPVTSPTGI

SEQ ID NO: 1545027 - protein, 9 aa, Mycobacterium tuberculosis
PYRDDAGHS

SEQ ID NO: 1545028 - protein, 8 aa, Mycobacterium tuberculosis
QAADREIA

SEQ ID NO: 1545029 - protein, 8 aa, Mycobacterium tuberculosis
QAAPTADE

SEQ ID NO: 1545030 - protein, 14 aa, Mycobacterium tuberculosis
QAARRGESERGPSR

SEQ ID NO: 1545031 - protein, 5 aa, Mycobacterium tuberculosis
QADPD

SEQ ID NO: 1545032 - protein, 9 aa, Mycobacterium tuberculosis
QAEQTAAQA

SEQ ID NO: 1545033 - protein, 10 aa, Mycobacterium tuberculosis
QAESAKAIST

SEQ ID NO: 1545034 - protein, 11 aa, Mycobacterium tuberculosis
QAFSPANLPTT

SEQ ID NO: 1545035 - protein, 7 aa, Mycobacterium tuberculosis
QAGAGSL

SEQ ID NO: 1545036 - protein, 8 aa, Mycobacterium tuberculosis
QAGNGLSD

SEQ ID NO: 1545037 - protein, 5 aa, Mycobacterium tuberculosis
QAGVA

SEQ ID NO: 1545038 - protein, 7 aa, Mycobacterium tuberculosis
QAHADGG

SEQ ID NO: 1545039 - protein, 7 aa, Mycobacterium tuberculosis
QAQPDRL

SEQ ID NO: 1545040 - protein, 74 aa, Mycobacterium tuberculosis
QARGASPTAPGPLAFPAPKAWPARPASAGRRRACRSRGAGLKPRARDCTPTRRLGRTTARARAQRAESSSSSFG

SEQ ID NO: 1545041 - protein, 8 aa, Mycobacterium tuberculosis
QARPEARA

SEQ ID NO: 1545042 - protein, 17 aa, Mycobacterium tuberculosis
QARQRRRWRSSSSTRRT

SEQ ID NO: 1545043 - protein, 14 aa, Mycobacterium tuberculosis
QARQTGAGGDLRQA

SEQ ID NO: 1545044 - protein, 8 aa, Mycobacterium tuberculosis
QAVTPAAR

SEQ ID NO: 1545045 - protein, 19 aa, Mycobacterium tuberculosis
QDGTPVPACSRGTLSHPWI

SEQ ID NO: 1545046 - protein, 5 aa, Mycobacterium tuberculosis
QEERG

SEQ ID NO: 1545047 - protein, 9 aa, Mycobacterium tuberculosis
QEQTSAASA

SEQ ID NO: 1545048 - protein, 23 aa, Mycobacterium tuberculosis
QETERGHAGYTTEGTKGLPAGGE

SEQ ID NO: 1545049 - protein, 10 aa, Mycobacterium tuberculosis
QFGEAGEGVR

SEQ ID NO: 1545050 - protein, 4 aa, Mycobacterium tuberculosis
QFGT

SEQ ID NO: 1545051 - protein, 6 aa, Mycobacterium tuberculosis
QFSADE

SEQ ID NO: 1545052 - protein, 16 aa, Mycobacterium tuberculosis
QGDGGQSAALPDSSAL

SEQ ID NO: 1545053 - protein, 14 aa, Mycobacterium tuberculosis
QGGAGGAGGSGFGA

SEQ ID NO: 1545054 - protein, 7 aa, Mycobacterium tuberculosis
QGGGNAV

SEQ ID NO: 1545055 - protein, 16 aa, Mycobacterium tuberculosis
QGHVTGGAAAAITGGA

SEQ ID NO: 1545056 - protein, 4 aa, Mycobacterium tuberculosis
QGMG

SEQ ID NO: 1545057 - protein, 13 aa, Mycobacterium tuberculosis
QGQAYQAASAQAA

SEQ ID NO: 1545058 - protein, 6 aa, Mycobacterium tuberculosis
QGTMTA

SEQ ID NO: 1545059 - protein, 26 aa, Mycobacterium tuberculosis
QGVGGSGGKGGAGGLAGDGGNGANGN

SEQ ID NO: 1545060 - protein, 63 aa, Mycobacterium tuberculosis
QHANSGNGGGGGTGGAGGTHGTPGSGNAGGTGTGHADSTNGGPGSDGLGGDAFNGSRGTDGNP

SEQ ID NO: 1545061 - protein, 10 aa, Mycobacterium tuberculosis
QISAAGSFGR

SEQ ID NO: 1545062 - protein, 8 aa, Mycobacterium tuberculosis
QKDNAQQV

SEQ ID NO: 1545063 - protein, 16 aa, Mycobacterium tuberculosis
QLATGSWQGPASAAMT

SEQ ID NO: 1545064 - protein, 10 aa, Mycobacterium tuberculosis
QLDPCQSPRP

SEQ ID NO: 1545065 - protein, 17 aa, Mycobacterium tuberculosis
QLGDPLAADNPPGAVDP

SEQ ID NO: 1545066 - protein, 4 aa, Mycobacterium tuberculosis
QLPD

SEQ ID NO: 1545067 - protein, 5 aa, Mycobacterium tuberculosis
QLPDG

SEQ ID NO: 1545068 - protein, 25 aa, Mycobacterium tuberculosis
QLPKTDPIDPEAPPITPGEKIVTLL

SEQ ID NO: 1545069 - protein, 27 aa, Mycobacterium tuberculosis
QLSSNPDSAPADEPTHPGRAPSAAPRQ

SEQ ID NO: 1545070 - protein, 5 aa, Mycobacterium tuberculosis
QNAPA

SEQ ID NO: 1545071 - protein, 7 aa, Mycobacterium tuberculosis
QNAPAIA

SEQ ID NO: 1545072 - protein, 10 aa, Mycobacterium tuberculosis
QNAPAIAAAE

SEQ ID NO: 1545073 - protein, 13 aa, Mycobacterium tuberculosis
QNAPAIAAAEATY

SEQ ID NO: 1545074 - protein, 7 aa, Mycobacterium tuberculosis
QNAPEAD

SEQ ID NO: 1545075 - protein, 49 aa, Mycobacterium tuberculosis
QNGGAAAPAASPPVPPIPRGRGGATDGPNHRAGRLSPGSAENAPAAKAS

SEQ ID NO: 1545076 - protein, 14 aa, Mycobacterium tuberculosis
QNGNAGSRVSMRDL

SEQ ID NO: 1545077 - protein, 8 aa, Mycobacterium tuberculosis
QNLPFPDE

SEQ ID NO: 1545078 - protein, 8 aa, Mycobacterium tuberculosis
QPDRDGIA

SEQ ID NO: 1545079 - protein, 4 aa, Mycobacterium tuberculosis
QPGF

SEQ ID NO: 1545080 - protein, 6 aa, Mycobacterium tuberculosis
QPGGRC

SEQ ID NO: 1545081 - protein, 8 aa, Mycobacterium tuberculosis
QPGSGESL

SEQ ID NO: 1545082 - protein, 12 aa, Mycobacterium tuberculosis
QPKKKNTAAAAT

SEQ ID NO: 1545083 - protein, 6 aa, Mycobacterium tuberculosis
QPLAAQ

SEQ ID NO: 1545084 - protein, 12 aa, Mycobacterium tuberculosis
QPPVVPAPAPDA

SEQ ID NO: 1545085 - protein, 6 aa, Mycobacterium tuberculosis
QPRTRL

SEQ ID NO: 1545086 - protein, 7 aa, Mycobacterium tuberculosis
QPWDTGD

SEQ ID NO: 1545087 - protein, 21 aa, Mycobacterium tuberculosis
QQAGLPDRGPQSWSECDEWGP

SEQ ID NO: 1545088 - protein, 18 aa, Mycobacterium tuberculosis
QQAIPGTPGGAGDSGSSV

SEQ ID NO: 1545089 - protein, 7 aa, Mycobacterium tuberculosis
QQLDPQA

SEQ ID NO: 1545090 - protein, 14 aa, Mycobacterium tuberculosis
QQRGAGRGQARRLS

SEQ ID NO: 1545091 - protein, 22 aa, Mycobacterium tuberculosis
QQRLDSAGRHRNERPRSGGGAG

SEQ ID NO: 1545092 - protein, 11 aa, Mycobacterium tuberculosis
QQRRPAGSPTA

SEQ ID NO: 1545093 - protein, 8 aa, Mycobacterium tuberculosis
QQSAQPSF

SEQ ID NO: 1545094 - protein, 13 aa, Mycobacterium tuberculosis
QRADRRSHPAADS

SEQ ID NO: 1545095 - protein, 5 aa, Mycobacterium tuberculosis
QRCES

SEQ ID NO: 1545096 - protein, 5 aa, Mycobacterium tuberculosis
QRDRR

SEQ ID NO: 1545097 - protein, 12 aa, Mycobacterium tuberculosis
QRNRHPKASRRC

SEQ ID NO: 1545098 - protein, 25 aa, Mycobacterium tuberculosis
QRPDPGGEPAGFRRKPTGGTRAVPA

SEQ ID NO: 1545099 - protein, 31 aa, Mycobacterium tuberculosis; identical to SEQ ID NO: 1369939

SEQ ID NO: 1545100 - protein, 6 aa, Mycobacterium tuberculosis
QRPRVE

SEQ ID NO: 1545101 - protein, 23 aa, Mycobacterium tuberculosis
QRRGRRGRRQRRQQYQRRHRWCR

SEQ ID NO: 1545102 - protein, 17 aa, Mycobacterium tuberculosis
QRRGRRPGRHRRSRRSR

SEQ ID NO: 1545103 - protein, 17 aa, Mycobacterium tuberculosis
QRRPRRSRRGRARRPAT

SEQ ID NO: 1545104 - protein, 7 aa, Mycobacterium tuberculosis
QRRQRRG

SEQ ID NO: 1545105 - protein, 16 aa, Mycobacterium tuberculosis
QRRQRRQRRDRPARRR

SEQ ID NO: 1545106 - protein, 5 aa, Mycobacterium tuberculosis
QRRRR

SEQ ID NO: 1545107 - protein, 10 aa, Mycobacterium tuberculosis
QRSIGDVPTG

SEQ ID NO: 1545108 - protein, 12 aa, Mycobacterium tuberculosis
QRTEQEAVRTQT

SEQ ID NO: 1545109 - protein, 7 aa, Mycobacterium tuberculosis
QRTRRGC

SEQ ID NO: 1545110 - protein, 16 aa, Mycobacterium tuberculosis
QSAGRHGGANLSGSLG

SEQ ID NO: 1545111 - protein, 10 aa, Mycobacterium tuberculosis
QSLSDAENTL

SEQ ID NO: 1545112 - protein, 6 aa, Mycobacterium tuberculosis
QSQWPQ

SEQ ID NO: 1545113 - protein, 8 aa, Mycobacterium tuberculosis
QSRSELTE

SEQ ID NO: 1545114 - protein, 20 aa, Mycobacterium tuberculosis
QSSSKFAPVGDPSSTGVGDV

SEQ ID NO: 1545115 - protein, 6 aa, Mycobacterium tuberculosis
QTAQTV

SEQ ID NO: 1545116 - protein, 5 aa, Mycobacterium tuberculosis
QTARS

SEQ ID NO: 1545117 - protein, 16 aa, Mycobacterium tuberculosis
QTASASGYNEPRGYDR

SEQ ID NO: 1545118 - protein, 16 aa, Mycobacterium tuberculosis
QTEAGTTSPTTSKSRT

SEQ ID NO: 1545119 - protein, 4 aa, Mycobacterium tuberculosis
QTET

SEQ ID NO: 1545120 - protein, 20 aa, Mycobacterium tuberculosis
QTGAVADQQGQIAGLGRAGR

SEQ ID NO: 1545121 - protein, 14 aa, Mycobacterium tuberculosis
QTGIGGLNSGSGNI

SEQ ID NO: 1545122 - protein, 19 aa, Mycobacterium tuberculosis
QTLGPQRNSHGRAGSDRFR

SEQ ID NO: 1545123 - protein, 22 aa, Mycobacterium tuberculosis
QTLTTTPHPDTDAPLPVPPTDD

SEQ ID NO: 1545124 - protein, 4 aa, Mycobacterium tuberculosis
QTQP

SEQ ID NO: 1545125 - protein, 9 aa, Mycobacterium tuberculosis
QTREPNAQI

SEQ ID NO: 1545126 - protein, 4 aa, Mycobacterium tuberculosis
QTVG

SEQ ID NO: 1545127 - protein, 16 aa, Mycobacterium tuberculosis
QVERVEPGRGRPGRPP

SEQ ID NO: 1545128 - protein, 21 aa, Mycobacterium tuberculosis
QVESSDTLPNTKIRGFDGPSV

SEQ ID NO: 1545129 - protein, 8 aa, Mycobacterium tuberculosis
QVNTGDQI

SEQ ID NO: 1545130 - protein, 12 aa, Mycobacterium tuberculosis
QVPDSPAMTGPY

SEQ ID NO: 1545131 - protein, 6 aa, Mycobacterium tuberculosis
QVPSSV

SEQ ID NO: 1545132 - protein, 4 aa, Mycobacterium tuberculosis
QVST

SEQ ID NO: 1545133 - protein, 12 aa, Mycobacterium tuberculosis
QVTTESNGDYGR

SEQ ID NO: 1545134 - protein, 13 aa, Mycobacterium tuberculosis
QVTTESNGDYGRI

SEQ ID NO: 1545135 - protein, 10 aa, Mycobacterium tuberculosis
QYYTDSSRTI

SEQ ID NO: 1545136 - protein, 11 aa, Mycobacterium tuberculosis
RAAGRVDGVRP

SEQ ID NO: 1545137 - protein, 12 aa, Mycobacterium tuberculosis
RAALTTPTCTTC

SEQ ID NO: 1545138 - protein, 27 aa, Mycobacterium tuberculosis
RAARPGRPAVTAGAAGPSGAANTDAAV

SEQ ID NO: 1545139 - protein, 7 aa, Mycobacterium tuberculosis
RAATAHP

SEQ ID NO: 1545140 - protein, 13 aa, Mycobacterium tuberculosis
RAEQTQKNTLGRA

SEQ ID NO: 1545141 - protein, 8 aa, Mycobacterium tuberculosis
RAGGKGHI

SEQ ID NO: 1545142 - protein, 9 aa, Mycobacterium tuberculosis
RAGRDPATA

SEQ ID NO: 1545143 - protein, 7 aa, Mycobacterium tuberculosis
RAGSGRP

SEQ ID NO: 1545144 - protein, 6 aa, Mycobacterium tuberculosis
RAGTAT

SEQ ID NO: 1545145 - protein, 7 aa, Mycobacterium tuberculosis
RAGVGPR

SEQ ID NO: 1545146 - protein, 13 aa, Mycobacterium tuberculosis
RAMPAATGIPRGG

SEQ ID NO: 1545147 - protein, 8 aa, Mycobacterium tuberculosis
RANGTYGD

SEQ ID NO: 1545148 - protein, 4 aa, Mycobacterium tuberculosis
RANP

SEQ ID NO: 1545149 - protein, 10 aa, Mycobacterium tuberculosis
RANTAGPTLA

SEQ ID NO: 1545150 - protein, 14 aa, Mycobacterium tuberculosis
RARAPGRLAPNRHN

SEQ ID NO: 1545151 - protein, 7 aa, Mycobacterium tuberculosis
RARGDRA

SEQ ID NO: 1545152 - protein, 5 aa, Mycobacterium tuberculosis
RARGG

SEQ ID NO: 1545153 - protein, 13 aa, Mycobacterium tuberculosis
RARKRYERQGILV

SEQ ID NO: 1545154 - protein, 8 aa, Mycobacterium tuberculosis
RARPASAV

SEQ ID NO: 1545155 - protein, 10 aa, Mycobacterium tuberculosis
RARPGQTSRK

SEQ ID NO: 1545156 - protein, 19 aa, Mycobacterium tuberculosis
RARRGECTRGGQSDRGTPW

SEQ ID NO: 1545157 - protein, 12 aa, Mycobacterium tuberculosis
RARSNQTPSDAG

SEQ ID NO: 1545158 - protein, 6 aa, Mycobacterium tuberculosis
RARSVG

SEQ ID NO: 1545159 - protein, 9 aa, Mycobacterium tuberculosis
RARTGTPAV

SEQ ID NO: 1545160 - protein, 6 aa, Mycobacterium tuberculosis
RARTTV

SEQ ID NO: 1545161 - protein, 18 aa, Mycobacterium tuberculosis
RARYATDGDDDGVADPQN

SEQ ID NO: 1545162 - protein, 10 aa, Mycobacterium tuberculosis
RAVPAAPVAP

SEQ ID NO: 1545163 - protein, 7 aa, Mycobacterium tuberculosis
RDASRCD

SEQ ID NO: 1545164 - protein, 6 aa, Mycobacterium tuberculosis
RDDGTT

SEQ ID NO: 1545165 - protein, 8 aa, Mycobacterium tuberculosis
RDDSGERT

SEQ ID NO: 1545166 - protein, 24 aa, Mycobacterium tuberculosis
RDIGAQAKRGLDANTARSQEAIGR

SEQ ID NO: 1545167 - protein, 10 aa, Mycobacterium tuberculosis
RDNTDQFNTR

SEQ ID NO: 1545168 - protein, 6 aa, Mycobacterium tuberculosis
RDQASA

SEQ ID NO: 1545169 - protein, 14 aa, Mycobacterium tuberculosis
RDQRKRRAYTPDEV

SEQ ID NO: 1545170 - protein, 6 aa, Mycobacterium tuberculosis
RDRARR

SEQ ID NO: 1545171 - protein, 7 aa, Mycobacterium tuberculosis
RDSRITP

SEQ ID NO: 1545172 - protein, 5 aa, Mycobacterium tuberculosis
RDTGR

SEQ ID NO: 1545173 - protein, 6 aa, Mycobacterium tuberculosis
REARIR

SEQ ID NO: 1545174 - protein, 4 aa, Mycobacterium tuberculosis
REED

SEQ ID NO: 1545175 - protein, 15 aa, Mycobacterium tuberculosis
REIPPPTIRSMWAPT

SEQ ID NO: 1545176 - protein, 9 aa, Mycobacterium tuberculosis
RERAQRAVS

SEQ ID NO: 1545177 - protein, 5 aa, Mycobacterium tuberculosis
RERPV

SEQ ID NO: 1545178 - protein, 13 aa, Mycobacterium tuberculosis
RERRGMSTVAVRA

SEQ ID NO: 1545179 - protein, 8 aa, Mycobacterium tuberculosis
RERTPRRC

SEQ ID NO: 1545180 - protein, 12 aa, Mycobacterium tuberculosis
REYQTLSVRFVF

SEQ ID NO: 1545181 - protein, 7 aa, Mycobacterium tuberculosis
RFPDPKD

SEQ ID NO: 1545182 - protein, 9 aa, Mycobacterium tuberculosis
RFPPAPPVE

SEQ ID NO: 1545183 - protein, 4 aa, Mycobacterium tuberculosis
RGAF

SEQ ID NO: 1545184 - protein, 12 aa, Mycobacterium tuberculosis
RGANGSTPDDGF

SEQ ID NO: 1545185 - protein, 10 aa, Mycobacterium tuberculosis
RGARSPRLRS

SEQ ID NO: 1545186 - protein, 5 aa, Mycobacterium tuberculosis
RGGGE

SEQ ID NO: 1545187 - protein, 8 aa, Mycobacterium tuberculosis
RGGTPTAY

SEQ ID NO: 1545188 - protein, 14 aa, Mycobacterium tuberculosis
RGHRRDRRGRRGGR

SEQ ID NO: 1545189 - protein, 7 aa, Mycobacterium tuberculosis
RGMSDDA

SEQ ID NO: 1545190 - protein, 4 aa, Mycobacterium tuberculosis
RGRG

SEQ ID NO: 1545191 - protein, 8 aa, Mycobacterium tuberculosis
RGRGPPGG

SEQ ID NO: 1545192 - protein, 10 aa, Mycobacterium tuberculosis
RGRSTTPAVT

SEQ ID NO: 1545193 - protein, 19 aa, Mycobacterium tuberculosis
RGSATSGWATPAATTSASA

SEQ ID NO: 1545194 - protein, 11 aa, Mycobacterium tuberculosis
RGTGEPPGVGR

SEQ ID NO: 1545195 - protein, 4 aa, Mycobacterium tuberculosis
RGVA

SEQ ID NO: 1545196 - protein, 18 aa, Mycobacterium tuberculosis
RGWPPADVQTAQHASEAA

SEQ ID NO: 1545197 - protein, 4 aa, Mycobacterium tuberculosis
RHAP

SEQ ID NO: 1545198 - protein, 8 aa, Mycobacterium tuberculosis
RHAPPSAR

SEQ ID NO: 1545199 - protein, 6 aa, Mycobacterium tuberculosis
RHARTP

SEQ ID NO: 1545200 - protein, 16 aa, Mycobacterium tuberculosis
RHPRASASPAYPTQSP

SEQ ID NO: 1545201 - protein, 19 aa, Mycobacterium tuberculosis
RHQRGRSIGGAGGNGGNAG

SEQ ID NO: 1545202 - protein, 6 aa, Mycobacterium tuberculosis
RHRAAT

SEQ ID NO: 1545203 - protein, 5 aa, Mycobacterium tuberculosis
RHRGT

SEQ ID NO: 1545204 - protein, 28 aa, Mycobacterium tuberculosis
RHSGQGRQDNDGQLPGAAGAVPGPGGFR

SEQ ID NO: 1545205 - protein, 13 aa, Mycobacterium tuberculosis
RHSSQPHAAVTPA

SEQ ID NO: 1545206 - protein, 7 aa, Mycobacterium tuberculosis
RHTQAST

SEQ ID NO: 1545207 - protein, 9 aa, Mycobacterium tuberculosis
RIEPGPGAR

SEQ ID NO: 1545208 - protein, 9 aa, Mycobacterium tuberculosis
RIGGSDRPV

SEQ ID NO: 1545209 - protein, 7 aa, Mycobacterium tuberculosis
RIPAKPA

SEQ ID NO: 1545210 - protein, 17 aa, Mycobacterium tuberculosis
RIPPAGRPIGLAPAVIA

SEQ ID NO: 1545211 - protein, 5 aa, Mycobacterium tuberculosis
RISAR

SEQ ID NO: 1545212 - protein, 9 aa, Mycobacterium tuberculosis
RKAQETQRV

SEQ ID NO: 1545213 - protein, 4 aa, Mycobacterium tuberculosis
RKEG

SEQ ID NO: 1545214 - protein, 22 aa, Mycobacterium tuberculosis
RKEHADEPEVQEQPTLAPQVEP

SEQ ID NO: 1545215 - protein, 28 aa, Mycobacterium tuberculosis
RKPARPHDSHNGPTRESDQDTAASTTSC

SEQ ID NO: 1545216 - protein, 11 aa, Mycobacterium tuberculosis
RKPWGNGRGGN

SEQ ID NO: 1545217 - protein, 4 aa, Mycobacterium tuberculosis
RKRQ

SEQ ID NO: 1545218 - protein, 49 aa, Mycobacterium tuberculosis
RKRRRHRRARHRDPADLRPNAGRHPARQRDHHPKQRRQSRHVRPRDGAN

SEQ ID NO: 1545219 - protein, 6 aa, Mycobacterium tuberculosis
RKSGPL

SEQ ID NO: 1545220 - protein, 4 aa, Mycobacterium tuberculosis
RLPK

SEQ ID NO: 1545221 - protein, 5 aa, Mycobacterium tuberculosis
RLPKT

SEQ ID NO: 1545222 - protein, 6 aa, Mycobacterium tuberculosis
RLPRTP

SEQ ID NO: 1545223 - protein, 6 aa, Mycobacterium tuberculosis
RLRAES

SEQ ID NO: 1545224 - protein, 10 aa, Mycobacterium tuberculosis
RMAEPKLGQP

SEQ ID NO: 1545225 - protein, 7 aa, Mycobacterium tuberculosis
RMAQPGD

SEQ ID NO: 1545226 - protein, 13 aa, Mycobacterium tuberculosis
RMGRPATSGPGSV

SEQ ID NO: 1545227 - protein, 8 aa, Mycobacterium tuberculosis
RNAESDSG

SEQ ID NO: 1545228 - protein, 6 aa, Mycobacterium tuberculosis
RNAQVD

SEQ ID NO: 1545229 - protein, 26 aa, Mycobacterium tuberculosis
RNGGAGGNGQLGSGAVSSAGGMGGNG

SEQ ID NO: 1545230 - protein, 11 aa, Mycobacterium tuberculosis
RNGKNKTKLSI

SEQ ID NO: 1545231 - protein, 7 aa, Mycobacterium tuberculosis
RNGSGPV

SEQ ID NO: 1545232 - protein, 4 aa, Mycobacterium tuberculosis
RNGV

SEQ ID NO: 1545233 - protein, 5 aa, Mycobacterium tuberculosis
RNPDR

SEQ ID NO: 1545234 - protein, 15 aa, Mycobacterium tuberculosis
RPADAVPHDQPGRGL

SEQ ID NO: 1545235 - protein, 4 aa, Mycobacterium tuberculosis
RPAT

SEQ ID NO: 1545236 - protein, 6 aa, Mycobacterium tuberculosis
RPDGSF

SEQ ID NO: 1545237 - protein, 36 aa, Mycobacterium tuberculosis; identical to SEQ ID NO: 1367289

SEQ ID NO: 1545238 - protein, 10 aa, Mycobacterium tuberculosis
RPGCGSHRGN

SEQ ID NO: 1545239 - protein, 6 aa, Mycobacterium tuberculosis
RPGPVA

SEQ ID NO: 1545240 - protein, 5 aa, Mycobacterium tuberculosis
RPGQR

SEQ ID NO: 1545241 - protein, 16 aa, Mycobacterium tuberculosis
RPGRAGTGRDRGRGDR

SEQ ID NO: 1545242 - protein, 8 aa, Mycobacterium tuberculosis
RPGSDVEE

SEQ ID NO: 1545243 - protein, 6 aa, Mycobacterium tuberculosis
RPHRGP

SEQ ID NO: 1545244 - protein, 10 aa, Mycobacterium tuberculosis
RPIDETSLGA

SEQ ID NO: 1545245 - protein, 14 aa, Mycobacterium tuberculosis
RPKTPTTPGGRRDP

SEQ ID NO: 1545246 - protein, 18 aa, Mycobacterium tuberculosis
RPLATELDNRKAEVNNDI

SEQ ID NO: 1545247 - protein, 9 aa, Mycobacterium tuberculosis
RPNAADVER

SEQ ID NO: 1545248 - protein, 15 aa, Mycobacterium tuberculosis
RPPDLPPGTHDAQTD

SEQ ID NO: 1545249 - protein, 31 aa, Mycobacterium tuberculosis
RPPRSGHADAGQSAGPGVAGGRQVAQYRRRC

SEQ ID NO: 1545250 - protein, 7 aa, Mycobacterium tuberculosis
RPPTSAA

SEQ ID NO: 1545251 - protein, 9 aa, Mycobacterium tuberculosis
RPPVGPRGH

SEQ ID NO: 1545252 - protein, 15 aa, Mycobacterium tuberculosis
RPRAEPDRRSHRPRR

SEQ ID NO: 1545253 - protein, 4 aa, Mycobacterium tuberculosis
RPRL

SEQ ID NO: 1545254 - protein, 6 aa, Mycobacterium tuberculosis
RPTHTT

SEQ ID NO: 1545255 - protein, 5 aa, Mycobacterium tuberculosis
RPTIA

SEQ ID NO: 1545256 - protein, 43 aa, Mycobacterium tuberculosis
RPTRSARPARPRLTRPNRRGPRNPEKGWSTPGANIRWAQRHTS

SEQ ID NO: 1545257 - protein, 12 aa, Mycobacterium tuberculosis
RQAALNPPTDVP

SEQ ID NO: 1545258 - protein, 6 aa, Mycobacterium tuberculosis
RQGRSV

SEQ ID NO: 1545259 - protein, 10 aa, Mycobacterium tuberculosis
RQPQPQPCAG

SEQ ID NO: 1545260 - protein, 18 aa, Mycobacterium tuberculosis
RQRLGGAEHRPAAARSDQ

SEQ ID NO: 1545261 - protein, 4 aa, Mycobacterium tuberculosis
RQRQ

SEQ ID NO: 1545262 - protein, 5 aa, Mycobacterium tuberculosis
RQRRH

SEQ ID NO: 1545263 - protein, 5 aa, Mycobacterium tuberculosis
RQRRQ

SEQ ID NO: 1545264 - protein, 8 aa, Mycobacterium tuberculosis
RQSCDGCQ

SEQ ID NO: 1545265 - protein, 6 aa, Mycobacterium tuberculosis
RQTLQG

SEQ ID NO: 1545266 - protein, 21 aa, Mycobacterium tuberculosis
RQTTSTPGGGAGSRSSPDYGC

SEQ ID NO: 1545267 - protein, 5 aa, Mycobacterium tuberculosis
RRAAG

SEQ ID NO: 1545268 - protein, 5 aa, Mycobacterium tuberculosis
RRADQ

SEQ ID NO: 1545269 - protein, 5 aa, Mycobacterium tuberculosis
RRAGD

SEQ ID NO: 1545270 - protein, 18 aa, Mycobacterium tuberculosis
RRARMPAPRRPMSSSRCW

SEQ ID NO: 1545271 - protein, 10 aa, Mycobacterium tuberculosis
RRATGAAGGG

SEQ ID NO: 1545272 - protein, 13 aa, Mycobacterium tuberculosis
RRATTTSAPCPAG

SEQ ID NO: 1545273 - protein, 5 aa, Mycobacterium tuberculosis
RRDGV

SEQ ID NO: 1545274 - protein, 10 aa, Mycobacterium tuberculosis
RRDRRGRREE

SEQ ID NO: 1545275 - protein, 11 aa, Mycobacterium tuberculosis
RREKDDVTEVR

SEQ ID NO: 1545276 - protein, 14 aa, Mycobacterium tuberculosis
RREPTSSDSRPVTT

SEQ ID NO: 1545277 - protein, 10 aa, Mycobacterium tuberculosis
RRGRAASATA

SEQ ID NO: 1545278 - protein, 11 aa, Mycobacterium tuberculosis
RRGRAEIGTRK

SEQ ID NO: 1545279 - protein, 19 aa, Mycobacterium tuberculosis
RRGRSTTGHPDPPGHRPGR

SEQ ID NO: 1545280 - protein, 7 aa, Mycobacterium tuberculosis
RRHQRGR

SEQ ID NO: 1545281 - protein, 4 aa, Mycobacterium tuberculosis
RRHR

SEQ ID NO: 1545282 - protein, 18 aa, Mycobacterium tuberculosis
RRKRPAAHDRAGWVGLFT

SEQ ID NO: 1545283 - protein, 8 aa, Mycobacterium tuberculosis
RRNAELDE

SEQ ID NO: 1545284 - protein, 44 aa, Mycobacterium tuberculosis; identical to SEQ ID NO: 186136

SEQ ID NO: 1545285 - protein, 9 aa, Mycobacterium tuberculosis
RRPGDTSAT

SEQ ID NO: 1545286 - protein, 8 aa, Mycobacterium tuberculosis
RRPPAGMS

SEQ ID NO: 1545287 - protein, 12 aa, Mycobacterium tuberculosis
RRPRWAGTSRWP

SEQ ID NO: 1545288 - protein, 10 aa, Mycobacterium tuberculosis
RRQAKPGDFD

SEQ ID NO: 1545289 - protein, 8 aa, Mycobacterium tuberculosis
RRRDDRGH

SEQ ID NO: 1545290 - protein, 6 aa, Mycobacterium tuberculosis
RRRDEE

SEQ ID NO: 1545291 - protein, 8 aa, Mycobacterium tuberculosis
RRRGGFGR

SEQ ID NO: 1545292 - protein, 4 aa, Mycobacterium tuberculosis
RRRH

SEQ ID NO: 1545293 - protein, 16 aa, Mycobacterium tuberculosis
RRRNRRTTRRRRRSRR

SEQ ID NO: 1545294 - protein, 18 aa, Mycobacterium tuberculosis
RRRPPTGHRDPGRRFAAA

SEQ ID NO: 1545295 - protein, 29 aa, Mycobacterium tuberculosis
RRRQARRHHRAPGRSCRPRSSTPAAPAVV

SEQ ID NO: 1545296 - protein, 7 aa, Mycobacterium tuberculosis
RRRRAQQ

SEQ ID NO: 1545297 - protein, 26 aa, Mycobacterium tuberculosis
RRRRARGGAGGTVFGSGGAGGAGGVA

SEQ ID NO: 1545298 - protein, 9 aa, Mycobacterium tuberculosis
RRRRGRRRR

SEQ ID NO: 1545299 - protein, 14 aa, Mycobacterium tuberculosis
RRRRPAQHGARLRS

SEQ ID NO: 1545300 - protein, 41 aa, Mycobacterium tuberculosis
RRRRRGERQRRRRKRRRGRQGRVGRRGRQRRRRRCHDSRKG

SEQ ID NO: 1545301 - protein, 13 aa, Mycobacterium tuberculosis
RRRRSPPPGISWT

SEQ ID NO: 1545302 - protein, 11 aa, Mycobacterium tuberculosis
RRRSGDPVAPP

SEQ ID NO: 1545303 - protein, 8 aa, Mycobacterium tuberculosis
RRRSLRAA

SEQ ID NO: 1545304 - protein, 25 aa, Mycobacterium tuberculosis
RRRTPSMPLPPSTAGSTVAAGPRRF

SEQ ID NO: 1545305 - protein, 17 aa, Mycobacterium tuberculosis
RRSMPAHGPGPRPKNPL

SEQ ID NO: 1545306 - protein, 8 aa, Mycobacterium tuberculosis
RRSPRRSI

SEQ ID NO: 1545307 - protein, 7 aa, Mycobacterium tuberculosis
RRSRQGR

SEQ ID NO: 1545308 - protein, 23 aa, Mycobacterium tuberculosis
RRTQSPCRSPKPRVGRKRTRGQG

SEQ ID NO: 1545309 - protein, 11 aa, Mycobacterium tuberculosis
RSAAGHSAYPG

SEQ ID NO: 1545310 - protein, 9 aa, Mycobacterium tuberculosis
RSAASGAAL

SEQ ID NO: 1545311 - protein, 6 aa, Mycobacterium tuberculosis
RSATPA

SEQ ID NO: 1545312 - protein, 9 aa, Mycobacterium tuberculosis
RSDEEAQAR

SEQ ID NO: 1545313 - protein, 7 aa, Mycobacterium tuberculosis
RSDRDAA

SEQ ID NO: 1545314 - protein, 8 aa, Mycobacterium tuberculosis
RSKTPGAT

SEQ ID NO: 1545315 - protein, 7 aa, Mycobacterium tuberculosis
RSMKSGS

SEQ ID NO: 1545316 - protein, 8 aa, Mycobacterium tuberculosis
RSMTTPSR

SEQ ID NO: 1545317 - protein, 9 aa, Mycobacterium tuberculosis
RSNAGAGTA

SEQ ID NO: 1545318 - protein, 16 aa, Mycobacterium tuberculosis
RSQLPSGAGFRCHGVA

SEQ ID NO: 1545319 - protein, 32 aa, Mycobacterium tuberculosis; identical to SEQ ID NO: 153756

SEQ ID NO: 1545320 - protein, 7 aa, Mycobacterium tuberculosis
RSRSSGH

SEQ ID NO: 1545321 - protein, 5 aa, Mycobacterium tuberculosis
RSSAG

SEQ ID NO: 1545322 - protein, 38 aa, Mycobacterium tuberculosis
RSSKARGAWRASRATAGYSSAARRAGDRAGRQARLGNN

SEQ ID NO: 1545323 - protein, 10 aa, Mycobacterium tuberculosis
RSTSELPGEL

SEQ ID NO: 1545324 - protein, 22 aa, Mycobacterium tuberculosis
RSVGGAGKSGCKSWLGSVGWRR

SEQ ID NO: 1545325 - protein, 5 aa, Mycobacterium tuberculosis
RTAAD

SEQ ID NO: 1545326 - protein, 5 aa, Mycobacterium tuberculosis
RTDHE

SEQ ID NO: 1545327 - protein, 9 aa, Mycobacterium tuberculosis
RTDSTGTRR

SEQ ID NO: 1545328 - protein, 6 aa, Mycobacterium tuberculosis
RTEQPH

SEQ ID NO: 1545329 - protein, 21 aa, Mycobacterium tuberculosis
RTGCSGSSRPRSKTSPSTRPD

SEQ ID NO: 1545330 - protein, 11 aa, Mycobacterium tuberculosis
RTGEPPGVGGI

SEQ ID NO: 1545331 - protein, 6 aa, Mycobacterium tuberculosis
RTGGLG

SEQ ID NO: 1545332 - protein, 7 aa, Mycobacterium tuberculosis
RTGIGGL

SEQ ID NO: 1545333 - protein, 4 aa, Mycobacterium tuberculosis
RTGK

SEQ ID NO: 1545334 - protein, 8 aa, Mycobacterium tuberculosis
RTNGYTAE

SEQ ID NO: 1545335 - protein, 10 aa, Mycobacterium tuberculosis
RTPGAQRAQC

SEQ ID NO: 1545336 - protein, 33 aa, Mycobacterium tuberculosis
RTPGRSADAHPGRPAPPGRGTPGRLARGGGAGQ

SEQ ID NO: 1545337 - protein, 13 aa, Mycobacterium tuberculosis
RTQSASPCAEGAN

SEQ ID NO: 1545338 - protein, 5 aa, Mycobacterium tuberculosis
RTSIR

SEQ ID NO: 1545339 - protein, 6 aa, Mycobacterium tuberculosis
RTSPAL

SEQ ID NO: 1545340 - protein, 4 aa, Mycobacterium tuberculosis
RTTT

SEQ ID NO: 1545341 - protein, 17 aa, Mycobacterium tuberculosis
RTTVPSRHHQDGISHPA

SEQ ID NO: 1545342 - protein, 12 aa, Mycobacterium tuberculosis
RVAPAERCQTPQ

SEQ ID NO: 1545343 - protein, 5 aa, Mycobacterium tuberculosis
RVASE

SEQ ID NO: 1545344 - protein, 7 aa, Mycobacterium tuberculosis
RVGGAER

SEQ ID NO: 1545345 - protein, 46 aa, Mycobacterium tuberculosis
RVGRPHRRRRNRRDHGVARDDCPSSRGATRAASAAGTSLAPGTART

SEQ ID NO: 1545346 - protein, 7 aa, Mycobacterium tuberculosis
RVPDGED

SEQ ID NO: 1545347 - protein, 4 aa, Mycobacterium tuberculosis
RVSD

SEQ ID NO: 1545348 - protein, 20 aa, Mycobacterium tuberculosis
RWPRSGSSEPVGRRARARWW

SEQ ID NO: 1545349 - protein, 6 aa, Mycobacterium tuberculosis
RYGPRA

SEQ ID NO: 1545350 - protein, 34 aa, Mycobacterium tuberculosis
RYPPTSRHGIGRRTGLPGSPTRGPANSITSAGQP

SEQ ID NO: 1545351 - protein, 6 aa, Mycobacterium tuberculosis
RYRSPL

SEQ ID NO: 1545352 - protein, 12 aa, Mycobacterium tuberculosis
RYSRPQSERHRK

SEQ ID NO: 1545353 - protein, 30 aa, Mycobacterium tuberculosis; identical to SEQ ID NO: 1425885

SEQ ID NO: 1545354 - protein, 6 aa, Mycobacterium tuberculosis
SAAAAG

SEQ ID NO: 1545355 - protein, 10 aa, Mycobacterium tuberculosis
SAAADRARGV

SEQ ID NO: 1545356 - protein, 12 aa, Mycobacterium tuberculosis
SAAELATALGVP

SEQ ID NO: 1545357 - protein, 8 aa, Mycobacterium tuberculosis
SAAGSRVS

SEQ ID NO: 1545358 - protein, 13 aa, Mycobacterium tuberculosis
SAAKGTGAYAGPR

SEQ ID NO: 1545359 - protein, 18 aa, Mycobacterium tuberculosis
SAANAAAAGPTTHVLAAR

SEQ ID NO: 1545360 - protein, 18 aa, Mycobacterium tuberculosis
SAAPTDPSSSSTDSPVDA

SEQ ID NO: 1545361 - protein, 19 aa, Mycobacterium tuberculosis
SAAPVARAGRAHPEVPAGR

SEQ ID NO: 1545362 - protein, 11 aa, Mycobacterium tuberculosis
SAARAAADAAL

SEQ ID NO: 1545363 - protein, 9 aa, Mycobacterium tuberculosis
SAARQPISR

SEQ ID NO: 1545364 - protein, 8 aa, Mycobacterium tuberculosis
SAATRGAS

SEQ ID NO: 1545365 - protein, 19 aa, Mycobacterium tuberculosis
SACSPQKSPQPSSPRLPTM

SEQ ID NO: 1545366 - protein, 8 aa, Mycobacterium tuberculosis
SADPAKPI

SEQ ID NO: 1545367 - protein, 19 aa, Mycobacterium tuberculosis
SADRRRRQRDRGEPGRPKT

SEQ ID NO: 1545368 - protein, 12 aa, Mycobacterium tuberculosis
SAEATDGGPLGT

SEQ ID NO: 1545369 - protein, 7 aa, Mycobacterium tuberculosis
SAEATNA

SEQ ID NO: 1545370 - protein, 7 aa, Mycobacterium tuberculosis
SAEGNGN

SEQ ID NO: 1545371 - protein, 4 aa, Mycobacterium tuberculosis
SAEL

SEQ ID NO: 1545372 - protein, 27 aa, Mycobacterium tuberculosis
SAEPHATDGSPVANRVEPGKRPRSSMA

SEQ ID NO: 1545373 - protein, 13 aa, Mycobacterium tuberculosis
SAGAATAKKNRSF

SEQ ID NO: 1545374 - protein, 9 aa, Mycobacterium tuberculosis
SAGAGGHRP

SEQ ID NO: 1545375 - protein, 8 aa, Mycobacterium tuberculosis
SAGDPATL

SEQ ID NO: 1545376 - protein, 9 aa, Mycobacterium tuberculosis
SAGQSTGGG

SEQ ID NO: 1545377 - protein, 14 aa, Mycobacterium tuberculosis
SAGYATGGMSTAAL

SEQ ID NO: 1545378 - protein, 5 aa, Mycobacterium tuberculosis
SAHAE

SEQ ID NO: 1545379 - protein, 15 aa, Mycobacterium tuberculosis
SAISSANAAAAVNTT

SEQ ID NO: 1545380 - protein, 9 aa, Mycobacterium tuberculosis
SALAGSGSG

SEQ ID NO: 1545381 - protein, 17 aa, Mycobacterium tuberculosis
SALLGAGSGVGNVGTLG

SEQ ID NO: 1545382 - protein, 8 aa, Mycobacterium tuberculosis
SAMAEPRY

SEQ ID NO: 1545383 - protein, 12 aa, Mycobacterium tuberculosis
SAMTSSRRDHRE

SEQ ID NO: 1545384 - protein, 19 aa, Mycobacterium tuberculosis
SANFGSANIGGNNIGGANT

SEQ ID NO: 1545385 - protein, 7 aa, Mycobacterium tuberculosis
SAPHRAA

SEQ ID NO: 1545386 - protein, 14 aa, Mycobacterium tuberculosis
SAPHREQYSDPEKP

SEQ ID NO: 1545387 - protein, 13 aa, Mycobacterium tuberculosis
SAPRPPLSTPLWG

SEQ ID NO: 1545388 - protein, 11 aa, Mycobacterium tuberculosis
SAQGGHRGDHA

SEQ ID NO: 1545389 - protein, 10 aa, Mycobacterium tuberculosis
SAQSRDALTD

SEQ ID NO: 1545390 - protein, 5 aa, Mycobacterium tuberculosis
SAQVD

SEQ ID NO: 1545391 - protein, 13 aa, Mycobacterium tuberculosis
SASAGNADKTSVR

SEQ ID NO: 1545392 - protein, 13 aa, Mycobacterium tuberculosis
SASESRNVLGTQD

SEQ ID NO: 1545393 - protein, 7 aa, Mycobacterium tuberculosis
SASRGIG

SEQ ID NO: 1545394 - protein, 34 aa, Mycobacterium tuberculosis
SASTARLSATALPSVASSTVPFSDSGLFPRCFFL

SEQ ID NO: 1545395 - protein, 18 aa, Mycobacterium tuberculosis
SASTARPAATALPAVAAS

SEQ ID NO: 1545396 - protein, 21 aa, Mycobacterium tuberculosis
SATAAQVASGAQGAKAASAPG

SEQ ID NO: 1545397 - protein, 24 aa, Mycobacterium tuberculosis
SATAAQVASGAQGAKAASAPGAAP

SEQ ID NO: 1545398 - protein, 26 aa, Mycobacterium tuberculosis
SATAAQVASGAQGAKAASAPGAAPAV

SEQ ID NO: 1545399 - protein, 23 aa, Mycobacterium tuberculosis
SATATAPADAPASVLQPALAWSE

SEQ ID NO: 1545400 - protein, 8 aa, Mycobacterium tuberculosis
SATSGASG

SEQ ID NO: 1545401 - protein, 22 aa, Mycobacterium tuberculosis
SATSRRAQRLPGRGLGRGPALP

SEQ ID NO: 1545402 - protein, 8 aa, Mycobacterium tuberculosis
SATTSTGW

SEQ ID NO: 1545403 - protein, 7 aa, Mycobacterium tuberculosis
SATWPEP

SEQ ID NO: 1545404 - protein, 5 aa, Mycobacterium tuberculosis
SATYQ

SEQ ID NO: 1545405 - protein, 14 aa, Mycobacterium tuberculosis
SAVRSIPDSVPPPR

SEQ ID NO: 1545406 - protein, 6 aa, Mycobacterium tuberculosis
SCPNHA

SEQ ID NO: 1545407 - protein, 6 aa, Mycobacterium tuberculosis
SCPPGR

SEQ ID NO: 1545408 - protein, 6 aa, Mycobacterium tuberculosis
SDAEPV

SEQ ID NO: 1545409 - protein, 8 aa, Mycobacterium tuberculosis
SDDQNPNL

SEQ ID NO: 1545410 - protein, 16 aa, Mycobacterium tuberculosis
SDDTHTGGAVQKPRGT

SEQ ID NO: 1545411 - protein, 8 aa, Mycobacterium tuberculosis
SDGEPATE

SEQ ID NO: 1545412 - protein, 4 aa, Mycobacterium tuberculosis
SDGG

SEQ ID NO: 1545413 - protein, 5 aa, Mycobacterium tuberculosis
SDGGR

SEQ ID NO: 1545414 - protein, 13 aa, Mycobacterium tuberculosis
SDGTGTALDSASL

SEQ ID NO: 1545415 - protein, 6 aa, Mycobacterium tuberculosis
SDLAGI

SEQ ID NO: 1545416 - protein, 14 aa, Mycobacterium tuberculosis
SDLAKGGPVHAQSE

SEQ ID NO: 1545417 - protein, 6 aa, Mycobacterium tuberculosis
SDMTEA

SEQ ID NO: 1545418 - protein, 5 aa, Mycobacterium tuberculosis
SDPNW

SEQ ID NO: 1545419 - protein, 22 aa, Mycobacterium tuberculosis
SDQRGDRSSDQPTLGVGRRDSA

SEQ ID NO: 1545420 - protein, 12 aa, Mycobacterium tuberculosis
SDRRRGRPGQHG

SEQ ID NO: 1545421 - protein, 26 aa, Mycobacterium tuberculosis
SDSPDGAAQLPGTPTHPGTGQAAASS

SEQ ID NO: 1545422 - protein, 6 aa, Mycobacterium tuberculosis
SDYRPT

SEQ ID NO: 1545423 - protein, 8 aa, Mycobacterium tuberculosis
SEASAPGI

SEQ ID NO: 1545424 - protein, 15 aa, Mycobacterium tuberculosis
SEHGGAAAVQATRDL

SEQ ID NO: 1545425 - protein, 12 aa, Mycobacterium tuberculosis
SEIDKARSELAA

SEQ ID NO: 1545426 - protein, 5 aa, Mycobacterium tuberculosis
SENNT

SEQ ID NO: 1545427 - protein, 6 aa, Mycobacterium tuberculosis
SEPDVT

SEQ ID NO: 1545428 - protein, 7 aa, Mycobacterium tuberculosis
SEQRGYG

SEQ ID NO: 1545429 - protein, 19 aa, Mycobacterium tuberculosis
SERLTSAAAAAAGPPSAAG

SEQ ID NO: 1545430 - protein, 8 aa, Mycobacterium tuberculosis
SESDEPNR

SEQ ID NO: 1545431 - protein, 12 aa, Mycobacterium tuberculosis
SETSAEAAARHE

SEQ ID NO: 1545432 - protein, 22 aa, Mycobacterium tuberculosis
SFASSGLAKPPEAQANPAVPPN

SEQ ID NO: 1545433 - protein, 8 aa, Mycobacterium tuberculosis
SFDPREEP

SEQ ID NO: 1545434 - protein, 17 aa, Mycobacterium tuberculosis
SFGSVTSGLAGQSWQGA

SEQ ID NO: 1545435 - protein, 13 aa, Mycobacterium tuberculosis
SFNPGSANTGSVN

SEQ ID NO: 1545436 - protein, 201 aa, Mycobacterium tuberculosis
SFSNGSNGGTGGTGGVGGTGGDGGNAGTGAGDPGKGGTGGTGGTGGSGGAGGSGGANFNGGTGGTGGTGGKGGLNTDGLSSATSGTGGTGGTGGKGGTGGAGDDSAGGTGGTGGAGGNAGAGGLANTGGTAGNAGIGGDGGQGGNGGQGDSGSGLGGQPGFAGGAGGKGGAGGSSGAGGTNGSGGAGGAGGQGGAGGAGIS

SEQ ID NO: 1545437 - protein, 11 aa, Mycobacterium tuberculosis
SGAARRRTPAR

SEQ ID NO: 1545438 - protein, 12 aa, Mycobacterium tuberculosis
SGAAVTNDISHP

SEQ ID NO: 1545439 - protein, 16 aa, Mycobacterium tuberculosis
SGAGGNSGFGNNGSGL

SEQ ID NO: 1545440 - protein, 14 aa, Mycobacterium tuberculosis
SGAGGVSGFGNVGS

SEQ ID NO: 1545441 - protein, 7 aa, Mycobacterium tuberculosis
SGAGLSG

SEQ ID NO: 1545442 - protein, 8 aa, Mycobacterium tuberculosis
SGAGSASG

SEQ ID NO: 1545443 - protein, 8 aa, Mycobacterium tuberculosis
SGAGSVSG

SEQ ID NO: 1545444 - protein, 4 aa, Mycobacterium tuberculosis
SGAL

SEQ ID NO: 1545445 - protein, 8 aa, Mycobacterium tuberculosis
SGAPAAAM

SEQ ID NO: 1545446 - protein, 5 aa, Mycobacterium tuberculosis
SGAPE

SEQ ID NO: 1545447 - protein, 14 aa, Mycobacterium tuberculosis
SGAPFDGASLQGKP

SEQ ID NO: 1545448 - protein, 5 aa, Mycobacterium tuberculosis
SGAPV

SEQ ID NO: 1545449 - protein, 5 aa, Mycobacterium tuberculosis
SGASA

SEQ ID NO: 1545450 - protein, 8 aa, Mycobacterium tuberculosis
SGASAAAE

SEQ ID NO: 1545451 - protein, 13 aa, Mycobacterium tuberculosis
SGASSTTASTGDI

SEQ ID NO: 1545452 - protein, 15 aa, Mycobacterium tuberculosis
SGDGNTGFGNAGDVN

SEQ ID NO: 1545453 - protein, 14 aa, Mycobacterium tuberculosis
SGDGNTGFGNAGNI

SEQ ID NO: 1545454 - protein, 6 aa, Mycobacterium tuberculosis
SGEAAA

SEQ ID NO: 1545455 - protein, 53 aa, Mycobacterium tuberculosis; identical to SEQ ID NO: 1426436

SEQ ID NO: 1545456 - protein, 13 aa, Mycobacterium tuberculosis
SGFSNLGSGVSGF

SEQ ID NO: 1545457 - protein, 69 aa, Mycobacterium tuberculosis; identical to SEQ ID NO: 187377

SEQ ID NO: 1545458 - protein, 28 aa, Mycobacterium tuberculosis
SGGAGGNGGYSLNGTGGDGGTGGAGQIT

SEQ ID NO: 1545459 - protein, 6 aa, Mycobacterium tuberculosis
SGGLRG

SEQ ID NO: 1545460 - protein, 34 aa, Mycobacterium tuberculosis
SGGNGGAGGAGPAGAIGAPGVAGGASGAGGTAGL

SEQ ID NO: 1545461 - protein, 24 aa, Mycobacterium tuberculosis
SGGNGGAGGAGPAGRRSPAPGQLE

SEQ ID NO: 1545462 - protein, 19 aa, Mycobacterium tuberculosis
SGGNGGSGGAGPAGAIGAP

SEQ ID NO: 1545463 - protein, 9 aa, Mycobacterium tuberculosis
SGGRTGKFN

SEQ ID NO: 1545464 - protein, 9 aa, Mycobacterium tuberculosis
SGGSDRKLS

SEQ ID NO: 1545465 - protein, 56 aa, Mycobacterium tuberculosis
SGGSGGAGGISKSVGDSAAGGAGGAPGLIGNGGNGGNGGASTGGGDGGPGGAGGTG

SEQ ID NO: 1545466 - protein, 6 aa, Mycobacterium tuberculosis
SGGTRL

SEQ ID NO: 1545467 - protein, 8 aa, Mycobacterium tuberculosis
SGIDSSTV

SEQ ID NO: 1545468 - protein, 7 aa, Mycobacterium tuberculosis
SGKNTRV

SEQ ID NO: 1545469 - protein, 7 aa, Mycobacterium tuberculosis
SGLPNQT

SEQ ID NO: 1545470 - protein, 41 aa, Mycobacterium tuberculosis
SGLQTTGIANSGALNTGVANTGDHSSGGFNQGSDQSGFFGQ

SEQ ID NO: 1545471 - protein, 24 aa, Mycobacterium tuberculosis
SGLSGGDGGAGGAGGAGGAGGTGG

SEQ ID NO: 1545472 - protein, 7 aa, Mycobacterium tuberculosis
SGMQRQE

SEQ ID NO: 1545473 - protein, 18 aa, Mycobacterium tuberculosis
SGNFGNSNIGSASLGNNN

SEQ ID NO: 1545474 - protein, 22 aa, Mycobacterium tuberculosis
SGNGGAGGNGVTGASGADAAAP

SEQ ID NO: 1545475 - protein, 26 aa, Mycobacterium tuberculosis
SGNGNLGIGNSSDANVGIGNSGATVG

SEQ ID NO: 1545476 - protein, 19 aa, Mycobacterium tuberculosis
SGNIGNTNFGNGNQGNLNF

SEQ ID NO: 1545477 - protein, 54 aa, Mycobacterium tuberculosis; identical to SEQ ID NO: 1420774

SEQ ID NO: 1545478 - protein, 5 aa, Mycobacterium tuberculosis
SGNMG

SEQ ID NO: 1545479 - protein, 15 aa, Mycobacterium tuberculosis
SGNRPAHVVNPEVLG

SEQ ID NO: 1545480 - protein, 28 aa, Mycobacterium tuberculosis
SGNTANTNFGSGNSATSTCAAATTATVT

SEQ ID NO: 1545481 - protein, 22 aa, Mycobacterium tuberculosis
SGPAIPPSGERDAWASNSGVGG

SEQ ID NO: 1545482 - protein, 6 aa, Mycobacterium tuberculosis
SGPGID

SEQ ID NO: 1545483 - protein, 6 aa, Mycobacterium tuberculosis
SGQHGH

SEQ ID NO: 1545484 - protein, 5 aa, Mycobacterium tuberculosis
SGREL

SEQ ID NO: 1545485 - protein, 18 aa, Mycobacterium tuberculosis
SGRPGDVPPNVPGTPLPI

SEQ ID NO: 1545486 - protein, 14 aa, Mycobacterium tuberculosis
SGRSTSEVTEEQIR

SEQ ID NO: 1545487 - protein, 8 aa, Mycobacterium tuberculosis
SGRTGLPR

SEQ ID NO: 1545488 - protein, 13 aa, Mycobacterium tuberculosis
SGSAIPAPTTSGS

SEQ ID NO: 1545489 - protein, 18 aa, Mycobacterium tuberculosis
SGSFNTGIGNTGNTNTGL

SEQ ID NO: 1545490 - protein, 27 aa, Mycobacterium tuberculosis
SGSGNFGIGNAGTGNWGIGNSGAGNFG

SEQ ID NO: 1545491 - protein, 6 aa, Mycobacterium tuberculosis
SGSHNT

SEQ ID NO: 1545492 - protein, 5 aa, Mycobacterium tuberculosis
SGSNN

SEQ ID NO: 1545493 - protein, 13 aa, Mycobacterium tuberculosis
SGSPTPAPTTSGL

SEQ ID NO: 1545494 - protein, 10 aa, Mycobacterium tuberculosis
SGSTGEPKGV

SEQ ID NO: 1545495 - protein, 10 aa, Mycobacterium tuberculosis
SGSTGSPKAV

SEQ ID NO: 1545496 - protein, 8 aa, Mycobacterium tuberculosis
SGSVGAGR

SEQ ID NO: 1545497 - protein, 17 aa, Mycobacterium tuberculosis
SGTGNFGIGNSGTGNFG

SEQ ID NO: 1545498 - protein, 6 aa, Mycobacterium tuberculosis
SGTGNL

SEQ ID NO: 1545499 - protein, 15 aa, Mycobacterium tuberculosis
SGTGNVGIGNTGTAN

SEQ ID NO: 1545500 - protein, 5 aa, Mycobacterium tuberculosis
SGTNN

SEQ ID NO: 1545501 - protein, 5 aa, Mycobacterium tuberculosis
SGTQL

SEQ ID NO: 1545502 - protein, 8 aa, Mycobacterium tuberculosis
SGTSYAAG

SEQ ID NO: 1545503 - protein, 7 aa, Mycobacterium tuberculosis
SGTTNTG

SEQ ID NO: 1545504 - protein, 16 aa, Mycobacterium tuberculosis
SGTTNTGIGNSGGNLV

SEQ ID NO: 1545505 - protein, 9 aa, Mycobacterium tuberculosis
SGVANVGNT

SEQ ID NO: 1545506 - protein, 4 aa, Mycobacterium tuberculosis
SGVS

SEQ ID NO: 1545507 - protein, 6 aa, Mycobacterium tuberculosis
SGVSGI

SEQ ID NO: 1545508 - protein, 8 aa, Mycobacterium tuberculosis
SHAESDAL

SEQ ID NO: 1545509 - protein, 13 aa, Mycobacterium tuberculosis
SHAGGAAGHRNPG

SEQ ID NO: 1545510 - protein, 7 aa, Mycobacterium tuberculosis
SHGGVGG

SEQ ID NO: 1545511 - protein, 7 aa, Mycobacterium tuberculosis
SHPKGAV

SEQ ID NO: 1545512 - protein, 5 aa, Mycobacterium tuberculosis
SHQYP

SEQ ID NO: 1545513 - protein, 7 aa, Mycobacterium tuberculosis
SHSPQVD

SEQ ID NO: 1545514 - protein, 14 aa, Mycobacterium tuberculosis
SHTASPKLPERKRG

SEQ ID NO: 1545515 - protein, 19 aa, Mycobacterium tuberculosis
SISAARLTGAAGSQAISDS

SEQ ID NO: 1545516 - protein, 18 aa, Mycobacterium tuberculosis
SKEAVGSGTAAGSAGAAG

SEQ ID NO: 1545517 - protein, 7 aa, Mycobacterium tuberculosis
SKIRGRE

SEQ ID NO: 1545518 - protein, 8 aa, Mycobacterium tuberculosis
SKSPHWTG

SEQ ID NO: 1545519 - protein, 19 aa, Mycobacterium tuberculosis
SKTTGDPAIPGQPPPVAND

SEQ ID NO: 1545520 - protein, 11 aa, Mycobacterium tuberculosis
SLAGKDELTGK

SEQ ID NO: 1545521 - protein, 4 aa, Mycobacterium tuberculosis
SLAP

SEQ ID NO: 1545522 - protein, 4 aa, Mycobacterium tuberculosis
SLDG

SEQ ID NO: 1545523 - protein, 10 aa, Mycobacterium tuberculosis
SLEPNAAPRT

SEQ ID NO: 1545524 - protein, 8 aa, Mycobacterium tuberculosis
SLGGPVSS

SEQ ID NO: 1545525 - protein, 6 aa, Mycobacterium tuberculosis
SLGSGR

SEQ ID NO: 1545526 - protein, 9 aa, Mycobacterium tuberculosis
SLGSSSDLR

SEQ ID NO: 1545527 - protein, 8 aa, Mycobacterium tuberculosis
SLNSGSNN

SEQ ID NO: 1545528 - protein, 4 aa, Mycobacterium tuberculosis
SLPP

SEQ ID NO: 1545529 - protein, 12 aa, Mycobacterium tuberculosis
SLRRTDKQKDSG

SEQ ID NO: 1545530 - protein, 4 aa, Mycobacterium tuberculosis
SMEP

SEQ ID NO: 1545531 - protein, 7 aa, Mycobacterium tuberculosis
SNAAGLG

SEQ ID NO: 1545532 - protein, 10 aa, Mycobacterium tuberculosis
SNDEVTYRAT

SEQ ID NO: 1545533 - protein, 7 aa, Mycobacterium tuberculosis
SNGAGTV

SEQ ID NO: 1545534 - protein, 7 aa, Mycobacterium tuberculosis
SNGIGSD

SEQ ID NO: 1545535 - protein, 10 aa, Mycobacterium tuberculosis
SNLGGGNVGL

SEQ ID NO: 1545536 - protein, 5 aa, Mycobacterium tuberculosis
SNPGF

SEQ ID NO: 1545537 - protein, 5 aa, Mycobacterium tuberculosis
SNPQF

SEQ ID NO: 1545538 - protein, 7 aa, Mycobacterium tuberculosis
SNQVPAT

SEQ ID NO: 1545539 - protein, 7 aa, Mycobacterium tuberculosis
SNRSHTA

SEQ ID NO: 1545540 - protein, 6 aa, Mycobacterium tuberculosis
SPAEFE

SEQ ID NO: 1545541 - protein, 5 aa, Mycobacterium tuberculosis
SPAKA

SEQ ID NO: 1545542 - protein, 4 aa, Mycobacterium tuberculosis
SPAQ

SEQ ID NO: 1545543 - protein, 7 aa, Mycobacterium tuberculosis
SPAQIAD

SEQ ID NO: 1545544 - protein, 7 aa, Mycobacterium tuberculosis
SPAYNDQ

SEQ ID NO: 1545545 - protein, 7 aa, Mycobacterium tuberculosis
SPDPGPV

SEQ ID NO: 1545546 - protein, 6 aa, Mycobacterium tuberculosis
SPELTP

SEQ ID NO: 1545547 - protein, 11 aa, Mycobacterium tuberculosis
SPFGPGPTRTC

SEQ ID NO: 1545548 - protein, 6 aa, Mycobacterium tuberculosis
SPFSKP

SEQ ID NO: 1545549 - protein, 8 aa, Mycobacterium tuberculosis
SPIAEGAV

SEQ ID NO: 1545550 - protein, 17 aa, Mycobacterium tuberculosis
SPKNPDNWTFTPNGPPV

SEQ ID NO: 1545551 - protein, 11 aa, Mycobacterium tuberculosis
SPKSLTGNQTD

SEQ ID NO: 1545552 - protein, 20 aa, Mycobacterium tuberculosis
SPLGGSASSLAAIPGASVPQ

SEQ ID NO: 1545553 - protein, 5 aa, Mycobacterium tuberculosis
SPLRD

SEQ ID NO: 1545554 - protein, 9 aa, Mycobacterium tuberculosis
SPPLHGPTA

SEQ ID NO: 1545555 - protein, 11 aa, Mycobacterium tuberculosis
SPPLPLPPPPL

SEQ ID NO: 1545556 - protein, 5 aa, Mycobacterium tuberculosis
SPPQL

SEQ ID NO: 1545557 - protein, 7 aa, Mycobacterium tuberculosis
SPPRTAR

SEQ ID NO: 1545558 - protein, 21 aa, Mycobacterium tuberculosis
SPPTIDPGALPPDGPPGPLAP

SEQ ID NO: 1545559 - protein, 14 aa, Mycobacterium tuberculosis
SPQSTVIGGATQTV

SEQ ID NO: 1545560 - protein, 21 aa, Mycobacterium tuberculosis
SPRDRIPGTAAAYPAAFPVGM

SEQ ID NO: 1545561 - protein, 15 aa, Mycobacterium tuberculosis
SPRDRIQGTAAAYPA

SEQ ID NO: 1545562 - protein, 7 aa, Mycobacterium tuberculosis
SPSPIPT

SEQ ID NO: 1545563 - protein, 19 aa, Mycobacterium tuberculosis
SPTRRIDDSYANGYANSKW

SEQ ID NO: 1545564 - protein, 8 aa, Mycobacterium tuberculosis
SPTSGSGC

SEQ ID NO: 1545565 - protein, 12 aa, Mycobacterium tuberculosis
SPTTLPGPGSRS

SEQ ID NO: 1545566 - protein, 9 aa, Mycobacterium tuberculosis
SPVAEQRRA

SEQ ID NO: 1545567 - protein, 10 aa, Mycobacterium tuberculosis
SQAQQGGQQH

SEQ ID NO: 1545568 - protein, 9 aa, Mycobacterium tuberculosis
SQDRPGRHP

SEQ ID NO: 1545569 - protein, 13 aa, Mycobacterium tuberculosis
SQFDGYTSGAAKD

SEQ ID NO: 1545570 - protein, 10 aa, Mycobacterium tuberculosis
SQIAERDQAI

SEQ ID NO: 1545571 - protein, 6 aa, Mycobacterium tuberculosis
SQLHDT

SEQ ID NO: 1545572 - protein, 8 aa, Mycobacterium tuberculosis
SQPGGPLK

SEQ ID NO: 1545573 - protein, 7 aa, Mycobacterium tuberculosis
SQTSRSA

SEQ ID NO: 1545574 - protein, 6 aa, Mycobacterium tuberculosis
SQVDLT

SEQ ID NO: 1545575 - protein, 19 aa, Mycobacterium tuberculosis
SRCAGSASCRHRSSRPVRR

SEQ ID NO: 1545576 - protein, 8 aa, Mycobacterium tuberculosis
SRDNTGDV

SEQ ID NO: 1545577 - protein, 5 aa, Mycobacterium tuberculosis
SREPI

SEQ ID NO: 1545578 - protein, 29 aa, Mycobacterium tuberculosis
SRGDPDAAPGDSRRSRGPGGTAGPVDPPA

SEQ ID NO: 1545579 - protein, 4 aa, Mycobacterium tuberculosis
SRLP

SEQ ID NO: 1545580 - protein, 6 aa, Mycobacterium tuberculosis
SRLPDQ

SEQ ID NO: 1545581 - protein, 13 aa, Mycobacterium tuberculosis
SRNSSSPPTKLPE

SEQ ID NO: 1545582 - protein, 14 aa, Mycobacterium tuberculosis
SRNSSSPPTKLPED

SEQ ID NO: 1545583 - protein, 15 aa, Mycobacterium tuberculosis
SRPPVPPAPPAPPVP

SEQ ID NO: 1545584 - protein, 31 aa, Mycobacterium tuberculosis
SRPSLERPSPHPSRESEWPRPRPDLRPPSRL

SEQ ID NO: 1545585 - protein, 15 aa, Mycobacterium tuberculosis
SRRGPLSHILLSNCV

SEQ ID NO: 1545586 - protein, 6 aa, Mycobacterium tuberculosis
SRRNPV

SEQ ID NO: 1545587 - protein, 7 aa, Mycobacterium tuberculosis
SRTELSS

SEQ ID NO: 1545588 - protein, 9 aa, Mycobacterium tuberculosis
SRTNGIADP

SEQ ID NO: 1545589 - protein, 8 aa, Mycobacterium tuberculosis
SRTNGPCR

SEQ ID NO: 1545590 - protein, 8 aa, Mycobacterium tuberculosis
SRTSGASL

SEQ ID NO: 1545591 - protein, 9 aa, Mycobacterium tuberculosis
SSAGAYPKR

SEQ ID NO: 1545592 - protein, 15 aa, Mycobacterium tuberculosis
SSCPTTPGDHRRRAP

SEQ ID NO: 1545593 - protein, 11 aa, Mycobacterium tuberculosis
SSCSQGDAPLG

SEQ ID NO: 1545594 - protein, 15 aa, Mycobacterium tuberculosis
SSEGSRQNNAATPAT

SEQ ID NO: 1545595 - protein, 13 aa, Mycobacterium tuberculosis
SSGDGGAGGAGGV

SEQ ID NO: 1545596 - protein, 6 aa, Mycobacterium tuberculosis
SSGDLS

SEQ ID NO: 1545597 - protein, 20 aa, Mycobacterium tuberculosis
SSGQAPSTVAASGPLPTADR

SEQ ID NO: 1545598 - protein, 4 aa, Mycobacterium tuberculosis
SSGT

SEQ ID NO: 1545599 - protein, 21 aa, Mycobacterium tuberculosis
SSGTSGLVPQPSTTPPSPTRR

SEQ ID NO: 1545600 - protein, 5 aa, Mycobacterium tuberculosis
SSICP

SEQ ID NO: 1545601 - protein, 17 aa, Mycobacterium tuberculosis
SSLSGKAGAGGAGGSAG

SEQ ID NO: 1545602 - protein, 7 aa, Mycobacterium tuberculosis
SSPAGAA

SEQ ID NO: 1545603 - protein, 22 aa, Mycobacterium tuberculosis
SSPATGPSCSAGSTGRRRSQHS

SEQ ID NO: 1545604 - protein, 14 aa, Mycobacterium tuberculosis
SSPMAADQQTAGPL

SEQ ID NO: 1545605 - protein, 5 aa, Mycobacterium tuberculosis
SSQAF

SEQ ID NO: 1545606 - protein, 5 aa, Mycobacterium tuberculosis
SSQLD

SEQ ID NO: 1545607 - protein, 28 aa, Mycobacterium tuberculosis
SSTANPPAATTTPATATTTTATSGPTAA

SEQ ID NO: 1545608 - protein, 19 aa, Mycobacterium tuberculosis
SSTGAPPPKKSREQRVREN

SEQ ID NO: 1545609 - protein, 14 aa, Mycobacterium tuberculosis
SSTGAPPPKKVGNS

SEQ ID NO: 1545610 - protein, 8 aa, Mycobacterium tuberculosis
SSTRGATV

SEQ ID NO: 1545611 - protein, 5 aa, Mycobacterium tuberculosis
STAAL

SEQ ID NO: 1545612 - protein, 18 aa, Mycobacterium tuberculosis
STAAPATTAGATALEGSG

SEQ ID NO: 1545613 - protein, 7 aa, Mycobacterium tuberculosis
STADEGA

SEQ ID NO: 1545614 - protein, 17 aa, Mycobacterium tuberculosis
STAKPGAAGRHASTLER

SEQ ID NO: 1545615 - protein, 14 aa, Mycobacterium tuberculosis
STGGEGICLGRGRR

SEQ ID NO: 1545616 - protein, 4 aa, Mycobacterium tuberculosis
STGL

SEQ ID NO: 1545617 - protein, 7 aa, Mycobacterium tuberculosis
STLATQR

SEQ ID NO: 1545618 - protein, 35 aa, Mycobacterium tuberculosis; identical to SEQ ID NO: 193325

SEQ ID NO: 1545619 - protein, 21 aa, Mycobacterium tuberculosis
STPERVAGGTCSAGQQCDRLA

SEQ ID NO: 1545620 - protein, 27 aa, Mycobacterium tuberculosis
STPERVAGGTCSAGQQCDRLAAVLMPD

SEQ ID NO: 1545621 - protein, 9 aa, Mycobacterium tuberculosis
STTAGVAAS

SEQ ID NO: 1545622 - protein, 13 aa, Mycobacterium tuberculosis
STTARKAANLRSD

SEQ ID NO: 1545623 - protein, 4 aa, Mycobacterium tuberculosis
STTH

SEQ ID NO: 1545624 - protein, 13 aa, Mycobacterium tuberculosis
STYGVPVSSAQGY

SEQ ID NO: 1545625 - protein, 4 aa, Mycobacterium tuberculosis
SVDR

SEQ ID NO: 1545626 - protein, 42 aa, Mycobacterium tuberculosis; identical to SEQ ID NO: 231426

SEQ ID NO: 1545627 - protein, 5 aa, Mycobacterium tuberculosis
SVGQQ

SEQ ID NO: 1545628 - protein, 37 aa, Mycobacterium tuberculosis
SVNGGDGGAGGGGGGRFGSGSGAGGDGAVGGAGGAGA

SEQ ID NO: 1545629 - protein, 9 aa, Mycobacterium tuberculosis
SVNTDTAPL

SEQ ID NO: 1545630 - protein, 27 aa, Mycobacterium tuberculosis
SVNTDTAPLVQSTRGEGSSTCNVAGIT

SEQ ID NO: 1545631 - protein, 5 aa, Mycobacterium tuberculosis
SVPGA

SEQ ID NO: 1545632 - protein, 5 aa, Mycobacterium tuberculosis
SVSAC

SEQ ID NO: 1545633 - protein, 25 aa, Mycobacterium tuberculosis
SYFGTGGGGGVGGDGAPGGDGGAGP

SEQ ID NO: 1545634 - protein, 12 aa, Mycobacterium tuberculosis
SYGGPGTIPGPF

SEQ ID NO: 1545635 - protein, 23 aa, Mycobacterium tuberculosis
SYNTGSFNAGDTNTGGFNPGGVN

SEQ ID NO: 1545636 - protein, 12 aa, Mycobacterium tuberculosis
SYRDPAAASPVS

SEQ ID NO: 1545637 - protein, 13 aa, Mycobacterium tuberculosis
TAAAATAAVAPPR

SEQ ID NO: 1545638 - protein, 18 aa, Mycobacterium tuberculosis
TAAAGAPQPGGTARTAVT

SEQ ID NO: 1545639 - protein, 10 aa, Mycobacterium tuberculosis
TAAATDIDGI

SEQ ID NO: 1545640 - protein, 15 aa, Mycobacterium tuberculosis
TAAEASAAANGRSLP

SEQ ID NO: 1545641 - protein, 9 aa, Mycobacterium tuberculosis
TAAGSAVSA

SEQ ID NO: 1545642 - protein, 7 aa, Mycobacterium tuberculosis
TAAPAVP

SEQ ID NO: 1545643 - protein, 8 aa, Mycobacterium tuberculosis
TAAPPVSR

SEQ ID NO: 1545644 - protein, 17 aa, Mycobacterium tuberculosis
TAAQTKQTATQARAAAA

SEQ ID NO: 1545645 - protein, 13 aa, Mycobacterium tuberculosis
TAATAATAHPAAS

SEQ ID NO: 1545646 - protein, 6 aa, Mycobacterium tuberculosis
TAATAV

SEQ ID NO: 1545647 - protein, 18 aa, Mycobacterium tuberculosis
TAATAVSATLAKTGVGTG

SEQ ID NO: 1545648 - protein, 8 aa, Mycobacterium tuberculosis
TADGLDGD

SEQ ID NO: 1545649 - protein, 7 aa, Mycobacterium tuberculosis
TADPANR

SEQ ID NO: 1545650 - protein, 31 aa, Mycobacterium tuberculosis; identical to SEQ ID NO: 1373056

SEQ ID NO: 1545651 - protein, 36 aa, Mycobacterium tuberculosis; identical to SEQ ID NO: 1421741

SEQ ID NO: 1545652 - protein, 8 aa, Mycobacterium tuberculosis
TAERGGQV

SEQ ID NO: 1545653 - protein, 23 aa, Mycobacterium tuberculosis
TAGKGGTGGVGGDGGGGAGGGGG

SEQ ID NO: 1545654 - protein, 26 aa, Mycobacterium tuberculosis
TAGPAGPAAGPGCGAPAGPAEPAVTA

SEQ ID NO: 1545655 - protein, 13 aa, Mycobacterium tuberculosis
TAGPGSAWQGPAA

SEQ ID NO: 1545656 - protein, 13 aa, Mycobacterium tuberculosis
TAGQAEQAGMQAR

SEQ ID NO: 1545657 - protein, 21 aa, Mycobacterium tuberculosis
TAGRAGPAAPAASVPAEPAAS

SEQ ID NO: 1545658 - protein, 12 aa, Mycobacterium tuberculosis
TAGSGGAGGTGG

SEQ ID NO: 1545659 - protein, 5 aa, Mycobacterium tuberculosis
TAGTE

SEQ ID NO: 1545660 - protein, 8 aa, Mycobacterium tuberculosis
TAHHPPAG

SEQ ID NO: 1545661 - protein, 720 aa, Mycobacterium tuberculosis
TAKAGDGGAAGNGGNGGAGGAGGAGDNNFNGGQGGAGGQGGQGGLGGASTTSINANGGAGGNGGTGGKGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGQGGDGGQGGIGGAGANAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGTGDGF

SEQ ID NO: 1545662 - protein, 11 aa, Mycobacterium tuberculosis
TAKRGAQITQA

SEQ ID NO: 1545663 - protein, 8 aa, Mycobacterium tuberculosis
TALGRQTP

SEQ ID NO: 1545664 - protein, 121 aa, Mycobacterium tuberculosis
TANCRSPAGGGTRAAGATVAAGTTDAADATGAADTAGTPATTKPDERPSRPAVAADTAAATHTAGTADTAEAPQTAGAAFRGTRTVGETLSARAADTAREAGGATTTGAARPAGPTGAAVA

SEQ ID NO: 1545665 - protein, 9 aa, Mycobacterium tuberculosis
TAPALTPAD

SEQ ID NO: 1545666 - protein, 13 aa, Mycobacterium tuberculosis
TAPAVPNGQPVKG

SEQ ID NO: 1545667 - protein, 10 aa, Mycobacterium tuberculosis
TAPERAPSME

SEQ ID NO: 1545668 - protein, 9 aa, Mycobacterium tuberculosis
TAPVHEGDT

SEQ ID NO: 1545669 - protein, 7 aa, Mycobacterium tuberculosis
TAQRDRA

SEQ ID NO: 1545670 - protein, 9 aa, Mycobacterium tuberculosis
TARAAGVAE

SEQ ID NO: 1545671 - protein, 16 aa, Mycobacterium tuberculosis
TARAEGAAAGAKAAAA

SEQ ID NO: 1545672 - protein, 8 aa, Mycobacterium tuberculosis
TARREAVA

SEQ ID NO: 1545673 - protein, 71 aa, Mycobacterium tuberculosis
TARRPNARGAGHTGLTTAPAITPATGGTAQPGATGDAEQVARPARAARAAVSAGAAVTADPAVTPVTSVTP

SEQ ID NO: 1545674 - protein, 25 aa, Mycobacterium tuberculosis
TASAAGPEVPAATAATAPSAALAET

SEQ ID NO: 1545675 - protein, 16 aa, Mycobacterium tuberculosis
TASGDNASGSGRPWDG

SEQ ID NO: 1545676 - protein, 16 aa, Mycobacterium tuberculosis
TASGDNASGSGRPWDR

SEQ ID NO: 1545677 - protein, 8 aa, Mycobacterium tuberculosis
TASGHTPA

SEQ ID NO: 1545678 - protein, 8 aa, Mycobacterium tuberculosis
TASLAAGT

SEQ ID NO: 1545679 - protein, 8 aa, Mycobacterium tuberculosis
TASWPRSS

SEQ ID NO: 1545680 - protein, 13 aa, Mycobacterium tuberculosis
TATASEAKPITAK

SEQ ID NO: 1545681 - protein, 5 aa, Mycobacterium tuberculosis
TATER

SEQ ID NO: 1545682 - protein, 7 aa, Mycobacterium tuberculosis
TATIDGQ

SEQ ID NO: 1545683 - protein, 7 aa, Mycobacterium tuberculosis
TATPRAY

SEQ ID NO: 1545684 - protein, 15 aa, Mycobacterium tuberculosis
TATRRVNTIAELARR

SEQ ID NO: 1545685 - protein, 11 aa, Mycobacterium tuberculosis
TAVANRSGTEP

SEQ ID NO: 1545686 - protein, 4 aa, Mycobacterium tuberculosis
TAVT

SEQ ID NO: 1545687 - protein, 9 aa, Mycobacterium tuberculosis
TDAPDDPVI

SEQ ID NO: 1545688 - protein, 15 aa, Mycobacterium tuberculosis
TDGATERYQGARRMG

SEQ ID NO: 1545689 - protein, 10 aa, Mycobacterium tuberculosis
TDGDQGGGNP

SEQ ID NO: 1545690 - protein, 6 aa, Mycobacterium tuberculosis
TDPNVS

SEQ ID NO: 1545691 - protein, 15 aa, Mycobacterium tuberculosis
TDPSGASLAYSGDTG

SEQ ID NO: 1545692 - protein, 16 aa, Mycobacterium tuberculosis
TDRVDPNSPLSWPRCS

SEQ ID NO: 1545693 - protein, 34 aa, Mycobacterium tuberculosis
TDSAPTTSPTTTSPTTSTTTTSSTTSAQAAGPNY

SEQ ID NO: 1545694 - protein, 11 aa, Mycobacterium tuberculosis
TDSARARTVGR

SEQ ID NO: 1545695 - protein, 10 aa, Mycobacterium tuberculosis
TDSGKIDRAE

SEQ ID NO: 1545696 - protein, 12 aa, Mycobacterium tuberculosis
TDVGTDSATYAR

SEQ ID NO: 1545697 - protein, 7 aa, Mycobacterium tuberculosis
TELGGQP

SEQ ID NO: 1545698 - protein, 4 aa, Mycobacterium tuberculosis
TEQQ

SEQ ID NO: 1545699 - protein, 12 aa, Mycobacterium tuberculosis
TERRQNHAARQR

SEQ ID NO: 1545700 - protein, 9 aa, Mycobacterium tuberculosis
TESTTVPMA

SEQ ID NO: 1545701 - protein, 6 aa, Mycobacterium tuberculosis
TETDDR

SEQ ID NO: 1545702 - protein, 7 aa, Mycobacterium tuberculosis
TFDSGDP

SEQ ID NO: 1545703 - protein, 5 aa, Mycobacterium tuberculosis
TFGST

SEQ ID NO: 1545704 - protein, 42 aa, Mycobacterium tuberculosis
TFSGSARTTRSTASAIRSRSRTQTQTSSCRWPNSSTSTSARS

SEQ ID NO: 1545705 - protein, 9 aa, Mycobacterium tuberculosis
TGAATEDDA

SEQ ID NO: 1545706 - protein, 6 aa, Mycobacterium tuberculosis
TGAGGA

SEQ ID NO: 1545707 - protein, 17 aa, Mycobacterium tuberculosis
TGAGGASGFGNFGGANS

SEQ ID NO: 1545708 - protein, 12 aa, Mycobacterium tuberculosis
TGAGGGSGIGNL

SEQ ID NO: 1545709 - protein, 9 aa, Mycobacterium tuberculosis
TGAGGVSGF

SEQ ID NO: 1545710 - protein, 18 aa, Mycobacterium tuberculosis
TGAGTASGFGNVGGNTSG

SEQ ID NO: 1545711 - protein, 34 aa, Mycobacterium tuberculosis; identical to SEQ ID NO: 154443

SEQ ID NO: 1545712 - protein, 10 aa, Mycobacterium tuberculosis
TGAWQGPSAA

SEQ ID NO: 1545713 - protein, 7 aa, Mycobacterium tuberculosis
TGDFGAQ

SEQ ID NO: 1545714 - protein, 12 aa, Mycobacterium tuberculosis
TGDHQAAKGDGD

SEQ ID NO: 1545715 - protein, 8 aa, Mycobacterium tuberculosis
TGDSNLGI

SEQ ID NO: 1545716 - protein, 15 aa, Mycobacterium tuberculosis
TGDYNTGMANTGNIN

SEQ ID NO: 1545717 - protein, 16 aa, Mycobacterium tuberculosis
TGDYNTGVANTGNVNT

SEQ ID NO: 1545718 - protein, 5 aa, Mycobacterium tuberculosis
TGEAV

SEQ ID NO: 1545719 - protein, 9 aa, Mycobacterium tuberculosis
TGFGNGNSV

SEQ ID NO: 1545720 - protein, 12 aa, Mycobacterium tuberculosis
TGFGNSGAGNTG

SEQ ID NO: 1545721 - protein, 5 aa, Mycobacterium tuberculosis
TGFPE

SEQ ID NO: 1545722 - protein, 24 aa, Mycobacterium tuberculosis
TGGAGGAGGFGGFGGDGGDGGIGG

SEQ ID NO: 1545723 - protein, 31 aa, Mycobacterium tuberculosis; identical to SEQ ID NO: 189388

SEQ ID NO: 1545724 - protein, 4 aa, Mycobacterium tuberculosis
TGGE

SEQ ID NO: 1545725 - protein, 28 aa, Mycobacterium tuberculosis
TGGHGGDGGAGGAAVKGGDGGGGAAGPA

SEQ ID NO: 1545726 - protein, 56 aa, Mycobacterium tuberculosis
TGGHGGDGGAGGAAVKGGDSGAAAGTGIAGAGGRGGAGGSGGSGGDGGGRGRRPRR

SEQ ID NO: 1545727 - protein, 8 aa, Mycobacterium tuberculosis
TGGPNGVG

SEQ ID NO: 1545728 - protein, 8 aa, Mycobacterium tuberculosis
TGGPSSGF

SEQ ID NO: 1545729 - protein, 26 aa, Mycobacterium tuberculosis
TGGTGGASDLAGTGRGGVGGAGGNGG

SEQ ID NO: 1545730 - protein, 5 aa, Mycobacterium tuberculosis
TGHSE

SEQ ID NO: 1545731 - protein, 11 aa, Mycobacterium tuberculosis
TGIANTGDVDT

SEQ ID NO: 1545732 - protein, 6 aa, Mycobacterium tuberculosis
TGIAPG

SEQ ID NO: 1545733 - protein, 38 aa, Mycobacterium tuberculosis
TGIDPSHAAGPAPAVAPTVTPPVAAPPASAPAPAPDAA

SEQ ID NO: 1545734 - protein, 63 aa, Mycobacterium tuberculosis
TGIDPSHAAGPAPAVAPTVTPPVAAPPASAPAPAPDAAQPVAVPGPPPAPASGFGADAPPTQD

SEQ ID NO: 1545735 - protein, 64 aa, Mycobacterium tuberculosis
TGIDPSHAAGPAPAVAPTVTPPVAAPPASAPAPAPDAAQPVAVPGPPPAPPAPRAAAPAPASAA

SEQ ID NO: 1545736 - protein, 96 aa, Mycobacterium tuberculosis
TGIDPSHAAGPAPAVAPTVTPPVAAPPASAPAPAPDAAQPVAVPGPPPAPPAPRAAAPAPASAAPAPAAALAPASGFGRRRSAHTGTSWYPFDSGL

SEQ ID NO: 1545737 - protein, 17 aa, Mycobacterium tuberculosis
TGIGGPASARCSATPPA

SEQ ID NO: 1545738 - protein, 15 aa, Mycobacterium tuberculosis
TGKTPVSKDDAQQHA

SEQ ID NO: 1545739 - protein, 4 aa, Mycobacterium tuberculosis
TGLG

SEQ ID NO: 1545740 - protein, 13 aa, Mycobacterium tuberculosis
TGLRGKTRAQPGC

SEQ ID NO: 1545741 - protein, 6 aa, Mycobacterium tuberculosis
TGNDSN

SEQ ID NO: 1545742 - protein, 6 aa, Mycobacterium tuberculosis
TGNGQI

SEQ ID NO: 1545743 - protein, 6 aa, Mycobacterium tuberculosis
TGPEVT

SEQ ID NO: 1545744 - protein, 12 aa, Mycobacterium tuberculosis
TGPGDVPPQNIR

SEQ ID NO: 1545745 - protein, 10 aa, Mycobacterium tuberculosis
TGPGPGTTGE

SEQ ID NO: 1545746 - protein, 9 aa, Mycobacterium tuberculosis
TGPRPGGFG

SEQ ID NO: 1545747 - protein, 18 aa, Mycobacterium tuberculosis
TGPRRGGPDPDRGQPGHV

SEQ ID NO: 1545748 - protein, 16 aa, Mycobacterium tuberculosis
TGPSPTIVAMKNGWRI

SEQ ID NO: 1545749 - protein, 8 aa, Mycobacterium tuberculosis
TGQAGELP

SEQ ID NO: 1545750 - protein, 6 aa, Mycobacterium tuberculosis
TGSEAD

SEQ ID NO: 1545751 - protein, 5 aa, Mycobacterium tuberculosis
TGSTG

SEQ ID NO: 1545752 - protein, 7 aa, Mycobacterium tuberculosis
TGTDKPG

SEQ ID NO: 1545753 - protein, 5 aa, Mycobacterium tuberculosis
TGTGE

SEQ ID NO: 1545754 - protein, 7 aa, Mycobacterium tuberculosis
TGTGGAS

SEQ ID NO: 1545755 - protein, 8 aa, Mycobacterium tuberculosis
TGTRNTGA

SEQ ID NO: 1545756 - protein, 13 aa, Mycobacterium tuberculosis
TGYPVRGKAWPVR

SEQ ID NO: 1545757 - protein, 4 aa, Mycobacterium tuberculosis
THDP

SEQ ID NO: 1545758 - protein, 168 aa, Mycobacterium tuberculosis
THKRPIKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKRKKTKKQKTKKKKKKKKKKKNKTKKKKKKR

SEQ ID NO: 1545759 - protein, 8 aa, Mycobacterium tuberculosis
THSPARDF

SEQ ID NO: 1545760 - protein, 5 aa, Mycobacterium tuberculosis
THSPD

SEQ ID NO: 1545761 - protein, 7 aa, Mycobacterium tuberculosis
THSSGRI

SEQ ID NO: 1545762 - protein, 5 aa, Mycobacterium tuberculosis
THTSG

SEQ ID NO: 1545763 - protein, 15 aa, Mycobacterium tuberculosis
THTTRPATCSQEHSY

SEQ ID NO: 1545764 - protein, 7 aa, Mycobacterium tuberculosis
TIPAQTR

SEQ ID NO: 1545765 - protein, 19 aa, Mycobacterium tuberculosis
TIPGPPAQPYLGPHPRPMH

SEQ ID NO: 1545766 - protein, 14 aa, Mycobacterium tuberculosis
TIPTTETPPPPQTV

SEQ ID NO: 1545767 - protein, 11 aa, Mycobacterium tuberculosis
TKAELPQAVPH

SEQ ID NO: 1545768 - protein, 18 aa, Mycobacterium tuberculosis
TKSHSRPHTSNDNPLSEA

SEQ ID NO: 1545769 - protein, 10 aa, Mycobacterium tuberculosis
TLAKTGVGTG

SEQ ID NO: 1545770 - protein, 9 aa, Mycobacterium tuberculosis
TLGAGTPAV

SEQ ID NO: 1545771 - protein, 60 aa, Mycobacterium tuberculosis; identical to SEQ ID NO: 232462

SEQ ID NO: 1545772 - protein, 60 aa, Mycobacterium tuberculosis
TLGSPGADGGMGGNGGKGGDGGGGGTGGTAVAGTAGKAGDGGAGGDGGKAGDGGAGAAGD

SEQ ID NO: 1545773 - protein, 7 aa, Mycobacterium tuberculosis
TLNTTPA

SEQ ID NO: 1545774 - protein, 14 aa, Mycobacterium tuberculosis
TLPPGATTGDARAE

SEQ ID NO: 1545775 - protein, 7 aa, Mycobacterium tuberculosis
TLRSSPP

SEQ ID NO: 1545776 - protein, 15 aa, Mycobacterium tuberculosis
TLTSKTDPASGAGLA

SEQ ID NO: 1545777 - protein, 5 aa, Mycobacterium tuberculosis
TMRSD

SEQ ID NO: 1545778 - protein, 5 aa, Mycobacterium tuberculosis
TNGAR

SEQ ID NO: 1545779 - protein, 12 aa, Mycobacterium tuberculosis
TNPAAEQPAATL

SEQ ID NO: 1545780 - protein, 5 aa, Mycobacterium tuberculosis
TPAFG

SEQ ID NO: 1545781 - protein, 8 aa, Mycobacterium tuberculosis
TPAGTADS

SEQ ID NO: 1545782 - protein, 6 aa, Mycobacterium tuberculosis
TPAITT

SEQ ID NO: 1545783 - protein, 65 aa, Mycobacterium tuberculosis
TPALNGSAGANGTAPTSGGNGGNGGAGATPTVAGENGGAGGNGGHGGSVGNGGAGGAGGNGVAGT

SEQ ID NO: 1545784 - protein, 20 aa, Mycobacterium tuberculosis
TPARATSGSGWSGTIGPGSG

SEQ ID NO: 1545785 - protein, 4 aa, Mycobacterium tuberculosis
TPDN

SEQ ID NO: 1545786 - protein, 14 aa, Mycobacterium tuberculosis
TPDPEPDPSATHAP

SEQ ID NO: 1545787 - protein, 5 aa, Mycobacterium tuberculosis
TPDQP

SEQ ID NO: 1545788 - protein, 7 aa, Mycobacterium tuberculosis
TPEHTAR

SEQ ID NO: 1545789 - protein, 6 aa, Mycobacterium tuberculosis
TPGDLE

SEQ ID NO: 1545790 - protein, 12 aa, Mycobacterium tuberculosis
TPGFGNSTGGLS

SEQ ID NO: 1545791 - protein, 12 aa, Mycobacterium tuberculosis
TPGVEGHPYRQR

SEQ ID NO: 1545792 - protein, 27 aa, Mycobacterium tuberculosis
TPQQPAGPARLPGSRRPVGTVADQRAP

SEQ ID NO: 1545793 - protein, 4 aa, Mycobacterium tuberculosis
TPRA

SEQ ID NO: 1545794 - protein, 6 aa, Mycobacterium tuberculosis
TPRAVA

SEQ ID NO: 1545795 - protein, 6 aa, Mycobacterium tuberculosis
TPRPQL

SEQ ID NO: 1545796 - protein, 6 aa, Mycobacterium tuberculosis
TPRRPA

SEQ ID NO: 1545797 - protein, 5 aa, Mycobacterium tuberculosis
TPTAL

SEQ ID NO: 1545798 - protein, 4 aa, Mycobacterium tuberculosis
TPTM

SEQ ID NO: 1545799 - protein, 8 aa, Mycobacterium tuberculosis
TPTPGAAQ

SEQ ID NO: 1545800 - protein, 8 aa, Mycobacterium tuberculosis
TPTSAGTK

SEQ ID NO: 1545801 - protein, 22 aa, Mycobacterium tuberculosis
TPTSGPSAVYSPASGELVGPDG

SEQ ID NO: 1545802 - protein, 21 aa, Mycobacterium tuberculosis
TPVANPQQVSVPEGGHRRPGP

SEQ ID NO: 1545803 - protein, 37 aa, Mycobacterium tuberculosis
TQGGDGTPGGAGVNGGNGGAGGAANGNPANTSIANAG

SEQ ID NO: 1545804 - protein, 69 aa, Mycobacterium tuberculosis
TQGGDGTPGGAGVNGGNGGAGGDANGNPANTSIANAGAGGNGAAGGDGGANGGAGGAGGQAASAGSSVG

SEQ ID NO: 1545805 - protein, 178 aa, Mycobacterium tuberculosis
  misc_feature (94)..(95): Xaa can be any naturally occurring amino acid
TQGGDGTPGGAGVNGGNGGAGGDANGNPANTSIANAGAGGNGAAGGDGGANGGAGGAGGQAASAGSSVGGDGGNGGAGGTGTNGHAGGAGGAGXXGGRGGWLVGNGGNGGNGGNGAAGGNGAIGGTGGAGGVPANQGGNSALGTQPVGGDGGDGGNGGTGGTGGRGGDGGSGGAGGAS

SEQ ID NO: 1545806 - protein, 49 aa, Mycobacterium tuberculosis
TQGGDGTPGGAGVNGGNGGAGGDANGNPANTSIANAGAGGNGARRAVDG

SEQ ID NO: 1545807 - protein, 14 aa, Mycobacterium tuberculosis
TQGNTTVVWIVVRP

SEQ ID NO: 1545808 - protein, 62 aa, Mycobacterium tuberculosis
TQPTPVQQAPVQPAPGPASARPAKRPSNRRPSNRRRFNRRRSSKRPSRQAPVQPPPFGTARS

SEQ ID NO: 1545809 - protein, 25 aa, Mycobacterium tuberculosis
TQPTPVQQAPVQPAPVSSARQQAPV

SEQ ID NO: 1545810 - protein, 4 aa, Mycobacterium tuberculosis
TQQQ

SEQ ID NO: 1545811 - protein, 16 aa, Mycobacterium tuberculosis
TRAAPAQARVPGPDPA

SEQ ID NO: 1545812 - protein, 44 aa, Mycobacterium tuberculosis; identical to SEQ ID NO: 1452026

SEQ ID NO: 1545813 - protein, 5 aa, Mycobacterium tuberculosis
TRDAV

SEQ ID NO: 1545814 - protein, 23 aa, Mycobacterium tuberculosis
TRGVTPSPTRLTAAGRAKLDHSY

SEQ ID NO: 1545815 - protein, 6 aa, Mycobacterium tuberculosis
TRINQE

SEQ ID NO: 1545816 - protein, 6 aa, Mycobacterium tuberculosis
TRLSGQ

SEQ ID NO: 1545817 - protein, 8 aa, Mycobacterium tuberculosis
TRLTADGQ

SEQ ID NO: 1545818 - protein, 5 aa, Mycobacterium tuberculosis
TRPWN

SEQ ID NO: 1545819 - protein, 12 aa, Mycobacterium tuberculosis
TRQRRRFNGGLV

SEQ ID NO: 1545820 - protein, 16 aa, Mycobacterium tuberculosis
TRRQQWSGRPGAALGE

SEQ ID NO: 1545821 - protein, 6 aa, Mycobacterium tuberculosis
TSAGPL

SEQ ID NO: 1545822 - protein, 7 aa, Mycobacterium tuberculosis
TSAGSDA

SEQ ID NO: 1545823 - protein, 12 aa, Mycobacterium tuberculosis
TSDLSTPAVNSG

SEQ ID NO: 1545824 - protein, 27 aa, Mycobacterium tuberculosis
TSEAFEPVGSQANPNDPNATPAAGSIR

SEQ ID NO: 1545825 - protein, 10 aa, Mycobacterium tuberculosis
TSGSPPEATS

SEQ ID NO: 1545826 - protein, 9 aa, Mycobacterium tuberculosis
TSHDGRYTR

SEQ ID NO: 1545827 - protein, 21 aa, Mycobacterium tuberculosis
TSLSGEPKPPPQKKPKLPPPA

SEQ ID NO: 1545828 - protein, 5 aa, Mycobacterium tuberculosis
TSPGS

SEQ ID NO: 1545829 - protein, 8 aa, Mycobacterium tuberculosis
TSPNPELR

SEQ ID NO: 1545830 - protein, 24 aa, Mycobacterium tuberculosis
TSPRSRNRSFGERLGRGETLQSAG

SEQ ID NO: 1545831 - protein, 15 aa, Mycobacterium tuberculosis
TSQPLPAPSPGKDCS

SEQ ID NO: 1545832 - protein, 13 aa, Mycobacterium tuberculosis
TSRGGHATGAAAA

SEQ ID NO: 1545833 - protein, 16 aa, Mycobacterium tuberculosis
TSRSHRASTSRGQRES

SEQ ID NO: 1545834 - protein, 21 aa, Mycobacterium tuberculosis
TSSCRRPSSPPTGEVDPDGAV

SEQ ID NO: 1545835 - protein, 8 aa, Mycobacterium tuberculosis
TSSGTPAM

SEQ ID NO: 1545836 - protein, 8 aa, Mycobacterium tuberculosis
TSSPIKGT

SEQ ID NO: 1545837 - protein, 4 aa, Mycobacterium tuberculosis
TSSS

SEQ ID NO: 1545838 - protein, 10 aa, Mycobacterium tuberculosis
TSTPHCRGSP

SEQ ID NO: 1545839 - protein, 6 aa, Mycobacterium tuberculosis
TSTRRA

SEQ ID NO: 1545840 - protein, 6 aa, Mycobacterium tuberculosis
TSYTGQ

SEQ ID NO: 1545841 - protein, 11 aa, Mycobacterium tuberculosis
TTADGRDPSST

SEQ ID NO: 1545842 - protein, 5 aa, Mycobacterium tuberculosis
TTAQI

SEQ ID NO: 1545843 - protein, 19 aa, Mycobacterium tuberculosis
TTASGGAGGAGGAGGMFTD

SEQ ID NO: 1545844 - protein, 10 aa, Mycobacterium tuberculosis
TTASNSPVVT

SEQ ID NO: 1545845 - protein, 6 aa, Mycobacterium tuberculosis
TTATRD

SEQ ID NO: 1545846 - protein, 19 aa, Mycobacterium tuberculosis
TTDGRSWSGARDDGQHNSG

SEQ ID NO: 1545847 - protein, 5 aa, Mycobacterium tuberculosis
TTGGI

SEQ ID NO: 1545848 - protein, 15 aa, Mycobacterium tuberculosis
TTGPAGAAVPAGPAV

SEQ ID NO: 1545849 - protein, 11 aa, Mycobacterium tuberculosis
TTIRPTGSPTC

SEQ ID NO: 1545850 - protein, 10 aa, Mycobacterium tuberculosis
TTKITGTIPA

SEQ ID NO: 1545851 - protein, 8 aa, Mycobacterium tuberculosis
TTPGKPPS

SEQ ID NO: 1545852 - protein, 5 aa, Mycobacterium tuberculosis
TTPPL

SEQ ID NO: 1545853 - protein, 7 aa, Mycobacterium tuberculosis
TTRGDGV

SEQ ID NO: 1545854 - protein, 11 aa, Mycobacterium tuberculosis
TTRKDPSTPKI

SEQ ID NO: 1545855 - protein, 6 aa, Mycobacterium tuberculosis
TTSFER

SEQ ID NO: 1545856 - protein, 5 aa, Mycobacterium tuberculosis
TTSGM

SEQ ID NO: 1545857 - protein, 28 aa, Mycobacterium tuberculosis
TTTAEQIASRADPWDPGSVVTDNSGRER

SEQ ID NO: 1545858 - protein, 15 aa, Mycobacterium tuberculosis
TTTGTADGDAASRWT

SEQ ID NO: 1545859 - protein, 12 aa, Mycobacterium tuberculosis
TTVNSRGATTTT

SEQ ID NO: 1545860 - protein, 7 aa, Mycobacterium tuberculosis
TVAPPAL

SEQ ID NO: 1545861 - protein, 8 aa, Mycobacterium tuberculosis
TVESPANA

SEQ ID NO: 1545862 - protein, 47 aa, Mycobacterium tuberculosis
TVGPAPARPAATAAEAATAAKASPEPAATVGPAGHPATAATVATAPV

SEQ ID NO: 1545863 - protein, 6 aa, Mycobacterium tuberculosis
TVGPAR

SEQ ID NO: 1545864 - protein, 9 aa, Mycobacterium tuberculosis
TVGPDAGGR

SEQ ID NO: 1545865 - protein, 5 aa, Mycobacterium tuberculosis
TVGQL

SEQ ID NO: 1545866 - protein, 4 aa, Mycobacterium tuberculosis
TVPE

SEQ ID NO: 1545867 - protein, 7 aa, Mycobacterium tuberculosis
TVPRGGV

SEQ ID NO: 1545868 - protein, 6 aa, Mycobacterium tuberculosis
TVSPAR

SEQ ID NO: 1545869 - protein, 23 aa, Mycobacterium tuberculosis
TVTSASACSSSPGTGTSAKITSH

SEQ ID NO: 1545870 - protein, 12 aa, Mycobacterium tuberculosis
TWESSPQQNPLN

SEQ ID NO: 1545871 - protein, 7 aa, Mycobacterium tuberculosis
TYDPANK

SEQ ID NO: 1545872 - protein, 35 aa, Mycobacterium tuberculosis
TYPGSAAATPQPSDNAAATKRQCRKGAPTIPYPQK

SEQ ID NO: 1545873 - protein, 5 aa, Mycobacterium tuberculosis
TYPGT

SEQ ID NO: 1545874 - protein, 4 aa, Mycobacterium tuberculosis
TYTT

SEQ ID NO: 1545875 - protein, 51 aa, Mycobacterium tuberculosis
VAADPARAADAADAPDAAGAAGGTGSHARAARPAGAPKSAGATLAAGTTVA

SEQ ID NO: 1545876 - protein, 11 aa, Mycobacterium tuberculosis
VAAGGDPPAVA

SEQ ID NO: 1545877 - protein, 6 aa, Mycobacterium tuberculosis
VADGDA

SEQ ID NO: 1545878 - protein, 28 aa, Mycobacterium tuberculosis
VADQSGETHRSPRRLRRRPRRRRFSHDL

SEQ ID NO: 1545879 - protein, 9 aa, Mycobacterium tuberculosis
VADQSGKLT

SEQ ID NO: 1545880 - protein, 21 aa, Mycobacterium tuberculosis
VAEPGPDAPALTGDRSARSAI

SEQ ID NO: 1545881 - protein, 13 aa, Mycobacterium tuberculosis
VAEPGSTAARPPC

SEQ ID NO: 1545882 - protein, 16 aa, Mycobacterium tuberculosis
VAGASGQAGGREGGPV

SEQ ID NO: 1545883 - protein, 11 aa, Mycobacterium tuberculosis
VAGDSGPGRLR

SEQ ID NO: 1545884 - protein, 9 aa, Mycobacterium tuberculosis
VAGGRQDHP

SEQ ID NO: 1545885 - protein, 13 aa, Mycobacterium tuberculosis
VAGPHGGSAVATN

SEQ ID NO: 1545886 - protein, 5 aa, Mycobacterium tuberculosis
VANND

SEQ ID NO: 1545887 - protein, 5 aa, Mycobacterium tuberculosis
VAPAA

SEQ ID NO: 1545888 - protein, 7 aa, Mycobacterium tuberculosis
VAPPGTF

SEQ ID NO: 1545889 - protein, 9 aa, Mycobacterium tuberculosis
VAPRGGGHS

SEQ ID NO: 1545890 - protein, 7 aa, Mycobacterium tuberculosis
VARPAET

SEQ ID NO: 1545891 - protein, 5 aa, Mycobacterium tuberculosis
VARSG

SEQ ID NO: 1545892 - protein, 13 aa, Mycobacterium tuberculosis
VASAPQTTPAPPI

SEQ ID NO: 1545893 - protein, 18 aa, Mycobacterium tuberculosis
VATGETPYPPAVGQDDRG

SEQ ID NO: 1545894 - protein, 14 aa, Mycobacterium tuberculosis
VDAGARPRDHDRRI

SEQ ID NO: 1545895 - protein, 6 aa, Mycobacterium tuberculosis
VDAPRT

SEQ ID NO: 1545896 - protein, 15 aa, Mycobacterium tuberculosis
VDASPRVPAEPGGDF

SEQ ID NO: 1545897 - protein, 12 aa, Mycobacterium tuberculosis
VDDPPDQQRGRV

SEQ ID NO: 1545898 - protein, 9 aa, Mycobacterium tuberculosis
VDGAPGPDM

SEQ ID NO: 1545899 - protein, 8 aa, Mycobacterium tuberculosis
VDGARPHR

SEQ ID NO: 1545900 - protein, 12 aa, Mycobacterium tuberculosis
VDGGHTRTAKRL

SEQ ID NO: 1545901 - protein, 20 aa, Mycobacterium tuberculosis
VDPENGRRTGRHPGQPWARP

SEQ ID NO: 1545902 - protein, 15 aa, Mycobacterium tuberculosis
VDPGEGLREFAFAPL

SEQ ID NO: 1545903 - protein, 8 aa, Mycobacterium tuberculosis
VDPGSIPD

SEQ ID NO: 1545904 - protein, 13 aa, Mycobacterium tuberculosis
VDPPAGCSSPPKD

SEQ ID NO: 1545905 - protein, 7 aa, Mycobacterium tuberculosis
VDPPTCH

SEQ ID NO: 1545906 - protein, 11 aa, Mycobacterium tuberculosis
VDQPPQTTRAR

SEQ ID NO: 1545907 - protein, 4 aa, Mycobacterium tuberculosis
VDRR

SEQ ID NO: 1545908 - protein, 55 aa, Mycobacterium tuberculosis
VDSAARNSAGFGARATASNPSSCPSQQPSRRQTYGRPRSTNNEIQPNNSTETEYP

SEQ ID NO: 1545909 - protein, 5 aa, Mycobacterium tuberculosis
VDSAE

SEQ ID NO: 1545910 - protein, 7 aa, Mycobacterium tuberculosis
VDSQYDT

SEQ ID NO: 1545911 - protein, 8 aa, Mycobacterium tuberculosis
VDTNTSMG

SEQ ID NO: 1545912 - protein, 10 aa, Mycobacterium tuberculosis
VEAAPGGTAG

SEQ ID NO: 1545913 - protein, 4 aa, Mycobacterium tuberculosis
VEAP

SEQ ID NO: 1545914 - protein, 11 aa, Mycobacterium tuberculosis
VEARDPDRHAA

SEQ ID NO: 1545915 - protein, 11 aa, Mycobacterium tuberculosis
VEPADETRTDY

SEQ ID NO: 1545916 - protein, 8 aa, Mycobacterium tuberculosis
VEPDPGTV

SEQ ID NO: 1545917 - protein, 22 aa, Mycobacterium tuberculosis
VEPSATATGTAEATVSTADDVG

SEQ ID NO: 1545918 - protein, 15 aa, Mycobacterium tuberculosis
VERSGDRSAPYAAPR

SEQ ID NO: 1545919 - protein, 5 aa, Mycobacterium tuberculosis
VESQD

SEQ ID NO: 1545920 - protein, 19 aa, Mycobacterium tuberculosis
VFSGPPGTGGPDATGAVGG

SEQ ID NO: 1545921 - protein, 74 aa, Mycobacterium tuberculosis
VGAGGAVDAAATAGPAFPAGRTGPANTAVTARAGGAGGTGIENGPTVAAAAAGPASPAGAADASGTTGPAGPKL

SEQ ID NO: 1545922 - protein, 9 aa, Mycobacterium tuberculosis
VGAPDQRGL

SEQ ID NO: 1545923 - protein, 100 aa, Mycobacterium tuberculosis; identical to SEQ ID NO: 233012

SEQ ID NO: 1545924 - protein, 9 aa, Mycobacterium tuberculosis
VGCSRQDVE

SEQ ID NO: 1545925 - protein, 7 aa, Mycobacterium tuberculosis
VGDGAND

SEQ ID NO: 1545926 - protein, 11 aa, Mycobacterium tuberculosis
VGDGQARIRTT

SEQ ID NO: 1545927 - protein, 14 aa, Mycobacterium tuberculosis
VGDTNTGGFNPGDI

SEQ ID NO: 1545928 - protein, 10 aa, Mycobacterium tuberculosis
VGERQPGCGQ

SEQ ID NO: 1545929 - protein, 15 aa, Mycobacterium tuberculosis
VGGGNVGNANNGLAN

SEQ ID NO: 1545930 - protein, 5 aa, Mycobacterium tuberculosis
VGGKD

SEQ ID NO: 1545931 - protein, 8 aa, Mycobacterium tuberculosis
VGGNRDHR

SEQ ID NO: 1545932 - protein, 17 aa, Mycobacterium tuberculosis
VGGPGSAAAAARAHDSS

SEQ ID NO: 1545933 - protein, 9 aa, Mycobacterium tuberculosis
VGGPTTSIG

SEQ ID NO: 1545934 - protein, 5 aa, Mycobacterium tuberculosis
VGGRR

SEQ ID NO: 1545935 - protein, 5 aa, Mycobacterium tuberculosis
VGGST

SEQ ID NO: 1545936 - protein, 6 aa, Mycobacterium tuberculosis
VGHGPS

SEQ ID NO: 1545937 - protein, 27 aa, Mycobacterium tuberculosis
VGLGGGRGRPRRLGGGSRGAAGPLGTA

SEQ ID NO: 1545938 - protein, 27 aa, Mycobacterium tuberculosis
VGNGGAGGNGQLGSGAVSSAGGMGGNG

SEQ ID NO: 1545939 - protein, 38 aa, Mycobacterium tuberculosis
VGNGGAGGPVGNGGPGSASVAGRGDPPGGRRRETAAAP

SEQ ID NO: 1545940 - protein, 34 aa, Mycobacterium tuberculosis
VGNGGTGGAGGAGHAGSTGATGTALQPTGGNGTN

SEQ ID NO: 1545941 - protein, 10 aa, Mycobacterium tuberculosis
VGPDTQERRA

SEQ ID NO: 1545942 - protein, 14 aa, Mycobacterium tuberculosis
VGPEGSSAVPQESA

SEQ ID NO: 1545943 - protein, 6 aa, Mycobacterium tuberculosis
VGPGVT

SEQ ID NO: 1545944 - protein, 39 aa, Mycobacterium tuberculosis; identical to SEQ ID NO: 1439610

SEQ ID NO: 1545945 - protein, 9 aa, Mycobacterium tuberculosis
VGRPRPTAP

SEQ ID NO: 1545946 - protein, 8 aa, Mycobacterium tuberculosis
VGSEEADK

SEQ ID NO: 1545947 - protein, 10 aa, Mycobacterium tuberculosis
VGSGGAGGSR

SEQ ID NO: 1545948 - protein, 18 aa, Mycobacterium tuberculosis
VGSSGFQNGGSNNSGLQN

SEQ ID NO: 1545949 - protein, 16 aa, Mycobacterium tuberculosis
VGSYAAAEAANASPLQ

SEQ ID NO: 1545950 - protein, 5 aa, Mycobacterium tuberculosis
VGSYT

SEQ ID NO: 1545951 - protein, 20 aa, Mycobacterium tuberculosis
VGTGSGPNSGFGNAGTNNSG

SEQ ID NO: 1545952 - protein, 4 aa, Mycobacterium tuberculosis
VGTQ

SEQ ID NO: 1545953 - protein, 23 aa, Mycobacterium tuberculosis
VGTSTVDGGRSTVHQDGDPDGLS

SEQ ID NO: 1545954 - protein, 25 aa, Mycobacterium tuberculosis
VGVGESGASYLAGDAAAAATYGVVG

SEQ ID NO: 1545955 - protein, 12 aa, Mycobacterium tuberculosis
VGVTAGGEGPDK

SEQ ID NO: 1545956 - protein, 21 aa, Mycobacterium tuberculosis
VGYSGNRKDRVVDENDSAGTG

SEQ ID NO: 1545957 - protein, 9 aa, Mycobacterium tuberculosis
VHEDPSGPV

SEQ ID NO: 1545958 - protein, 12 aa, Mycobacterium tuberculosis
VHPGAVSANRGR

SEQ ID NO: 1545959 - protein, 18 aa, Mycobacterium tuberculosis
VIGPDDDPEFLRRLGHGG

SEQ ID NO: 1545960 - protein, 12 aa, Mycobacterium tuberculosis
VKDARMKAVCGG

SEQ ID NO: 1545961 - protein, 10 aa, Mycobacterium tuberculosis
VKPPSSPVTS

SEQ ID NO: 1545962 - protein, 7 aa, Mycobacterium tuberculosis
VLPGGSD

SEQ ID NO: 1545963 - protein, 13 aa, Mycobacterium tuberculosis
VMPGGTTAHPDRD

SEQ ID NO: 1545964 - protein, 8 aa, Mycobacterium tuberculosis
VNAGSGIN

SEQ ID NO: 1545965 - protein, 9 aa, Mycobacterium tuberculosis
VNAQGEPSA

SEQ ID NO: 1545966 - protein, 6 aa, Mycobacterium tuberculosis
VNDPGN

SEQ ID NO: 1545967 - protein, 5 aa, Mycobacterium tuberculosis
VNGGG

SEQ ID NO: 1545968 - protein, 6 aa, Mycobacterium tuberculosis
VNPGRE

SEQ ID NO: 1545969 - protein, 9 aa, Mycobacterium tuberculosis
VNPQRSLSR

SEQ ID NO: 1545970 - protein, 10 aa, Mycobacterium tuberculosis
VNPSGQHGDE

SEQ ID NO: 1545971 - protein, 10 aa, Mycobacterium tuberculosis
VNPSKVGSHG

SEQ ID NO: 1545972 - protein, 17 aa, Mycobacterium tuberculosis
VNSYASAEAANASPLQA

SEQ ID NO: 1545973 - protein, 32 aa, Mycobacterium tuberculosis
VPAAPTAPAAPAAPTAPAAPAAPADKAAPGVL

SEQ ID NO: 1545974 - protein, 19 aa, Mycobacterium tuberculosis
VPAGPGSSSGSGGSAMIAR

SEQ ID NO: 1545975 - protein, 10 aa, Mycobacterium tuberculosis
VPATKGNTRR

SEQ ID NO: 1545976 - protein, 11 aa, Mycobacterium tuberculosis
VPDLPTPWPQE

SEQ ID NO: 1545977 - protein, 7 aa, Mycobacterium tuberculosis
VPDQTPV

SEQ ID NO: 1545978 - protein, 22 aa, Mycobacterium tuberculosis
VPEQPGGAAATTGPAHTGHTRP

SEQ ID NO: 1545979 - protein, 6 aa, Mycobacterium tuberculosis
VPIPGA

SEQ ID NO: 1545980 - protein, 35 aa, Mycobacterium tuberculosis; identical to SEQ ID NO: 154922

SEQ ID NO: 1545981 - protein, 9 aa, Mycobacterium tuberculosis
VPPAPPARA

SEQ ID NO: 1545982 - protein, 8 aa, Mycobacterium tuberculosis
VPPETTGF

SEQ ID NO: 1545983 - protein, 5 aa, Mycobacterium tuberculosis
VPPGA

SEQ ID NO: 1545984 - protein, 20 aa, Mycobacterium tuberculosis
VPPSVPVKSADDKPVVTKST

SEQ ID NO: 1545985 - protein, 60 aa, Mycobacterium tuberculosis
VPRASSSAPAERPVTPVSAGPAAKAVTAEPAGPAPTPTSPAPPAAPGSPVEPAEPAGPAV

SEQ ID NO: 1545986 - protein, 26 aa, Mycobacterium tuberculosis
VPRGDGRLPDRDGKGPASRTQPVQDP

SEQ ID NO: 1545987 - protein, 8 aa, Mycobacterium tuberculosis
VPRGRKEA

SEQ ID NO: 1545988 - protein, 4 aa, Mycobacterium tuberculosis
VPRS

SEQ ID NO: 1545989 - protein, 8 aa, Mycobacterium tuberculosis
VPTITGTA

SEQ ID NO: 1545990 - protein, 17 aa, Mycobacterium tuberculosis
VPVAPPAVGGPLSAEPA

SEQ ID NO: 1545991 - protein, 20 aa, Mycobacterium tuberculosis
VQCRSDTGLTVNGRPLKEPY

SEQ ID NO: 1545992 - protein, 8 aa, Mycobacterium tuberculosis
VQEKLEPG

SEQ ID NO: 1545993 - protein, 5 aa, Mycobacterium tuberculosis
VQPGE

SEQ ID NO: 1545994 - protein, 6 aa, Mycobacterium tuberculosis
VQPKDE

SEQ ID NO: 1545995 - protein, 7 aa, Mycobacterium tuberculosis
VQPSAAT

SEQ ID NO: 1545996 - protein, 15 aa, Mycobacterium tuberculosis
VQPSRQRRRGERGAV

SEQ ID NO: 1545997 - protein, 11 aa, Mycobacterium tuberculosis
VRANTAGPTLA

SEQ ID NO: 1545998 - protein, 5 aa, Mycobacterium tuberculosis
VRNTA

SEQ ID NO: 1545999 - protein, 25 aa, Mycobacterium tuberculosis
VRNTGWSNSGLTNTGAFNAGSLNTG

SEQ ID NO: 1546000 - protein, 13 aa, Mycobacterium tuberculosis
VRPGKPAGPAAPP

SEQ ID NO: 1546001 - protein, 7 aa, Mycobacterium tuberculosis
VRPPSRL

SEQ ID NO: 1546002 - protein, 7 aa, Mycobacterium tuberculosis
VRQGDQR

SEQ ID NO: 1546003 - protein, 16 aa, Mycobacterium tuberculosis
VRRGPALPAVSADPAG

SEQ ID NO: 1546004 - protein, 8 aa, Mycobacterium tuberculosis
VSAAGTAL

SEQ ID NO: 1546005 - protein, 7 aa, Mycobacterium tuberculosis
VSAERDA

SEQ ID NO: 1546006 - protein, 8 aa, Mycobacterium tuberculosis
VSAGPAVA

SEQ ID NO: 1546007 - protein, 16 aa, Mycobacterium tuberculosis
VSARDCRGGTAPGRVA

SEQ ID NO: 1546008 - protein, 23 aa, Mycobacterium tuberculosis
VSARHQARRRRRAAAKERGNADE

SEQ ID NO: 1546009 - protein, 4 aa, Mycobacterium tuberculosis
VSDG

SEQ ID NO: 1546010 - protein, 10 aa, Mycobacterium tuberculosis
VSDQRALTDP

SEQ ID NO: 1546011 - protein, 4 aa, Mycobacterium tuberculosis
VSEG

SEQ ID NO: 1546012 - protein, 11 aa, Mycobacterium tuberculosis
VSENAGAKPQT

SEQ ID NO: 1546013 - protein, 15 aa, Mycobacterium tuberculosis
VSGRGQRRHRAHHRL

SEQ ID NO: 1546014 - protein, 7 aa, Mycobacterium tuberculosis
VSGRTSQ

SEQ ID NO: 1546015 - protein, 7 aa, Mycobacterium tuberculosis
VSIDGQT

SEQ ID NO: 1546016 - protein, 26 aa, Mycobacterium tuberculosis
VSLQPPEEIEGPAIPPASSQLVCVAP

SEQ ID NO: 1546017 - protein, 203 aa, Mycobacterium tuberculosis
VSNGGTGGTGGVGGTGGGGGIAGTGAADPGKGGTGGTAGTGGSGGSGGSGGANLYGGTGGTGGTGGTSGKGGMGGIAGDGGPGGDGGNAGVGGKGGTNGNGGSGGTGGTGGPGGSGGAPTGSGTGGKGGAGGDGGDGADGGAATGVGDGGDGGNGGNGGNGGTGVGSPGGLGGAGGTGGLGGAGAGGGADGDDGDDGQPGNNG

SEQ ID NO: 1546018 - protein, 11 aa, Mycobacterium tuberculosis
VSNTDSDAHEV

SEQ ID NO: 1546019 - protein, 5 aa, Mycobacterium tuberculosis
VSPGP

SEQ ID NO: 1546020 - protein, 11 aa, Mycobacterium tuberculosis
VSPRPDAGGQQ

SEQ ID NO: 1546021 - protein, 11 aa, Mycobacterium tuberculosis
VSPTGRCHAST

SEQ ID NO: 1546022 - protein, 12 aa, Mycobacterium tuberculosis
VSTIRSGQRSVR

SEQ ID NO: 1546023 - protein, 13 aa, Mycobacterium tuberculosis
VSTIRSGQRSVRS

SEQ ID NO: 1546024 - protein, 20 aa, Mycobacterium tuberculosis
VSTPARALSKPGDRESPDAY

SEQ ID NO: 1546025 - protein, 15 aa, Mycobacterium tuberculosis
VTAEPPEPASAAEAR

SEQ ID NO: 1546026 - protein, 11 aa, Mycobacterium tuberculosis
VTAGERPGRGA

SEQ ID NO: 1546027 - protein, 6 aa, Mycobacterium tuberculosis
VTEEAN

SEQ ID NO: 1546028 - protein, 8 aa, Mycobacterium tuberculosis
VTGGSANY

SEQ ID NO: 1546029 - protein, 9 aa, Mycobacterium tuberculosis
VTGTGGASL

SEQ ID NO: 1546030 - protein, 6 aa, Mycobacterium tuberculosis
VTPHPR

SEQ ID NO: 1546031 - protein, 8 aa, Mycobacterium tuberculosis
VTRTAAPP

SEQ ID NO: 1546032 - protein, 12 aa, Mycobacterium tuberculosis
VTRTAAPPRILW

SEQ ID NO: 1546033 - protein, 11 aa, Mycobacterium tuberculosis
VTTGESTTASI

SEQ ID NO: 1546034 - protein, 11 aa, Mycobacterium tuberculosis
VTTPKSDAGVR

SEQ ID NO: 1546035 - protein, 37 aa, Mycobacterium tuberculosis
VTTSASETPAAGISVSETRATTTSVSGSPAMVRSASA

SEQ ID NO: 1546036 - protein, 4 aa, Mycobacterium tuberculosis
VTVP

SEQ ID NO: 1546037 - protein, 7 aa, Mycobacterium tuberculosis
VVPTTGP

SEQ ID NO: 1546038 - protein, 4 aa, Mycobacterium tuberculosis
VVSG

SEQ ID NO: 1546039 - protein, 50 aa, Mycobacterium tuberculosis
WAAETSGSQNLGSGNIGSTNVGSGNIGSTNVGSGNIGDTNFGNGTTATST

SEQ ID NO: 1546040 - protein, 41 aa, Mycobacterium tuberculosis
WAAPAPAAAPTATTATAAAPAPTAAKLTAAQSASSHPTTLG

SEQ ID NO: 1546041 - protein, 16 aa, Mycobacterium tuberculosis
WGSGEATADHGADRTA

SEQ ID NO: 1546042 - protein, 29 aa, Mycobacterium tuberculosis
WGSGGSGGQGGNGLTGNDGVNPAPVTNTQ

SEQ ID NO: 1546043 - protein, 8 aa, Mycobacterium tuberculosis
WKKPGTSD

SEQ ID NO: 1546044 - protein, 20 aa, Mycobacterium tuberculosis
WKTQRDGRPGPRAVRPDHPA

SEQ ID NO: 1546045 - protein, 14 aa, Mycobacterium tuberculosis
WNQAPSALLGGGSG

SEQ ID NO: 1546046 - protein, 7 aa, Mycobacterium tuberculosis
WNTEARQ

SEQ ID NO: 1546047 - protein, 4 aa, Mycobacterium tuberculosis
WPAK

SEQ ID NO: 1546048 - protein, 29 aa, Mycobacterium tuberculosis
WPDPNGSRFPNGAPPPPPPVLEGTPEHLG

SEQ ID NO: 1546049 - protein, 4 aa, Mycobacterium tuberculosis
WPPR

SEQ ID NO: 1546050 - protein, 9 aa, Mycobacterium tuberculosis
WPPTPGSPL

SEQ ID NO: 1546051 - protein, 33 aa, Mycobacterium tuberculosis
WPSPANSPDVGSSPIQPAPGRLTESSAAASALA

SEQ ID NO: 1546052 - protein, 8 aa, Mycobacterium tuberculosis
WRPTAADE

SEQ ID NO: 1546053 - protein, 13 aa, Mycobacterium tuberculosis
WRSHSPESEPIRR

SEQ ID NO: 1546054 - protein, 16 aa, Mycobacterium tuberculosis
WRSPDDGAAPVPEHAA

SEQ ID NO: 1546055 - protein, 22 aa, Mycobacterium tuberculosis
WSATAAQRGIGGTGGEGGIGAR

SEQ ID NO: 1546056 - protein, 35 aa, Mycobacterium tuberculosis
WSGGGGSGDAGCGAAGAGGRPAGTASGSAAVTGRA

SEQ ID NO: 1546057 - protein, 18 aa, Mycobacterium tuberculosis
WSTGSSIMPQKKNPDIAE

SEQ ID NO: 1546058 - protein, 6 aa, Mycobacterium tuberculosis
WTRGQS

SEQ ID NO: 1546059 - protein, 16 aa, Mycobacterium tuberculosis
YADRGEAFATAVRAVI

SEQ ID NO: 1546060 - protein, 15 aa, Mycobacterium tuberculosis
YAHSSYHRGVFAPAR

SEQ ID NO: 1546061 - protein, 8 aa, Mycobacterium tuberculosis
YANARDDY

SEQ ID NO: 1546062 - protein, 5 aa, Mycobacterium tuberculosis
YAQGP

SEQ ID NO: 1546063 - protein, 4 aa, Mycobacterium tuberculosis
YARN

SEQ ID NO: 1546064 - protein, 12 aa, Mycobacterium tuberculosis
YASAEAAAAAPL

SEQ ID NO: 1546065 - protein, 7 aa, Mycobacterium tuberculosis
YDPDGDS

SEQ ID NO: 1546066 - protein, 7 aa, Mycobacterium tuberculosis
YEPPQTA

SEQ ID NO: 1546067 - protein, 8 aa, Mycobacterium tuberculosis
YGDAQEAL

SEQ ID NO: 1546068 - protein, 21 aa, Mycobacterium tuberculosis
YGGNLGRPSEQGLAADARAAQ

SEQ ID NO: 1546069 - protein, 15 aa, Mycobacterium tuberculosis
YGPWNGPAMAVPLAR

SEQ ID NO: 1546070 - protein, 11 aa, Mycobacterium tuberculosis
YGQNPQAACDG

SEQ ID NO: 1546071 - protein, 18 aa, Mycobacterium tuberculosis
YGRSQARRLSPGAAGRPR

SEQ ID NO: 1546072 - protein, 10 aa, Mycobacterium tuberculosis
YNANPDSMRA

SEQ ID NO: 1546073 - protein, 6 aa, Mycobacterium tuberculosis
YNYPPL

SEQ ID NO: 1546074 - protein, 30 aa, Mycobacterium tuberculosis
YPASDDYRASASNGSDDASAHIQRTVAMSS

SEQ ID NO: 1546075 - protein, 61 aa, Mycobacterium tuberculosis
YPDDRRGGRRQRRQRGVDRQRRGRRRRRGRRRRRPRRQTAGGCTATAGPAASGARAPEPVV

SEQ ID NO: 1546076 - protein, 9 aa, Mycobacterium tuberculosis
YPEGIPPTD

SEQ ID NO: 1546077 - protein, 6 aa, Mycobacterium tuberculosis
YPGGAG

SEQ ID NO: 1546078 - protein, 5 aa, Mycobacterium tuberculosis
YPLPE

SEQ ID NO: 1546079 - protein, 27 aa, Mycobacterium tuberculosis
YPPGKSREEIENDNAADFKRSEAAAKY

SEQ ID NO: 1546080 - protein, 19 aa, Mycobacterium tuberculosis
YQRDPDAQSPAGGVSSSLN

SEQ ID NO: 1546081 - protein, 5 aa, Mycobacterium tuberculosis
YQRRD

SEQ ID NO: 1546082 - protein, 20 aa, Mycobacterium tuberculosis
YRDTGDGRDHPLGDDARRVA

SEQ ID NO: 1546083 - protein, 18 aa, Mycobacterium tuberculosis
YRGNDKKMRTEEVDAERA

SEQ ID NO: 1546084 - protein, 9 aa, Mycobacterium tuberculosis
YRPAPPLAA

SEQ ID NO: 1546085 - protein, 9 aa, Mycobacterium tuberculosis
YRSSGGLAD

SEQ ID NO: 1546086 - protein, 5 aa, Mycobacterium tuberculosis
YSCPP

SEQ ID NO: 1546087 - protein, 4 aa, Mycobacterium tuberculosis
YSGR

SEQ ID NO: 1546088 - protein, 10 aa, Mycobacterium tuberculosis
YSIGDDSQLV

SEQ ID NO: 1546089 - protein, 8 aa, Mycobacterium tuberculosis
YSPYENVT

SEQ ID NO: 1546090 - protein, 11 aa, Mycobacterium tuberculosis
YSTNSAQLHTD

SEQ ID NO: 1546091 - protein, 11 aa, Mycobacterium tuberculosis
YSYASAEAAAV

SEQ ID NO: 1546092 - protein, 17 aa, Mycobacterium tuberculosis
YTKPADAEHPNSGMGTS

SEQ ID NO: 1546093 - protein, 24 aa, Mycobacterium tuberculosis
TAGAFSRPGLPVEYLQVPSPSMGR

SEQ ID NO: 1546094 - protein, 18 aa, Mycobacterium tuberculosis
IEPAEPIANVILQTISDR

SEQ ID NO: 1546095 - protein, 26 aa, Mycobacterium tuberculosis
LTLVAFWWWQRPRTNAVAADSLVGVL

SEQ ID NO: 1546096 - protein, 24 aa, Mycobacterium tuberculosis
MVSGLSWKDHEYMTSALAPEDVGW

SEQ ID NO: 1546097 - protein, 24 aa, Mycobacterium tuberculosis
SHVYRLKSSVFISVGVLGIEPAEP

SEQ ID NO: 1546098 - protein, 24 aa, Mycobacterium tuberculosis
ADGTLDHAGAWAGFVTAFHISSDR

SEQ ID NO: 1546099 - protein, 23 aa, Mycobacterium tuberculosis
ADPCSDIAVVFARGTHQASGLGD

SEQ ID NO: 1546100 - protein, 19 aa, Mycobacterium tuberculosis
AGGNGGWLLGNGGIGGPGG

SEQ ID NO: 1546101 - protein, 23 aa, Mycobacterium tuberculosis
APELQFKPGTRFDYSNSNYLLLG

SEQ ID NO: 1546102 - protein, 29 aa, Mycobacterium tuberculosis
APVARDALFHWGVAMLPAGPAGRVSVTNG

SEQ ID NO: 1546103 - protein, 21 aa, Mycobacterium tuberculosis
AQLVCKKLASGETGTEIAEEV

SEQ ID NO: 1546104 - protein, 26 aa, Mycobacterium tuberculosis
ASGIPKAAGVEAIFRLDECPRGLYSG

SEQ ID NO: 1546105 - protein, 30 aa, Mycobacterium tuberculosis; identical to SEQ ID NO: 233247

SEQ ID NO: 1546106 - protein, 24 aa, Mycobacterium tuberculosis
DEQFRIAYDASQQVFGFAPYPAVA

SEQ ID NO: 1546107 - protein, 26 aa, Mycobacterium tuberculosis
DFVTSLQLLLTFPFPNFGIKQAVRGD

SEQ ID NO: 1546108 - protein, 23 aa, Mycobacterium tuberculosis
DKIARMLLIWAALAAVALVLVGC

SEQ ID NO: 1546109 - protein, 29 aa, Mycobacterium tuberculosis
DLDMAVDMLEMLPTPWGLVRSGVAPDHPK

SEQ ID NO: 1546110 - protein, 26 aa, Mycobacterium tuberculosis
DNVNYRITVKPGWKFTDGSPVTAHSF

SEQ ID NO: 1546111 - protein, 18 aa, Mycobacterium tuberculosis
DSPPAQWMPPNKAFACQY

SEQ ID NO: 1546112 - protein, 19 aa, Mycobacterium tuberculosis
DVNGTRYLCTGSPKQVATT

SEQ ID NO: 1546113 - protein, 20 aa, Mycobacterium tuberculosis
EFFDRRLALHSPEMAAKTIV

SEQ ID NO: 1546114 - protein, 24 aa, Mycobacterium tuberculosis
EIKGKRKVERIVLGRNELVSDGSG

SEQ ID NO: 1546115 - protein, 21 aa, Mycobacterium tuberculosis
ELVSKLLAGPRPEMARTVRNL

SEQ ID NO: 1546116 - protein, 17 aa, Mycobacterium tuberculosis
ERIKMQGARQVDLIRAQ

SEQ ID NO: 1546117 - protein, 27 aa, Mycobacterium tuberculosis
EVSAAVAALFARFGQEYQAVSAQASAF

SEQ ID NO: 1546118 - protein, 18 aa, Mycobacterium tuberculosis
FAFDNPGAIEAFRYLVGL

SEQ ID NO: 1546119 - protein, 18 aa, Mycobacterium tuberculosis
FATIPVLDGAGWSDDGMQ

SEQ ID NO: 1546120 - protein, 25 aa, Mycobacterium tuberculosis
FDYAEGRLGWRTLDFEVEVLPIGDF

SEQ ID NO: 1546121 - protein, 18 aa, Mycobacterium tuberculosis
FHDMPVVPLWDYISVVGW

SEQ ID NO: 1546122 - protein, 22 aa, Mycobacterium tuberculosis
FLTSELPQWLSANRAVKPTGSA

SEQ ID NO: 1546123 - protein, 19 aa, Mycobacterium tuberculosis
FPQRVRAMILDGAVDPNAD

SEQ ID NO: 1546124 - protein, 20 aa, Mycobacterium tuberculosis
FTLYHLPAVPPLAGLAGTQA

SEQ ID NO: 1546125 - protein, 21 aa, Mycobacterium tuberculosis
FYAAVKLDLDKNVLLPANAVA

SEQ ID NO: 1546126 - protein, 18 aa, Mycobacterium tuberculosis
GAIEAFRYLVGLINDDHV

SEQ ID NO: 1546127 - protein, 25 aa, Mycobacterium tuberculosis
GDKTCKVVSRFTRCGAVAYNGSKYQ

SEQ ID NO: 1546128 - protein, 27 aa, Mycobacterium tuberculosis
GDLKRSCLDIGLAERVLGWRPQIELAD

SEQ ID NO: 1546129 - protein, 19 aa, Mycobacterium tuberculosis
GEGLVVWFNTLLVSAGGSV

SEQ ID NO: 1546130 - protein, 25 aa, Mycobacterium tuberculosis
GNNVRRLAGPYAWSNALSAGYTAEE

SEQ ID NO: 1546131 - protein, 21 aa, Mycobacterium tuberculosis
GPDPLGVLYWQVPKGSTLDST

SEQ ID NO: 1546132 - protein, 30 aa, Mycobacterium tuberculosis; identical to SEQ ID NO: 233591

SEQ ID NO: 1546133 - protein, 32 aa, Mycobacterium tuberculosis; identical to SEQ ID NO: 233602

SEQ ID NO: 1546134 - protein, 25 aa, Mycobacterium tuberculosis
GRQKLNGPQALSFVRQRHDLPRGDL

SEQ ID NO: 1546135 - protein, 31 aa, Mycobacterium tuberculosis; identical to SEQ ID NO: 233622

SEQ ID NO: 1546136 - protein, 23 aa, Mycobacterium tuberculosis
GSYFWQHNWGSPKGYTHPAAHLH

SEQ ID NO: 1546137 - protein, 25 aa, Mycobacterium tuberculosis
HIVNISSLFGLIAVPGQSAYNAAKF

SEQ ID NO: 1546138 - protein, 17 aa, Mycobacterium tuberculosis
IKMQGARQVDLIRAQLT

SEQ ID NO: 1546139 - protein, 24 aa, Mycobacterium tuberculosis
ILVCPADRGPLVLVEDGDIQVLYN

SEQ ID NO: 1546140 - protein, 23 aa, Mycobacterium tuberculosis
INTEINWIRGFLPPLPPISPPGF

SEQ ID NO: 1546141 - protein, 23 aa, Mycobacterium tuberculosis
ISGYSGGLYYIFATYTTTVDFGN

SEQ ID NO: 1546142 - protein, 18 aa, Mycobacterium tuberculosis
IWDRGRELGMVNRLQRVG

SEQ ID NO: 1546143 - protein, 21 aa, Mycobacterium tuberculosis
KAGNPGVNVNFAFAGSSELAT

SEQ ID NO: 1546144 - protein, 18 aa, Mycobacterium tuberculosis
KLGQPVEWTPCRSSNPQV

SEQ ID NO: 1546145 - protein, 22 aa, Mycobacterium tuberculosis
KTVVPDPRYVAVSDRDQLATEL

SEQ ID NO: 1546146 - protein, 23 aa, Mycobacterium tuberculosis
LAALGEAVGKVFADLHRDQGVDL

SEQ ID NO: 1546147 - protein, 25 aa, Mycobacterium tuberculosis
LAARREFSEEIGLCVPDGPRIDFGS

SEQ ID NO: 1546148 - protein, 25 aa, Mycobacterium tuberculosis
LAIRGNRVLIGFSLPGKTIGMQSRA

SEQ ID NO: 1546149 - protein, 17 aa, Mycobacterium tuberculosis
LAPHTPLARVFSPRTRI

SEQ ID NO: 1546150 - protein, 26 aa, Mycobacterium tuberculosis
LAVTAAEVPLAFALAAGSFRDATRVA

SEQ ID NO: 1546151 - protein, 21 aa, Mycobacterium tuberculosis
LDAGRELAKALGLDPAAVTIA

SEQ ID NO: 1546152 - protein, 24 aa, Mycobacterium tuberculosis
LDGLNRVSAILARDKDNLGRALDT

SEQ ID NO: 1546153 - protein, 18 aa, Mycobacterium tuberculosis
LDVPYTRIHEFRHFHPER

SEQ ID NO: 1546154 - protein, 18 aa, Mycobacterium tuberculosis
LGGVDVCLKEPVYEPLSG

SEQ ID NO: 1546155 - protein, 17 aa, Mycobacterium tuberculosis
LLAEALAVTAAEVPLAF

SEQ ID NO: 1546156 - protein, 25 aa, Mycobacterium tuberculosis
LLNKNARFVAVAGIGLLSPGNTGQL

SEQ ID NO: 1546157 - protein, 22 aa, Mycobacterium tuberculosis
LPKRVHERFDLVGFDPRGVASS

SEQ ID NO: 1546158 - protein, 26 aa, Mycobacterium tuberculosis
LQCPLKELRRAAPYLVGALKLILTQP

SEQ ID NO: 1546159 - protein, 23 aa, Mycobacterium tuberculosis
LQIVTELAPVFKAAGFRPNNSVP

SEQ ID NO: 1546160 - protein, 18 aa, Mycobacterium tuberculosis
LRALAPMAAAAQYVETFD

SEQ ID NO: 1546161 - protein, 26 aa, Mycobacterium tuberculosis
LSACGFKPGFPMAEWASKRRAQLDSQ

SEQ ID NO: 1546162 - protein, 19 aa, Mycobacterium tuberculosis
LSGADFPAGRQKLNGPQAL

SEQ ID NO: 1546163 - protein, 26 aa, Mycobacterium tuberculosis
LSGNGLKIVSCYQYGKGSTADWLGGA

SEQ ID NO: 1546164 - protein, 18 aa, Mycobacterium tuberculosis
LYRARAGVVDVLLAHPGG

SEQ ID NO: 1546165 - protein, 22 aa, Mycobacterium tuberculosis
MALPGDLNQGVLIDAPAGELVF

SEQ ID NO: 1546166 - protein, 21 aa, Mycobacterium tuberculosis
MRRRSTMYLTYWTAGDTRNRG

SEQ ID NO: 1546167 - protein, 29 aa, Mycobacterium tuberculosis
NGTQWVREISWQWDCLLPDGTIEYAPAKS

SEQ ID NO: 1546168 - protein, 23 aa, Mycobacterium tuberculosis
NKGLRFEFYANLDTAYADLLSGN

SEQ ID NO: 1546169 - protein, 23 aa, Mycobacterium tuberculosis
NLSEKRAKLALSDVDTDGLAKTV

SEQ ID NO: 1546170 - protein, 23 aa, Mycobacterium tuberculosis
NQIVPYLRSWESVIGHQRTGVYA

SEQ ID NO: 1546171 - protein, 21 aa, Mycobacterium tuberculosis
NRGREMLAFATAYRDAGVKPP

SEQ ID NO: 1546172 - protein, 20 aa, Mycobacterium tuberculosis
NRLYRGRADLVLLYIDPAAL

SEQ ID NO: 1546173 - protein, 24 aa, Mycobacterium tuberculosis
NRVLAEQGLDAWPTCGAASGLPIA

SEQ ID NO: 1546174 - protein, 25 aa, Mycobacterium tuberculosis
PAANITRLPVRYTFDNRYFSDTYEG

SEQ ID NO: 1546175 - protein, 24 aa, Mycobacterium tuberculosis
PDQPALRPLLDLLPIAGGSGTLGE

SEQ ID NO: 1546176 - protein, 21 aa, Mycobacterium tuberculosis
PECSAALLFKGSPLRPDGSSD

SEQ ID NO: 1546177 - protein, 20 aa, Mycobacterium tuberculosis
PEVVFHLAAQIDVRRSVADP

SEQ ID NO: 1546178 - protein, 19 aa, Mycobacterium tuberculosis
PPGQDTWYHGAARIGDLVE

SEQ ID NO: 1546179 - protein, 22 aa, Mycobacterium tuberculosis
PREPYVHWIVIGIAPGAGSTAD

SEQ ID NO: 1546180 - protein, 24 aa, Mycobacterium tuberculosis
PTTEEVFSALGVVVNKGNVGALEE

SEQ ID NO: 1546181 - protein, 35 aa, Mycobacterium tuberculosis; identical to SEQ ID NO: 234871

SEQ ID NO: 1546182 - protein, 25 aa, Mycobacterium tuberculosis
QAYQFPMGLGLVSQFFGKYFTPEQA

SEQ ID NO: 1546183 - protein, 17 aa, Mycobacterium tuberculosis
QFQETYKRNTLYFADPT

SEQ ID NO: 1546184 - protein, 19 aa, Mycobacterium tuberculosis
QGPAGWLRAKTGSLTAINS

SEQ ID NO: 1546185 - protein, 26 aa, Mycobacterium tuberculosis
QLLSTDFRAGCPIAAVSVEAGDEQDR

SEQ ID NO: 1546186 - protein, 21 aa, Mycobacterium tuberculosis
QQDPPVWWTHIHGMGDAARLA

SEQ ID NO: 1546187 - protein, 24 aa, Mycobacterium tuberculosis
QRTRLTEVLSRIYGHPVTVQLHID

SEQ ID NO: 1546188 - protein, 17 aa, Mycobacterium tuberculosis
RGAALMANQELRLSRTY

SEQ ID NO: 1546189 - protein, 25 aa, Mycobacterium tuberculosis
RHDLPRGDLDRVVRQQAVMAALAHR

SEQ ID NO: 1546190 - protein, 18 aa, Mycobacterium tuberculosis
RIRLIERLVSGKVGAPTL

SEQ ID NO: 1546191 - protein, 19 aa, Mycobacterium tuberculosis
RPIEYTWNGTQWVREISWQ

SEQ ID NO: 1546192 - protein, 20 aa, Mycobacterium tuberculosis
RRIGETFFTTAYFDPNMAHM

SEQ ID NO: 1546193 - protein, 23 aa, Mycobacterium tuberculosis
RTLDVMALDVVWTAEFAEAGWAL

SEQ ID NO: 1546194 - protein, 20 aa, Mycobacterium tuberculosis
RTVAELRALAPMAAAAQYVE

SEQ ID NO: 1546195 - protein, 19 aa, Mycobacterium tuberculosis
RVLGWRPQIELADGVRRTV

SEQ ID NO: 1546196 - protein, 35 aa, Mycobacterium tuberculosis; identical to SEQ ID NO: 234205

SEQ ID NO: 1546197 - protein, 24 aa, Mycobacterium tuberculosis
SAAVGVEGKVIWSGVRGIADLASG

SEQ ID NO: 1546198 - protein, 25 aa, Mycobacterium tuberculosis
SASRRALTSLVDWFGTMAQDLDHQG

SEQ ID NO: 1546199 - protein, 24 aa, Mycobacterium tuberculosis
SDRRPGGAWMLGKPIQLSEARDLS

SEQ ID NO: 1546200 - protein, 19 aa, Mycobacterium tuberculosis
SPAAVGCVISHDFRPRQSG

SEQ ID NO: 1546201 - protein, 25 aa, Mycobacterium tuberculosis
SVADIPTLLAHYGVDAVITDEDHAT

SEQ ID NO: 1546202 - protein, 28 aa, Mycobacterium tuberculosis
SYGVDIKPGLSLGGYAAFARYDNNETLL

SEQ ID NO: 1546203 - protein, 23 aa, Mycobacterium tuberculosis
TAGHGGLFNRAPWVVSVDDHVDP

SEQ ID NO: 1546204 - protein, 26 aa, Mycobacterium tuberculosis
TRAAELRYGRSFGIVAGYGGHGIGRQ

SEQ ID NO: 1546205 - protein, 20 aa, Mycobacterium tuberculosis
TYPIAWEIEIERIGLTLRGA

SEQ ID NO: 1546206 - protein, 22 aa, Mycobacterium tuberculosis
VAIVLGTGVAWSSVRSFEDGIF

SEQ ID NO: 1546207 - protein, 23 aa, Mycobacterium tuberculosis
VDHYAEIGLLGFALIADALGGVD

SEQ ID NO: 1546208 - protein, 25 aa, Mycobacterium tuberculosis
VDQFTRSGVLWGVPQLTDAGIAVFY

SEQ ID NO: 1546209 - protein, 24 aa, Mycobacterium tuberculosis
VFNFPPNGTHSWEYWGAQLNAMKG

SEQ ID NO: 1546210 - protein, 18 aa, Mycobacterium tuberculosis
VGALKLILTQPFDVDTVP

SEQ ID NO: 1546211 - protein, 20 aa, Mycobacterium tuberculosis
VGALLPRAGAAAAAALPALA

SEQ ID NO: 1546212 - protein, 22 aa, Mycobacterium tuberculosis
VGPDGTYPCIIRVENLSAGYNH

SEQ ID NO: 1546213 - protein, 18 aa, Mycobacterium tuberculosis
VGRGRAAINGDFILIAPE

SEQ ID NO: 1546214 - protein, 18 aa, Mycobacterium tuberculosis
VGVAQSFTSVPMLFATPT

SEQ ID NO: 1546215 - protein, 23 aa, Mycobacterium tuberculosis
VIARAAAVFDRWSDLTAQRFIAD

SEQ ID NO: 1546216 - protein, 23 aa, Mycobacterium tuberculosis
VIVGRRGPLQAAFTTLELRELAD

SEQ ID NO: 1546217 - protein, 17 aa, Mycobacterium tuberculosis
VIVNAGIGKGARLGSGK

SEQ ID NO: 1546218 - protein, 19 aa, Mycobacterium tuberculosis
VKGGVPFLPLNRIPQLAGS

SEQ ID NO: 1546219 - protein, 18 aa, Mycobacterium tuberculosis
VLAGIAVLPKRIHRYDYR

SEQ ID NO: 1546220 - protein, 26 aa, Mycobacterium tuberculosis
VLALLLSSCGWRGISNVAIPGGPGTG

SEQ ID NO: 1546221 - protein, 18 aa, Mycobacterium tuberculosis
VLDGAGWSDDGMQSVVRV

SEQ ID NO: 1546222 - protein, 17 aa, Mycobacterium tuberculosis
VRGQLRPGSPAAPVVYT

SEQ ID NO: 1546223 - protein, 24 aa, Mycobacterium tuberculosis
VRVDPRQVQDWVVGLLHEQDQGKT

SEQ ID NO: 1546224 - protein, 23 aa, Mycobacterium tuberculosis
VSADVGGGLRFNIGTGKETSDRQ

SEQ ID NO: 1546225 - protein, 21 aa, Mycobacterium tuberculosis
VSINAEMIWGQPVEETDSAGN

SEQ ID NO: 1546226 - protein, 27 aa, Mycobacterium tuberculosis
VTASGGLRVNPEFHCEIVVDGQVVVSQ

SEQ ID NO: 1546227 - protein, 18 aa, Mycobacterium tuberculosis
VVNDLEFTVRLKAPTIDF

SEQ ID NO: 1546228 - protein, 23 aa, Mycobacterium tuberculosis
VVSLSWRTGDDIVVTRTDAAHPV

SEQ ID NO: 1546229 - protein, 17 aa, Mycobacterium tuberculosis
WEIEIERIGLTLRGAAL

SEQ ID NO: 1546230 - protein, 19 aa, Mycobacterium tuberculosis
WYYQSGLSIVMPVGGQSSF

SEQ ID NO: 1546231 - protein, 20 aa, Mycobacterium tuberculosis
YDSFPRSDIVTVVIGADKWR

SEQ ID NO: 1546232 - protein, 22 aa, Mycobacterium tuberculosis
YTGPCPPAGTGTHHYRFTLYHL

SEQ ID NO: 1546233 - protein, 18 aa, Mycobacterium tuberculosis
YYLGEPIVQAVLFNAIDF

SEQ ID NO: 1546234 - protein, 17 aa, Mycobacterium tuberculosis
AAAASPYVGWLSTVASQ

SEQ ID NO: 1546235 - protein, 17 aa, Mycobacterium tuberculosis
AAARAAGATVFLVPAKN

SEQ ID NO: 1546236 - protein, 27 aa, Mycobacterium tuberculosis
AAHQKLCEVYKLAARAVQIATNGDNPA

SEQ ID NO: 1546237 - protein, 23 aa, Mycobacterium tuberculosis
AALEVNWPFVFASMLENAVKGGV

SEQ ID NO: 1546238 - protein, 19 aa, Mycobacterium tuberculosis
AANTIEWLSDYGLTGLLRR

SEQ ID NO: 1546239 - protein, 21 aa, Mycobacterium tuberculosis
ACTPDTFVFDGQRRLVYRGQL

SEQ ID NO: 1546240 - protein, 24 aa, Mycobacterium tuberculosis
ADAEARVLLARRFHNDAVRDTLAL

SEQ ID NO: 1546241 - protein, 18 aa, Mycobacterium tuberculosis
ADAVIRIVRDFMTQAHLK

SEQ ID NO: 1546242 - protein, 19 aa, Mycobacterium tuberculosis
ADDLFARFSAQWKECDGTT

SEQ ID NO: 1546243 - protein, 18 aa, Mycobacterium tuberculosis
AEHGDLPLSFSVTNIQPA

SEQ ID NO: 1546244 - protein, 20 aa, Mycobacterium tuberculosis
AGIASGFALAACASKPTASG

SEQ ID NO: 1546245 - protein, 18 aa, Mycobacterium tuberculosis
AGVVGWWVNPQAPGIDAC

SEQ ID NO: 1546246 - protein, 18 aa, Mycobacterium tuberculosis
AKPSPPAAYCPATNTIVV

SEQ ID NO: 1546247 - protein, 25 aa, Mycobacterium tuberculosis
ANGAQCPRCNEEYRQLCAALAAALS

SEQ ID NO: 1546248 - protein, 17 aa, Mycobacterium tuberculosis
ANLRSDPFVAILRFPFI

SEQ ID NO: 1546249 - protein, 21 aa, Mycobacterium tuberculosis
AQLTRQLRLELGHESVRQARE

SEQ ID NO: 1546250 - protein, 23 aa, Mycobacterium tuberculosis
AQRQLCDTYKLVAHAVPVDTNGS

SEQ ID NO: 1546251 - protein, 26 aa, Mycobacterium tuberculosis
ARTADGINYRVLWQAAGPDTISGATI

SEQ ID NO: 1546252 - protein, 25 aa, Mycobacterium tuberculosis
ASAEEVPGVLIARGLAEQTGKRIRL

SEQ ID NO: 1546253 - protein, 18 aa, Mycobacterium tuberculosis
ASVFLPLQRVLGCQQNTA

SEQ ID NO: 1546254 - protein, 18 aa, Mycobacterium tuberculosis
ATLLRGGGLVNLEGIQQE

SEQ ID NO: 1546255 - protein, 18 aa, Mycobacterium tuberculosis
ATSGGFCGKKNLYTVYFA

SEQ ID NO: 1546256 - protein, 24 aa, Mycobacterium tuberculosis
CPNHHSKMAFAMANFEPGSNEPTH

SEQ ID NO: 1546257 - protein, 17 aa, Mycobacterium tuberculosis
CVKSGWRKATAGTPTSM

SEQ ID NO: 1546258 - protein, 17 aa, Mycobacterium tuberculosis
DALKACVKSGWRKATAG

SEQ ID NO: 1546259 - protein, 25 aa, Mycobacterium tuberculosis
DFEEGLRTTIDWYRDNESWWRPLKD

SEQ ID NO: 1546260 - protein, 25 aa, Mycobacterium tuberculosis
DIFLREVQDVWIWVRPYFDDRATAA

SEQ ID NO: 1546261 - protein, 24 aa, Mycobacterium tuberculosis
DKLISRLLAGPALAIAKTKNAINA

SEQ ID NO: 1546262 - protein, 19 aa, Mycobacterium tuberculosis
DPLTFAWVNHMKIFFNNKG

SEQ ID NO: 1546263 - protein, 33 aa, Mycobacterium tuberculosis; identical to SEQ ID NO: 233316

SEQ ID NO: 1546264 - protein, 17 aa, Mycobacterium tuberculosis
DRVPAAEALSWGLVSAV

SEQ ID NO: 1546265 - protein, 19 aa, Mycobacterium tuberculosis
EFRTLPVVRYDNIDGQDVN

SEQ ID NO: 1546266 - protein, 24 aa, Mycobacterium tuberculosis
EGGQGAPPFRMWDPGSGPAGGRAW

SEQ ID NO: 1546267 - protein, 19 aa, Mycobacterium tuberculosis
EGRHGPFFPQCGGVSDQTV

SEQ ID NO: 1546268 - protein, 30 aa, Mycobacterium tuberculosis; identical to SEQ ID NO: 233370

SEQ ID NO: 1546269 - protein, 20 aa, Mycobacterium tuberculosis
ELADVAVLLGRYTAALTEAV

SEQ ID NO: 1546270 - protein, 25 aa, Mycobacterium tuberculosis
ELTARLNSLGEAWTGGGSDKALAAA

SEQ ID NO: 1546271 - protein, 17 aa, Mycobacterium tuberculosis
EPFGCLKPAPPPDGVGV

SEQ ID NO: 1546272 - protein, 24 aa, Mycobacterium tuberculosis
ERRAALKIPAGVPFYEESTFWNPS

SEQ ID NO: 1546273 - protein, 24 aa, Mycobacterium tuberculosis
ETAYGEWKGGWVDFDGIHLQVGSA

SEQ ID NO: 1546274 - protein, 19 aa, Mycobacterium tuberculosis
ETKQFVGRCVDKMGKNFLA

SEQ ID NO: 1546275 - protein, 24 aa, Mycobacterium tuberculosis
FADLTRPGLNVVVCQPSVPCGSAT

SEQ ID NO: 1546276 - protein, 26 aa, Mycobacterium tuberculosis
FDQPLLALRIPWYVTVLDLGSAGAVY

SEQ ID NO: 1546277 - protein, 17 aa, Mycobacterium tuberculosis
FLHTNVIGTFTILEAVR

SEQ ID NO: 1546278 - protein, 28 aa, Mycobacterium tuberculosis
FNLTAWAVGWLPYIGILAPQINFFYYLG

SEQ ID NO: 1546279 - protein, 21 aa, Mycobacterium tuberculosis
FSLTMSEGMLFSGGTGAAGMT

SEQ ID NO: 1546280 - protein, 20 aa, Mycobacterium tuberculosis
GAAESLWALLARVLPEPWRV

SEQ ID NO: 1546281 - protein, 26 aa, Mycobacterium tuberculosis
GAARLRWARRPDWGGLEVDVDVAGTT

SEQ ID NO: 1546282 - protein, 21 aa, Mycobacterium tuberculosis
GDSRVLAGMNVNVWDVVDDVK

SEQ ID NO: 1546283 - protein, 18 aa, Mycobacterium tuberculosis
GDTLKSYFDHQAGKYGTT

SEQ ID NO: 1546284 - protein, 19 aa, Mycobacterium tuberculosis
GDTLLALADMYMRRDSHGR

SEQ ID NO: 1546285 - protein, 19 aa, Mycobacterium tuberculosis
GGAPGNFLSAGGHYHVPGH

SEQ ID NO: 1546286 - protein, 26 aa, Mycobacterium tuberculosis
GGFSAWQLGGSYSKNGKLRTVAQKTV

SEQ ID NO: 1546287 - protein, 23 aa, Mycobacterium tuberculosis
GLGIYRLHSIFGVHEQPTVMVKP

SEQ ID NO: 1546288 - protein, 20 aa, Mycobacterium tuberculosis
GLLACNCYVLAERPGTDAVI

SEQ ID NO: 1546289 - protein, 36 aa, Mycobacterium tuberculosis; identical to SEQ ID NO: 233590

SEQ ID NO: 1546290 - protein, 18 aa, Mycobacterium tuberculosis
GRPMGRYAGCNVINDLFD

SEQ ID NO: 1546291 - protein, 26 aa, Mycobacterium tuberculosis
GRQRLNAAQALAFVRQRHGLDNGDLD

SEQ ID NO: 1546292 - protein, 21 aa, Mycobacterium tuberculosis
GSAYAEEFPQRVRAMILDGAV

SEQ ID NO: 1546293 - protein, 22 aa, Mycobacterium tuberculosis
GSLTRTPLMSQLIEKPVAPSVM

SEQ ID NO: 1546294 - protein, 19 aa, Mycobacterium tuberculosis
GSVLEVRTALSYVSVDGAR

SEQ ID NO: 1546295 - protein, 22 aa, Mycobacterium tuberculosis
GTDAVVLPGGFPEQFTAELSAN

SEQ ID NO: 1546296 - protein, 24 aa, Mycobacterium tuberculosis
GTPISANFAHRVSVLVDLSVASDD

SEQ ID NO: 1546297 - protein, 18 aa, Mycobacterium tuberculosis
GVAACGLSLAVLAAAPTA

SEQ ID NO: 1546298 - protein, 20 aa, Mycobacterium tuberculosis
GVASDAAGVVGWWVNPQAPG

SEQ ID NO: 1546299 - protein, 25 aa, Mycobacterium tuberculosis
GVDKFPRMVDYVVPTGVRIADADRV

SEQ ID NO: 1546300 - protein, 29 aa, Mycobacterium tuberculosis
GVLVCTRAVYKHMAKRGGGAIVNQSSTAA

SEQ ID NO: 1546301 - protein, 17 aa, Mycobacterium tuberculosis
HAAVVAWWAHREAALCG

SEQ ID NO: 1546302 - protein, 22 aa, Mycobacterium tuberculosis
HNALRELAQVAGRLGDSRGDIF

SEQ ID NO: 1546303 - protein, 19 aa, Mycobacterium tuberculosis
HPQCRRCRRRTATLRRSSG

SEQ ID NO: 1546304 - protein, 17 aa, Mycobacterium tuberculosis
HRPEVVFHLAAQIDVRR

SEQ ID NO: 1546305 - protein, 17 aa, Mycobacterium tuberculosis
IAPPLTWSAPFGGALVV

SEQ ID NO: 1546306 - protein, 17 aa, Mycobacterium tuberculosis
IDLSGPVVIAMKRPPTS

SEQ ID NO: 1546307 - protein, 32 aa, Mycobacterium tuberculosis; identical to SEQ ID NO: 233693

SEQ ID NO: 1546308 - protein, 23 aa, Mycobacterium tuberculosis
IIDRLFAGLMSYDAVGKPSLEVA

SEQ ID NO: 1546309 - protein, 18 aa, Mycobacterium tuberculosis
IKLAWITAVVAGLMVGVA

SEQ ID NO: 1546310 - protein, 26 aa, Mycobacterium tuberculosis
IRRAGSQMGVPYSWGGGSLQGPSKGV

SEQ ID NO: 1546311 - protein, 26 aa, Mycobacterium tuberculosis
IYGGMKLDLLLTVPLDYYKKFMSVNH

SEQ ID NO: 1546312 - protein, 31 aa, Mycobacterium tuberculosis; identical to SEQ ID NO: 99027

SEQ ID NO: 1546313 - protein, 27 aa, Mycobacterium tuberculosis
IYREAALRLDHHFAISVIDCGSSMEAA

SEQ ID NO: 1546314 - protein, 23 aa, Mycobacterium tuberculosis
LAHEFGHALQVMANLVTRKDPTI

SEQ ID NO: 1546315 - protein, 17 aa, Mycobacterium tuberculosis
LDGDSRVLAGMNVNVWD

SEQ ID NO: 1546316 - protein, 20 aa, Mycobacterium tuberculosis
LERRYIRDARWCDANDIAQL

SEQ ID NO: 1546317 - protein, 27 aa, Mycobacterium tuberculosis
LFGEPSSGFSSMLWGGGSLPTIGPLYS

SEQ ID NO: 1546318 - protein, 20 aa, Mycobacterium tuberculosis
LGAADGRRALQTWRRLAVTR

SEQ ID NO: 1546319 - protein, 20 aa, Mycobacterium tuberculosis
LGASPVWHTFCIDQCSIAFT

SEQ ID NO: 1546320 - protein, 24 aa, Mycobacterium tuberculosis
LGKPSRPTPIGSFHAMSKERTVVM

SEQ ID NO: 1546321 - protein, 20 aa, Mycobacterium tuberculosis
LKYPKAVTVASVMDPGPSVD

SEQ ID NO: 1546322 - protein, 24 aa, Mycobacterium tuberculosis
LLAPKFRAMPELMFSADRYHPSAP

SEQ ID NO: 1546323 - protein, 25 aa, Mycobacterium tuberculosis
LMCRAYDGLFTRGGKWAINPMFIDP

SEQ ID NO: 1546324 - protein, 18 aa, Mycobacterium tuberculosis
LPLSFSVTNIQPAAAGSA

SEQ ID NO: 1546325 - protein, 24 aa, Mycobacterium tuberculosis
LQARRYEAVRVWRSGLCSASNAYR

SEQ ID NO: 1546326 - protein, 17 aa, Mycobacterium tuberculosis
LRVPPGRGLWVNMALST

SEQ ID NO: 1546327 - protein, 29 aa, Mycobacterium tuberculosis
LVNAFFSSRCNLIAWDRGVFMAVAQEYFG

SEQ ID NO: 1546328 - protein, 26 aa, Mycobacterium tuberculosis
LYNAVEPWVQYGFNLTAWAVGWLPYI

SEQ ID NO: 1546329 - protein, 28 aa, Mycobacterium tuberculosis
MKTQGPGAWPKCSSCSQGDAPLGSLTHI

SEQ ID NO: 1546330 - protein, 27 aa, Mycobacterium tuberculosis
MLLSFERWAPDMGWEIATGKSVLAGEL

SEQ ID NO: 1546331 - protein, 18 aa, Mycobacterium tuberculosis
MSGLRVVNDLEFTVRLKA

SEQ ID NO: 1546332 - protein, 23 aa, Mycobacterium tuberculosis
MSNPRWTCDYGLAVVPHAVLVLS

SEQ ID NO: 1546333 - protein, 25 aa, Mycobacterium tuberculosis
MSVPPTWQGSIPISMASSAMSGLGV

SEQ ID NO: 1546334 - protein, 17 aa, Mycobacterium tuberculosis
MVDRAVGAFGGIDYLVN

SEQ ID NO: 1546335 - protein, 21 aa, Mycobacterium tuberculosis
NDPPTIVAILSKLTGDIDPAK

SEQ ID NO: 1546336 - protein, 25 aa, Mycobacterium tuberculosis
NNRMLSQIWSHWSLLSAPSCAAQLD

SEQ ID NO: 1546337 - protein, 17 aa, Mycobacterium tuberculosis
NRLNVRYDLSWQSLDSA

SEQ ID NO: 1546338 - protein, 32 aa, Mycobacterium tuberculosis; identical to SEQ ID NO: 233960

SEQ ID NO: 1546339 - protein, 19 aa, Mycobacterium tuberculosis
NVRYDLSWQSLDSALARRA

SEQ ID NO: 1546340 - protein, 26 aa, Mycobacterium tuberculosis
PAGGMLRRMRPLFSVGLGARLGSGRQ

SEQ ID NO: 1546341 - protein, 26 aa, Mycobacterium tuberculosis
PAPTHRRWSQYLAWVADHIGLKVIHG

SEQ ID NO: 1546342 - protein, 22 aa, Mycobacterium tuberculosis
PDELNWRVGTVEMFTAATTANL

SEQ ID NO: 1546343 - protein, 20 aa, Mycobacterium tuberculosis
PDGAAVRYDKLLLATGSAPR

SEQ ID NO: 1546344 - protein, 33 aa, Mycobacterium tuberculosis; identical to SEQ ID NO: 233986

SEQ ID NO: 1546345 - protein, 25 aa, Mycobacterium tuberculosis
PFDPHLRPGGVIDMSHEMAPTTRLK

SEQ ID NO: 1546346 - protein, 19 aa, Mycobacterium tuberculosis
PGEYAELPYLFTDQYDLGM

SEQ ID NO: 1546347 - protein, 23 aa, Mycobacterium tuberculosis
PGHTRGSVVFRVLQATNNDKDIV

SEQ ID NO: 1546348 - protein, 23 aa, Mycobacterium tuberculosis
PGNPRVLSIAQFWDRAAGHDRIN

SEQ ID NO: 1546349 - protein, 19 aa, Mycobacterium tuberculosis
PHFSFSWYRGSPIGRERKT

SEQ ID NO: 1546350 - protein, 26 aa, Mycobacterium tuberculosis
PIYGLGPRIAQLVAGAFFREPKQVVE

SEQ ID NO: 1546351 - protein, 29 aa, Mycobacterium tuberculosis
PLTDLSTRCSLPISGLQAIGLMQAVQGAR

SEQ ID NO: 1546352 - protein, 18 aa, Mycobacterium tuberculosis
PPEINSARMFAGAGSGPL

SEQ ID NO: 1546353 - protein, 23 aa, Mycobacterium tuberculosis
PYQHVEKFIPRQITNVLTGRRPK

SEQ ID NO: 1546354 - protein, 22 aa, Mycobacterium tuberculosis
QADAISPWSGRYAIAYNADAGH

SEQ ID NO: 1546355 - protein, 22 aa, Mycobacterium tuberculosis
QADCFAGVYLWWVAEGKSTRFT

SEQ ID NO: 1546356 - protein, 20 aa, Mycobacterium tuberculosis
QLLWYRPDLVNSPPTDWNAM

SEQ ID NO: 1546357 - protein, 18 aa, Mycobacterium tuberculosis
QLVGSMSVPPTWQGSIPI

SEQ ID NO: 1546358 - protein, 23 aa, Mycobacterium tuberculosis
QPACGKAGCQTYKWETFLTSELP

SEQ ID NO: 1546359 - protein, 27 aa, Mycobacterium tuberculosis
QRDGLTLGEALALWLSGQEQLMPRDLV

SEQ ID NO: 1546360 - protein, 19 aa, Mycobacterium tuberculosis
RAAYQVGGRTWLRAGAGII

SEQ ID NO: 1546361 - protein, 20 aa, Mycobacterium tuberculosis
RAGAAFLVLGIAAATFPQSA

SEQ ID NO: 1546362 - protein, 20 aa, Mycobacterium tuberculosis
RDGAAPKWWFTVGGQVRPGE

SEQ ID NO: 1546363 - protein, 24 aa, Mycobacterium tuberculosis
REAARAATLRAVRSLTGVPIDYFA

SEQ ID NO: 1546364 - protein, 19 aa, Mycobacterium tuberculosis
REHYAELEIKAFAVEHAGS

SEQ ID NO: 1546365 - protein, 17 aa, Mycobacterium tuberculosis
REIAPFMSYGKFTGDAP

SEQ ID NO: 1546366 - protein, 19 aa, Mycobacterium tuberculosis
RGMTPRAALTKHLLDGDDS

SEQ ID NO: 1546367 - protein, 21 aa, Mycobacterium tuberculosis
RLDSVSLPWSVTVETTLPAVS

SEQ ID NO: 1546368 - protein, 31 aa, Mycobacterium tuberculosis; identical to SEQ ID NO: 234150

SEQ ID NO: 1546369 - protein, 24 aa, Mycobacterium tuberculosis
RRGMSQIGVPYSWGGGNAAGPSKG

SEQ ID NO: 1546370 - protein, 20 aa, Mycobacterium tuberculosis
RRKNEPPGIAQITLGKNKDR

SEQ ID NO: 1546371 - protein, 19 aa, Mycobacterium tuberculosis
RRRLLAVLIALALPGAAVA

SEQ ID NO: 1546372 - protein, 23 aa, Mycobacterium tuberculosis
RVFAGGMATGFIGVVLVTAGKAS

SEQ ID NO: 1546373 - protein, 18 aa, Mycobacterium tuberculosis
RWTIAILAVVAALMAALV

SEQ ID NO: 1546374 - protein, 24 aa, Mycobacterium tuberculosis
SAQRLADCVRRLRTRGAVVVVGTC

SEQ ID NO: 1546375 - protein, 23 aa, Mycobacterium tuberculosis
SARPADCVGVGYLTQRNVYRSVE

SEQ ID NO: 1546376 - protein, 23 aa, Mycobacterium tuberculosis
SASPEPIVKVWAGEVGLDDQHVV

SEQ ID NO: 1546377 - protein, 23 aa, Mycobacterium tuberculosis
SATWRARPRLAITPDGLAIRGWF

SEQ ID NO: 1546378 - protein, 20 aa, Mycobacterium tuberculosis
SDPTDWAALTFDERRDALAR

SEQ ID NO: 1546379 - protein, 25 aa, Mycobacterium tuberculosis
SFAGQGVGFGGWYAPVALHVDTESI

SEQ ID NO: 1546380 - protein, 21 aa, Mycobacterium tuberculosis
SGAAIPAFKPLGGRELGAGMS

SEQ ID NO: 1546381 - protein, 21 aa, Mycobacterium tuberculosis
SGATPSFLGYHGYPASICASI

SEQ ID NO: 1546382 - protein, 18 aa, Mycobacterium tuberculosis
SIGKRCLLGANSGLGISL

SEQ ID NO: 1546383 - protein, 35 aa, Mycobacterium tuberculosis; identical to SEQ ID NO: 234269

SEQ ID NO: 1546384 - protein, 25 aa, Mycobacterium tuberculosis
SLGAPCSSWERFIFGRGPSGQAEAC

SEQ ID NO: 1546385 - protein, 17 aa, Mycobacterium tuberculosis
SNALCANEILSLLDGET

SEQ ID NO: 1546386 - protein, 32 aa, Mycobacterium tuberculosis; identical to SEQ ID NO: 234281

SEQ ID NO: 1546387 - protein, 17 aa, Mycobacterium tuberculosis
SRYALAVQHERGLPMQS

SEQ ID NO: 1546388 - protein, 19 aa, Mycobacterium tuberculosis
STEDFPIPRRMIATTCDAE

SEQ ID NO: 1546389 - protein, 24 aa, Mycobacterium tuberculosis
SVESRPGWADVPGLMVPGAAPVLP

SEQ ID NO: 1546390 - protein, 20 aa, Mycobacterium tuberculosis
TALGTCWAVTVMGSSNTVVA

SEQ ID NO: 1546391 - protein, 25 aa, Mycobacterium tuberculosis
TGLFPPELSGGIGNILNIGAGNWAS

SEQ ID NO: 1546392 - protein, 25 aa, Mycobacterium tuberculosis
TGSRGLRYATVIALVAALVGGVYVL

SEQ ID NO: 1546393 - protein, 19 aa, Mycobacterium tuberculosis
TINKAHWFFSLSPAERRDY

SEQ ID NO: 1546394 - protein, 20 aa, Mycobacterium tuberculosis
TLYDELCWAPKHTDFEEGLR

SEQ ID NO: 1546395 - protein, 33 aa, Mycobacterium tuberculosis; identical to SEQ ID NO: 234358

SEQ ID NO: 1546396 - protein, 20 aa, Mycobacterium tuberculosis
TPVPACSRGTLSRIEAALAD

SEQ ID NO: 1546397 - protein, 17 aa, Mycobacterium tuberculosis
TSPGGDRLYAFNTNDYR

SEQ ID NO: 1546398 - protein, 21 aa, Mycobacterium tuberculosis
TSTLPGAGWTAAAPQAAAGTF

SEQ ID NO: 1546399 - protein, 17 aa, Mycobacterium tuberculosis
TVRLKAPTIDFTLRLGH

SEQ ID NO: 1546400 - protein, 31 aa, Mycobacterium tuberculosis; identical to SEQ ID NO: 234396

SEQ ID NO: 1546401 - protein, 27 aa, Mycobacterium tuberculosis
VDAFAALKRLTMVTSHVLAETKVDFGE

SEQ ID NO: 1546402 - protein, 24 aa, Mycobacterium tuberculosis
VDVQAVIMSPNLVAARFIQLTPVY

SEQ ID NO: 1546403 - protein, 27 aa, Mycobacterium tuberculosis
VKIPGGALCGKLAVPVDYDRPDGDVAA

SEQ ID NO: 1546404 - protein, 20 aa, Mycobacterium tuberculosis
VKVVRLGGAGRGFSSGGAIS

SEQ ID NO: 1546405 - protein, 25 aa, Mycobacterium tuberculosis
VPDYYWCPGQPFDPAWGPNWDPYTC

SEQ ID NO: 1546406 - protein, 20 aa, Mycobacterium tuberculosis
VPFTGVPGYNHIKIKEAYGL

SEQ ID NO: 1546407 - protein, 21 aa, Mycobacterium tuberculosis
VSALQAALFTAYGTFYQQVSA

SEQ ID NO: 1546408 - protein, 21 aa, Mycobacterium tuberculosis
VSLAAVFLALAMGVVLGSGFF

SEQ ID NO: 1546409 - protein, 17 aa, Mycobacterium tuberculosis
VTTMKSRVIDIVEENGF

SEQ ID NO: 1546410 - protein, 20 aa, Mycobacterium tuberculosis
VVAFSIPRDDWVPFTGVPGY

SEQ ID NO: 1546411 - protein, 23 aa, Mycobacterium tuberculosis
VVDAPWAPFAVDFHLANVGGPSA

SEQ ID NO: 1546412 - protein, 25 aa, Mycobacterium tuberculosis
VVQRLRAGSVPHLPGSVPQLPGSVL

SEQ ID NO: 1546413 - protein, 24 aa, Mycobacterium tuberculosis
VYTRGGGPVQRWRREVPFDVHLMI

SEQ ID NO: 1546414 - protein, 19 aa, Mycobacterium tuberculosis
WIIILDDWTDGIGKSPQQL

SEQ ID NO: 1546415 - protein, 27 aa, Mycobacterium tuberculosis
WQASEIYPPLKAWQRMGRPTIAVNANF

SEQ ID NO: 1546416 - protein, 18 aa, Mycobacterium tuberculosis
WQASGGWTDGAHRLGTSP

SEQ ID NO: 1546417 - protein, 17 aa, Mycobacterium tuberculosis
WSSLTTMILPVGGAPYV

SEQ ID NO: 1546418 - protein, 23 aa, Mycobacterium tuberculosis
WVASNVVRWVPHRYWPPHTRVSV

SEQ ID NO: 1546419 - protein, 20 aa, Mycobacterium tuberculosis
WYRDNESWWRPLKDATEARY

SEQ ID NO: 1546420 - protein, 17 aa, Mycobacterium tuberculosis
YISLIPVNVVADIEAAT

SEQ ID NO: 1546421 - protein, 23 aa, Mycobacterium tuberculosis
YNHIKIKEAYGLTKQYVAEQLAN

SEQ ID NO: 1546422 - protein, 25 aa, Mycobacterium tuberculosis
AAAEIAAATGMVFAVFADDDSLAAF

SEQ ID NO: 1546423 - protein, 25 aa, Mycobacterium tuberculosis
AAEALSWGLVSAVYPAADFDAEVDK

SEQ ID NO: 1546424 - protein, 19 aa, Mycobacterium tuberculosis
AAISALVLPSAFRPIPDPN

SEQ ID NO: 1546425 - protein, 23 aa, Mycobacterium tuberculosis
AARYLCSGGLNLRDPAQVMAALL

SEQ ID NO: 1546426 - protein, 24 aa, Mycobacterium tuberculosis
ACELPGRLHALFARGDGVTPRVVL

SEQ ID NO: 1546427 - protein, 26 aa, Mycobacterium tuberculosis
ACPDAEVVFARGRFEPPGIGTVGNAF

SEQ ID NO: 1546428 - protein, 18 aa, Mycobacterium tuberculosis
ADESMLLSFERWAPDMGW

SEQ ID NO: 1546429 - protein, 20 aa, Mycobacterium tuberculosis
AGADMLVRAWVRSYGVRATI

SEQ ID NO: 1546430 - protein, 23 aa, Mycobacterium tuberculosis
AGDARLPASGMLFVGTPDGQIVA

SEQ ID NO: 1546431 - protein, 17 aa, Mycobacterium tuberculosis
AGGGAPVGNPADLQSLL

SEQ ID NO: 1546432 - protein, 20 aa, Mycobacterium tuberculosis
AIPARWTLDNGATFRGVDPG

SEQ ID NO: 1546433 - protein, 18 aa, Mycobacterium tuberculosis
ALLPMLACWLRRPAQQGR

SEQ ID NO: 1546434 - protein, 17 aa, Mycobacterium tuberculosis
ALREKLSAADNFDIQVG

SEQ ID NO: 1546435 - protein, 18 aa, Mycobacterium tuberculosis
ALRQRISQQLFSFGDPTV

SEQ ID NO: 1546436 - protein, 17 aa, Mycobacterium tuberculosis
ARGAWRASRATAGYSSA

SEQ ID NO: 1546437 - protein, 18 aa, Mycobacterium tuberculosis
ASAAAFEAAFAMTVPPAE

SEQ ID NO: 1546438 - protein, 18 aa, Mycobacterium tuberculosis
AVCSLALMLAMFGANVYA

SEQ ID NO: 1546439 - protein, 25 aa, Mycobacterium tuberculosis
AWLYSQRRFEVPSDKIANTMKLAIV

SEQ ID NO: 1546440 - protein, 18 aa, Mycobacterium tuberculosis
DAHKVLAMASNRKYGLDL

SEQ ID NO: 1546441 - protein, 25 aa, Mycobacterium tuberculosis
DAQSGSIGLGFAIPVDQAKRIADEL

SEQ ID NO: 1546442 - protein, 25 aa, Mycobacterium tuberculosis
DDLGALSSWYVWAALGLYPSTPGTT

SEQ ID NO: 1546443 - protein, 19 aa, Mycobacterium tuberculosis
DDLVLAWAAQSGRFPGFDA

SEQ ID NO: 1546444 - protein, 23 aa, Mycobacterium tuberculosis
DGYPQRFGIPDGLYAEPVAVKQG

SEQ ID NO: 1546445 - protein, 19 aa, Mycobacterium tuberculosis
DVSDRLVGITSDIGSVTVA

SEQ ID NO: 1546446 - protein, 22 aa, Mycobacterium tuberculosis
EAKAVDVLARIMGSSYQRLVAA

SEQ ID NO: 1546447 - protein, 25 aa, Mycobacterium tuberculosis
EANGGLRYAPRADLATREEQIAVAE

SEQ ID NO: 1546448 - protein, 17 aa, Mycobacterium tuberculosis
EDLFRRMGDLAGGNVEF

SEQ ID NO: 1546449 - protein, 17 aa, Mycobacterium tuberculosis
EDLVGMCLFLLSDSASW

SEQ ID NO: 1546450 - protein, 25 aa, Mycobacterium tuberculosis
EDVFARGGPYLARAAADLVPTATLL

SEQ ID NO: 1546451 - protein, 24 aa, Mycobacterium tuberculosis
ELERRYDARLGVYVPATGTTAAIE

SEQ ID NO: 1546452 - protein, 25 aa, Mycobacterium tuberculosis
EPGFGVPWLYNYIGQPWKTQRTVDR

SEQ ID NO: 1546453 - protein, 18 aa, Mycobacterium tuberculosis
ERRYIMVIESLQPADDAT

SEQ ID NO: 1546454 - protein, 18 aa, Mycobacterium tuberculosis
ESAPKAPAVEELRSPLDQ

SEQ ID NO: 1546455 - protein, 20 aa, Mycobacterium tuberculosis
ESIVRTGGDLTFSLAGTPNK

SEQ ID NO: 1546456 - protein, 28 aa, Mycobacterium tuberculosis
ESLPLASIFKLYVLHALAGAVQHNTVSW

SEQ ID NO: 1546457 - protein, 17 aa, Mycobacterium tuberculosis
EYVIRRAGSQMGVPYSW

SEQ ID NO: 1546458 - protein, 18 aa, Mycobacterium tuberculosis
FADHSGVDWKGTLTGLAG

SEQ ID NO: 1546459 - protein, 23 aa, Mycobacterium tuberculosis
FALLCGDLSAPVTFAVDRTGWAP

SEQ ID NO: 1546460 - protein, 24 aa, Mycobacterium tuberculosis
FGPNPLDPLCRVNSAMAGRQQGRR

SEQ ID NO: 1546461 - protein, 25 aa, Mycobacterium tuberculosis
FNCLAPGMWPAWWLSNDDPGRSGEI

SEQ ID NO: 1546462 - protein, 20 aa, Mycobacterium tuberculosis
FPFAGGLGLMSNRASEVVAN

SEQ ID NO: 1546463 - protein, 21 aa, Mycobacterium tuberculosis
GAHPSTWYKAFNYNLATSQPI

SEQ ID NO: 1546464 - protein, 23 aa, Mycobacterium tuberculosis
GDAWLNRHLSAYANWAKTNNSLL

SEQ ID NO: 1546465 - protein, 19 aa, Mycobacterium tuberculosis
GDRLYAFNTNDYRPTVISS

SEQ ID NO: 1546466 - protein, 25 aa, Mycobacterium tuberculosis
GGIIQDIEELLGITFVQNAINGAVN

SEQ ID NO: 1546467 - protein, 17 aa, Mycobacterium tuberculosis
GKPGEDGVFRFEPSPVE

SEQ ID NO: 1546468 - protein, 21 aa, Mycobacterium tuberculosis
GNEPSRTWFAAMKPIANNFGE

SEQ ID NO: 1546469 - protein, 19 aa, Mycobacterium tuberculosis
GNTIAWLYSQRRFEVPSDK

SEQ ID NO: 1546470 - protein, 19 aa, Mycobacterium tuberculosis
GPTGFPPGLWARQTTEIRS

SEQ ID NO: 1546471 - protein, 18 aa, Mycobacterium tuberculosis
GQFELNRPATLIAALPAI

SEQ ID NO: 1546472 - protein, 25 aa, Mycobacterium tuberculosis
GQPWVVSFQLNWPRDHGPTVTGWML

SEQ ID NO: 1546473 - protein, 22 aa, Mycobacterium tuberculosis
GRIAGASVTLEWSVDDFAISRF

SEQ ID NO: 1546474 - protein, 32 aa, Mycobacterium tuberculosis; identical to SEQ ID NO: 233605

SEQ ID NO: 1546475 - protein, 21 aa, Mycobacterium tuberculosis
GSANRPAAVAVTRADADMAAE

SEQ ID NO: 1546476 - protein, 21 aa, Mycobacterium tuberculosis
GSGADPLWFTSLFSQHTLDLL

SEQ ID NO: 1546477 - protein, 26 aa, Mycobacterium tuberculosis
GSRLGPARTAAICAVSPALWLSAGSV

SEQ ID NO: 1546478 - protein, 17 aa, Mycobacterium tuberculosis
GSSNRFSPAPAPAPIAS

SEQ ID NO: 1546479 - protein, 20 aa, Mycobacterium tuberculosis
GTEVPPVIDGSIWDAIAGCE

SEQ ID NO: 1546480 - protein, 23 aa, Mycobacterium tuberculosis
GYGRPNARLAATIGTIADACAPA

SEQ ID NO: 1546481 - protein, 25 aa, Mycobacterium tuberculosis
HPVSPRARASFYGYGFNVGVTSSGR

SEQ ID NO: 1546482 - protein, 24 aa, Mycobacterium tuberculosis
HTSGTLACLVRLANPPPRPETAYG

SEQ ID NO: 1546483 - protein, 23 aa, Mycobacterium tuberculosis
IAADDFWYLWQQMVTQPGVVDPA

SEQ ID NO: 1546484 - protein, 24 aa, Mycobacterium tuberculosis
ICSDGNRWRAHLGYVPGMTNQAAR

SEQ ID NO: 1546485 - protein, 18 aa, Mycobacterium tuberculosis
IDGYRVLTDPVWSDRCSP

SEQ ID NO: 1546486 - protein, 33 aa, Mycobacterium tuberculosis; identical to SEQ ID NO: 233697

SEQ ID NO: 1546487 - protein, 21 aa, Mycobacterium tuberculosis
IGATDLCEFVEFPSQLLQVCG

SEQ ID NO: 1546488 - protein, 20 aa, Mycobacterium tuberculosis
IISRAEWGADESLRCETPEY

SEQ ID NO: 1546489 - protein, 17 aa, Mycobacterium tuberculosis
ILTRYLNLVSFGNNSFG

SEQ ID NO: 1546490 - protein, 26 aa, Mycobacterium tuberculosis
IQSTFVGAICRWQAANPAGLIDITRF

SEQ ID NO: 1546491 - protein, 19 aa, Mycobacterium tuberculosis
IRAEVAAAFGSAPPTSQTA

SEQ ID NO: 1546492 - protein, 19 aa, Mycobacterium tuberculosis
IRSTNRLAYLDAHATSQFE

SEQ ID NO: 1546493 - protein, 21 aa, Mycobacterium tuberculosis
ISETYPPGSTFKVITTAAALA

SEQ ID NO: 1546494 - protein, 20 aa, Mycobacterium tuberculosis
KDVGFPYRSALVPRRNAELD

SEQ ID NO: 1546495 - protein, 25 aa, Mycobacterium tuberculosis
KQDPEGWGKSPGFGTTVDFPAVPGA

SEQ ID NO: 1546496 - protein, 19 aa, Mycobacterium tuberculosis
KQTAIEPLPPMPGPSPTRP

SEQ ID NO: 1546497 - protein, 23 aa, Mycobacterium tuberculosis
KRRFSRRGFLGAGIASGFALAAC

SEQ ID NO: 1546498 - protein, 21 aa, Mycobacterium tuberculosis
KRSEAAAEYAALGYLKYPKAV

SEQ ID NO: 1546499 - protein, 20 aa, Mycobacterium tuberculosis
LAEPGPRSAKEFYRGAPHGV

SEQ ID NO: 1546500 - protein, 31 aa, Mycobacterium tuberculosis; identical to SEQ ID NO: 233787

SEQ ID NO: 1546501 - protein, 19 aa, Mycobacterium tuberculosis
LATEIARAAGKLVSATSET

SEQ ID NO: 1546502 - protein, 17 aa, Mycobacterium tuberculosis
LGGLGINLGGPAASAPS

SEQ ID NO: 1546503 - protein, 17 aa, Mycobacterium tuberculosis
LLLVLAFAGGYAVAACK

SEQ ID NO: 1546504 - protein, 17 aa, Mycobacterium tuberculosis
LLVLCMLASKPIGAATA

SEQ ID NO: 1546505 - protein, 23 aa, Mycobacterium tuberculosis
LNDNRVDAIVGWRQAGGNLATLL

SEQ ID NO: 1546506 - protein, 23 aa, Mycobacterium tuberculosis
LPRGCIAAGDRAFFCDYVQEYLS

SEQ ID NO: 1546507 - protein, 18 aa, Mycobacterium tuberculosis
LSAGYTFMGFAEDLPAVG

SEQ ID NO: 1546508 - protein, 21 aa, Mycobacterium tuberculosis
LSQRDIVLWAAHVVDRVAAGG

SEQ ID NO: 1546509 - protein, 17 aa, Mycobacterium tuberculosis
LSVPAGWSTAAPAMTSG

SEQ ID NO: 1546510 - protein, 22 aa, Mycobacterium tuberculosis
LTTEQWLGPASMSMVVAAQPYL

SEQ ID NO: 1546511 - protein, 27 aa, Mycobacterium tuberculosis
LVATTSGYRAGLLASIAASCTASYTVA

SEQ ID NO: 1546512 - protein, 19 aa, Mycobacterium tuberculosis
LVGMCLFLLSDSASWITGQ

SEQ ID NO: 1546513 - protein, 17 aa, Mycobacterium tuberculosis
LVTELRQLGPVLESLAN

SEQ ID NO: 1546514 - protein, 22 aa, Mycobacterium tuberculosis
NNLPAKFLEGFVRTSNIKFQDA

SEQ ID NO: 1546515 - protein, 22 aa, Mycobacterium tuberculosis
NPVQFICGGSFDTAAGPSAPDY

SEQ ID NO: 1546516 - protein, 18 aa, Mycobacterium tuberculosis
PAAPIPLASPNIYRGDAS

SEQ ID NO: 1546517 - protein, 26 aa, Mycobacterium tuberculosis
PARKLREIRMALTLDKTFTKSEILTR

SEQ ID NO: 1546518 - protein, 23 aa, Mycobacterium tuberculosis
PEPWRVEALVLLAFSAYARGDGP

SEQ ID NO: 1546519 - protein, 23 aa, Mycobacterium tuberculosis
PERYYDMLRKFGLGQRTGVGLPG

SEQ ID NO: 1546520 - protein, 32 aa, Mycobacterium tuberculosis; identical to SEQ ID NO: 233993

SEQ ID NO: 1546521 - protein, 19 aa, Mycobacterium tuberculosis
PIVQAVLFNAIDFVDGTVT

SEQ ID NO: 1546522 - protein, 21 aa, Mycobacterium tuberculosis
PKPQNYPGLPTVSFVIPNADN

SEQ ID NO: 1546523 - protein, 24 aa, Mycobacterium tuberculosis
PLHVRLGQRPTLMFDNTTMMYHPI

SEQ ID NO: 1546524 - protein, 20 aa, Mycobacterium tuberculosis
PPTAPRRPSDPGALVKAPSN

SEQ ID NO: 1546525 - protein, 24 aa, Mycobacterium tuberculosis
PSGVAGSWHIRWAALTPARQAAVI

SEQ ID NO: 1546526 - protein, 18 aa, Mycobacterium tuberculosis
PTACSFSIGTSHSHSVSK

SEQ ID NO: 1546527 - protein, 26 aa, Mycobacterium tuberculosis
PTDSFAVLALLCRRLSHDEVKAVANE

SEQ ID NO: 1546528 - protein, 27 aa, Mycobacterium tuberculosis
PTITARLNFQLAFGARVGQRLADAREQ

SEQ ID NO: 1546529 - protein, 23 aa, Mycobacterium tuberculosis
PTPDSPTGWVYIVADSFTRGEPA

SEQ ID NO: 1546530 - protein, 28 aa, Mycobacterium tuberculosis
PTVGCGVSLALACDLVLASDNAFFMLAH

SEQ ID NO: 1546531 - protein, 18 aa, Mycobacterium tuberculosis
QHLAGAYVSSGMVNQAAD

SEQ ID NO: 1546532 - protein, 17 aa, Mycobacterium tuberculosis
QKMRAVLVADNPGVWVM

SEQ ID NO: 1546533 - protein, 22 aa, Mycobacterium tuberculosis
QPDRPSAMPPRGAVTGPPSPVA

SEQ ID NO: 1546534 - protein, 30 aa, Mycobacterium tuberculosis; identical to SEQ ID NO: 234095

SEQ ID NO: 1546535 - protein, 19 aa, Mycobacterium tuberculosis
RAGGLMSALTPQFGSKTIN

SEQ ID NO: 1546536 - protein, 22 aa, Mycobacterium tuberculosis
RANDIAVVWSPTGVPYVVAVMS

SEQ ID NO: 1546537 - protein, 18 aa, Mycobacterium tuberculosis
RDRLRSGNLQELIDTKSV

SEQ ID NO: 1546538 - protein, 24 aa, Mycobacterium tuberculosis
REFHLCVVDAPTLHNAAEALHRQF

SEQ ID NO: 1546539 - protein, 19 aa, Mycobacterium tuberculosis
RELLVAMAMLVSVTGCARH

SEQ ID NO: 1546540 - protein, 27 aa, Mycobacterium tuberculosis
RFRYPRNGWPALFHVRSGASLAGNYAA

SEQ ID NO: 1546541 - protein, 19 aa, Mycobacterium tuberculosis
RGSDGVVIPGSYRNRHKAV

SEQ ID NO: 1546542 - protein, 23 aa, Mycobacterium tuberculosis
RGVASSRPAIWCNSDADNDRLRA

SEQ ID NO: 1546543 - protein, 30 aa, Mycobacterium tuberculosis; identical to SEQ ID NO: 143350

SEQ ID NO: 1546544 - protein, 20 aa, Mycobacterium tuberculosis
RLAGMTTWVASIALLAAALS

SEQ ID NO: 1546545 - protein, 19 aa, Mycobacterium tuberculosis
RLDNLMAVARKDVVLSAGW

SEQ ID NO: 1546546 - protein, 19 aa, Mycobacterium tuberculosis
RLYPVRLTTTMTRFISAAV

SEQ ID NO: 1546547 - protein, 20 aa, Mycobacterium tuberculosis
RNCRLHWVQIIPTIASQSTP

SEQ ID NO: 1546548 - protein, 24 aa, Mycobacterium tuberculosis
RPEHHEFKQAAVLTDLPGELMSAL

SEQ ID NO: 1546549 - protein, 17 aa, Mycobacterium tuberculosis
RTALSYVSVDGARANLD

SEQ ID NO: 1546550 - protein, 21 aa, Mycobacterium tuberculosis
RTYWEGAVALEGRYQGMPISG

SEQ ID NO: 1546551 - protein, 39 aa, Mycobacterium tuberculosis; identical to SEQ ID NO: 234213

SEQ ID NO: 1546552 - protein, 22 aa, Mycobacterium tuberculosis
SDVPVELAALIGRDDDRRTETI

SEQ ID NO: 1546553 - protein, 20 aa, Mycobacterium tuberculosis
SELPGWLQANRHVKPTGSAV

SEQ ID NO: 1546554 - protein, 21 aa, Mycobacterium tuberculosis
SFAIGLAMMLAPMVAAPGLAA

SEQ ID NO: 1546555 - protein, 21 aa, Mycobacterium tuberculosis
SGAYPRWALANSATGMMSGDS

SEQ ID NO: 1546556 - protein, 27 aa, Mycobacterium tuberculosis
SGGAKGCPKETWCVVNAGNYRGSMNVT

SEQ ID NO: 1546557 - protein, 22 aa, Mycobacterium tuberculosis
SGRNRLKYIDGLTIDRQPSNQT

SEQ ID NO: 1546558 - protein, 18 aa, Mycobacterium tuberculosis
SQLPAGVVQINRRNYLMV

SEQ ID NO: 1546559 - protein, 25 aa, Mycobacterium tuberculosis
STNTICLDIDWVIGGCMSVDPTHNT

SEQ ID NO: 1546560 - protein, 24 aa, Mycobacterium tuberculosis
STSSRFTDFLARPNHAVNHVKVAD

SEQ ID NO: 1546561 - protein, 17 aa, Mycobacterium tuberculosis
SVPAGFTRIAAFRAGVG

SEQ ID NO: 1546562 - protein, 20 aa, Mycobacterium tuberculosis
SWTARTWQMLAARGVRIAAD

SEQ ID NO: 1546563 - protein, 25 aa, Mycobacterium tuberculosis
TEAPDYLPVVLEFAATVDPEAGRRL

SEQ ID NO: 1546564 - protein, 21 aa, Mycobacterium tuberculosis
TLFRPDTRLAVTIPTVDPQRG

SEQ ID NO: 1546565 - protein, 17 aa, Mycobacterium tuberculosis
TLVGLMLTLLPAPTSAA

SEQ ID NO: 1546566 - protein, 21 aa, Mycobacterium tuberculosis
TMEALWWDRPFALAGVDIGAS

SEQ ID NO: 1546567 - protein, 18 aa, Mycobacterium tuberculosis
TPEALAWSRQRANLPPCP

SEQ ID NO: 1546568 - protein, 20 aa, Mycobacterium tuberculosis
TVASCPNTRIVLGGYSQGAT

SEQ ID NO: 1546569 - protein, 17 aa, Mycobacterium tuberculosis
TVYGWDETVFFRNGDPF

SEQ ID NO: 1546570 - protein, 19 aa, Mycobacterium tuberculosis
VDMAIKLGLRSYANPGTAR

SEQ ID NO: 1546571 - protein, 25 aa, Mycobacterium tuberculosis
VELPLCALLTAWVRGQARPEARAQV

SEQ ID NO: 1546572 - protein, 22 aa, Mycobacterium tuberculosis
VEPRLWNMSTVLPILQDTTIVA

SEQ ID NO: 1546573 - protein, 17 aa, Mycobacterium tuberculosis
VGLYPGDQVRVLGVPVG

SEQ ID NO: 1546574 - protein, 25 aa, Mycobacterium tuberculosis
VGSTVCSAGKYARKHVPWVNFSNVP

SEQ ID NO: 1546575 - protein, 18 aa, Mycobacterium tuberculosis
VPELPDWAQTVTVEQLMH

SEQ ID NO: 1546576 - protein, 19 aa, Mycobacterium tuberculosis
VPPAEAKRGDLIFYGPGGG

SEQ ID NO: 1546577 - protein, 19 aa, Mycobacterium tuberculosis
VRARLRRRGPVTVYGVDKF

SEQ ID NO: 1546578 - protein, 21 aa, Mycobacterium tuberculosis
VRSRFPSSGPYKIESVLDDGA

SEQ ID NO: 1546579 - protein, 24 aa, Mycobacterium tuberculosis
VTFSDGRTAPFTVVGADPTSDIAV

SEQ ID NO: 1546580 - protein, 26 aa, Mycobacterium tuberculosis
VVLLDDRWWFHFALSGVLTALDDLFG

SEQ ID NO: 1546581 - protein, 22 aa, Mycobacterium tuberculosis
VVPVDPPPGFGYTRSGVPVKSF

SEQ ID NO: 1546582 - protein, 18 aa, Mycobacterium tuberculosis
VWHTFCIDQCSIAFTADI

SEQ ID NO: 1546583 - protein, 27 aa, Mycobacterium tuberculosis
WDEVKEGLTRLAADLSPAAGELQGPLG

SEQ ID NO: 1546584 - protein, 18 aa, Mycobacterium tuberculosis
WDRPFALAGVDIGASVAA

SEQ ID NO: 1546585 - protein, 20 aa, Mycobacterium tuberculosis
WFVDRPELIGADGVHPNDAG

SEQ ID NO: 1546586 - protein, 17 aa, Mycobacterium tuberculosis
WQMLAARGVRIAADVAA

SEQ ID NO: 1546587 - protein, 17 aa, Mycobacterium tuberculosis
WRAGAARRLTSLVAAAF

SEQ ID NO: 1546588 - protein, 18 aa, Mycobacterium tuberculosis
YAVPYARSTPLFYYNKAA

SEQ ID NO: 1546589 - protein, 19 aa, Mycobacterium tuberculosis
YLDGKRCWANQVIFGVTGP

SEQ ID NO: 1546590 - protein, 17 aa, Mycobacterium tuberculosis
YLSRAGISKEQVATGGY

SEQ ID NO: 1546591 - protein, 17 aa, Mycobacterium tuberculosis
YMLDMTFPVDYPDQQAL

SEQ ID NO: 1546592 - protein, 24 aa, Mycobacterium tuberculosis
YSDGRPVTCDDLVLAWAAQSGRFP

SEQ ID NO: 1546593 - protein, 20 aa, Mycobacterium tuberculosis
AAHPPWDPVIAVGNTARQPA

SEQ ID NO: 1546594 - protein, 22 aa, Mycobacterium tuberculosis
ADTRGGQLLVYGVDPLILRQAY

SEQ ID NO: 1546595 - protein, 25 aa, Mycobacterium tuberculosis
AEGISVNVTLIFSVQRYREVMDAYL

SEQ ID NO: 1546596 - protein, 20 aa, Mycobacterium tuberculosis
AEQAELWGGTADEPFDPNYH

SEQ ID NO: 1546597 - protein, 22 aa, Mycobacterium tuberculosis
AGGYAVAACKTVTLTVDGTAMR

SEQ ID NO: 1546598 - protein, 24 aa, Mycobacterium tuberculosis
AGTGFLAQLCVDWETATRPAQQSG

SEQ ID NO: 1546599 - protein, 24 aa, Mycobacterium tuberculosis
AHYGEMWAQDALAMYGYAASSAAA

SEQ ID NO: 1546600 - protein, 18 aa, Mycobacterium tuberculosis
AIARRSDGKLVLGSADGA

SEQ ID NO: 1546601 - protein, 19 aa, Mycobacterium tuberculosis
AKVDNGRCDPVAGTNTGES

SEQ ID NO: 1546602 - protein, 17 aa, Mycobacterium tuberculosis
APLGEPLPAAPADPAPP

SEQ ID NO: 1546603 - protein, 24 aa, Mycobacterium tuberculosis
AQPIGCPAFHAFPASRWRRYDKLE

SEQ ID NO: 1546604 - protein, 25 aa, Mycobacterium tuberculosis
ASCSVPGAWPPVTIAGRRYMDGGVA

SEQ ID NO: 1546605 - protein, 25 aa, Mycobacterium tuberculosis
ATGLSAKGAKTFAVDAASAYCPQYV

SEQ ID NO: 1546606 - protein, 22 aa, Mycobacterium tuberculosis
ATLRERFGYDAWALIYDVDTVR

SEQ ID NO: 1546607 - protein, 23 aa, Mycobacterium tuberculosis
AVAEFPGFAFFEIQLRLPVNGRW

SEQ ID NO: 1546608 - protein, 24 aa, Mycobacterium tuberculosis
AVTFADSYQPAWVYQGQDVDDVRD

SEQ ID NO: 1546609 - protein, 27 aa, Mycobacterium tuberculosis
AVVVAFLTTGCIRWSTQSRPVVNGPAA

SEQ ID NO: 1546610 - protein, 26 aa, Mycobacterium tuberculosis
AYSEERLRPPPGYKDTTVPGIFSRDT

SEQ ID NO: 1546611 - protein, 20 aa, Mycobacterium tuberculosis
DAYLQSWVHRTARFQDALQD

SEQ ID NO: 1546612 - protein, 19 aa, Mycobacterium tuberculosis
DINDAKLLAAFAAGAQAAG

SEQ ID NO: 1546613 - protein, 28 aa, Mycobacterium tuberculosis
DLPSSTQLPVWLAHAGIDVLRSHPIVAV

SEQ ID NO: 1546614 - protein, 26 aa, Mycobacterium tuberculosis
DPGAKSARPATVWIAQDGSHHLVRAS

SEQ ID NO: 1546615 - protein, 19 aa, Mycobacterium tuberculosis
DPIVWAFNCALNVVSTTPQ

SEQ ID NO: 1546616 - protein, 23 aa, Mycobacterium tuberculosis
DRQHRVAAVFLRELLAADLQPVV

SEQ ID NO: 1546617 - protein, 17 aa, Mycobacterium tuberculosis
DTPAMPPPIFVAASGPQ

SEQ ID NO: 1546618 - protein, 26 aa, Mycobacterium tuberculosis
DVDTFYTCLYRSLLHPNTFNDVDGRY

SEQ ID NO: 1546619 - protein, 21 aa, Mycobacterium tuberculosis
DVRTARIVTPRVMQFTLRANV

SEQ ID NO: 1546620 - protein, 23 aa, Mycobacterium tuberculosis
DYDRLPVSGAVVLVDRGVCPFAQ

SEQ ID NO: 1546621 - protein, 25 aa, Mycobacterium tuberculosis
EATMARWPRRRSMRFESSPHGKRID

SEQ ID NO: 1546622 - protein, 22 aa, Mycobacterium tuberculosis
EAVLALRARKGMVLDPTDHDTW

SEQ ID NO: 1546623 - protein, 22 aa, Mycobacterium tuberculosis
EKKCLLDLVELVGFDTEIDHRA

SEQ ID NO: 1546624 - protein, 22 aa, Mycobacterium tuberculosis
ELINQWYYNPAFFAIMSDCANT

SEQ ID NO: 1546625 - protein, 24 aa, Mycobacterium tuberculosis
EPLPRWWRPAGSLFDQFLGAAETD

SEQ ID NO: 1546626 - protein, 19 aa, Mycobacterium tuberculosis
EQPRLFYMHFWAENDAVAL

SEQ ID NO: 1546627 - protein, 25 aa, Mycobacterium tuberculosis
ESAELCAQYLAPVLDALKFNYLPFG

SEQ ID NO: 1546628 - protein, 29 aa, Mycobacterium tuberculosis
ETLTILGRFSASFGETFASGPYFKVLLAN

SEQ ID NO: 1546629 - protein, 22 aa, Mycobacterium tuberculosis
ETPGCVAYIGISFLDQASQRGL

SEQ ID NO: 1546630 - protein, 20 aa, Mycobacterium tuberculosis
FAVGPDRLARFVLVVLTQAE

SEQ ID NO: 1546631 - protein, 20 aa, Mycobacterium tuberculosis
FDARRVRQWGYNAANDPQAI

SEQ ID NO: 1546632 - protein, 20 aa, Mycobacterium tuberculosis
FDCSGLVRYAFAGVGVLIPR

SEQ ID NO: 1546633 - protein, 19 aa, Mycobacterium tuberculosis
FICNHCPYVQHVAAGLATL

SEQ ID NO: 1546634 - protein, 17 aa, Mycobacterium tuberculosis
FKAKPGQRIRIRIINSA

SEQ ID NO: 1546635 - protein, 19 aa, Mycobacterium tuberculosis
FRVPSMKPLAGTTFEHIRD

SEQ ID NO: 1546636 - protein, 21 aa, Mycobacterium tuberculosis
FSERARGAAGLADVVVTNHAL

SEQ ID NO: 1546637 - protein, 18 aa, Mycobacterium tuberculosis
GADESLRCETPEYDRGVR

SEQ ID NO: 1546638 - protein, 22 aa, Mycobacterium tuberculosis
GCYGPCKGAVVALEPSTGKILA

SEQ ID NO: 1546639 - protein, 24 aa, Mycobacterium tuberculosis
GDNISVKLFDDWSNLGSISELSTS

SEQ ID NO: 1546640 - protein, 20 aa, Mycobacterium tuberculosis
GEGAAAYGVLVTRPDGTRVE

SEQ ID NO: 1546641 - protein, 22 aa, Mycobacterium tuberculosis
GFRYVWASDHLQPWQDNEGHSM

SEQ ID NO: 1546642 - protein, 19 aa, Mycobacterium tuberculosis
GGLSHSISVASLVDRWRAV

SEQ ID NO: 1546643 - protein, 20 aa, Mycobacterium tuberculosis
GLGGLECLSGIPGSAGATPV

SEQ ID NO: 1546644 - protein, 17 aa, Mycobacterium tuberculosis
GSGPIDFWSSHPGQSSA

SEQ ID NO: 1546645 - protein, 28 aa, Mycobacterium tuberculosis
GTEVLQRLRGMFAFALWDTVTRELFCAR

SEQ ID NO: 1546646 - protein, 20 aa, Mycobacterium tuberculosis
GVRVPPRIIKATVAPDGSRT

SEQ ID NO: 1546647 - protein, 27 aa, Mycobacterium tuberculosis
GVTVAPALSLGSWVAFARTPDGQTMLM

SEQ ID NO: 1546648 - protein, 19 aa, Mycobacterium tuberculosis
GVVLGSGFFSDTLLSSLRS

SEQ ID NO: 1546649 - protein, 17 aa, Mycobacterium tuberculosis
HARALATEIARAAGKLV

SEQ ID NO: 1546650 - protein, 21 aa, Mycobacterium tuberculosis
HASGPKYMLDMTFPVDYPDQQ

SEQ ID NO: 1546651 - protein, 25 aa, Mycobacterium tuberculosis
HGNHEPGWVVAPGMQGMQVQPFTAN

SEQ ID NO: 1546652 - protein, 24 aa, Mycobacterium tuberculosis
HKSTWRSVPLVGHIPSAPGNPGRW

SEQ ID NO: 1546653 - protein, 23 aa, Mycobacterium tuberculosis
HSLSKIHSVASFFVSRVDTEIDK

SEQ ID NO: 1546654 - protein, 22 aa, Mycobacterium tuberculosis
HSRQLLAAQIIWTLARADIRGP

SEQ ID NO: 1546655 - protein, 20 aa, Mycobacterium tuberculosis
HTVAPFKVGPDFIDPGYHAL

SEQ ID NO: 1546656 - protein, 30 aa, Mycobacterium tuberculosis; identical to SEQ ID NO: 233682

SEQ ID NO: 1546657 - protein, 21 aa, Mycobacterium tuberculosis
IADACAPAGITVSDVTVDTPG

SEQ ID NO: 1546658 - protein, 20 aa, Mycobacterium tuberculosis
ICSAIQAGSRLGYQESAELC

SEQ ID NO: 1546659 - protein, 25 aa, Mycobacterium tuberculosis
IDPQHRLLLEVSWEAIEHAGVDPAT

SEQ ID NO: 1546660 - protein, 23 aa, Mycobacterium tuberculosis
IPNAVFLGHAFAALNPATVTAAA

SEQ ID NO: 1546661 - protein, 19 aa, Mycobacterium tuberculosis
IPSGGLFSGAEVKKSAEQA

SEQ ID NO: 1546662 - protein, 23 aa, Mycobacterium tuberculosis
IQLRLPVNGRWVLVVTGGTGAIS

SEQ ID NO: 1546663 - protein, 22 aa, Mycobacterium tuberculosis
IREFLERLATFTAELNNQRGDL

SEQ ID NO: 1546664 - protein, 17 aa, Mycobacterium tuberculosis
ITVILALHDLINGGHVG

SEQ ID NO: 1546665 - protein, 18 aa, Mycobacterium tuberculosis
ITVKDSYETAGMRTTCGR

SEQ ID NO: 1546666 - protein, 19 aa, Mycobacterium tuberculosis
IWRRDEVFEFNGSLIDSEE

SEQ ID NO: 1546667 - protein, 20 aa, Mycobacterium tuberculosis
KGQRGGNLWLSEVFGAELII

SEQ ID NO: 1546668 - protein, 21 aa, Mycobacterium tuberculosis
KLERFPRGIVPFGDAVASFNP

SEQ ID NO: 1546669 - protein, 18 aa, Mycobacterium tuberculosis
KTIQQAIELWKIVDRPNL

SEQ ID NO: 1546670 - protein, 18 aa, Mycobacterium tuberculosis
KTTYPVWMMNAIGDISFH

SEQ ID NO: 1546671 - protein, 17 aa, Mycobacterium tuberculosis
LAANVVGGIDWDGHGLL

SEQ ID NO: 1546672 - protein, 17 aa, Mycobacterium tuberculosis
LAGCCLLASVVATALTF

SEQ ID NO: 1546673 - protein, 22 aa, Mycobacterium tuberculosis
LARDRGRQMRKLGITIDFAPVV

SEQ ID NO: 1546674 - protein, 20 aa, Mycobacterium tuberculosis
LDVNPRYISLIPVNVVADIE

SEQ ID NO: 1546675 - protein, 19 aa, Mycobacterium tuberculosis
LDYADGIEPYFSVPATGIE

SEQ ID NO: 1546676 - protein, 19 aa, Mycobacterium tuberculosis
LELDLHYLPRLEGHGAPGV

SEQ ID NO: 1546677 - protein, 25 aa, Mycobacterium tuberculosis
LGQHGVNIMEFCKAYNAATENQRGN

SEQ ID NO: 1546678 - protein, 28 aa, Mycobacterium tuberculosis
LMAGAGPAPMLAAAAGWQTLSAALDAQA

SEQ ID NO: 1546679 - protein, 25 aa, Mycobacterium tuberculosis
LTRSLSLLATFPFPNETFQNFQRGE

SEQ ID NO: 1546680 - protein, 19 aa, Mycobacterium tuberculosis
LTYNFTFKFEKAGQGSVMV

SEQ ID NO: 1546681 - protein, 21 aa, Mycobacterium tuberculosis
LVGPGCAEYAAANPTGPASVQ

SEQ ID NO: 1546682 - protein, 25 aa, Mycobacterium tuberculosis
LVGSCAPGWSAAVFDWSGVELESGS

SEQ ID NO: 1546683 - protein, 18 aa, Mycobacterium tuberculosis
METFVEAWATSHDFMAVT

SEQ ID NO: 1546684 - protein, 27 aa, Mycobacterium tuberculosis
MPEGKYIPRLGGMAFRDPDWADEVYVF

SEQ ID NO: 1546685 - protein, 17 aa, Mycobacterium tuberculosis
MQQGCYGPCKGAVVALE

SEQ ID NO: 1546686 - protein, 21 aa, Mycobacterium tuberculosis
MSVSNLRWSGDYVLIDVDASP

SEQ ID NO: 1546687 - protein, 39 aa, Mycobacterium tuberculosis; identical to SEQ ID NO: 233936

SEQ ID NO: 1546688 - protein, 17 aa, Mycobacterium tuberculosis
NPVDSWGTGLVVDHNHV

SEQ ID NO: 1546689 - protein, 17 aa, Mycobacterium tuberculosis
NQRGNVIPVEITVYEDR

SEQ ID NO: 1546690 - protein, 19 aa, Mycobacterium tuberculosis
PAVEELRSPLDQARHDGAL

SEQ ID NO: 1546691 - protein, 30 aa, Mycobacterium tuberculosis; identical to SEQ ID NO: 234002

SEQ ID NO: 1546692 - protein, 18 aa, Mycobacterium tuberculosis
PNGSCDFVAGANLRTPDG

SEQ ID NO: 1546693 - protein, 24 aa, Mycobacterium tuberculosis
PPLAAPKNDLSWHDCTSRVYSNAG

SEQ ID NO: 1546694 - protein, 30 aa, Mycobacterium tuberculosis; identical to SEQ ID NO: 234025

SEQ ID NO: 1546695 - protein, 23 aa, Mycobacterium tuberculosis
PVHAECAGLLYLVSELDGHPMCG

SEQ ID NO: 1546696 - protein, 26 aa, Mycobacterium tuberculosis
PVPRSCAEPAGIPALLSPRDKLAQLL

SEQ ID NO: 1546697 - protein, 24 aa, Mycobacterium tuberculosis
QAGLPDRGPQSWSEFDEWGPELQR

SEQ ID NO: 1546698 - protein, 20 aa, Mycobacterium tuberculosis
QKKARVSFIPDRSVVDHSQL

SEQ ID NO: 1546699 - protein, 17 aa, Mycobacterium tuberculosis
QSDETFVYLARAVDPAV

SEQ ID NO: 1546700 - protein, 18 aa, Mycobacterium tuberculosis
RGHTRNCRLHWVQIIPTI

SEQ ID NO: 1546701 - protein, 23 aa, Mycobacterium tuberculosis
RGTRLPVWLTQWGYRRPAEDTVD

SEQ ID NO: 1546702 - protein, 18 aa, Mycobacterium tuberculosis
RKAARLTIDGVTHTTRPA

SEQ ID NO: 1546703 - protein, 25 aa, Mycobacterium tuberculosis
RLAARVLVALAALFAMIALTGSACL

SEQ ID NO: 1546704 - protein, 28 aa, Mycobacterium tuberculosis
RLQNFSGRARMSSMLWTFQVNQADGVAC

SEQ ID NO: 1546705 - protein, 20 aa, Mycobacterium tuberculosis
RRLFGRRLADFFTGRDPRGG

SEQ ID NO: 1546706 - protein, 25 aa, Mycobacterium tuberculosis
RVAPADMIGPIWRRDEVFEFNGSLI

SEQ ID NO: 1546707 - protein, 24 aa, Mycobacterium tuberculosis
RVCVTVGALVALACMVLAGCTVSP

SEQ ID NO: 1546708 - protein, 18 aa, Mycobacterium tuberculosis
SAARRAGDRAGRQARLGN

SEQ ID NO: 1546709 - protein, 24 aa, Mycobacterium tuberculosis
SARDLRFGYRTSVLKHADGLAVPT

SEQ ID NO: 1546710 - protein, 19 aa, Mycobacterium tuberculosis
SCNTAFVQLGIRTGADALR

SEQ ID NO: 1546711 - protein, 28 aa, Mycobacterium tuberculosis
SDIERLRKLWDVPALAFVGIGNGTQVAL

SEQ ID NO: 1546712 - protein, 21 aa, Mycobacterium tuberculosis
SDPGNPACRVFEGELNEHWTI

SEQ ID NO: 1546713 - protein, 23 aa, Mycobacterium tuberculosis
SEERKVNALKFIAFVTNPTNTAY

SEQ ID NO: 1546714 - protein, 20 aa, Mycobacterium tuberculosis
SGALLKRGYTAGQVRDRESG

SEQ ID NO: 1546715 - protein, 20 aa, Mycobacterium tuberculosis
SGPYFKVLLANLVPGQILQP

SEQ ID NO: 1546716 - protein, 23 aa, Mycobacterium tuberculosis
SGTIAGGVYKFFIARRDPVTMSG

SEQ ID NO: 1546717 - protein, 20 aa, Mycobacterium tuberculosis
SIYSSCAVPPLVAYLDTGKL

SEQ ID NO: 1546718 - protein, 24 aa, Mycobacterium tuberculosis
SPACGKAGCQTYKWETFLTSELPQ

SEQ ID NO: 1546719 - protein, 21 aa, Mycobacterium tuberculosis
SPPPKTTVTFSDGRTAPFTVV

SEQ ID NO: 1546720 - protein, 19 aa, Mycobacterium tuberculosis
SSCMVTFKTSYGVIQQSLF

SEQ ID NO: 1546721 - protein, 17 aa, Mycobacterium tuberculosis
STIDELKTNSSLLTSIL

SEQ ID NO: 1546722 - protein, 26 aa, Mycobacterium tuberculosis
SVATDGRFRFLRVYPNPEVYAPVTGF

SEQ ID NO: 1546723 - protein, 21 aa, Mycobacterium tuberculosis
SVLSALFLGAGAALLSACSSP

SEQ ID NO: 1546724 - protein, 23 aa, Mycobacterium tuberculosis
TAAKAMCGLCANGVTGLQLVADL

SEQ ID NO: 1546725 - protein, 19 aa, Mycobacterium tuberculosis
TAVASRFPGAINDLQLSRD

SEQ ID NO: 1546726 - protein, 27 aa, Mycobacterium tuberculosis
TDLPGELMSALSQGLSQFGINIPPVPS

SEQ ID NO: 1546727 - protein, 30 aa, Mycobacterium tuberculosis; identical to SEQ ID NO: 234321

SEQ ID NO: 1546728 - protein, 23 aa, Mycobacterium tuberculosis
TGSRWEMDPTLLVSADVTNNHPF

SEQ ID NO: 1546729 - protein, 25 aa, Mycobacterium tuberculosis
THTFMPNFALEWLINAYHRRGADIE

SEQ ID NO: 1546730 - protein, 25 aa, Mycobacterium tuberculosis
TNLEFLSCFLGLMLHGAVPVPIPPR

SEQ ID NO: 1546731 - protein, 24 aa, Mycobacterium tuberculosis
TSDADWKPVADILGRTGKLNDGSV

SEQ ID NO: 1546732 - protein, 18 aa, Mycobacterium tuberculosis
VAVGQSFTSVPMLFAKPS

SEQ ID NO: 1546733 - protein, 31 aa, Mycobacterium tuberculosis; identical to SEQ ID NO: 234437

SEQ ID NO: 1546734 - protein, 19 aa, Mycobacterium tuberculosis
VHGLWRGGIGTTWEARIKF

SEQ ID NO: 1546735 - protein, 21 aa, Mycobacterium tuberculosis
VKQGWMCCIGSSWMHLSTGVI

SEQ ID NO: 1546736 - protein, 18 aa, Mycobacterium tuberculosis
VRAEAGAVLTEISDTASR

SEQ ID NO: 1546737 - protein, 19 aa, Mycobacterium tuberculosis
VRGGVYWDAYRDPVSVVVL

SEQ ID NO: 1546738 - protein, 17 aa, Mycobacterium tuberculosis
VRHCARIALDQLGVPPA

SEQ ID NO: 1546739 - protein, 25 aa, Mycobacterium tuberculosis
VSAARAGKMTNWAIARPPGQTQALR

SEQ ID NO: 1546740 - protein, 25 aa, Mycobacterium tuberculosis
VSVARFAAALAPRGSGTLLAGRDGS

SEQ ID NO: 1546741 - protein, 19 aa, Mycobacterium tuberculosis
VTCPIYRYHPATVAQAFAS

SEQ ID NO: 1546742 - protein, 19 aa, Mycobacterium tuberculosis
VTLGGTMAKYDWTINGEPY

SEQ ID NO: 1546743 - protein, 21 aa, Mycobacterium tuberculosis
VVGALKLGLTAPFNIDEVPNV

SEQ ID NO: 1546744 - protein, 23 aa, Mycobacterium tuberculosis
VWTAEFAEAGWALPLSDDPAGLA

SEQ ID NO: 1546745 - protein, 19 aa, Mycobacterium tuberculosis
VYGAIAYSGNGSWGRSWDY

SEQ ID NO: 1546746 - protein, 20 aa, Mycobacterium tuberculosis
WCGPCRAEVSQLQRVYDATR

SEQ ID NO: 1546747 - protein, 18 aa, Mycobacterium tuberculosis
WGQWCGPCRAEVSQLQRV

SEQ ID NO: 1546748 - protein, 18 aa, Mycobacterium tuberculosis
WIPMVIVIVVAVAAVTVS

SEQ ID NO: 1546749 - protein, 27 aa, Mycobacterium tuberculosis
WRFSVPLVCLLAGLLLAATHGVSGGTE

SEQ ID NO: 1546750 - protein, 19 aa, Mycobacterium tuberculosis
YAASRPDNVARLILDSPIA

SEQ ID NO: 1546751 - protein, 23 aa, Mycobacterium tuberculosis
YFAMKFSQPFSSYGTWDGYAVYP

SEQ ID NO: 1546752 - protein, 24 aa, Mycobacterium tuberculosis
YGRRARLAVQAMTAVVARHVDLAA

SEQ ID NO: 1546753 - protein, 19 aa, Mycobacterium tuberculosis
YRLSTTVRKAANLRSDPFV

SEQ ID NO: 1546754 - protein, 18 aa, Mycobacterium tuberculosis
YSGNGSWGRSWDYPTRAA

SEQ ID NO: 1546755 - protein, 17 aa, Mycobacterium tuberculosis
AAAGARLYRKLTTTTVV

SEQ ID NO: 1546756 - protein, 17 aa, Mycobacterium tuberculosis
AAAGRLNPLITPSQTAN

SEQ ID NO: 1546757 - protein, 22 aa, Mycobacterium tuberculosis
AAARAADLWRFTAGAVDQPNPV

SEQ ID NO: 1546758 - protein, 25 aa, Mycobacterium tuberculosis
AAHKVCRKLDGGMPVNDIVDGLRND

SEQ ID NO: 1546759 - protein, 25 aa, Mycobacterium tuberculosis
AEAVARLRRAGAIIMGKTNMPTGNQ

SEQ ID NO: 1546760 - protein, 28 aa, Mycobacterium tuberculosis
AGRSAHGWANADLISWTFQGPNWAFGGA

SEQ ID NO: 1546761 - protein, 20 aa, Mycobacterium tuberculosis
AGRYGDGWIAQARDINDAKL

SEQ ID NO: 1546762 - protein, 18 aa, Mycobacterium tuberculosis
AISKGQRGGNLWLSEVFG

SEQ ID NO: 1546763 - protein, 28 aa, Mycobacterium tuberculosis
ALRSWRPRVAVWGIHLLRRGGLTGDGIP

SEQ ID NO: 1546764 - protein, 24 aa, Mycobacterium tuberculosis
ALSDLQPGDVLTFYSDASHAGIYI

SEQ ID NO: 1546765 - protein, 20 aa, Mycobacterium tuberculosis
APLRYGELIAALNATSGERA

SEQ ID NO: 1546766 - protein, 27 aa, Mycobacterium tuberculosis
APQSARTETWINLQVGDCLADLPPADL

SEQ ID NO: 1546767 - protein, 24 aa, Mycobacterium tuberculosis
AQGRIPRVYGRQASEYVIRRGMSQ

SEQ ID NO: 1546768 - protein, 29 aa, Mycobacterium tuberculosis
ARAMGPMQFLPGTWARYATDGDDDGVADP

SEQ ID NO: 1546769 - protein, 26 aa, Mycobacterium tuberculosis
ARLLSEEDRRFAVVFVHDQSDYARME

SEQ ID NO: 1546770 - protein, 21 aa, Mycobacterium tuberculosis
ARQRAPVAIFVKHPSDSVVAG

SEQ ID NO: 1546771 - protein, 24 aa, Mycobacterium tuberculosis
ARTGESLAVLGWNMSVSNLRWSGD

SEQ ID NO: 1546772 - protein, 18 aa, Mycobacterium tuberculosis
ASAGCPDAEVVFARGTGE

SEQ ID NO: 1546773 - protein, 26 aa, Mycobacterium tuberculosis
ASLTGWQWLGPSSVRMGAAVTPYVEW

SEQ ID NO: 1546774 - protein, 17 aa, Mycobacterium tuberculosis
ATAWGLTADTPWRGLDV

SEQ ID NO: 1546775 - protein, 20 aa, Mycobacterium tuberculosis
AWFPLTKRWLGFEDAHITFE

SEQ ID NO: 1546776 - protein, 23 aa, Mycobacterium tuberculosis
AYLRALPADGWLRVLCTCVEIGQ

SEQ ID NO: 1546777 - protein, 17 aa, Mycobacterium tuberculosis
CTGEVRWVSARDLRFGY

SEQ ID NO: 1546778 - protein, 17 aa, Mycobacterium tuberculosis
DEWPEPAESLPPPYDNR

SEQ ID NO: 1546779 - protein, 23 aa, Mycobacterium tuberculosis
DTRARLIDLGRPFIAETVFSHPS

SEQ ID NO: 1546780 - protein, 24 aa, Mycobacterium tuberculosis
DVAHGLPVHLTRFVGRGAQITEVH

SEQ ID NO: 1546781 - protein, 23 aa, Mycobacterium tuberculosis
EGGAIYQRWQALGGMNSALGAPT

SEQ ID NO: 1546782 - protein, 28 aa, Mycobacterium tuberculosis
EQAVQRSVVLSSGWDIMDFVRQLQKLAG

SEQ ID NO: 1546783 - protein, 24 aa, Mycobacterium tuberculosis
EVRRFARERSRWLFSNPEMTHLSV

SEQ ID NO: 1546784 - protein, 25 aa, Mycobacterium tuberculosis
FAERGFRRARTWLGATAEAIEACEC

SEQ ID NO: 1546785 - protein, 20 aa, Mycobacterium tuberculosis
FSWYRGSPIGRERKTEELSR

SEQ ID NO: 1546786 - protein, 23 aa, Mycobacterium tuberculosis
GAGTVGFDCSGLVLYSFAGVGIK

SEQ ID NO: 1546787 - protein, 19 aa, Mycobacterium tuberculosis
GAIYEAWASQSYERGPLGL

SEQ ID NO: 1546788 - protein, 17 aa, Mycobacterium tuberculosis
GGHPEVFAFSTSLTRLT

SEQ ID NO: 1546789 - protein, 20 aa, Mycobacterium tuberculosis
GGMPGLPFVQPDGAGGDRTA

SEQ ID NO: 1546790 - protein, 18 aa, Mycobacterium tuberculosis
GKLYPQFGAVAALNLVKC

SEQ ID NO: 1546791 - protein, 22 aa, Mycobacterium tuberculosis
GRDIPVAFLAGGPHAVYLLDAF

SEQ ID NO: 1546792 - protein, 26 aa, Mycobacterium tuberculosis
GSGGLPLDRAAVIIADLAQSTPTGID

SEQ ID NO: 1546793 - protein, 18 aa, Mycobacterium tuberculosis
GWTGRFVSRILIDGSTLS

SEQ ID NO: 1546794 - protein, 17 aa, Mycobacterium tuberculosis
GYMLLGLEVDAVPDRYR

SEQ ID NO: 1546795 - protein, 29 aa, Mycobacterium tuberculosis
HLSVLRNHARWAVLLRNLRFVIVDECHYY

SEQ ID NO: 1546796 - protein, 18 aa, Mycobacterium tuberculosis
IGLRGADVTKTFTNIQKR

SEQ ID NO: 1546797 - protein, 31 aa, Mycobacterium tuberculosis; identical to SEQ ID NO: 233719

SEQ ID NO: 1546798 - protein, 20 aa, Mycobacterium tuberculosis
IVAGGGPLPLAVSVDEEGGR

SEQ ID NO: 1546799 - protein, 19 aa, Mycobacterium tuberculosis
IYTYHSKTLGWCDIAYNAL

SEQ ID NO: 1546800 - protein, 18 aa, Mycobacterium tuberculosis
KALEGGAIYQRWQALGGM

SEQ ID NO: 1546801 - protein, 23 aa, Mycobacterium tuberculosis
KHMRADVTVGAFLSGGIDSTAIA

SEQ ID NO: 1546802 - protein, 18 aa, Mycobacterium tuberculosis
LGDMVAELIELSRLQGAE

SEQ ID NO: 1546803 - protein, 19 aa, Mycobacterium tuberculosis
LGHDQLRAAHALAAAVPRL

SEQ ID NO: 1546804 - protein, 22 aa, Mycobacterium tuberculosis
LGRDVQRLTAWASTTVSGDRDD

SEQ ID NO: 1546805 - protein, 19 aa, Mycobacterium tuberculosis
LHVTAARLADWVDQNGNAG

SEQ ID NO: 1546806 - protein, 17 aa, Mycobacterium tuberculosis
LQAARLVAWSSEGGQGA

SEQ ID NO: 1546807 - protein, 19 aa, Mycobacterium tuberculosis
LRAKVEALEHGRIAVAIAG

SEQ ID NO: 1546808 - protein, 21 aa, Mycobacterium tuberculosis
LRKRLTGLLGAFRAFSYGSLY

SEQ ID NO: 1546809 - protein, 24 aa, Mycobacterium tuberculosis
LSRNTTLWASWAFVGPNHRAYFGG

SEQ ID NO: 1546810 - protein, 30 aa, Mycobacterium tuberculosis
MIAAVVASCGWRGLNSLPLPGTQGNGPGSF

SEQ ID NO: 1546811 - protein, 19 aa, Mycobacterium tuberculosis
MLRHRGPQLLPAVFSHSQQ

SEQ ID NO: 1546812 - protein, 18 aa, Mycobacterium tuberculosis
MLVPVHWGTFRLAPHPWG

SEQ ID NO: 1546813 - protein, 19 aa, Mycobacterium tuberculosis
NDLPWSVLKQLHAGDSDDG

SEQ ID NO: 1546814 - protein, 28 aa, Mycobacterium tuberculosis
NVCWPTPRPPMRIWPRRFDAPPGTCRAS

SEQ ID NO: 1546815 - protein, 26 aa, Mycobacterium tuberculosis
PAPDGVKLAAGWLVERAGFGKGYPDA

SEQ ID NO: 1546816 - protein, 21 aa, Mycobacterium tuberculosis
PEFSARVFKAEKGVVTLGGNT

SEQ ID NO: 1546817 - protein, 28 aa, Mycobacterium tuberculosis
PFDPCRDIPFDVIQRLGLAYTPPEAEEG

SEQ ID NO: 1546818 - protein, 24 aa, Mycobacterium tuberculosis
PGSPCSYTPPADGLPRPWDPLPCA

SEQ ID NO: 1546819 - protein, 20 aa, Mycobacterium tuberculosis
PRDDWVPFTGVPGYNHIKIK

SEQ ID NO: 1546820 - protein, 24 aa, Mycobacterium tuberculosis
PRTMPAALHWDRILFCAKEATYKA

SEQ ID NO: 1546821 - protein, 24 aa, Mycobacterium tuberculosis
PVADPALVPLFFVAREARKHVKVV

SEQ ID NO: 1546822 - protein, 30 aa, Mycobacterium tuberculosis; identical to SEQ ID NO: 234873

SEQ ID NO: 1546823 - protein, 26 aa, Mycobacterium tuberculosis
QDNEGHSMFPWLTLALVGNSTSSILF

SEQ ID NO: 1546824 - protein, 20 aa, Mycobacterium tuberculosis
QKRLQVILDRQIMRKLAGHG

SEQ ID NO: 1546825 - protein, 19 aa, Mycobacterium tuberculosis
QTLQAFLHWAITDGNKASF

SEQ ID NO: 1546826 - protein, 17 aa, Mycobacterium tuberculosis
RDGRPAAKLVLDVNPRY

SEQ ID NO: 1546827 - protein, 19 aa, Mycobacterium tuberculosis
RDRFALLTGGARTAAHRQQ

SEQ ID NO: 1546828 - protein, 24 aa, Mycobacterium tuberculosis
RELFCARDPFGIKPLFIATGAGGT

SEQ ID NO: 1546829 - protein, 24 aa, Mycobacterium tuberculosis
RFVIVDECHYYRGVFGSNVAMVLR

SEQ ID NO: 1546830 - protein, 20 aa, Mycobacterium tuberculosis
RGRVGMMGAVVTVLVVGVAQ

SEQ ID NO: 1546831 - protein, 18 aa, Mycobacterium tuberculosis
RGVRRLESGCFARIRADQ

SEQ ID NO: 1546832 - protein, 24 aa, Mycobacterium tuberculosis
RLLLQAAKSLGWRAAPIPRNAPGC

SEQ ID NO: 1546833 - protein, 24 aa, Mycobacterium tuberculosis
RNYLYDAWAARFLVTARLNNSLPE

SEQ ID NO: 1546834 - protein, 19 aa, Mycobacterium tuberculosis
RPRRRPRRVLLLCDVSRSM

SEQ ID NO: 1546835 - protein, 23 aa, Mycobacterium tuberculosis
SAPGSRLAFEFVPDTAIFADERW

SEQ ID NO: 1546836 - protein, 31 aa, Mycobacterium tuberculosis; identical to SEQ ID NO: 234227

SEQ ID NO: 1546837 - protein, 18 aa, Mycobacterium tuberculosis
SGMYFWLDYADGIEPYFS

SEQ ID NO: 1546838 - protein, 23 aa, Mycobacterium tuberculosis
SKAPGATVALTFQDPSGGSRTVQ

SEQ ID NO: 1546839 - protein, 28 aa, Mycobacterium tuberculosis
SLRLPKLSAKVVVVGGLVVVLAVVAAAA

SEQ ID NO: 1546840 - protein, 23 aa, Mycobacterium tuberculosis
SQMLQCIVTLMPLGAAVVDTHRD

SEQ ID NO: 1546841 - protein, 18 aa, Mycobacterium tuberculosis
STIDELRIFVSQWDTRAR

SEQ ID NO: 1546842 - protein, 26 aa, Mycobacterium tuberculosis
TAADPAGWPRLDWSMDAALLLAALAS

SEQ ID NO: 1546843 - protein, 24 aa, Mycobacterium tuberculosis
TGPEGLPSVFVYDGYPGGAGFAER

SEQ ID NO: 1546844 - protein, 20 aa, Mycobacterium tuberculosis
TIARWLLTRRSVILREVGPE

SEQ ID NO: 1546845 - protein, 30 aa, Mycobacterium tuberculosis; identical to SEQ ID NO: 234365

SEQ ID NO: 1546846 - protein, 19 aa, Mycobacterium tuberculosis
TSVSAWRADGMQLGKPQLG

SEQ ID NO: 1546847 - protein, 17 aa, Mycobacterium tuberculosis
VEGSTWLWETHPDDMGA

SEQ ID NO: 1546848 - protein, 24 aa, Mycobacterium tuberculosis
VLAGFPGTVASFWQQAGRSGRRGQ

SEQ ID NO: 1546849 - protein, 17 aa, Mycobacterium tuberculosis
VMVKPDFDVPLFNPKRV

SEQ ID NO: 1546850 - protein, 17 aa, Mycobacterium tuberculosis
VRQRHGLDNGDLDRTHR

SEQ ID NO: 1546851 - protein, 19 aa, Mycobacterium tuberculosis
VSALNRPVSTTGEAGNQNT

SEQ ID NO: 1546852 - protein, 17 aa, Mycobacterium tuberculosis
VTQVARRYGLRSTAPPS

SEQ ID NO: 1546853 - protein, 23 aa, Mycobacterium tuberculosis
VVGGIDWDGHGLLGLEDSLDAVL

SEQ ID NO: 1546854 - protein, 17 aa, Mycobacterium tuberculosis
VYAGTGWTAMRGQRLDD

SEQ ID NO: 1546855 - protein, 18 aa, Mycobacterium tuberculosis
VYAPVTGFYSLRYSSTAL

SEQ ID NO: 1546856 - protein, 17 aa, Mycobacterium tuberculosis
WQALGGMNSALGAPTSP

SEQ ID NO: 1546857 - protein, 21 aa, Mycobacterium tuberculosis
YKADFDPYQFLLIPLARITGI

SEQ ID NO: 1546858 - protein, 22 aa, Mycobacterium tuberculosis
YQMAVEPIIWRTYAQTLPPDAI

SEQ ID NO: 1546859 - protein, 23 aa, Mycobacterium tuberculosis
AALNPPPMFPWMAPDPSAPMPGC

SEQ ID NO: 1546860 - protein, 19 aa, Mycobacterium tuberculosis
AALVQVHRDGEFVVATVTA

SEQ ID NO: 1546861 - protein, 20 aa, Mycobacterium tuberculosis
AAVEGLKAIVLLANGADTYA

SEQ ID NO: 1546862 - protein, 17 aa, Mycobacterium tuberculosis
ADREALWKIVHDRCEFG

SEQ ID NO: 1546863 - protein, 24 aa, Mycobacterium tuberculosis
ADREPRPGHRRMVFRFLTSPIEIK

SEQ ID NO: 1546864 - protein, 22 aa, Mycobacterium tuberculosis
ADTNVPGPCRVVGSSDRTFGTD

SEQ ID NO: 1546865 - protein, 20 aa, Mycobacterium tuberculosis
AEERRTCVFFESPRRLAACL

SEQ ID NO: 1546866 - protein, 19 aa, Mycobacterium tuberculosis
AEKVRDTFDLARHRAPSAS

SEQ ID NO: 1546867 - protein, 19 aa, Mycobacterium tuberculosis
AELGVALRAAIAGPVAGLA

SEQ ID NO: 1546868 - protein, 18 aa, Mycobacterium tuberculosis
AFLGERIGVRRGVVVDAD

SEQ ID NO: 1546869 - protein, 18 aa, Mycobacterium tuberculosis
AKLRCRLTDGSKTYGISV

SEQ ID NO: 1546870 - protein, 18 aa, Mycobacterium tuberculosis
ALELTWRSLGEIGNLSSA

SEQ ID NO: 1546871 - protein, 20 aa, Mycobacterium tuberculosis
ALRPPVFAGTIWVQQGSQPL

SEQ ID NO: 1546872 - protein, 18 aa, Mycobacterium tuberculosis
ALTFPFAGGLGLMSNRAS

SEQ ID NO: 1546873 - protein, 19 aa, Mycobacterium tuberculosis
APCRLSTKHALALTNRGGA

SEQ ID NO: 1546874 - protein, 18 aa, Mycobacterium tuberculosis
APSCDRVVFRGNVAGREF

SEQ ID NO: 1546875 - protein, 18 aa, Mycobacterium tuberculosis
ARFNVSRAALLVVALTER

SEQ ID NO: 1546876 - protein, 20 aa, Mycobacterium tuberculosis
ARTTVLLDEIVTLVGTDQRL

SEQ ID NO: 1546877 - protein, 19 aa, Mycobacterium tuberculosis
ASSVGGLSVPAGWSTAAPA

SEQ ID NO: 1546878 - protein, 26 aa, Mycobacterium tuberculosis
AVPWWPWAPLVRLMWVLPPRLTRRFA

SEQ ID NO: 1546879 - protein, 26 aa, Mycobacterium tuberculosis
AVSLRLHPDIRLFTAIPEQRSSTAET

SEQ ID NO: 1546880 - protein, 21 aa, Mycobacterium tuberculosis
CHPELRIDFPPLRVANDDVAH

SEQ ID NO: 1546881 - protein, 27 aa, Mycobacterium tuberculosis
CRQLDAFLKWHHGVREFLQSAIDANSR

SEQ ID NO: 1546882 - protein, 18 aa, Mycobacterium tuberculosis
DNSAHVFVEADIVTADLH

SEQ ID NO: 1546883 - protein, 25 aa, Mycobacterium tuberculosis
DPSAPMPGCTLICIGSHGPPVGAPP

SEQ ID NO: 1546884 - protein, 18 aa, Mycobacterium tuberculosis
DYFAEINLAGFYDLAQTL

SEQ ID NO: 1546885 - protein, 17 aa, Mycobacterium tuberculosis
EAAKFRTAYEVRCDNPT

SEQ ID NO: 1546886 - protein, 19 aa, Mycobacterium tuberculosis
EALEHGRIAVAIAGVPFKC

SEQ ID NO: 1546887 - protein, 19 aa, Mycobacterium tuberculosis
EALVSMLKDHGVGFHPRKA

SEQ ID NO: 1546888 - protein, 22 aa, Mycobacterium tuberculosis
EDPRFRFFGNVVVGEHVQPGEL

SEQ ID NO: 1546889 - protein, 20 aa, Mycobacterium tuberculosis
EELPAQLVVRSVGYRGVPTP

SEQ ID NO: 1546890 - protein, 22 aa, Mycobacterium tuberculosis
EEPRLFYMHYWAVDDAVTLARA

SEQ ID NO: 1546891 - protein, 19 aa, Mycobacterium tuberculosis
EFQPRAGSMAAALPYCDLF

SEQ ID NO: 1546892 - protein, 19 aa, Mycobacterium tuberculosis
EGFAPRKGAARRAWLAELA

SEQ ID NO: 1546893 - protein, 17 aa, Mycobacterium tuberculosis
FEMPEGKYIPRLGGMAF

SEQ ID NO: 1546894 - protein, 24 aa, Mycobacterium tuberculosis
FEPWSVADFSRYLSTLGLPAAGDA

SEQ ID NO: 1546895 - protein, 17 aa, Mycobacterium tuberculosis
FKKRGISPEDFWRSAGL

SEQ ID NO: 1546896 - protein, 25 aa, Mycobacterium tuberculosis
GARLGSGRQYMSWISLEDEVRALQF

SEQ ID NO: 1546897 - protein, 25 aa, Mycobacterium tuberculosis
GGAGGRGGLLYGGYGVSGPGGDGRT

SEQ ID NO: 1546898 - protein, 19 aa, Mycobacterium tuberculosis
GLVRVLPPFLSRKHLPSRL

SEQ ID NO: 1546899 - protein, 19 aa, Mycobacterium tuberculosis
GPEVGEALVSMLKDHGVGF

SEQ ID NO: 1546900 - protein, 18 aa, Mycobacterium tuberculosis
GRSGLSVHGHARLLSEED

SEQ ID NO: 1546901 - protein, 27 aa, Mycobacterium tuberculosis
GSAPRRPPIPGSDAAGVHYLRSYNDAV

SEQ ID NO: 1546902 - protein, 23 aa, Mycobacterium tuberculosis
GSPRGARTVALWEPALRSDVIGE

SEQ ID NO: 1546903 - protein, 27 aa, Mycobacterium tuberculosis
GTLGLSLLWVLRGWRRPDDVRVRPTAA

SEQ ID NO: 1546904 - protein, 21 aa, Mycobacterium tuberculosis
GTYKMAKSVLLAMSHSLATEL

SEQ ID NO: 1546905 - protein, 17 aa, Mycobacterium tuberculosis
HAAAKVNGRHLVLPLQQ

SEQ ID NO: 1546906 - protein, 22 aa, Mycobacterium tuberculosis
HESARAVLRVAPLSVAELLATQ

SEQ ID NO: 1546907 - protein, 24 aa, Mycobacterium tuberculosis
HGENRFPYDIEFIIRGESEQHRTK

SEQ ID NO: 1546908 - protein, 29 aa, Mycobacterium tuberculosis
HTGGFNRNTWGVAMIGNFDDVAPTPIQIR

SEQ ID NO: 1546909 - protein, 22 aa, Mycobacterium tuberculosis
IDAAREAARLAARGDVRSATDV

SEQ ID NO: 1546910 - protein, 22 aa, Mycobacterium tuberculosis
IGQMSVPPAWKAPAVTTVRAFD

SEQ ID NO: 1546911 - protein, 17 aa, Mycobacterium tuberculosis
IRIGGRVVSLFDRVEAL

SEQ ID NO: 1546912 - protein, 32 aa, Mycobacterium tuberculosis; identical to SEQ ID NO: 233730

SEQ ID NO: 1546913 - protein, 21 aa, Mycobacterium tuberculosis
KCPAAPFEAAFLIAAQLGDRY

SEQ ID NO: 1546914 - protein, 17 aa, Mycobacterium tuberculosis
KEGAECKSFPEDHADQV

SEQ ID NO: 1546915 - protein, 18 aa, Mycobacterium tuberculosis
KGAARRAWLAELAEERRT

SEQ ID NO: 1546916 - protein, 23 aa, Mycobacterium tuberculosis
KYGGLQFKPATWAAFGGVGNPAA

SEQ ID NO: 1546917 - protein, 23 aa, Mycobacterium tuberculosis
LALVKACRGVRLLATCREPLRVE

SEQ ID NO: 1546918 - protein, 18 aa, Mycobacterium tuberculosis
LAPPRAGALKDFRVAVWA

SEQ ID NO: 1546919 - protein, 25 aa, Mycobacterium tuberculosis
LATAVLPRSATPVLLPDVVAAAPGM

SEQ ID NO: 1546920 - protein, 18 aa, Mycobacterium tuberculosis
LEEGRRWTVEEFRSTHPV

SEQ ID NO: 1546921 - protein, 17 aa, Mycobacterium tuberculosis
LEIEPRGAQALPPGGVL

SEQ ID NO: 1546922 - protein, 18 aa, Mycobacterium tuberculosis
LEQLRILTDLLVDRKEDL

SEQ ID NO: 1546923 - protein, 17 aa, Mycobacterium tuberculosis
LESGCFARIRADQLAPV

SEQ ID NO: 1546924 - protein, 18 aa, Mycobacterium tuberculosis
LGAWLEATMARWPRRRSM

SEQ ID NO: 1546925 - protein, 25 aa, Mycobacterium tuberculosis
LKAPTIDFTLRLGHSSFYPLPDSAF

SEQ ID NO: 1546926 - protein, 18 aa, Mycobacterium tuberculosis
LLCCSGVATAAPKTYCEE

SEQ ID NO: 1546927 - protein, 20 aa, Mycobacterium tuberculosis
LRGVARGQTLVLYRPDPAGD

SEQ ID NO: 1546928 - protein, 22 aa, Mycobacterium tuberculosis
LSARPVIEQALLDNGVETRTGV

SEQ ID NO: 1546929 - protein, 24 aa, Mycobacterium tuberculosis
LSSGPFFKAYVVNLLPGQFVQPFI

SEQ ID NO: 1546930 - protein, 20 aa, Mycobacterium tuberculosis
LSSRIDPRAAGSFWELTTDT

SEQ ID NO: 1546931 - protein, 17 aa, Mycobacterium tuberculosis
LTVGEAVRWSPTVRVPG

SEQ ID NO: 1546932 - protein, 18 aa, Mycobacterium tuberculosis
LWPAPYLVMDTGASLAPY

SEQ ID NO: 1546933 - protein, 19 aa, Mycobacterium tuberculosis
MAATVVIVAWIANRPPASS

SEQ ID NO: 1546934 - protein, 22 aa, Mycobacterium tuberculosis
MRADGGFSYALAPPRAGALKDF

SEQ ID NO: 1546935 - protein, 20 aa, Mycobacterium tuberculosis
NLLEEIGILLLPIAPELTPF

SEQ ID NO: 1546936 - protein, 30 aa, Mycobacterium tuberculosis; identical to SEQ ID NO: 233954

SEQ ID NO: 1546937 - protein, 25 aa, Mycobacterium tuberculosis
NSPNGYRTDVDWATQISYSGVFVHS

SEQ ID NO: 1546938 - protein, 19 aa, Mycobacterium tuberculosis
PGDRAEVLASLNKLGYTPG

SEQ ID NO: 1546939 - protein, 21 aa, Mycobacterium tuberculosis
PPHAWYIAFAPAQAPKVAVAV

SEQ ID NO: 1546940 - protein, 23 aa, Mycobacterium tuberculosis
PRTLSTSADNVWAIGDATVLTLP

SEQ ID NO: 1546941 - protein, 19 aa, Mycobacterium tuberculosis
QRDGKFAFDNPGAIEAFRY

SEQ ID NO: 1546942 - protein, 21 aa, Mycobacterium tuberculosis
QRMGRPTIAVNANFFDVRGQK

SEQ ID NO: 1546943 - protein, 31 aa, Mycobacterium tuberculosis; identical to SEQ ID NO: 234087

SEQ ID NO: 1546944 - protein, 17 aa, Mycobacterium tuberculosis
QRVAVAVAVTYAPEAFD

SEQ ID NO: 1546945 - protein, 22 aa, Mycobacterium tuberculosis
RAGALKDFRVAVWAEDPHCPID

SEQ ID NO: 1546946 - protein, 27 aa, Mycobacterium tuberculosis
RCNQQIKFAALSARAVALGFDTVATGH

SEQ ID NO: 1546947 - protein, 20 aa, Mycobacterium tuberculosis
RELFCSGLRTPKAVLSAERQ

SEQ ID NO: 1546948 - protein, 19 aa, Mycobacterium tuberculosis
RGAAVLAARIMSRLATQPN

SEQ ID NO: 1546949 - protein, 21 aa, Mycobacterium tuberculosis
RLVAACIDAGVSVTCLPGPSA

SEQ ID NO: 1546950 - protein, 18 aa, Mycobacterium tuberculosis
RNQFLAGKMALFQSGTYS

SEQ ID NO: 1546951 - protein, 18 aa, Mycobacterium tuberculosis
RPDLLMAATEDLLHQPQR

SEQ ID NO: 1546952 - protein, 26 aa, Mycobacterium tuberculosis
RPELGLRPRLAIGIHQPGVGALRPPV

SEQ ID NO: 1546953 - protein, 22 aa, Mycobacterium tuberculosis
RQQTLWASVDWSYTLLTEPERT

SEQ ID NO: 1546954 - protein, 17 aa, Mycobacterium tuberculosis
RRIAVLAAVSIAATVVA

SEQ ID NO: 1546955 - protein, 24 aa, Mycobacterium tuberculosis
RRLDLKRGEPVLITAHTNLEFLSC

SEQ ID NO: 1546956 - protein, 23 aa, Mycobacterium tuberculosis
RTLQAGADIALWVTTKEVPAVLD

SEQ ID NO: 1546957 - protein, 18 aa, Mycobacterium tuberculosis
RTTCGRRDLADYVPTQDA

SEQ ID NO: 1546958 - protein, 17 aa, Mycobacterium tuberculosis
RVAVWAEDPHCPIDADV

SEQ ID NO: 1546959 - protein, 19 aa, Mycobacterium tuberculosis
SAEYLRLLRRHNVAAALSG

SEQ ID NO: 1546960 - protein, 24 aa, Mycobacterium tuberculosis
SGERLAAATVVWCAGMRASRLTEQ

SEQ ID NO: 1546961 - protein, 29 aa, Mycobacterium tuberculosis
SGLDARAYRLAWPVGSIVYEVDMPEVIEF

SEQ ID NO: 1546962 - protein, 19 aa, Mycobacterium tuberculosis
SIAPRAALVQVHRDGEFVV

SEQ ID NO: 1546963 - protein, 39 aa, Mycobacterium tuberculosis; identical to SEQ ID NO: 234270

SEQ ID NO: 1546964 - protein, 17 aa, Mycobacterium tuberculosis
SLTRLTSVLSHRSAEMA

SEQ ID NO: 1546965 - protein, 29 aa, Mycobacterium tuberculosis
SSDHSRRLWTMLIFMLWHAIFVEHSVVPQ

SEQ ID NO: 1546966 - protein, 26 aa, Mycobacterium tuberculosis
SSLRLWPDRRLSRRGVEIISRRAPRG

SEQ ID NO: 1546967 - protein, 24 aa, Mycobacterium tuberculosis
SSLYPDSLHIMGWDVGSHGLRLRL

SEQ ID NO: 1546968 - protein, 18 aa, Mycobacterium tuberculosis
TDAVEFGAAKGFAVTELT

SEQ ID NO: 1546969 - protein, 24 aa, Mycobacterium tuberculosis
TEIDNLRAAFVWNRENSDTEGALA

SEQ ID NO: 1546970 - protein, 20 aa, Mycobacterium tuberculosis
TPNPCVRCNQQIKFAALSAR

SEQ ID NO: 1546971 - protein, 21 aa, Mycobacterium tuberculosis
TRKKSSIGWVLLACSVAGCKG

SEQ ID NO: 1546972 - protein, 22 aa, Mycobacterium tuberculosis
TYSEDWLRPDYVAPVADTPPDP

SEQ ID NO: 1546973 - protein, 25 aa, Mycobacterium tuberculosis
VACGSGRGPAPIKVIADKGTPFADL

SEQ ID NO: 1546974 - protein, 26 aa, Mycobacterium tuberculosis
VAMVLRRLLRLCARYSAHPTVIFASA

SEQ ID NO: 1546975 - protein, 25 aa, Mycobacterium tuberculosis
VDDYLRVIGVPAMFAAGDVAAARMD

SEQ ID NO: 1546976 - protein, 24 aa, Mycobacterium tuberculosis
VFFESPRRLAACLNDAVEQLGGAR

SEQ ID NO: 1546977 - protein, 22 aa, Mycobacterium tuberculosis
VTDDLRPGGPVMVETVSQAIAL

SEQ ID NO: 1546978 - protein, 19 aa, Mycobacterium tuberculosis
WIPLLILVVVAIAGFTVQR

SEQ ID NO: 1546979 - protein, 21 aa, Mycobacterium tuberculosis
YFAQGELLPSFVGACQAQVPR

SEQ ID NO: 1546980 - protein, 19 aa, Mycobacterium tuberculosis
YKQFRGEFTPKTELTMVAS

SEQ ID NO: 1546981 - protein, 22 aa, Mycobacterium tuberculosis
YNYPPLGANLFVGAQARPNEVT

SEQ ID NO: 1546982 - protein, 18 aa, Mycobacterium tuberculosis
YSFQVAKVDNGRCDPVAG

SEQ ID NO: 1546983 - protein, 24 aa, Mycobacterium tuberculosis
AADLIGRGCAQYAAQNPTGPGSVA

SEQ ID NO: 1546984 - protein, 18 aa, Mycobacterium tuberculosis
AAMVIGGQVILAGVEQTQ

SEQ ID NO: 1546985 - protein, 19 aa, Mycobacterium tuberculosis
AAVCGAGGDCGRCRRTLRA

SEQ ID NO: 1546986 - protein, 20 aa, Mycobacterium tuberculosis
AEARQALAAAPELQFKPGTR

SEQ ID NO: 1546987 - protein, 22 aa, Mycobacterium tuberculosis
AFPEQWSGNFLFYNKQLFDDAG

SEQ ID NO: 1546988 - protein, 25 aa, Mycobacterium tuberculosis
AGGDCGRCRRTLRAIIAAARLNPTQ

SEQ ID NO: 1546989 - protein, 17 aa, Mycobacterium tuberculosis
AGLLAGHPTNFATNTMV

SEQ ID NO: 1546990 - protein, 24 aa, Mycobacterium tuberculosis
AGYLAKRRQPLCTTYRGREICGMP

SEQ ID NO: 1546991 - protein, 22 aa, Mycobacterium tuberculosis
ALRIRTRLVADVAVPLVNIRAV

SEQ ID NO: 1546992 - protein, 24 aa, Mycobacterium tuberculosis
ALSQDRFADFPALPLDPSAMVAQV

SEQ ID NO: 1546993 - protein, 20 aa, Mycobacterium tuberculosis
ALTEMDYFIRMWNQAALAME

SEQ ID NO: 1546994 - protein, 27 aa, Mycobacterium tuberculosis
APDAGPPQRWFVVWLGTANNPVDKGAA

SEQ ID NO: 1546995 - protein, 25 aa, Mycobacterium tuberculosis
APILKGDKGEPCWPDGVVGSLTHCA

SEQ ID NO: 1546996 - protein, 39 aa, Mycobacterium tuberculosis; identical to SEQ ID NO: 233204

SEQ ID NO: 1546997 - protein, 19 aa, Mycobacterium tuberculosis
ASGPLGLMKTILALRHGVV

SEQ ID NO: 1546998 - protein, 17 aa, Mycobacterium tuberculosis
ASGRSIGVPGILRMLEM

SEQ ID NO: 1546999 - protein, 25 aa, Mycobacterium tuberculosis
ATEFDYLEMWAQDVAAMVGYHAGAK

SEQ ID NO: 1547000 - protein, 22 aa, Mycobacterium tuberculosis
ATVGGLMLPVGVRRLRNYHSTR

SEQ ID NO: 1547001 - protein, 22 aa, Mycobacterium tuberculosis
DELRPRMRVVNEFQRRYPDIKV

SEQ ID NO: 1547002 - protein, 24 aa, Mycobacterium tuberculosis
DGGFDISARMGAAISDAAPQLRDD

SEQ ID NO: 1547003 - protein, 26 aa, Mycobacterium tuberculosis
DGLRVICRRSRLMSRIAGSGAMASVE

SEQ ID NO: 1547004 - protein, 21 aa, Mycobacterium tuberculosis
DKMRVTLHYSNKYQVPATATA

SEQ ID NO: 1547005 - protein, 18 aa, Mycobacterium tuberculosis
DRGGRFIGYLHIKDVLTL

SEQ ID NO: 1547006 - protein, 20 aa, Mycobacterium tuberculosis
DVGGFDCDFFGLTEREATAI

SEQ ID NO: 1547007 - protein, 18 aa, Mycobacterium tuberculosis
EAVEMFCYRAQRVRPDFR

SEQ ID NO: 1547008 - protein, 20 aa, Mycobacterium tuberculosis
EAYFGAVGVDGVLGVGPNAV

SEQ ID NO: 1547009 - protein, 22 aa, Mycobacterium tuberculosis
ELPGEPPRLFVVTRSAASVLPS

SEQ ID NO: 1547010 - protein, 18 aa, Mycobacterium tuberculosis
FASAGIEPFGCLKPAPPP

SEQ ID NO: 1547011 - protein, 23 aa, Mycobacterium tuberculosis
FNQGTRVSAYFADAGGLRTGNTV

SEQ ID NO: 1547012 - protein, 24 aa, Mycobacterium tuberculosis
FQHVRAAMLSHGWIDGPPPGQYFH

SEQ ID NO: 1547013 - protein, 25 aa, Mycobacterium tuberculosis
FVISPYSRGGLMVHDRFDHTSQLQL

SEQ ID NO: 1547014 - protein, 19 aa, Mycobacterium tuberculosis
FYAAGLFAMNNGVPWSVPR

SEQ ID NO: 1547015 - protein, 19 aa, Mycobacterium tuberculosis
GAGLKLPRSSGQMYKVGQK

SEQ ID NO: 1547016 - protein, 24 aa, Mycobacterium tuberculosis
GDHRIHNVAAFPGAAYCEMALAAA

SEQ ID NO: 1547017 - protein, 21 aa, Mycobacterium tuberculosis
GGDGWTCQRALTARNNVTIDI

SEQ ID NO: 1547018 - protein, 23 aa, Mycobacterium tuberculosis
GGGMPMMLMPMSISGAGAGMPGG

SEQ ID NO: 1547019 - protein, 24 aa, Mycobacterium tuberculosis
GKTLARICALNALAAVDSLVDLDA

SEQ ID NO: 1547020 - protein, 30 aa, Mycobacterium tuberculosis; identical to SEQ ID NO: 233564

SEQ ID NO: 1547021 - protein, 24 aa, Mycobacterium tuberculosis
GNPPEVKSVGLGNVNGVTLGYTSG

SEQ ID NO: 1547022 - protein, 19 aa, Mycobacterium tuberculosis
GPLGYSYNTGCHLPAAWRT

SEQ ID NO: 1547023 - protein, 18 aa, Mycobacterium tuberculosis
GPQLPAPFINPGGTGGSG

SEQ ID NO: 1547024 - protein, 29 aa, Mycobacterium tuberculosis
GRLRRLALSAAINRPQICQQIFAGTRSPA

SEQ ID NO: 1547025 - protein, 26 aa, Mycobacterium tuberculosis
GRLSPDGLRWSTTEQLGYNRRYTLNA

SEQ ID NO: 1547026 - protein, 18 aa, Mycobacterium tuberculosis
GRTPWRDLFGPAVTLADG

SEQ ID NO: 1547027 - protein, 17 aa, Mycobacterium tuberculosis
GRVAQIGRIEWAQNGAS

SEQ ID NO: 1547028 - protein, 32 aa, Mycobacterium tuberculosis; identical to SEQ ID NO: 1470624

SEQ ID NO: 1547029 - protein, 24 aa, Mycobacterium tuberculosis
GVGKLTPGFHGLHIHQVGKCEPNS

SEQ ID NO: 1547030 - protein, 26 aa, Mycobacterium tuberculosis
GVPGRSVSRWGAFLDDVGGFDCDFFG

SEQ ID NO: 1547031 - protein, 22 aa, Mycobacterium tuberculosis
HASMLFLPVRILTSPITTLASM

SEQ ID NO: 1547032 - protein, 26 aa, Mycobacterium tuberculosis
HEMRDRWAGFFNEFDVLLLPVTPTPA

SEQ ID NO: 1547033 - protein, 25 aa, Mycobacterium tuberculosis
HGLRLRLSPDLTNLIERYLANDVTT

SEQ ID NO: 1547034 - protein, 25 aa, Mycobacterium tuberculosis
HIRAGDCGRDYRVLSAALLEVTFCG

SEQ ID NO: 1547035 - protein, 24 aa, Mycobacterium tuberculosis
HSAAPLFHNIAGWLMQRENVPLSP

SEQ ID NO: 1547036 - protein, 18 aa, Mycobacterium tuberculosis
IERQGWHALVTMRLDGDV

SEQ ID NO: 1547037 - protein, 18 aa, Mycobacterium tuberculosis
IKLKNWVATLTLSLKKDV

SEQ ID NO: 1547038 - protein, 17 aa, Mycobacterium tuberculosis
IRDARWCDANDIAQLVA

SEQ ID NO: 1547039 - protein, 21 aa, Mycobacterium tuberculosis
KRFGVPVPNLTPWRASVTGDM

SEQ ID NO: 1547040 - protein, 17 aa, Mycobacterium tuberculosis
KSLLAQEFIDHGQPVVE

SEQ ID NO: 1547041 - protein, 23 aa, Mycobacterium tuberculosis
LADAGGEVTLWARRAEVADQINT

SEQ ID NO: 1547042 - protein, 23 aa, Mycobacterium tuberculosis
LANGRGRWLAIAASLVVSAAILY

SEQ ID NO: 1547043 - protein, 25 aa, Mycobacterium tuberculosis
LDIDALKGIALYLNFDMLASPNPGY

SEQ ID NO: 1547044 - protein, 21 aa, Mycobacterium tuberculosis
LETDQAFGWVAFEFGVHRYGL

SEQ ID NO: 1547045 - protein, 24 aa, Mycobacterium tuberculosis
LGYTLSCRRAHRPVRTVVTASSFD

SEQ ID NO: 1547046 - protein, 23 aa, Mycobacterium tuberculosis
LPEVPQIDAGSWLLLSASEADPL

SEQ ID NO: 1547047 - protein, 20 aa, Mycobacterium tuberculosis
LPVGRGMGPDRMTIYVQMPD

SEQ ID NO: 1547048 - protein, 17 aa, Mycobacterium tuberculosis
LRAAKAEPLGVLPQPNE

SEQ ID NO: 1547049 - protein, 24 aa, Mycobacterium tuberculosis
LSELPSHCRGLLVGRVAGAHTPAA

SEQ ID NO: 1547050 - protein, 17 aa, Mycobacterium tuberculosis
LSVGFRALRRVAFVQWR

SEQ ID NO: 1547051 - protein, 18 aa, Mycobacterium tuberculosis
LTSVLSHRSAEMALHRAN

SEQ ID NO: 1547052 - protein, 25 aa, Mycobacterium tuberculosis
LTVEGLRLAAGISEHERANRVFDER

SEQ ID NO: 1547053 - protein, 18 aa, Mycobacterium tuberculosis
LVAARFIQLTPVYTGGAV

SEQ ID NO: 1547054 - protein, 17 aa, Mycobacterium tuberculosis
MLASLWSSTGMSLVSAG

SEQ ID NO: 1547055 - protein, 19 aa, Mycobacterium tuberculosis
MNNGVPWSVPRMNPTHLNF

SEQ ID NO: 1547056 - protein, 25 aa, Mycobacterium tuberculosis
MRANLERWAPLLPEGATLVSLAKGI

SEQ ID NO: 1547057 - protein, 26 aa, Mycobacterium tuberculosis
NGIWYTARLRPGPLRPAERRTAVVEY

SEQ ID NO: 1547058 - protein, 20 aa, Mycobacterium tuberculosis
NNFPGASVPFGMVQYSPDTV

SEQ ID NO: 1547059 - protein, 26 aa, Mycobacterium tuberculosis
NPVGGFSFALPAGWVESDAAHLDYGS

SEQ ID NO: 1547060 - protein, 20 aa, Mycobacterium tuberculosis
NRYFGGLVHGLWRGGIGTTW

SEQ ID NO: 1547061 - protein, 17 aa, Mycobacterium tuberculosis
NSSDGYLLTAHYAVRVT

SEQ ID NO: 1547062 - protein, 17 aa, Mycobacterium tuberculosis
PNPEVYAPVTGFYSLRY

SEQ ID NO: 1547063 - protein, 25 aa, Mycobacterium tuberculosis
PQNLSDAGISWKVYNSKLLGGLNDT

SEQ ID NO: 1547064 - protein, 19 aa, Mycobacterium tuberculosis
PRLGHNLALHPATMLAGLF

SEQ ID NO: 1547065 - protein, 17 aa, Mycobacterium tuberculosis
PRRVLLLCDVSRSMQPY

SEQ ID NO: 1547066 - protein, 30 aa, Mycobacterium tuberculosis; identical to SEQ ID NO: 1470901

SEQ ID NO: 1547067 - protein, 17 aa, Mycobacterium tuberculosis
PRYVTAIDADTATVHVG

SEQ ID NO: 1547068 - protein, 23 aa, Mycobacterium tuberculosis
QACAAGARIISWARVERILHRAG

SEQ ID NO: 1547069 - protein, 23 aa, Mycobacterium tuberculosis
QDGMRLGGWYFPHTSGGSGPAVL

SEQ ID NO: 1547070 - protein, 17 aa, Mycobacterium tuberculosis
QEWSHARERGGIYPESD

SEQ ID NO: 1547071 - protein, 19 aa, Mycobacterium tuberculosis
QGVAIMIWTLMNARNSRDS

SEQ ID NO: 1547072 - protein, 31 aa, Mycobacterium tuberculosis; identical to SEQ ID NO: 234073

SEQ ID NO: 1547073 - protein, 21 aa, Mycobacterium tuberculosis
QRARLAPIRLRIGVHTGEVAL

SEQ ID NO: 1547074 - protein, 20 aa, Mycobacterium tuberculosis
QRPPAALVLRSPFTSLAEVG

SEQ ID NO: 1547075 - protein, 18 aa, Mycobacterium tuberculosis
RFPVVDRGGRFIGYLHIK

SEQ ID NO: 1547076 - protein, 19 aa, Mycobacterium tuberculosis
RITSPEALLPVYTPQVISR

SEQ ID NO: 1547077 - protein, 24 aa, Mycobacterium tuberculosis
RNAPGCRGCCQCAIGCPSNAKFGV

SEQ ID NO: 1547078 - protein, 23 aa, Mycobacterium tuberculosis
RRKDQAWEFVKFATGPVGQALIG

SEQ ID NO: 1547079 - protein, 17 aa, Mycobacterium tuberculosis
RRSDLQAVIAVDDPVRS

SEQ ID NO: 1547080 - protein, 18 aa, Mycobacterium tuberculosis
RSLLGGRLTGVVVVTGPP

SEQ ID NO: 1547081 - protein, 22 aa, Mycobacterium tuberculosis
RTDGQWGGAMLVVAKSTVSDVD

SEQ ID NO: 1547082 - protein, 22 aa, Mycobacterium tuberculosis
RVNSVAPGYIWGDTLKSYFDHQ

SEQ ID NO: 1547083 - protein, 20 aa, Mycobacterium tuberculosis
RVRQAIPLINTYVMSLGESL

SEQ ID NO: 1547084 - protein, 26 aa, Mycobacterium tuberculosis
RYNPDYLPGALLPPSIHATADAEEAL

SEQ ID NO: 1547085 - protein, 21 aa, Mycobacterium tuberculosis
SFGSYHLVDGFILNNQLSDFS

SEQ ID NO: 1547086 - protein, 33 aa, Mycobacterium tuberculosis
SGPFFKAMVVNLLPYQILQPWVDAAFKKRGIDP

SEQ ID NO: 1547087 - protein, 19 aa, Mycobacterium tuberculosis
SIGVPGILRMLEMVHNEHG

SEQ ID NO: 1547088 - protein, 30 aa, Mycobacterium tuberculosis; identical to SEQ ID NO: 234266

SEQ ID NO: 1547089 - protein, 18 aa, Mycobacterium tuberculosis
SMGSARPGDFGAPTAVAP

SEQ ID NO: 1547090 - protein, 17 aa, Mycobacterium tuberculosis
SPQRLWEALLRGDDLVG

SEQ ID NO: 1547091 - protein, 19 aa, Mycobacterium tuberculosis
SYETAGMRTTCGRRDLADY

SEQ ID NO: 1547092 - protein, 20 aa, Mycobacterium tuberculosis
TAHSFVDAWNYGALSTNAQL

SEQ ID NO: 1547093 - protein, 33 aa, Mycobacterium tuberculosis; identical to SEQ ID NO: 234314

SEQ ID NO: 1547094 - protein, 19 aa, Mycobacterium tuberculosis
TENYLRWVSDVDRSAPRPN

SEQ ID NO: 1547095 - protein, 31 aa, Mycobacterium tuberculosis; identical to SEQ ID NO: 1380436

SEQ ID NO: 1547096 - protein, 20 aa, Mycobacterium tuberculosis
TPAFEWYDQSGLSVVMPVGG

SEQ ID NO: 1547097 - protein, 23 aa, Mycobacterium tuberculosis
TRLGPLLRHHRVLICTPAEHDEI

SEQ ID NO: 1547098 - protein, 25 aa, Mycobacterium tuberculosis
VDDRWRLAQILTFQAVDAVVAGDPV

SEQ ID NO: 1547099 - protein, 18 aa, Mycobacterium tuberculosis
VDSLDFQDGIAFVHAEDP

SEQ ID NO: 1547100 - protein, 27 aa, Mycobacterium tuberculosis
VEPAIQPKLTFTWRIMPQNLSDAGISW

SEQ ID NO: 1547101 - protein, 17 aa, Mycobacterium tuberculosis
VKVVGFVASAPGFHGQP

SEQ ID NO: 1547102 - protein, 19 aa, Mycobacterium tuberculosis
VMGAGAWGTALAKVLADAG

SEQ ID NO: 1547103 - protein, 21 aa, Mycobacterium tuberculosis
VNAWVSFYAAGLFAMNNGVPW

SEQ ID NO: 1547104 - protein, 27 aa, Mycobacterium tuberculosis
VNSGTCFRPSLAVQRRWRDEFGLGLAD

SEQ ID NO: 1547105 - protein, 26 aa, Mycobacterium tuberculosis
VPRAELLRPGLLVLPVRGPARFFGSE

SEQ ID NO: 1547106 - protein, 26 aa, Mycobacterium tuberculosis
VSAVVASLFARHAQAYQALSLQATAF

SEQ ID NO: 1547107 - protein, 18 aa, Mycobacterium tuberculosis
VTKDIGYHLTRIASSDRS

SEQ ID NO: 1547108 - protein, 18 aa, Mycobacterium tuberculosis
WIATLTLELEPTVRLPAN

SEQ ID NO: 1547109 - protein, 25 aa, Mycobacterium tuberculosis
WRIDRLPNGVFLDWQQFQETYKRNT

SEQ ID NO: 1547110 - protein, 20 aa, Mycobacterium tuberculosis
YNPEYTCFLQGAKWYLDNGG

SEQ ID NO: 1547111 - protein, 24 aa, Mycobacterium tuberculosis
YSYGLGIVISGHWLLQNPMFAGYA

SEQ ID NO: 1547112 - protein, 27 aa, Mycobacterium tuberculosis
AAANSWLDAFAHWRRAQGLPATSIAWG

SEQ ID NO: 1547113 - protein, 18 aa, Mycobacterium tuberculosis
AALYKKAFAPLNELAGSL

SEQ ID NO: 1547114 - protein, 26 aa, Mycobacterium tuberculosis
AAQPLEWFCLFSSAAALVGSPGQGAY

SEQ ID NO: 1547115 - protein, 18 aa, Mycobacterium tuberculosis
ADGCLVDGPLGRVGLEME

SEQ ID NO: 1547116 - protein, 20 aa, Mycobacterium tuberculosis
AEEGLRCHFDAGNYQMAVEP

SEQ ID NO: 1547117 - protein, 18 aa, Mycobacterium tuberculosis
AEPGRITVILALHDLING

SEQ ID NO: 1547118 - protein, 20 aa, Mycobacterium tuberculosis
AEPKRYVVVPGVGHNDPELL

SEQ ID NO: 1547119 - protein, 18 aa, Mycobacterium tuberculosis
AGAGAWLLVRGHGPQQPE

SEQ ID NO: 1547120 - protein, 27 aa, Mycobacterium tuberculosis
AGPPEHLQWIGQWGIFDALRAGREVVR

SEQ ID NO: 1547121 - protein, 19 aa, Mycobacterium tuberculosis
AGVGCTRLAIHAVTANGEE

SEQ ID NO: 1547122 - protein, 34 aa, Mycobacterium tuberculosis
AIDSAFRAGWRGDYPSMIEFLAPLFTAGAGSNDV

SEQ ID NO: 1547123 - protein, 17 aa, Mycobacterium tuberculosis
AKPGQRIRIRIINSAAD

SEQ ID NO: 1547124 - protein, 24 aa, Mycobacterium tuberculosis
ALVGAGLDRKDIRTTRVTVAPQYS

SEQ ID NO: 1547125 - protein, 20 aa, Mycobacterium tuberculosis
ANAILRLVGVQPKDELDIAV

SEQ ID NO: 1547126 - protein, 23 aa, Mycobacterium tuberculosis
APGSFDGPDDWSANSVFGLPALG

SEQ ID NO: 1547127 - protein, 21 aa, Mycobacterium tuberculosis
APLPSWTHRTLMLSREDSHRS

SEQ ID NO: 1547128 - protein, 18 aa, Mycobacterium tuberculosis
APVIEKAYGAGPCSGHLT

SEQ ID NO: 1547129 - protein, 25 aa, Mycobacterium tuberculosis
AQLSGLRLGKVISISEASGAAPTHE

SEQ ID NO: 1547130 - protein, 22 aa, Mycobacterium tuberculosis
AQPIPRECRFIYAETAVFGSEI

SEQ ID NO: 1547131 - protein, 23 aa, Mycobacterium tuberculosis
ARAFQTLLRYGRAYSGYAPIMGT

SEQ ID NO: 1547132 - protein, 19 aa, Mycobacterium tuberculosis
ASGAGRAGVVPRYGVRLTV

SEQ ID NO: 1547133 - protein, 21 aa, Mycobacterium tuberculosis
ATAKFEFANGYATVTIATTGV

SEQ ID NO: 1547134 - protein, 28 aa, Mycobacterium tuberculosis
AVGADFGASIYAEYRLSTTVRKAANLRS

SEQ ID NO: 1547135 - protein, 18 aa, Mycobacterium tuberculosis
AVLTDWAAPVIEKAYGAG

SEQ ID NO: 1547136 - protein, 23 aa, Mycobacterium tuberculosis
AWKAPAVTTVRAFDATPMTTLPG

SEQ ID NO: 1547137 - protein, 18 aa, Mycobacterium tuberculosis
CKNIIALACGMAVGIGLG

SEQ ID NO: 1547138 - protein, 17 aa, Mycobacterium tuberculosis
CSVLALGLLAGCAPPRT

SEQ ID NO: 1547139 - protein, 24 aa, Mycobacterium tuberculosis
DGLACVVLRVARFFVEGDDMPDLY

SEQ ID NO: 1547140 - protein, 27 aa, Mycobacterium tuberculosis
DIYGDTRLGLFPFRRNLSLYAVDLALL

SEQ ID NO: 1547141 - protein, 26 aa, Mycobacterium tuberculosis
DLTDLLWRMGIRTIGQFAALSRTDVA

SEQ ID NO: 1547142 - protein, 25 aa, Mycobacterium tuberculosis
DSVPDEVWPAVVFTLVTLLDDPVAA

SEQ ID NO: 1547143 - protein, 22 aa, Mycobacterium tuberculosis
EAAELGEYFAGMGYSALTTAAL

SEQ ID NO: 1547144 - protein, 19 aa, Mycobacterium tuberculosis
EAGVDCFVAGSAVYGADDP

SEQ ID NO: 1547145 - protein, 18 aa, Mycobacterium tuberculosis
EASRLVATTSGYRAGLLA

SEQ ID NO: 1547146 - protein, 38 aa, Mycobacterium tuberculosis; identical to SEQ ID NO: 233359

SEQ ID NO: 1547147 - protein, 19 aa, Mycobacterium tuberculosis
ELESRIIIDSMHLGRYLGI

SEQ ID NO: 1547148 - protein, 28 aa, Mycobacterium tuberculosis
ERTLFRRLAVFVGCFFVDDAQAVACSGD

SEQ ID NO: 1547149 - protein, 24 aa, Mycobacterium tuberculosis
FAALRAGQLVAAWTTTADPDIPAD

SEQ ID NO: 1547150 - protein, 21 aa, Mycobacterium tuberculosis
FANSDAWFLIRVVTAPDGTAL

SEQ ID NO: 1547151 - protein, 22 aa, Mycobacterium tuberculosis
FASGRVAYTLGLHGPAVTVDTA

SEQ ID NO: 1547152 - protein, 30 aa, Mycobacterium tuberculosis; identical to SEQ ID NO: 236328

SEQ ID NO: 1547153 - protein, 17 aa, Mycobacterium tuberculosis
FTGVTPFADAYKPRPCD

SEQ ID NO: 1547154 - protein, 17 aa, Mycobacterium tuberculosis
FVVKTLVAMLDWGLNPQ

SEQ ID NO: 1547155 - protein, 26 aa, Mycobacterium tuberculosis
GAAQRAGIELLAFGGRFVEIGKRDIY

SEQ ID NO: 1547156 - protein, 24 aa, Mycobacterium tuberculosis
GALALASSLLRVWMTRGRIQEGRA

SEQ ID NO: 1547157 - protein, 19 aa, Mycobacterium tuberculosis
GAVICSAVALGIALHSGDP

SEQ ID NO: 1547158 - protein, 19 aa, Mycobacterium tuberculosis
GFHPRKALARVDEAARTMH

SEQ ID NO: 1547159 - protein, 23 aa, Mycobacterium tuberculosis
GGDARFLSLLSIRQLATEPSLSG

SEQ ID NO: 1547160 - protein, 34 aa, Mycobacterium tuberculosis; identical to SEQ ID NO: 1483682

SEQ ID NO: 1547161 - protein, 22 aa, Mycobacterium tuberculosis
GLADRRLYLAANRCLAIAARRV

SEQ ID NO: 1547162 - protein, 25 aa, Mycobacterium tuberculosis
GQVVLGWKVSDLKSSTAVIPGYPVA

SEQ ID NO: 1547163 - protein, 24 aa, Mycobacterium tuberculosis
GTALPRRHKLVLSRGPYGYHDEFA

SEQ ID NO: 1547164 - protein, 23 aa, Mycobacterium tuberculosis
GTDLPPTPISVIFRSDKSGTSDN

SEQ ID NO: 1547165 - protein, 21 aa, Mycobacterium tuberculosis
GVDWKGTLTGLAGYASGDLDT

SEQ ID NO: 1547166 - protein, 19 aa, Mycobacterium tuberculosis
GVYANDYWGPATVTYHDGQ

SEQ ID NO: 1547167 - protein, 20 aa, Mycobacterium tuberculosis
HFDTLLVMSVEPGFGGQRFI

SEQ ID NO: 1547168 - protein, 21 aa, Mycobacterium tuberculosis
HKPQLAFLPRQAFLDTNIIGT

SEQ ID NO: 1547169 - protein, 20 aa, Mycobacterium tuberculosis
HRALMAAGVGCTRLAIHAVT

SEQ ID NO: 1547170 - protein, 22 aa, Mycobacterium tuberculosis
IARGLSQRGVPFSWAGGGISGP

SEQ ID NO: 1547171 - protein, 24 aa, Mycobacterium tuberculosis
IDNPDRWAPPYAEAGAYNVTFHAE

SEQ ID NO: 1547172 - protein, 26 aa, Mycobacterium tuberculosis
IDRCWAPKVHGAWNIHRATAAQPLEW

SEQ ID NO: 1547173 - protein, 24 aa, Mycobacterium tuberculosis
ILATLIYLGWRAARAQMNRPKTRV

SEQ ID NO: 1547174 - protein, 19 aa, Mycobacterium tuberculosis
KAYGAGPCPGHLTDIEHIV

SEQ ID NO: 1547175 - protein, 19 aa, Mycobacterium tuberculosis
KLEAQRPHGFKALDITLPM

SEQ ID NO: 1547176 - protein, 18 aa, Mycobacterium tuberculosis
KRPATGWESLTPTEIDVV

SEQ ID NO: 1547177 - protein, 25 aa, Mycobacterium tuberculosis
LGSPGGSMIIQFVVKTLVAMLDWGL

SEQ ID NO: 1547178 - protein, 24 aa, Mycobacterium tuberculosis
LHKANSLQGLAFALAYQGELSAAR

SEQ ID NO: 1547179 - protein, 21 aa, Mycobacterium tuberculosis
LLCGATLLIAACTRVVGGTAS

SEQ ID NO: 1547180 - protein, 30 aa, Mycobacterium tuberculosis
LLTGTRWECHLTQLELQWGRTIGQFPSPCT

SEQ ID NO: 1547181 - protein, 21 aa, Mycobacterium tuberculosis
LMTGAGYWVAHGALGGITISQ

SEQ ID NO: 1547182 - protein, 17 aa, Mycobacterium tuberculosis
LPAILGFVPEKSLVLVS

SEQ ID NO: 1547183 - protein, 24 aa, Mycobacterium tuberculosis
LPSHDWPDRVLRVTAIDIATGELV

SEQ ID NO: 1547184 - protein, 19 aa, Mycobacterium tuberculosis
LRQAGHTVAPFKVGPDFID

SEQ ID NO: 1547185 - protein, 22 aa, Mycobacterium tuberculosis
LRWSWLLSVLAAVGLGLATAPA

SEQ ID NO: 1547186 - protein, 20 aa, Mycobacterium tuberculosis
LTAFAQRSRFAEAFHATGQN

SEQ ID NO: 1547187 - protein, 26 aa, Mycobacterium tuberculosis
LTTLFPPVRPRQWLEIRYLDSVPDEV

SEQ ID NO: 1547188 - protein, 20 aa, Mycobacterium tuberculosis
LVAFGRYPTFEGYRQQLGID

SEQ ID NO: 1547189 - protein, 18 aa, Mycobacterium tuberculosis
LVLVLVYKQFRGEFTPKT

SEQ ID NO: 1547190 - protein, 24 aa, Mycobacterium tuberculosis
MEQFVYAYVRSCPGYTLDYNANGS

SEQ ID NO: 1547191 - protein, 22 aa, Mycobacterium tuberculosis
MGSMVFPGYGAELLRWLDRAPQ

SEQ ID NO: 1547192 - protein, 20 aa, Mycobacterium tuberculosis
MGTPWLTAFAQRSRFAEAFH

SEQ ID NO: 1547193 - protein, 17 aa, Mycobacterium tuberculosis
NDVPRAWAGDAPIGHIG

SEQ ID NO: 1547194 - protein, 18 aa, Mycobacterium tuberculosis
NLHFCRLPDQLAEIDTEL

SEQ ID NO: 1547195 - protein, 17 aa, Mycobacterium tuberculosis
PELPVAAAAAVPTASAT

SEQ ID NO: 1547196 - protein, 19 aa, Mycobacterium tuberculosis
PFYVWDFAEKFKEDVINDF

SEQ ID NO: 1547197 - protein, 21 aa, Mycobacterium tuberculosis
PKFRTGGYMIDFWGVGYQVAK

SEQ ID NO: 1547198 - protein, 19 aa, Mycobacterium tuberculosis
PMDCHLMIDNPDRWAPPYA

SEQ ID NO: 1547199 - protein, 34 aa, Mycobacterium tuberculosis
PRSTPPPPRRPTQIIMGIDWIGPGFNPHLLSDLS

SEQ ID NO: 1547200 - protein, 19 aa, Mycobacterium tuberculosis
PYAVWLDDWYARESNNNSV

SEQ ID NO: 1547201 - protein, 18 aa, Mycobacterium tuberculosis
QQEMAAAVAHAFETGEHL

SEQ ID NO: 1547202 - protein, 18 aa, Mycobacterium tuberculosis
QQLGIDFAGVVTAVGPDV

SEQ ID NO: 1547203 - protein, 30 aa, Mycobacterium tuberculosis; identical to SEQ ID NO: 1489590

SEQ ID NO: 1547204 - protein, 23 aa, Mycobacterium tuberculosis
RALTACGLIAVAVARADAAASYF

SEQ ID NO: 1547205 - protein, 25 aa, Mycobacterium tuberculosis
RLLFKRNICHQAIFYRRGLFGTIGP

SEQ ID NO: 1547206 - protein, 20 aa, Mycobacterium tuberculosis
RRPSWEEITEVLEWLSPLPG

SEQ ID NO: 1547207 - protein, 24 aa, Mycobacterium tuberculosis
RTEGPSNPLILVFGRVSELSTCSW

SEQ ID NO: 1547208 - protein, 19 aa, Mycobacterium tuberculosis
RTLTGFGYHGPDGQVVADR

SEQ ID NO: 1547209 - protein, 26 aa, Mycobacterium tuberculosis
RVRAKRPDGDWGPWYQTEYETEPRDP

SEQ ID NO: 1547210 - protein, 21 aa, Mycobacterium tuberculosis
RWDDPFRALDMLASLWSSTGM

SEQ ID NO: 1547211 - protein, 24 aa, Mycobacterium tuberculosis
RYWGPPSKPGIILFRRAGAPAALA

SEQ ID NO: 1547212 - protein, 17 aa, Mycobacterium tuberculosis
SAFPKPQNYPGLPTVSF

SEQ ID NO: 1547213 - protein, 17 aa, Mycobacterium tuberculosis
SDIVTVVIGADKWREQL

SEQ ID NO: 1547214 - protein, 17 aa, Mycobacterium tuberculosis
SFVFRHRTGNAVILVLM

SEQ ID NO: 1547215 - protein, 27 aa, Mycobacterium tuberculosis
SITYNEWSFAVGKQLNMAQIITSAGPD

SEQ ID NO: 1547216 - protein, 18 aa, Mycobacterium tuberculosis
SKTGARYSFQVAKVDNGR

SEQ ID NO: 1547217 - protein, 25 aa, Mycobacterium tuberculosis
SSKLLRCILGDPVVDAVVAVRQLEH

SEQ ID NO: 1547218 - protein, 30 aa, Mycobacterium tuberculosis; identical to SEQ ID NO: 234295

SEQ ID NO: 1547219 - protein, 27 aa, Mycobacterium tuberculosis
TAVKSCGYSDCKVLTSFTACGAVAAND

SEQ ID NO: 1547220 - protein, 17 aa, Mycobacterium tuberculosis
TEHRVPIDVLRGALADA

SEQ ID NO: 1547221 - protein, 17 aa, Mycobacterium tuberculosis
TNFSFTGVTPFADAYKP

SEQ ID NO: 1547222 - protein, 21 aa, Mycobacterium tuberculosis
TPHAIALVLQQLVLGNALPPD

SEQ ID NO: 1547223 - protein, 29 aa, Mycobacterium tuberculosis
TSSFYRPTQPGSYPIVLATYEIVCSKYPD

SEQ ID NO: 1547224 - protein, 17 aa, Mycobacterium tuberculosis
TTLSVPFSAFPKPQNYP

SEQ ID NO: 1547225 - protein, 18 aa, Mycobacterium tuberculosis
VEGLRGWLREERIDAVVD

SEQ ID NO: 1547226 - protein, 22 aa, Mycobacterium tuberculosis
VENLRYTVRFAAAVQAALKDGY

SEQ ID NO: 1547227 - protein, 25 aa, Mycobacterium tuberculosis
VGIQFSDDFIEWSVSFSQKPFPLPC

SEQ ID NO: 1547228 - protein, 19 aa, Mycobacterium tuberculosis
VPGAVRFPRDLGPHYDYQT

SEQ ID NO: 1547229 - protein, 19 aa, Mycobacterium tuberculosis
VPLPELPHGLRITDVSLAA

SEQ ID NO: 1547230 - protein, 27 aa, Mycobacterium tuberculosis
VVAGSARFTQHLKLGYRDAVAVVDSAL

SEQ ID NO: 1547231 - protein, 19 aa, Mycobacterium tuberculosis
WRREVPFDVHLMIFGDSTA

SEQ ID NO: 1547232 - protein, 18 aa, Mycobacterium tuberculosis
YFAGMGYSALTTAALAAG

SEQ ID NO: 1547233 - protein, 23 aa, Mycobacterium tuberculosis
YGVDPLILRQAYPVRQAPYGLAG

SEQ ID NO: 1547234 - protein, 18 aa, Mycobacterium tuberculosis
YPDIKVRALLSGPGVMQQ

SEQ ID NO: 1547235 - protein, 24 aa, Mycobacterium tuberculosis
AADQRIRQVAPFLSYGQFTGSAPR

SEQ ID NO: 1547236 - protein, 27 aa, Mycobacterium tuberculosis
AALAVASPCAYFLVYESTETTERPEHH

SEQ ID NO: 1547237 - protein, 18 aa, Mycobacterium tuberculosis
AAQSGRFPGFDAATQAGY

SEQ ID NO: 1547238 - protein, 24 aa, Mycobacterium tuberculosis
AGTRDFPENTVLAITNAVAAGVDG

SEQ ID NO: 1547239 - protein, 18 aa, Mycobacterium tuberculosis
AGVDGMWLTVQVSSDGVP

SEQ ID NO: 1547240 - protein, 18 aa, Mycobacterium tuberculosis
AHVKRYLPQLTQQHALAL

SEQ ID NO: 1547241 - protein, 38 aa, Mycobacterium tuberculosis; identical to SEQ ID NO: 233171

SEQ ID NO: 1547242 - protein, 18 aa, Mycobacterium tuberculosis
ANATPLQALQTVQQNVLT

SEQ ID NO: 1547243 - protein, 24 aa, Mycobacterium tuberculosis
APEDVGWDWFGLQFYNGTALMLFQ

SEQ ID NO: 1547244 - protein, 23 aa, Mycobacterium tuberculosis
APRDLCALWPVPATSTPHPAAPA

SEQ ID NO: 1547245 - protein, 20 aa, Mycobacterium tuberculosis
ARVQRPLWASTGVKNPDYSD

SEQ ID NO: 1547246 - protein, 29 aa, Mycobacterium tuberculosis
ASQAIDLLKGVLMPSIMQAVQNGGAAAPA

SEQ ID NO: 1547247 - protein, 23 aa, Mycobacterium tuberculosis
AVPRPLMGSLIQRVPLDGAALST

SEQ ID NO: 1547248 - protein, 22 aa, Mycobacterium tuberculosis
DAASVFARRVPLAAAVWTQRGW

SEQ ID NO: 1547249 - protein, 21 aa, Mycobacterium tuberculosis
DFDPAEAITHGYIDSQKLLAW

SEQ ID NO: 1547250 - protein, 20 aa, Mycobacterium tuberculosis
DPGTALLLCYRQRRWYLEGS

SEQ ID NO: 1547251 - protein, 19 aa, Mycobacterium tuberculosis
DWADEVYVFGYPRVPMTAE

SEQ ID NO: 1547252 - protein, 19 aa, Mycobacterium tuberculosis
DWAKYALKAPVMMVRSPDT

SEQ ID NO: 1547253 - protein, 21 aa, Mycobacterium tuberculosis
DYFIRMWNQAALAMEVYQAET

SEQ ID NO: 1547254 - protein, 17 aa, Mycobacterium tuberculosis
EAAWRNLSLALPLSAAV

SEQ ID NO: 1547255 - protein, 21 aa, Mycobacterium tuberculosis
EARRHGWTFPYLYDETQDVAR

SEQ ID NO: 1547256 - protein, 21 aa, Mycobacterium tuberculosis
EFNGRHYAVPYARSTPLFYYN

SEQ ID NO: 1547257 - protein, 17 aa, Mycobacterium tuberculosis
EGWAERVRLAHALGPTM

SEQ ID NO: 1547258 - protein, 23 aa, Mycobacterium tuberculosis
ENRPDCIYLGAAGHVLGTGHTLR

SEQ ID NO: 1547259 - protein, 17 aa, Mycobacterium tuberculosis
ESARSRLTGTFLDAYTQ

SEQ ID NO: 1547260 - protein, 22 aa, Mycobacterium tuberculosis
FGGPDFPAPLDVATSPPNPDGP

SEQ ID NO: 1547261 - protein, 22 aa, Mycobacterium tuberculosis
FTAGHCRGGGAVTSRDYKVIGH

SEQ ID NO: 1547262 - protein, 21 aa, Mycobacterium tuberculosis
GGGGNGRFMGNGGVGGAGGYG

SEQ ID NO: 1547263 - protein, 30 aa, Mycobacterium tuberculosis
GPAGGRAWDGLWDPTLPMIPSANIPGDPIA

SEQ ID NO: 1547264 - protein, 23 aa, Mycobacterium tuberculosis
GSSSDLRVGQPVLAIGSPLGLEG

SEQ ID NO: 1547265 - protein, 21 aa, Mycobacterium tuberculosis
GTMPNRLYWISATVNPDGDQG

SEQ ID NO: 1547266 - protein, 22 aa, Mycobacterium tuberculosis
HVPLTCWNTWGGVDQFDVGIGA

SEQ ID NO: 1547267 - protein, 19 aa, Mycobacterium tuberculosis
HVYTKLGFTSRLQLAQAAA

SEQ ID NO: 1547268 - protein, 28 aa, Mycobacterium tuberculosis
IGAKAGGLPGDLTFSWYAVDKTGQPWVV

SEQ ID NO: 1547269 - protein, 20 aa, Mycobacterium tuberculosis
IGALNSGIGNLGFGNSGNNN

SEQ ID NO: 1547270 - protein, 30 aa, Mycobacterium tuberculosis; identical to SEQ ID NO: 233700

SEQ ID NO: 1547271 - protein, 33 aa, Mycobacterium tuberculosis; identical to SEQ ID NO: 233703

SEQ ID NO: 1547272 - protein, 17 aa, Mycobacterium tuberculosis
IRHLTRLGVDIHFNTRV

SEQ ID NO: 1547273 - protein, 18 aa, Mycobacterium tuberculosis
KVGQKVLPQQARKGDLIF

SEQ ID NO: 1547274 - protein, 24 aa, Mycobacterium tuberculosis
LAQDCVDRMGFSFLANIGTASVAR

SEQ ID NO: 1547275 - protein, 23 aa, Mycobacterium tuberculosis
LGQSVCPILAEPGGSFNTAVASV

SEQ ID NO: 1547276 - protein, 21 aa, Mycobacterium tuberculosis
LLYECDGQWVLAAGVQAMVEL

SEQ ID NO: 1547277 - protein, 24 aa, Mycobacterium tuberculosis
LVALAAKLVHDFDIAPGHVFATGM

SEQ ID NO: 1547278 - protein, 25 aa, Mycobacterium tuberculosis
LYSPQRWKYLTSGLLGLQRGSDAGD

SEQ ID NO: 1547279 - protein, 23 aa, Mycobacterium tuberculosis
NGGMGGNAVGLFGQGGAGGAGGS

SEQ ID NO: 1547280 - protein, 20 aa, Mycobacterium tuberculosis
PNKAFACQYAMQFIAVLRGY

SEQ ID NO: 1547281 - protein, 19 aa, Mycobacterium tuberculosis
PRGLSAVPLEPGQQTVGFS

SEQ ID NO: 1547282 - protein, 31 aa, Mycobacterium tuberculosis
PVYFDYWSARGVDVTPFFAVLNGPRIAAPGG

SEQ ID NO: 1547283 - protein, 23 aa, Mycobacterium tuberculosis
QFISETWRLYGVAARNDGIANVD

SEQ ID NO: 1547284 - protein, 25 aa, Mycobacterium tuberculosis
QFVQALNMGAVCYAAAETANATPLQ

SEQ ID NO: 1547285 - protein, 24 aa, Mycobacterium tuberculosis
QGSQWPGMGTELLVAEPVFAATVA

SEQ ID NO: 1547286 - protein, 25 aa, Mycobacterium tuberculosis
QPDPGKWAGFELHRDVTVTEEFTLG

SEQ ID NO: 1547287 - protein, 21 aa, Mycobacterium tuberculosis
QRAPQLGFGRYLVSATTPFTR

SEQ ID NO: 1547288 - protein, 32 aa, Mycobacterium tuberculosis
RARLLAEAAPVLWDEMPTLPLYRQQRTLLMST

SEQ ID NO: 1547289 - protein, 19 aa, Mycobacterium tuberculosis
REPLRVEGEVSYRVPSLSL

SEQ ID NO: 1547290 - protein, 18 aa, Mycobacterium tuberculosis
RFPTLSVKLIDAGKDYDE

SEQ ID NO: 1547291 - protein, 20 aa, Mycobacterium tuberculosis
RFSGWQSTRQRVWGQMDSAR

SEQ ID NO: 1547292 - protein, 31 aa, Mycobacterium tuberculosis; identical to SEQ ID NO: 234131

SEQ ID NO: 1547293 - protein, 24 aa, Mycobacterium tuberculosis
RVMRHRAWQGLVLLVLALLLSSCG

SEQ ID NO: 1547294 - protein, 33 aa, Mycobacterium tuberculosis; identical to SEQ ID NO: 234201

SEQ ID NO: 1547295 - protein, 21 aa, Mycobacterium tuberculosis
SEDAKFVYVDGHLYSDLGQPG

SEQ ID NO: 1547296 - protein, 22 aa, Mycobacterium tuberculosis
SEIRTARCATVSVPVDYDQPGG

SEQ ID NO: 1547297 - protein, 22 aa, Mycobacterium tuberculosis
SGDHPGIDWAKYALKAPVMMVR

SEQ ID NO: 1547298 - protein, 17 aa, Mycobacterium tuberculosis
SGLRPEHIRDIAVTGYQ

SEQ ID NO: 1547299 - protein, 20 aa, Mycobacterium tuberculosis
SIADVLRCIDGPLASVRDIG

SEQ ID NO: 1547300 - protein, 26 aa, Mycobacterium tuberculosis
SMLFPHLYGPLPVRAVIGAAAYPPAG

SEQ ID NO: 1547301 - protein, 22 aa, Mycobacterium tuberculosis
SVRMGAAVTPYVEWLTTTAAQA

SEQ ID NO: 1547302 - protein, 19 aa, Mycobacterium tuberculosis
TASRILASFAPAIPDRSDV

SEQ ID NO: 1547303 - protein, 31 aa, Mycobacterium tuberculosis; identical to SEQ ID NO: 1492153

SEQ ID NO: 1547304 - protein, 20 aa, Mycobacterium tuberculosis
TNFRWGGAFDLDRLLFKRNI

SEQ ID NO: 1547305 - protein, 24 aa, Mycobacterium tuberculosis
TRRKGRLAALAIAAMASASLVTVA

SEQ ID NO: 1547306 - protein, 22 aa, Mycobacterium tuberculosis
TSSEWNAALSRIAVAGRGPGDV

SEQ ID NO: 1547307 - protein, 20 aa, Mycobacterium tuberculosis
TTALTDVWRALRASMRSVLE

SEQ ID NO: 1547308 - protein, 23 aa, Mycobacterium tuberculosis
TVEGLKIDGDHIVVKFSIGTNTI

SEQ ID NO: 1547309 - protein, 17 aa, Mycobacterium tuberculosis
TWNPSGMYFWLDYADGI

SEQ ID NO: 1547310 - protein, 17 aa, Mycobacterium tuberculosis
VCGELGLPYLVLARPPW

SEQ ID NO: 1547311 - protein, 18 aa, Mycobacterium tuberculosis
VEPRARWERLYHLVNHVL

SEQ ID NO: 1547312 - protein, 21 aa, Mycobacterium tuberculosis
VLARPPWDPGTAIIAVSDIEA

SEQ ID NO: 1547313 - protein, 21 aa, Mycobacterium tuberculosis
VLINNAFRVPSMKPLAGTTFE

SEQ ID NO: 1547314 - protein, 17 aa, Mycobacterium tuberculosis
VVTTHLQSQWSLVCVLQ

SEQ ID NO: 1547315 - protein, 19 aa, Mycobacterium tuberculosis
VWRALRASMRSVLEETTLA

SEQ ID NO: 1547316 - protein, 19 aa, Mycobacterium tuberculosis
YPYRPEPPAPPPGGPPPGP

SEQ ID NO: 1547317 - protein, 18 aa, Mycobacterium tuberculosis
YSGPTTALTDVWRALRAS

SEQ ID NO: 1547318 - protein, 19 aa, Mycobacterium tuberculosis
AAARCPQLFIATADADRDA

SEQ ID NO: 1547319 - protein, 23 aa, Mycobacterium tuberculosis
AALHHPCCGDLVYGADPKLAKRL

SEQ ID NO: 1547320 - protein, 24 aa, Mycobacterium tuberculosis
AALRIVLGHELFHYAARADTALDA

SEQ ID NO: 1547321 - protein, 32 aa, Mycobacterium tuberculosis; identical to SEQ ID NO: 233121

SEQ ID NO: 1547322 - protein, 33 aa, Mycobacterium tuberculosis; identical to SEQ ID NO: 233177

SEQ ID NO: 1547323 - protein, 21 aa, Mycobacterium tuberculosis
APDEPRAGAGACALQGADGRW

SEQ ID NO: 1547324 - protein, 20 aa, Mycobacterium tuberculosis
APLQRPILCTEYLARSQGST

SEQ ID NO: 1547325 - protein, 20 aa, Mycobacterium tuberculosis
ARAAAPLAPLALAMVLASCG

SEQ ID NO: 1547326 - protein, 17 aa, Mycobacterium tuberculosis
ARGTTSLRRIREIAPPP

SEQ ID NO: 1547327 - protein, 24 aa, Mycobacterium tuberculosis
ASVDCFRSQSGMKVMGFAVKTVDD

SEQ ID NO: 1547328 - protein, 17 aa, Mycobacterium tuberculosis
ATSFKAKPGQRIRIRII

SEQ ID NO: 1547329 - protein, 18 aa, Mycobacterium tuberculosis
AVHYPWLPLRRLLLDHYP

SEQ ID NO: 1547330 - protein, 20 aa, Mycobacterium tuberculosis
DIDADFVVFDGILYATLTPN

SEQ ID NO: 1547331 - protein, 21 aa, Mycobacterium tuberculosis
DIRARGRLIVGLDIGSNLFSF

SEQ ID NO: 1547332 - protein, 21 aa, Mycobacterium tuberculosis
DRQLARFALRGDRTMFLFVFR

SEQ ID NO: 1547333 - protein, 20 aa, Mycobacterium tuberculosis
EIAPPPVIVSVVNWADCLVA

SEQ ID NO: 1547334 - protein, 21 aa, Mycobacterium tuberculosis
EQYLWWVPHNVAGLVTALGGR

SEQ ID NO: 1547335 - protein, 19 aa, Mycobacterium tuberculosis
ESPGTLVMQVCGGPGDSGA

SEQ ID NO: 1547336 - protein, 18 aa, Mycobacterium tuberculosis
FALRGDRTMFLFVFRAEH

SEQ ID NO: 1547337 - protein, 28 aa, Mycobacterium tuberculosis
FALTYPRRLGFGLGSSVVSLSWRTGDDI

SEQ ID NO: 1547338 - protein, 19 aa, Mycobacterium tuberculosis
FIPEVLSKVRAVRKMVDAG

SEQ ID NO: 1547339 - protein, 25 aa, Mycobacterium tuberculosis
FLSAELPDWLAANRGLAPGGHAAVG

SEQ ID NO: 1547340 - protein, 22 aa, Mycobacterium tuberculosis
FQTRLAQFVAIAARYHIKPLFV

SEQ ID NO: 1547341 - protein, 18 aa, Mycobacterium tuberculosis
GAGPRYAGPLFVTDLDSP

SEQ ID NO: 1547342 - protein, 24 aa, Mycobacterium tuberculosis
GDYRCRSYQAGLFCVNYAHQSAVR

SEQ ID NO: 1547343 - protein, 24 aa, Mycobacterium tuberculosis
GGGTGGLGGWLWGNNGAAGTGDPV

SEQ ID NO: 1547344 - protein, 19 aa, Mycobacterium tuberculosis
GHSWRKRPATGWESLTPTE

SEQ ID NO: 1547345 - protein, 19 aa, Mycobacterium tuberculosis
GLQVKTIWVARAVSVLFPQ

SEQ ID NO: 1547346 - protein, 17 aa, Mycobacterium tuberculosis
GQGFAIPIGQAMAIAGQ

SEQ ID NO: 1547347 - protein, 18 aa, Mycobacterium tuberculosis
GRVVSLFDRVEALRVTAL

SEQ ID NO: 1547348 - protein, 25 aa, Mycobacterium tuberculosis
IEACECPSGCPSCVQSPKCGNGNDP

SEQ ID NO: 1547349 - protein, 17 aa, Mycobacterium tuberculosis
IKPLFVLFDSCWDPLPR

SEQ ID NO: 1547350 - protein, 24 aa, Mycobacterium tuberculosis
INAPTEFMFGRSLIGDGADGTAAS

SEQ ID NO: 1547351 - protein, 37 aa, Mycobacterium tuberculosis; identical to SEQ ID NO: 233736

SEQ ID NO: 1547352 - protein, 20 aa, Mycobacterium tuberculosis
KAYGAGPCSGHLTDIEHIVL

SEQ ID NO: 1547353 - protein, 20 aa, Mycobacterium tuberculosis
KPSMPYRLRVIVHEDENGRM

SEQ ID NO: 1547354 - protein, 24 aa, Mycobacterium tuberculosis
KTVDDYRLAHKIGLDAVLVDSPLA

SEQ ID NO: 1547355 - protein, 25 aa, Mycobacterium tuberculosis
LDRQWLHARSLAFAHPADGRRVEIV

SEQ ID NO: 1547356 - protein, 18 aa, Mycobacterium tuberculosis
LGLTAPFNIDEVPNVIRG

SEQ ID NO: 1547357 - protein, 21 aa, Mycobacterium tuberculosis
LHKGDRVRIAGLGVGTVEGLK

SEQ ID NO: 1547358 - protein, 17 aa, Mycobacterium tuberculosis
LPLLLAAGTVLGQAPRA

SEQ ID NO: 1547359 - protein, 29 aa, Mycobacterium tuberculosis
LPLRWGEYRAGGLARARWGLLEPPEPWLP

SEQ ID NO: 1547360 - protein, 24 aa, Mycobacterium tuberculosis
LPQQARKGDLIFYGPEGTQSVALY

SEQ ID NO: 1547361 - protein, 20 aa, Mycobacterium tuberculosis
LTMLLVFTVITGIVYPLAVT

SEQ ID NO: 1547362 - protein, 28 aa, Mycobacterium tuberculosis
LVVLGACLALWLSGCSSPKPDAEEQGVP

SEQ ID NO: 1547363 - protein, 21 aa, Mycobacterium tuberculosis
MGGNGGLVFGNGGPGGLGGPG

SEQ ID NO: 1547364 - protein, 23 aa, Mycobacterium tuberculosis
MSIARCVGNTLLLNGRTYSPPYT

SEQ ID NO: 1547365 - protein, 21 aa, Mycobacterium tuberculosis
PAIPDRSDVVWLEHEDNHESA

SEQ ID NO: 1547366 - protein, 19 aa, Mycobacterium tuberculosis
PDNVARLILDSPIALGVSA

SEQ ID NO: 1547367 - protein, 17 aa, Mycobacterium tuberculosis
PDTAIFADERWRNYHNR

SEQ ID NO: 1547368 - protein, 26 aa, Mycobacterium tuberculosis
PGGAIARLPAIFTHRDVGNTDCPGNA

SEQ ID NO: 1547369 - protein, 17 aa, Mycobacterium tuberculosis
PIELVKTSDGWRIDRLP

SEQ ID NO: 1547370 - protein, 21 aa, Mycobacterium tuberculosis
PKLAKRLGLDRQWLHARSLAF

SEQ ID NO: 1547371 - protein, 28 aa, Mycobacterium tuberculosis
PQAGRPRGWPEWAEPDVVDAFADRGISS

SEQ ID NO: 1547372 - protein, 19 aa, Mycobacterium tuberculosis
PVGFDRPQFFGQYRDSRQN

SEQ ID NO: 1547373 - protein, 18 aa, Mycobacterium tuberculosis
QSAVRFASAGIEPFGCLK

SEQ ID NO: 1547374 - protein, 17 aa, Mycobacterium tuberculosis
RAAHALAAAVPRLADVA

SEQ ID NO: 1547375 - protein, 20 aa, Mycobacterium tuberculosis
RALWIAALSFGLGGVAVAAE

SEQ ID NO: 1547376 - protein, 20 aa, Mycobacterium tuberculosis
REIDGLLPTLIRGQGTEFDS

SEQ ID NO: 1547377 - protein, 21 aa, Mycobacterium tuberculosis
RGREICGMPSSGGVAVAATLG

SEQ ID NO: 1547378 - protein, 22 aa, Mycobacterium tuberculosis
RMATGMACRTRFFDQFFLDATH

SEQ ID NO: 1547379 - protein, 23 aa, Mycobacterium tuberculosis
RTVSGQLTLLVPFIDRVRARVDL

SEQ ID NO: 1547380 - protein, 19 aa, Mycobacterium tuberculosis
RVCVARGTTSLRRIREIAP

SEQ ID NO: 1547381 - protein, 23 aa, Mycobacterium tuberculosis
SDGRRFACDYALLAVPYLTLREL

SEQ ID NO: 1547382 - protein, 24 aa, Mycobacterium tuberculosis
TDARGLGFLGERAVNVLRLNLALD

SEQ ID NO: 1547383 - protein, 17 aa, Mycobacterium tuberculosis
TSAVLVVLGACLALWLS

SEQ ID NO: 1547384 - protein, 24 aa, Mycobacterium tuberculosis
TSVPMLFAKPSYYGQFTDSGGLHK

SEQ ID NO: 1547385 - protein, 21 aa, Mycobacterium tuberculosis
TWNTLYRKWLTVLGPAPAPPT

SEQ ID NO: 1547386 - protein, 24 aa, Mycobacterium tuberculosis
VAELLPQVFRWARTVDPVQPLTSG

SEQ ID NO: 1547387 - protein, 18 aa, Mycobacterium tuberculosis
VLECLAGLASDAGTHHAA

SEQ ID NO: 1547388 - protein, 17 aa, Mycobacterium tuberculosis
WRDEFGLGLADPDQLGR

SEQ ID NO: 1547389 - protein, 17 aa, Mycobacterium tuberculosis
YKRNTLYFADPTGKTVV

SEQ ID NO: 1547390 - protein, 18 aa, Mycobacterium tuberculosis
YVPSRPHLEWQLRRRVLQ

SEQ ID NO: 1547391 - protein, 19 aa, Mycobacterium tuberculosis
AFHPDRFGFAGSMSGFLYP

SEQ ID NO: 1547392 - protein, 21 aa, Mycobacterium tuberculosis
AHRCARDGADLVLAARSAERL

SEQ ID NO: 1547393 - protein, 20 aa, Mycobacterium tuberculosis
ALALAPRLAGMAELVQITDK

SEQ ID NO: 1547394 - protein, 26 aa, Mycobacterium tuberculosis
ALALTCGAGLLKWQDGAVRDAAVARA

SEQ ID NO: 1547395 - protein, 20 aa, Mycobacterium tuberculosis
ALDATITWSSEGIKESVQNA

SEQ ID NO: 1547396 - protein, 25 aa, Mycobacterium tuberculosis
APIAIPLRVGGPIAIDGDPTKVRGL

SEQ ID NO: 1547397 - protein, 18 aa, Mycobacterium tuberculosis
AQTVPRKAARLTIDGVTH

SEQ ID NO: 1547398 - protein, 19 aa, Mycobacterium tuberculosis
AYPAAFPVGMLPTNQNDAG

SEQ ID NO: 1547399 - protein, 17 aa, Mycobacterium tuberculosis
DLPLPLRWGEYRAGGLA

SEQ ID NO: 1547400 - protein, 21 aa, Mycobacterium tuberculosis
DPATLWTLIGGPRMWERRPGA

SEQ ID NO: 1547401 - protein, 24 aa, Mycobacterium tuberculosis
DRSGLPVVVSVVGLVHTPGLVTLA

SEQ ID NO: 1547402 - protein, 20 aa, Mycobacterium tuberculosis
DVHVAPRVIFLPGPAAALTS

SEQ ID NO: 1547403 - protein, 20 aa, Mycobacterium tuberculosis
DVLVPGYLYHYSLDAGQAGR

SEQ ID NO: 1547404 - protein, 18 aa, Mycobacterium tuberculosis
DYQQITDVVIARGLSQRG

SEQ ID NO: 1547405 - protein, 23 aa, Mycobacterium tuberculosis
EDVKTVPTTVWIASDGSSHLVQI

SEQ ID NO: 1547406 - protein, 19 aa, Mycobacterium tuberculosis
EFVDVFLAIGRVGRSLGMH

SEQ ID NO: 1547407 - protein, 19 aa, Mycobacterium tuberculosis
EGTQSVALYLGKGQMLEVG

SEQ ID NO: 1547408 - protein, 21 aa, Mycobacterium tuberculosis
EIDKRLDRIGSRQALELRGQA

SEQ ID NO: 1547409 - protein, 23 aa, Mycobacterium tuberculosis
ERRRGDLPTALRVDASGNPETGE

SEQ ID NO: 1547410 - protein, 24 aa, Mycobacterium tuberculosis
FGQVTSGLTAGVWQGAAAAAMAAA

SEQ ID NO: 1547411 - protein, 21 aa, Mycobacterium tuberculosis
FPVTVNWSTPAVTIFPNGISI

SEQ ID NO: 1547412 - protein, 19 aa, Mycobacterium tuberculosis
FSVLSLPTTLIFDVDGRQR

SEQ ID NO: 1547413 - protein, 23 aa, Mycobacterium tuberculosis
FTVITGIVYPLAVTGVGQLFFGD

SEQ ID NO: 1547414 - protein, 18 aa, Mycobacterium tuberculosis
FYDHVKRGDIVEVVNTVG

SEQ ID NO: 1547415 - protein, 17 aa, Mycobacterium tuberculosis
GGLAGIGGNAGFVGNGG

SEQ ID NO: 1547416 - protein, 19 aa, Mycobacterium tuberculosis
GKLKRRAVAQAYRDGTLPR

SEQ ID NO: 1547417 - protein, 18 aa, Mycobacterium tuberculosis
GPDGGWNKPPTPLWPDQL

SEQ ID NO: 1547418 - protein, 27 aa, Mycobacterium tuberculosis
GQLKMARDEGRWHVRWTTSGLHPKLGE

SEQ ID NO: 1547419 - protein, 18 aa, Mycobacterium tuberculosis
GQVRDAWPPSARAQPHTH

SEQ ID NO: 1547420 - protein, 20 aa, Mycobacterium tuberculosis
GRPPVIQLWARPRGVAPDAL

SEQ ID NO: 1547421 - protein, 24 aa, Mycobacterium tuberculosis
GRTTGNSCGVTWGPGESPGTLVMQ

SEQ ID NO: 1547422 - protein, 25 aa, Mycobacterium tuberculosis
GSPAPRCWPSRCPIPRCVSRDRCWI

SEQ ID NO: 1547423 - protein, 18 aa, Mycobacterium tuberculosis
GSRIELRLADPADSELDR

SEQ ID NO: 1547424 - protein, 17 aa, Mycobacterium tuberculosis
GTSEPFDLLAVVPPHVP

SEQ ID NO: 1547425 - protein, 25 aa, Mycobacterium tuberculosis
HGTAFLAARGGYFVADLSSGHTARV

SEQ ID NO: 1547426 - protein, 32 aa, Mycobacterium tuberculosis
HPTTTYKAFDWDQAYRKPITYDTLWQADTDPL

SEQ ID NO: 1547427 - protein, 24 aa, Mycobacterium tuberculosis
IGNGGDGGPGMFGGPGGAGGSGGT

SEQ ID NO: 1547428 - protein, 19 aa, Mycobacterium tuberculosis
IPPRGTQAVVLKVYQNAGG

SEQ ID NO: 1547429 - protein, 18 aa, Mycobacterium tuberculosis
ITEVLEWLSPLPGGSVVS

SEQ ID NO: 1547430 - protein, 17 aa, Mycobacterium tuberculosis
KDRQCQFMPTIGSTVVP

SEQ ID NO: 1547431 - protein, 31 aa, Mycobacterium tuberculosis
KMAAAAPGCGVSWNLLAGIGRIESMHANGGA

SEQ ID NO: 1547432 - protein, 21 aa, Mycobacterium tuberculosis
KSELLRTIALGMMARNSPEVL

SEQ ID NO: 1547433 - protein, 18 aa, Mycobacterium tuberculosis
KVHLARGHAVNWVLVTDD

SEQ ID NO: 1547434 - protein, 23 aa, Mycobacterium tuberculosis
LASSCTWQLSLFITDGVPPPPGD

SEQ ID NO: 1547435 - protein, 18 aa, Mycobacterium tuberculosis
LDDQAWRAARQALGGEDV

SEQ ID NO: 1547436 - protein, 17 aa, Mycobacterium tuberculosis
LDELAIWAAGGVLGEIT

SEQ ID NO: 1547437 - protein, 18 aa, Mycobacterium tuberculosis
LGAAVLVALTTAAAACGA

SEQ ID NO: 1547438 - protein, 24 aa, Mycobacterium tuberculosis
LGLSGCSHPEFKRSSPPAPSLPPV

SEQ ID NO: 1547439 - protein, 23 aa, Mycobacterium tuberculosis
LMDSHPFTWLPLLSRVLGSAQLV

SEQ ID NO: 1547440 - protein, 21 aa, Mycobacterium tuberculosis
LRNVHIRPGVPPLVIAAPVEL

SEQ ID NO: 1547441 - protein, 23 aa, Mycobacterium tuberculosis
LSDEVLYRPLGMGSTSSRFTDFL

SEQ ID NO: 1547442 - protein, 22 aa, Mycobacterium tuberculosis
MQPYAAIYLRLMRAAVLRRAGG

SEQ ID NO: 1547443 - protein, 19 aa, Mycobacterium tuberculosis
MSRAFASSCNTTFAELSSR

SEQ ID NO: 1547444 - protein, 19 aa, Mycobacterium tuberculosis
NLAQYPSILVELGNMKNPA

SEQ ID NO: 1547445 - protein, 24 aa, Mycobacterium tuberculosis
NMANALRPNAIVSLHADGGPASGR

SEQ ID NO: 1547446 - protein, 18 aa, Mycobacterium tuberculosis
NVLGWRIDHELKHLDEAE

SEQ ID NO: 1547447 - protein, 25 aa, Mycobacterium tuberculosis
PADVQRLPLNVTWVNLTTGKSGSAT

SEQ ID NO: 1547448 - protein, 29 aa, Mycobacterium tuberculosis
PENFWRSAGLPEFRWPDPNGTRFPNGAPP

SEQ ID NO: 1547449 - protein, 24 aa, Mycobacterium tuberculosis
PERLPGAIRWAASALRQARDYLSG

SEQ ID NO: 1547450 - protein, 17 aa, Mycobacterium tuberculosis
PEVLNLLLVDFKGGATF

SEQ ID NO: 1547451 - protein, 21 aa, Mycobacterium tuberculosis
PEVNSALMFAGAGSGPTLAAA

SEQ ID NO: 1547452 - protein, 19 aa, Mycobacterium tuberculosis
PKGAVSALLSAARSGDGPG

SEQ ID NO: 1547453 - protein, 22 aa, Mycobacterium tuberculosis
PLSSALLSFGLLLGGLPLAAPP

SEQ ID NO: 1547454 - protein, 21 aa, Mycobacterium tuberculosis
PRVAHCIYAGLATDTGSFRWA

SEQ ID NO: 1547455 - protein, 21 aa, Mycobacterium tuberculosis
PTFEGYRQQLGIDFAGVVTAV

SEQ ID NO: 1547456 - protein, 17 aa, Mycobacterium tuberculosis
QGVRLGRGRGFYDRSLR

SEQ ID NO: 1547457 - protein, 25 aa, Mycobacterium tuberculosis
RALESRPGVVLHPGQAVCHFGVSTG

SEQ ID NO: 1547458 - protein, 19 aa, Mycobacterium tuberculosis
RDPDTMIPDVRYTPNPNDA

SEQ ID NO: 1547459 - protein, 22 aa, Mycobacterium tuberculosis
RDPLTVFLVLIIVFSLVLAGLI

SEQ ID NO: 1547460 - protein, 18 aa, Mycobacterium tuberculosis
RGAQALPPGGVLPVGQST

SEQ ID NO: 1547461 - protein, 20 aa, Mycobacterium tuberculosis
RINQSFPVTVNWSTPAVTIF

SEQ ID NO: 1547462 - protein, 25 aa, Mycobacterium tuberculosis
RSLAYDRAWWFARFVAAAYGTAKLR

SEQ ID NO: 1547463 - protein, 22 aa, Mycobacterium tuberculosis
RTFIRGSGWAELVGIGDVAAFD

SEQ ID NO: 1547464 - protein, 19 aa, Mycobacterium tuberculosis
RTPAALYWGARLTLVSRVD

SEQ ID NO: 1547465 - protein, 19 aa, Mycobacterium tuberculosis
SAVRFREAFFRDHGIDSVA

SEQ ID NO: 1547466 - protein, 20 aa, Mycobacterium tuberculosis
SGFAGLWAALGAARRLDELA

SEQ ID NO: 1547467 - protein, 22 aa, Mycobacterium tuberculosis
SGTEFNSQFSAAVRKIYDSGHN

SEQ ID NO: 1547468 - protein, 28 aa, Mycobacterium tuberculosis
SRDRCWIKPGPICLSILRSPRQVCSTTH

SEQ ID NO: 1547469 - protein, 24 aa, Mycobacterium tuberculosis
SVWGGFPAAVSWRSTSEQVHADLG

SEQ ID NO: 1547470 - protein, 33 aa, Mycobacterium tuberculosis; identical to SEQ ID NO: 234947

SEQ ID NO: 1547471 - protein, 34 aa, Mycobacterium tuberculosis; identical to SEQ ID NO: 235364

SEQ ID NO: 1547472 - protein, 40 aa, Mycobacterium tuberculosis; identical to SEQ ID NO: 1492653

SEQ ID NO: 1547473 - protein, 17 aa, Mycobacterium tuberculosis
TVWSMVMTLALDCGAMV

SEQ ID NO: 1547474 - protein, 18 aa, Mycobacterium tuberculosis
VALAEGKNALARALLSTG

SEQ ID NO: 1547475 - protein, 22 aa, Mycobacterium tuberculosis
VASTWSVCKGLAAVVITSAAAF

SEQ ID NO: 1547476 - protein, 18 aa, Mycobacterium tuberculosis
VAVNCALGSHPKGAVSAL

SEQ ID NO: 1547477 - protein, 17 aa, Mycobacterium tuberculosis
VAYSVNWDAIAQCESGG

SEQ ID NO: 1547478 - protein, 26 aa, Mycobacterium tuberculosis
VGALRDGGCNDVILVLGAVEVSAPAG

SEQ ID NO: 1547479 - protein, 22 aa, Mycobacterium tuberculosis
VITSAAAFALCPNAAADPATPQ

SEQ ID NO: 1547480 - protein, 36 aa, Mycobacterium tuberculosis
VLHRPKLGFPVPIRHWLRAGELLEWAYATVGSSQAG

SEQ ID NO: 1547481 - protein, 17 aa, Mycobacterium tuberculosis
VPDAFVVIADRLGNSVY

SEQ ID NO: 1547482 - protein, 19 aa, Mycobacterium tuberculosis
VQNAIPILGAFVTSSVVTH

SEQ ID NO: 1547483 - protein, 26 aa, Mycobacterium tuberculosis
VSDRNRAHWDWLKWLPHNQHPNACDA

SEQ ID NO: 1547484 - protein, 18 aa, Mycobacterium tuberculosis
WDQLKWNALANIAGTPAT

SEQ ID NO: 1547485 - protein, 30 aa, Mycobacterium tuberculosis; identical to SEQ ID NO: 234541

SEQ ID NO: 1547486 - protein, 25 aa, Mycobacterium tuberculosis
AAVEAEYELMWAADVAAMAGYHSGA

SEQ ID NO: 1547487 - protein, 26 aa, Mycobacterium tuberculosis
ADQRADWACDFWDCAAAEVAAALTIS

SEQ ID NO: 1547488 - protein, 18 aa, Mycobacterium tuberculosis
AEHTCCRETPAAIPTGPD

SEQ ID NO: 1547489 - protein, 18 aa, Mycobacterium tuberculosis
AGVVNVYAIAVLKRTSQP

SEQ ID NO: 1547490 - protein, 23 aa, Mycobacterium tuberculosis
AIAELRHLNPLNIVNLGNVGSYN

SEQ ID NO: 1547491 - protein, 37 aa, Mycobacterium tuberculosis; identical to SEQ ID NO: 234597

SEQ ID NO: 1547492 - protein, 25 aa, Mycobacterium tuberculosis
APGLVPRPGVPAAAAVPRVGPPAVP

SEQ ID NO: 1547493 - protein, 20 aa, Mycobacterium tuberculosis
ARFGVPVPNMTAWRDGVVGD

SEQ ID NO: 1547494 - protein, 30 aa, Mycobacterium tuberculosis; identical to SEQ ID NO: 209135

SEQ ID NO: 1547495 - protein, 19 aa, Mycobacterium tuberculosis
ATESLGRFSEVANRALAAT

SEQ ID NO: 1547496 - protein, 23 aa, Mycobacterium tuberculosis
DARRVADVLGIPFYVWDFAEKFK

SEQ ID NO: 1547497 - protein, 17 aa, Mycobacterium tuberculosis
DEIRAAASTDCQISRFT

SEQ ID NO: 1547498 - protein, 18 aa, Mycobacterium tuberculosis
DNRKEFGPALSKLNLVLA

SEQ ID NO: 1547499 - protein, 34 aa, Mycobacterium tuberculosis; identical to SEQ ID NO: 1471492

SEQ ID NO: 1547500 - protein, 25 aa, Mycobacterium tuberculosis
DSLPRIAQAIALPAVRKTGVLENEA

SEQ ID NO: 1547501 - protein, 20 aa, Mycobacterium tuberculosis
FAALDARRAALSALISGIDD

SEQ ID NO: 1547502 - protein, 18 aa, Mycobacterium tuberculosis
FLLTAGFFETHRPYPHER

SEQ ID NO: 1547503 - protein, 19 aa, Mycobacterium tuberculosis
GDPTSVHWHGIALRNDMDG

SEQ ID NO: 1547504 - protein, 17 aa, Mycobacterium tuberculosis
GGMGGNGGLVFGNGGPG

SEQ ID NO: 1547505 - protein, 25 aa, Mycobacterium tuberculosis
GGTCSAGQQCDRLAAVLMPDTATPS

SEQ ID NO: 1547506 - protein, 28 aa, Mycobacterium tuberculosis
GITIPEFPIHWTSTGGIGPIIIPDTTIL

SEQ ID NO: 1547507 - protein, 20 aa, Mycobacterium tuberculosis
GKVKADLGVDVFRRMVGDDF

SEQ ID NO: 1547508 - protein, 23 aa, Mycobacterium tuberculosis
GLETHLSYRMCLKTWSASESRNV

SEQ ID NO: 1547509 - protein, 20 aa, Mycobacterium tuberculosis
GPNGRPRYVTAIDADTATVH

SEQ ID NO: 1547510 - protein, 23 aa, Mycobacterium tuberculosis
GQGGEPRLTLPDAITGNPGDPRY

SEQ ID NO: 1547511 - protein, 18 aa, Mycobacterium tuberculosis
HNRVPALDGQRFLLTAGF

SEQ ID NO: 1547512 - protein, 17 aa, Mycobacterium tuberculosis
HSGDLNTGFGSPVDQPV

SEQ ID NO: 1547513 - protein, 24 aa, Mycobacterium tuberculosis
IARVIMRSAIGFFASFTVSSGVLA

SEQ ID NO: 1547514 - protein, 23 aa, Mycobacterium tuberculosis
IDHSAPWPLGPTHPSNLKCACRK

SEQ ID NO: 1547515 - protein, 20 aa, Mycobacterium tuberculosis
IRKRGRRISVADVELTQGGR

SEQ ID NO: 1547516 - protein, 19 aa, Mycobacterium tuberculosis
IYAGLATDTGSFRWASVRG

SEQ ID NO: 1547517 - protein, 20 aa, Mycobacterium tuberculosis
KAYPSHELTAVGDWMLLAAI

SEQ ID NO: 1547518 - protein, 18 aa, Mycobacterium tuberculosis
KNALARALLSTGAGSPPD

SEQ ID NO: 1547519 - protein, 28 aa, Mycobacterium tuberculosis
KTFVGAAARGGRRLVIAMMYGLVKEGGP

SEQ ID NO: 1547520 - protein, 25 aa, Mycobacterium tuberculosis
LAAACARATLVARAMRVEHAQCRVV

SEQ ID NO: 1547521 - protein, 17 aa, Mycobacterium tuberculosis
LDFQDGIAFVHAEDPGY

SEQ ID NO: 1547522 - protein, 18 aa, Mycobacterium tuberculosis
LDGQRFLLTAGFFETHRP

SEQ ID NO: 1547523 - protein, 18 aa, Mycobacterium tuberculosis
LDSLVLIASGGAFGPNGN

SEQ ID NO: 1547524 - protein, 19 aa, Mycobacterium tuberculosis
LGGHPRLGHNLALHPATML

SEQ ID NO: 1547525 - protein, 24 aa, Mycobacterium tuberculosis
LLEQSPPIWWTHIAGHGDAADLAR

SEQ ID NO: 1547526 - protein, 18 aa, Mycobacterium tuberculosis
LNTGFGSPVDQPVMNSGF

SEQ ID NO: 1547527 - protein, 20 aa, Mycobacterium tuberculosis
LPEGTRYVLSITWSDVETPG

SEQ ID NO: 1547528 - protein, 21 aa, Mycobacterium tuberculosis
LRSLPGCHLLVRPEVMRRDVD

SEQ ID NO: 1547529 - protein, 18 aa, Mycobacterium tuberculosis
LRYKVPRMPFSMSVAQAA

SEQ ID NO: 1547530 - protein, 24 aa, Mycobacterium tuberculosis
LTAVGDWMLLAAIEALIDEQDYLA

SEQ ID NO: 1547531 - protein, 23 aa, Mycobacterium tuberculosis
LVYVRLARPFIAFYNNCANAILR

SEQ ID NO: 1547532 - protein, 21 aa, Mycobacterium tuberculosis
MDPDVLLREFLKATADPANRH

SEQ ID NO: 1547533 - protein, 26 aa, Mycobacterium tuberculosis
MGMSSPIDCRDHFDRDEMRDQAQFQA

SEQ ID NO: 1547534 - protein, 26 aa, Mycobacterium tuberculosis
MPVVPLWDYISVVGWSSQVSNVTVTW

SEQ ID NO: 1547535 - protein, 17 aa, Mycobacterium tuberculosis
MQVCGGPGDSGAPVTVD

SEQ ID NO: 1547536 - protein, 18 aa, Mycobacterium tuberculosis
MSRREFLTKLTGAGAAAF

SEQ ID NO: 1547537 - protein, 17 aa, Mycobacterium tuberculosis
NLEDAGVSWKVYQNKGL

SEQ ID NO: 1547538 - protein, 23 aa, Mycobacterium tuberculosis
NYAPRPLLDLPWDIQESPAGMAV

SEQ ID NO: 1547539 - protein, 20 aa, Mycobacterium tuberculosis
PAVLAVAVVVAFLTTGCIRW

SEQ ID NO: 1547540 - protein, 23 aa, Mycobacterium tuberculosis
PDSEAMLLAAIYVAALRSYGFAA

SEQ ID NO: 1547541 - protein, 29 aa, Mycobacterium tuberculosis
PGGSHSWFAGYRGDLAFASLIVGGGSSEY

SEQ ID NO: 1547542 - protein, 23 aa, Mycobacterium tuberculosis
PLRRASPSAVHPVAPPSVRPFTT

SEQ ID NO: 1547543 - protein, 21 aa, Mycobacterium tuberculosis
PNRLYWLSANIDPAGTDGGPQ

SEQ ID NO: 1547544 - protein, 17 aa, Mycobacterium tuberculosis
PPMLGALLRDAEPAQAE

SEQ ID NO: 1547545 - protein, 38 aa, Mycobacterium tuberculosis
PQLPYLPLQVPQQLSLPADLPALASGVIPAAPIAPTPP

SEQ ID NO: 1547546 - protein, 21 aa, Mycobacterium tuberculosis
PTLAAAAAWDGLAAELGQAAN

SEQ ID NO: 1547547 - protein, 20 aa, Mycobacterium tuberculosis
PTQPRSITLTFIRNAQSQAN

SEQ ID NO: 1547548 - protein, 21 aa, Mycobacterium tuberculosis
QALLGRPIIGNGANGLPNTGQ

SEQ ID NO: 1547549 - protein, 23 aa, Mycobacterium tuberculosis
QATTRAGPYVPLTMGYYTRQDIP

SEQ ID NO: 1547550 - protein, 20 aa, Mycobacterium tuberculosis
RDESVWCLALSAAARSPTSV

SEQ ID NO: 1547551 - protein, 19 aa, Mycobacterium tuberculosis
RELSGSSNLLFRRNSVSGA

SEQ ID NO: 1547552 - protein, 23 aa, Mycobacterium tuberculosis
RPGAADFCRIRVGVGSAPLATRL

SEQ ID NO: 1547553 - protein, 20 aa, Mycobacterium tuberculosis
RYDPGALRRSRISARTRDLC

SEQ ID NO: 1547554 - protein, 25 aa, Mycobacterium tuberculosis
SIVRLRRRVRFAGEVTKVTSERATG

SEQ ID NO: 1547555 - protein, 25 aa, Mycobacterium tuberculosis
SSSLNDMTHWLAMVLADGVYNGRRI

SEQ ID NO: 1547556 - protein, 18 aa, Mycobacterium tuberculosis
SWDHPYRAPPKVWFHDLL

SEQ ID NO: 1547557 - protein, 20 aa, Mycobacterium tuberculosis
TGLYPPGSTFKMITAGAAVE

SEQ ID NO: 1547558 - protein, 23 aa, Mycobacterium tuberculosis
TNTGAFFIGHSGLLNSGGGQHVG

SEQ ID NO: 1547559 - protein, 25 aa, Mycobacterium tuberculosis
VARQEPRISWAAGLRDDGTTTLLVT

SEQ ID NO: 1547560 - protein, 17 aa, Mycobacterium tuberculosis
VAVAVAVTYAPEAFDDQ

SEQ ID NO: 1547561 - protein, 24 aa, Mycobacterium tuberculosis
VLASLRDLGCRALLMSGRPDEGAL

SEQ ID NO: 1547562 - protein, 27 aa, Mycobacterium tuberculosis
VLNLLLVDFKGGATFLDLAGAPHVAAV

SEQ ID NO: 1547563 - protein, 19 aa, Mycobacterium tuberculosis
VLVAGCSSNPLANFAPGYP

SEQ ID NO: 1547564 - protein, 22 aa, Mycobacterium tuberculosis
VSGEGCVVLLLKRLPDAVRDGD

SEQ ID NO: 1547565 - protein, 26 aa, Mycobacterium tuberculosis
VTADPRLNTGLTPFLLGPVYISNNPS

SEQ ID NO: 1547566 - protein, 18 aa, Mycobacterium tuberculosis
VVITGNPVTGWRLVEWDG

SEQ ID NO: 1547567 - protein, 18 aa, Mycobacterium tuberculosis
WQGWAGGPDGGWNKPPTP

SEQ ID NO: 1547568 - protein, 25 aa, Mycobacterium tuberculosis
WTLARADIRGPYVINADGAPLEDRF

SEQ ID NO: 1547569 - protein, 19 aa, Mycobacterium tuberculosis
YDPAMRTLIAFGGKYPTSV

SEQ ID NO: 1547570 - protein, 17 aa, Mycobacterium tuberculosis
YLYHYSLDAGQAGRELF

SEQ ID NO: 1547571 - protein, 17 aa, Mycobacterium tuberculosis
YNLRYRVLADWDFNIRC

SEQ ID NO: 1547572 - protein, 24 aa, Mycobacterium tuberculosis
YSPRLDRLAAEGILFTRAHATAPL

SEQ ID NO: 1547573 - protein, 26 aa, Mycobacterium tuberculosis
YSVLPGPLVATVFDLVFQPGKLPDSL

SEQ ID NO: 1547574 - protein, 18 aa, Mycobacterium tuberculosis
AADPDLGKLAGRITDALT

SEQ ID NO: 1547575 - protein, 17 aa, Mycobacterium tuberculosis
ADPDLGKLAGRITDALT

SEQ ID NO: 1547576 - protein, 17 aa, Mycobacterium tuberculosis
AFALAALIAFEVNLGVA

SEQ ID NO: 1547577 - protein, 34 aa, Mycobacterium tuberculosis; identical to SEQ ID NO: 233116

SEQ ID NO: 1547578 - protein, 36 aa, Mycobacterium tuberculosis; identical to SEQ ID NO: 1379049

SEQ ID NO: 1547579 - protein, 18 aa, Mycobacterium tuberculosis
ALGNWLMSRGEAVAPTAT

SEQ ID NO: 1547580 - protein, 17 aa, Mycobacterium tuberculosis
ANIPPERYVQVNGTPGP

SEQ ID NO: 1547581 - protein, 17 aa, Mycobacterium tuberculosis
AQVCGELGLPYLVLARP

SEQ ID NO: 1547582 - protein, 19 aa, Mycobacterium tuberculosis
ARQLLDGLLLVSGNDAANT

SEQ ID NO: 1547583 - protein, 21 aa, Mycobacterium tuberculosis
ARRILGWRVASTMATSMVLDA

SEQ ID NO: 1547584 - protein, 25 aa, Mycobacterium tuberculosis
AVAAQLAPWAQAVRALPNPTAPALA

SEQ ID NO: 1547585 - protein, 28 aa, Mycobacterium tuberculosis
AVFDQLGAIGIDLTDVFAVLEEEGVRKF

SEQ ID NO: 1547586 - protein, 19 aa, Mycobacterium tuberculosis
CASSIAIAAVMFSGVAGGA

SEQ ID NO: 1547587 - protein, 17 aa, Mycobacterium tuberculosis
CHAARLWMDAQPGSGES

SEQ ID NO: 1547588 - protein, 18 aa, Mycobacterium tuberculosis
DGKAGWRVVSVNQNGVDV

SEQ ID NO: 1547589 - protein, 20 aa, Mycobacterium tuberculosis
DPDVLLREFLKATADPANRH

SEQ ID NO: 1547590 - protein, 21 aa, Mycobacterium tuberculosis
EAPPVPVAYSVNWDAIAQCES

SEQ ID NO: 1547591 - protein, 17 aa, Mycobacterium tuberculosis
EIAANHITQAVLTATNF

SEQ ID NO: 1547592 - protein, 19 aa, Mycobacterium tuberculosis
ELVAAAATDLANIGSSISA

SEQ ID NO: 1547593 - protein, 24 aa, Mycobacterium tuberculosis
FNVNLKLQFLHDAFPNEFPDPTIS

SEQ ID NO: 1547594 - protein, 21 aa, Mycobacterium tuberculosis
GCSGGTRLAAGFGNGNSVHTL

SEQ ID NO: 1547595 - protein, 21 aa, Mycobacterium tuberculosis
GLPAVRASLYSDPQFQAKYPM

SEQ ID NO: 1547596 - protein, 24 aa, Mycobacterium tuberculosis
GPAKMLRLNAGLGNVGNYNVGLGN

SEQ ID NO: 1547597 - protein, 21 aa, Mycobacterium tuberculosis
GQAFPCIPNGGSVFAANPVVH

SEQ ID NO: 1547598 - protein, 21 aa, Mycobacterium tuberculosis
HAYAMEANWALLLLDDDGAGE

SEQ ID NO: 1547599 - protein, 24 aa, Mycobacterium tuberculosis
HLGARLFSIIAWRTYLVRDPHALS

SEQ ID NO: 1547600 - protein, 18 aa, Mycobacterium tuberculosis
HLGLTGQANYGFAVPDIP

SEQ ID NO: 1547601 - protein, 25 aa, Mycobacterium tuberculosis
HRGHEWKFAITKNGRHSLTHYDTLE

SEQ ID NO: 1547602 - protein, 20 aa, Mycobacterium tuberculosis
HYRPSAKLAEFVRMRDLTCR

SEQ ID NO: 1547603 - protein, 25 aa, Mycobacterium tuberculosis
IDLVPEYIGNLLLYFQPDATVTMLD

SEQ ID NO: 1547604 - protein, 19 aa, Mycobacterium tuberculosis
IPCEQRTLVLSAFPAEADA

SEQ ID NO: 1547605 - protein, 17 aa, Mycobacterium tuberculosis
KHHLLKTFWTGWRDVQL

SEQ ID NO: 1547606 - protein, 21 aa, Mycobacterium tuberculosis
KLALIDVRDPVEWDIVHIDGA

SEQ ID NO: 1547607 - protein, 22 aa, Mycobacterium tuberculosis
LCGAIQAASRLGGEQAAKLCVQ

SEQ ID NO: 1547608 - protein, 28 aa, Mycobacterium tuberculosis
LGGEQAAKLCVQYLAPIVKNRQYNYPPL

SEQ ID NO: 1547609 - protein, 29 aa, Mycobacterium tuberculosis
LHGSLFEFRCARCGVPYTDALPEMPEPAI

SEQ ID NO: 1547610 - protein, 17 aa, Mycobacterium tuberculosis
LNHLGRQPQLFVGGDGS

SEQ ID NO: 1547611 - protein, 22 aa, Mycobacterium tuberculosis
LPKLPQCIPNVVLGTTDGALPS

SEQ ID NO: 1547612 - protein, 17 aa, Mycobacterium tuberculosis
LRSTVPVTLAADRSGLV

SEQ ID NO: 1547613 - protein, 19 aa, Mycobacterium tuberculosis
LWAQAGFRPVDPAVAADFA

SEQ ID NO: 1547614 - protein, 21 aa, Mycobacterium tuberculosis
MVVAAQPYLAWLTYTAESAAH

SEQ ID NO: 1547615 - protein, 21 aa, Mycobacterium tuberculosis
NELCPALIWQLRNSAVDNRRS

SEQ ID NO: 1547616 - protein, 20 aa, Mycobacterium tuberculosis
NRGPTVPILLDTGSSSLVIP

SEQ ID NO: 1547617 - protein, 23 aa, Mycobacterium tuberculosis
NTTFPVGPFFGLGVVNISGIEIK

SEQ ID NO: 1547618 - protein, 17 aa, Mycobacterium tuberculosis
PAFEWYYQSGLSIVMPV

SEQ ID NO: 1547619 - protein, 26 aa, Mycobacterium tuberculosis
PAKLWTIADLGGWGSVDPQLFDKATG

SEQ ID NO: 1547620 - protein, 35 aa, Mycobacterium tuberculosis; identical to SEQ ID NO: 1488296

SEQ ID NO: 1547621 - protein, 21 aa, Mycobacterium tuberculosis
PQLLIDRLSVQRVMAHQMSTQ

SEQ ID NO: 1547622 - protein, 25 aa, Mycobacterium tuberculosis
PQLLSESGWYSALFGMQHETSYPKR

SEQ ID NO: 1547623 - protein, 29 aa, Mycobacterium tuberculosis
PQPLRAKISFWFDRKYRVPADAAAAILSP

SEQ ID NO: 1547624 - protein, 25 aa, Mycobacterium tuberculosis
PVVPLWDYISVVGWSSQVSNVTVTW

SEQ ID NO: 1547625 - protein, 21 aa, Mycobacterium tuberculosis
QAALKDGYRVFGELAPHPLLT

SEQ ID NO: 1547626 - protein, 20 aa, Mycobacterium tuberculosis
RAGGCFFAAAAADVDSQPGP

SEQ ID NO: 1547627 - protein, 19 aa, Mycobacterium tuberculosis
RDDRLRWWAGPWPDDERWW

SEQ ID NO: 1547628 - protein, 18 aa, Mycobacterium tuberculosis
RDGRGCVIVEDMAMASKS

SEQ ID NO: 1547629 - protein, 19 aa, Mycobacterium tuberculosis
RLHELRLAPSNAVDLFKQY

SEQ ID NO: 1547630 - protein, 19 aa, Mycobacterium tuberculosis
RTDTILGRKVLEIEPRGAQ

SEQ ID NO: 1547631 - protein, 17 aa, Mycobacterium tuberculosis
RWSRGRVLLIGDAAGCI

SEQ ID NO: 1547632 - protein, 18 aa, Mycobacterium tuberculosis
SLPEIAANHITQAVLTAT

SEQ ID NO: 1547633 - protein, 20 aa, Mycobacterium tuberculosis
SLPEIAANHITQAVLTATNF

SEQ ID NO: 1547634 - protein, 20 aa, Mycobacterium tuberculosis
SLVIPFWKIGWQNLGLPTGF

SEQ ID NO: 1547635 - protein, 17 aa, Mycobacterium tuberculosis
SSSLVIPFWKIGWQNLG

SEQ ID NO: 1547636 - protein, 19 aa, Mycobacterium tuberculosis
SWRIMPENLEDAGVSWKVY

SEQ ID NO: 1547637 - protein, 28 aa, Mycobacterium tuberculosis
TIPAIPIGLELNGGVGPITVLPIQILPT

SEQ ID NO: 1547638 - protein, 24 aa, Mycobacterium tuberculosis
TLARADIRGPYVINADGAPLEDRF

SEQ ID NO: 1547639 - protein, 25 aa, Mycobacterium tuberculosis
TLGNPVCLCRNVPVVRLNHLGRQPQ

SEQ ID NO: 1547640 - protein, 20 aa, Mycobacterium tuberculosis
TLLGRLLVYDALEMSYRTIT

SEQ ID NO: 1547641 - protein, 23 aa, Mycobacterium tuberculosis
TPVVSKLPWFALRDPYVTGQVTI

SEQ ID NO: 1547642 - protein, 32 aa, Mycobacterium tuberculosis; identical to SEQ ID NO: 211882

SEQ ID NO: 1547643 - protein, 20 aa, Mycobacterium tuberculosis
TTLLSALGITGQFRFGPITV

SEQ ID NO: 1547644 - protein, 20 aa, Mycobacterium tuberculosis
VAALPDWVPFATLFTVAAGT

SEQ ID NO: 1547645 - protein, 18 aa, Mycobacterium tuberculosis
VDLLPGLLSQALDELLEA

SEQ ID NO: 1547646 - protein, 26 aa, Mycobacterium tuberculosis
VENNFPLVNLLVNRGPTVPILLDTGS

SEQ ID NO: 1547647 - protein, 17 aa, Mycobacterium tuberculosis
VLTNVVWTNHGPCAIDG

SEQ ID NO: 1547648 - protein, 22 aa, Mycobacterium tuberculosis
VRANRLPKVSWLVPNILQSEHP

SEQ ID NO: 1547649 - protein, 18 aa, Mycobacterium tuberculosis
WLPLRRLLLDHYPSIERI

SEQ ID NO: 1547650 - protein, 17 aa, Mycobacterium tuberculosis
YKPRPCDASDWLDAALG

SEQ ID NO: 1547651 - protein, 22 aa, Mycobacterium tuberculosis
YTVQAQKLWAQAGFRPVDPAVA

SEQ ID NO: 1547652 - protein, 19 aa, Mycobacterium tuberculosis
YVLHRAWVGPMVLVVLDDP

SEQ ID NO: 1547653 - protein, 17 aa, Mycobacterium tuberculosis
AAEKFFAALAIGDTASA

SEQ ID NO: 1547654 - protein, 19 aa, Mycobacterium tuberculosis
AALASRAGDHVDFLAHDRI

SEQ ID NO: 1547655 - protein, 28 aa, Mycobacterium tuberculosis
AALSAAGYLCWRGKDLATPRGWITALRA

SEQ ID NO: 1547656 - protein, 20 aa, Mycobacterium tuberculosis
AASPAGWLFVSRWTAGGNSL

SEQ ID NO: 1547657 - protein, 26 aa, Mycobacterium tuberculosis
AEKRPPPAPRLTFRPADSAADVVPIA

SEQ ID NO: 1547658 - protein, 30 aa, Mycobacterium tuberculosis
AFQTRPSGLPGLRHKYSLDIAPGNFVTIND

SEQ ID NO: 1547659 - protein, 19 aa, Mycobacterium tuberculosis
ALLESGRGPRRYTAGGHRI

SEQ ID NO: 1547660 - protein, 19 aa, Mycobacterium tuberculosis
ARRDLNWRPRFDLNAVAAR

SEQ ID NO: 1547661 - protein, 26 aa, Mycobacterium tuberculosis
ASMYRAAAGLHRLCDSLSGAQVRDVA

SEQ ID NO: 1547662 - protein, 17 aa, Mycobacterium tuberculosis
ASSIAIAAVMFSGVAGG

SEQ ID NO: 1547663 - protein, 17 aa, Mycobacterium tuberculosis
AVGELTPSVAALAALAS

SEQ ID NO: 1547664 - protein, 18 aa, Mycobacterium tuberculosis
AYKPRPCDASDWLDAALG

SEQ ID NO: 1547665 - protein, 23 aa, Mycobacterium tuberculosis
DESVPGRWALTREGGHSRRRIVH

SEQ ID NO: 1547666 - protein, 17 aa, Mycobacterium tuberculosis
DIACLPTPHGLVPDYQR

SEQ ID NO: 1547667 - protein, 18 aa, Mycobacterium tuberculosis
DPTSVHWHGIALRNDMDG

SEQ ID NO: 1547668 - protein, 20 aa, Mycobacterium tuberculosis
DRFGFAGSMSGFLYPSNTTT

SEQ ID NO: 1547669 - protein, 25 aa, Mycobacterium tuberculosis
EDVELATARWVDWFNHRRLYQYCGD

SEQ ID NO: 1547670 - protein, 26 aa, Mycobacterium tuberculosis
EEPGRWSADRAHRWYQAHGWLVGANY

SEQ ID NO: 1547671 - protein, 19 aa, Mycobacterium tuberculosis
ELLPADWPGAGLRAAYHDF

SEQ ID NO: 1547672 - protein, 23 aa, Mycobacterium tuberculosis
ERLPGAIRWAASALRQARDYLSG

SEQ ID NO: 1547673 - protein, 20 aa, Mycobacterium tuberculosis
FIQFHPTMLFAGRAGGRRPL

SEQ ID NO: 1547674 - protein, 24 aa, Mycobacterium tuberculosis
GAGGAGGFGAVLFGNGGAGGSGAP

SEQ ID NO: 1547675 - protein, 23 aa, Mycobacterium tuberculosis
GATVGFAGSGGFGGAGGIAQLFG

SEQ ID NO: 1547676 - protein, 30 aa, Mycobacterium tuberculosis; identical to SEQ ID NO: 234704

SEQ ID NO: 1547677 - protein, 23 aa, Mycobacterium tuberculosis
GGGAGLFYGFGGAGGNGGMGGVA

SEQ ID NO: 1547678 - protein, 20 aa, Mycobacterium tuberculosis
GGGPACRPAELFATDNTTDG

SEQ ID NO: 1547679 - protein, 21 aa, Mycobacterium tuberculosis
GGGPACRPAELFATDNTTDGF

SEQ ID NO: 1547680 - protein, 19 aa, Mycobacterium tuberculosis
GGIAQLFGTGGMGGSGGGI

SEQ ID NO: 1547681 - protein, 23 aa, Mycobacterium tuberculosis
GGNGGDGGLVWGNGGTGGSGGAG

SEQ ID NO: 1547682 - protein, 18 aa, Mycobacterium tuberculosis
GQWRLRQQRHFGCGGQPE

SEQ ID NO: 1547683 - protein, 19 aa, Mycobacterium tuberculosis
GSGGLLWGNGGAGGAGGNG

SEQ ID NO: 1547684 - protein, 17 aa, Mycobacterium tuberculosis
GVLNFGSGVSGLYNTGG

SEQ ID NO: 1547685 - protein, 17 aa, Mycobacterium tuberculosis
GVVNVYAIAVLKRTSQP

SEQ ID NO: 1547686 - protein, 19 aa, Mycobacterium tuberculosis
HDGQLRLSLGPKNQTFDLT

SEQ ID NO: 1547687 - protein, 21 aa, Mycobacterium tuberculosis
IAGEFGRAWFVDLAPITDPDL

SEQ ID NO: 1547688 - protein, 23 aa, Mycobacterium tuberculosis
IGRACWPSWTPPPLMSRWSNRPE

SEQ ID NO: 1547689 - protein, 17 aa, Mycobacterium tuberculosis
IRGVPVGKIVKIEPQPL

SEQ ID NO: 1547690 - protein, 20 aa, Mycobacterium tuberculosis
ISVEVGDGWFQRVALTNSAG

SEQ ID NO: 1547691 - protein, 18 aa, Mycobacterium tuberculosis
IVSVVNWADCLVALQQRE

SEQ ID NO: 1547692 - protein, 17 aa, Mycobacterium tuberculosis
KNALARALLSTGAGSPP

SEQ ID NO: 1547693 - protein, 19 aa, Mycobacterium tuberculosis
LACGCGKPDCPSGAGNDER

SEQ ID NO: 1547694 - protein, 21 aa, Mycobacterium tuberculosis
LATQVACRVLRDGGTAADAVV

SEQ ID NO: 1547695 - protein, 20 aa, Mycobacterium tuberculosis
LPAVRASLYSDPQFQAKYPM

SEQ ID NO: 1547696 - protein, 18 aa, Mycobacterium tuberculosis
LPEFPRLWAEMVGPGQGW

SEQ ID NO: 1547697 - protein, 18 aa, Mycobacterium tuberculosis
LPTPHGLVPDYQRHTRTG

SEQ ID NO: 1547698 - protein, 19 aa, Mycobacterium tuberculosis
LQQFSWRIMPENLEDAGVS

SEQ ID NO: 1547699 - protein, 23 aa, Mycobacterium tuberculosis
LRTQSAALDRIWANISAVAEQLR

SEQ ID NO: 1547700 - protein, 17 aa, Mycobacterium tuberculosis
LSYADGDIWDWAVDWDT

SEQ ID NO: 1547701 - protein, 18 aa, Mycobacterium tuberculosis
LWAGVAVSDLEFIQFHPT

SEQ ID NO: 1547702 - protein, 22 aa, Mycobacterium tuberculosis
MPPCPERLATAVLPRSATPVLL

SEQ ID NO: 1547703 - protein, 21 aa, Mycobacterium tuberculosis
PASTIKVLLALVALDELDLNS

SEQ ID NO: 1547704 - protein, 18 aa, Mycobacterium tuberculosis
PEPISYTALDRGDLQRAM

SEQ ID NO: 1547705 - protein, 23 aa, Mycobacterium tuberculosis
PGKRPRSSMAPTLVFDHSSAGRG

SEQ ID NO: 1547706 - protein, 19 aa, Mycobacterium tuberculosis
PIFATFCAAVASISGAAVT

SEQ ID NO: 1547707 - protein, 18 aa, Mycobacterium tuberculosis
PPQTFKIENPLAVVATST

SEQ ID NO: 1547708 - protein, 20 aa, Mycobacterium tuberculosis
PQPHSGRWRAGAARRLTSLV

SEQ ID NO: 1547709 - protein, 18 aa, Mycobacterium tuberculosis
PTVWSMVMTLALDCGAMV

SEQ ID NO: 1547710 - protein, 20 aa, Mycobacterium tuberculosis
PYQGTVRMAFLLQGDHDAYF

SEQ ID NO: 1547711 - protein, 23 aa, Mycobacterium tuberculosis
QHGHCRSAAMARRSPNASTKARR

SEQ ID NO: 1547712 - protein, 20 aa, Mycobacterium tuberculosis
QYVVRFGLGYREEVHPDLQI

SEQ ID NO: 1547713 - protein, 18 aa, Mycobacterium tuberculosis
RAYQALSAQAAMFHEQFV

SEQ ID NO: 1547714 - protein, 20 aa, Mycobacterium tuberculosis
RPTELHPFVELTGPRHTAPA

SEQ ID NO: 1547715 - protein, 19 aa, Mycobacterium tuberculosis
RRSDAPRLVDLVRRAQASV

SEQ ID NO: 1547716 - protein, 21 aa, Mycobacterium tuberculosis
RTGHVALRVLHDGTAVTGLLV

SEQ ID NO: 1547717 - protein, 17 aa, Mycobacterium tuberculosis
RYKVPRMPFSMSVAQAA

SEQ ID NO: 1547718 - protein, 21 aa, Mycobacterium tuberculosis
SDNLPSCITKYIPLHTPAVVM

SEQ ID NO: 1547719 - protein, 24 aa, Mycobacterium tuberculosis
SGGNWSINTGNGYLGGLQFTQSTW

SEQ ID NO: 1547720 - protein, 21 aa, Mycobacterium tuberculosis
SLPRGDLAAAIYTTIEDQVET

SEQ ID NO: 1547721 - protein, 25 aa, Mycobacterium tuberculosis
STPNRWQVRPGPVAARRWDIEPDLT

SEQ ID NO: 1547722 - protein, 25 aa, Mycobacterium tuberculosis
SVAKIAFTGAVLGGGGIAMAAQATA

SEQ ID NO: 1547723 - protein, 23 aa, Mycobacterium tuberculosis
TALLQPTRPGGVSTLGALINTAA

SEQ ID NO: 1547724 - protein, 26 aa, Mycobacterium tuberculosis
TGGNGGRAGLLLGVGGMGGNGGATSV

SEQ ID NO: 1547725 - protein, 24 aa, Mycobacterium tuberculosis
TLGNPVCLCRNVPVVRLNHLGRQP

SEQ ID NO: 1547726 - protein, 20 aa, Mycobacterium tuberculosis
TLPLPTPVGMEIMPPQPPLP

SEQ ID NO: 1547727 - protein, 20 aa, Mycobacterium tuberculosis
TPAFEWYYQSGLSIVMPVGG

SEQ ID NO: 1547728 - protein, 18 aa, Mycobacterium tuberculosis
TPGDLLFHIRAETMDVCF

SEQ ID NO: 1547729 - protein, 22 aa, Mycobacterium tuberculosis
TPVVSKLPWFALRDPYVTGQVT

SEQ ID NO: 1547730 - protein, 25 aa, Mycobacterium tuberculosis
TTDPPVEGGWAWLPDEAQGARVHWR

SEQ ID NO: 1547731 - protein, 18 aa, Mycobacterium tuberculosis
VANARLAYAAYREVFEDS

SEQ ID NO: 1547732 - protein, 19 aa, Mycobacterium tuberculosis
VCDCGGLIRPDIVWFGEPL

SEQ ID NO: 1547733 - protein, 17 aa, Mycobacterium tuberculosis
VGIAAPVIIQFDSPISD

SEQ ID NO: 1547734 - protein, 22 aa, Mycobacterium tuberculosis
VHWRPREYYPAGTTVDVDAKLY

SEQ ID NO: 1547735 - protein, 18 aa, Mycobacterium tuberculosis
VRHNMPFGEVGKGEYGTY

SEQ ID NO: 1547736 - protein, 17 aa, Mycobacterium tuberculosis
VVIARGLSQRGVPFSWA

SEQ ID NO: 1547737 - protein, 24 aa, Mycobacterium tuberculosis
WDDLLRPGIEVITPSPLSSGSAKW

SEQ ID NO: 1547738 - protein, 20 aa, Mycobacterium tuberculosis
WDQVARCESGGNWSINTGNG

SEQ ID NO: 1547739 - protein, 18 aa, Mycobacterium tuberculosis
AADVAAMVSYHSGASAVA

SEQ ID NO: 1547740 - protein, 19 aa, Mycobacterium tuberculosis
AALTGEWFGALAVIAPSVS

SEQ ID NO: 1547741 - protein, 26 aa, Mycobacterium tuberculosis
AATDMPGRFVVAAAMVRHLLTDPMLP

SEQ ID NO: 1547742 - protein, 20 aa, Mycobacterium tuberculosis
AGEFGRAWFVDLAPITDPDL

SEQ ID NO: 1547743 - protein, 18 aa, Mycobacterium tuberculosis
AGSSGWWNQAHAALAGAG

SEQ ID NO: 1547744 - protein, 18 aa, Mycobacterium tuberculosis
AHAFHRFALAILGLALPV

SEQ ID NO: 1547745 - protein, 18 aa, Mycobacterium tuberculosis
AITLWLGLVAQFGQMITG

SEQ ID NO: 1547746 - protein, 17 aa, Mycobacterium tuberculosis
ALAEGKNALARALLSTG

SEQ ID NO: 1547747 - protein, 18 aa, Mycobacterium tuberculosis
ALASRAGDHVDFLAHDRI

SEQ ID NO: 1547748 - protein, 18 aa, Mycobacterium tuberculosis
AMGVRVATSFSARLFNLL

SEQ ID NO: 1547749 - protein, 18 aa, Mycobacterium tuberculosis
ANIPPERYVQVNGTPGPD

SEQ ID NO: 1547750 - protein, 25 aa, Mycobacterium tuberculosis
APEDVGWDWFGLQFYNGTALMLFQI

SEQ ID NO: 1547751 - protein, 19 aa, Mycobacterium tuberculosis
AQTVPRKAARLTIDGVTHT

SEQ ID NO: 1547752 - protein, 25 aa, Mycobacterium tuberculosis
ARAAASLLSRSNWVLATALPASQDV

SEQ ID NO: 1547753 - protein, 20 aa, Mycobacterium tuberculosis
ARELSGSSNLLFRRNSVSGA

SEQ ID NO: 1547754 - protein, 24 aa, Mycobacterium tuberculosis
ARTADRLKAAGFTVTDVGNLSLPD

SEQ ID NO: 1547755 - protein, 18 aa, Mycobacterium tuberculosis
ATALPGANRMPHWAAGTL

SEQ ID NO: 1547756 - protein, 34 aa, Mycobacterium tuberculosis; identical to SEQ ID NO: 233252

SEQ ID NO: 1547757 - protein, 17 aa, Mycobacterium tuberculosis
AVFDQLGAIGIDLTDVF

SEQ ID NO: 1547758 - protein, 17 aa, Mycobacterium tuberculosis
DEFGLGLADPDQLGRRL

SEQ ID NO: 1547759 - protein, 19 aa, Mycobacterium tuberculosis
DIDADFVVFDGILYATLTP

SEQ ID NO: 1547760 - protein, 30 aa, Mycobacterium tuberculosis
DPENFWRSAGLPEFRWPDPNGTRFPNGAPP

SEQ ID NO: 1547761 - protein, 18 aa, Mycobacterium tuberculosis
DRLRCQVVAATGLQLDEL

SEQ ID NO: 1547762 - protein, 27 aa, Mycobacterium tuberculosis
FALTYPRRLGFGLGSSVVSLSWRTGDD

SEQ ID NO: 1547763 - protein, 26 aa, Mycobacterium tuberculosis
FDQLGAIGIDLTDVFAVLEEEGVRKF

SEQ ID NO: 1547764 - protein, 17 aa, Mycobacterium tuberculosis
GCSRGGSSKAGRSSSVA

SEQ ID NO: 1547765 - protein, 18 aa, Mycobacterium tuberculosis
GGFGGVEGLRGWLREERI

SEQ ID NO: 1547766 - protein, 17 aa, Mycobacterium tuberculosis
GHHPGDVISVTWQTKSG

SEQ ID NO: 1547767 - protein, 24 aa, Mycobacterium tuberculosis
GNAGIGGAGGRGGDGGAGDSGALS

SEQ ID NO: 1547768 - protein, 19 aa, Mycobacterium tuberculosis
GNPVTGWRLVEWDGIRNFT

SEQ ID NO: 1547769 - protein, 21 aa, Mycobacterium tuberculosis
GRVPDRLAVVRVETGESLYDV

SEQ ID NO: 1547770 - protein, 17 aa, Mycobacterium tuberculosis
GRYFPAPGVKPHAAVDV

SEQ ID NO: 1547771 - protein, 19 aa, Mycobacterium tuberculosis
IANYLDWLNRCGSYQVTNH

SEQ ID NO: 1547772 - protein, 23 aa, Mycobacterium tuberculosis
IDALRPMMRLVVTNGTAKEIAGC

SEQ ID NO: 1547773 - protein, 17 aa, Mycobacterium tuberculosis
KTSDGWRIDRLPNGVFL

SEQ ID NO: 1547774 - protein, 17 aa, Mycobacterium tuberculosis
LAETLTILGRFSASFGE

SEQ ID NO: 1547775 - protein, 22 aa, Mycobacterium tuberculosis
LAHRCARDGADLVLAARSAERL

SEQ ID NO: 1547776 - protein, 26 aa, Mycobacterium tuberculosis
LDIHETMVIPPIVFLPSMTIGGQTYT

SEQ ID NO: 1547777 - protein, 23 aa, Mycobacterium tuberculosis
LELYKRLPGDLSILTPSPASDTD

SEQ ID NO: 1547778 - protein, 22 aa, Mycobacterium tuberculosis
LESVKVMRGCLVQSRKTTSVLA

SEQ ID NO: 1547779 - protein, 18 aa, Mycobacterium tuberculosis
LGSHPKGAVSALLSAARS

SEQ ID NO: 1547780 - protein, 22 aa, Mycobacterium tuberculosis
LLCAMVLALAWLSAVAGCSRGG

SEQ ID NO: 1547781 - protein, 17 aa, Mycobacterium tuberculosis
MPISGRGYVEMTGYVQR

SEQ ID NO: 1547782 - protein, 17 aa, Mycobacterium tuberculosis
PCEQRTLVLSAFPAEAD

SEQ ID NO: 1547783 - protein, 18 aa, Mycobacterium tuberculosis
PITIFPGGFTIDPLPLSL

SEQ ID NO: 1547784 - protein, 24 aa, Mycobacterium tuberculosis
PLHLPGFPVQFFVYKQIAANNAAR

SEQ ID NO: 1547785 - protein, 21 aa, Mycobacterium tuberculosis
PPYQGTVRMAFLLQGDHDAYF

SEQ ID NO: 1547786 - protein, 20 aa, Mycobacterium tuberculosis
PRLGAAVLVALTTAAAACGA

SEQ ID NO: 1547787 - protein, 26 aa, Mycobacterium tuberculosis
QAFPCIPNGGSVFGCQPCSAPDRSLG

SEQ ID NO: 1547788 - protein, 22 aa, Mycobacterium tuberculosis
QALLGRPLIGNGANGLPGTGQN

SEQ ID NO: 1547789 - protein, 18 aa, Mycobacterium tuberculosis
QVGSRIVHDALVGKSVVI

SEQ ID NO: 1547790 - protein, 19 aa, Mycobacterium tuberculosis
QYVVRFGLGYREEVHPDLQ

SEQ ID NO: 1547791 - protein, 34 aa, Mycobacterium tuberculosis; identical to SEQ ID NO: 205000

SEQ ID NO: 1547792 - protein, 19 aa, Mycobacterium tuberculosis
RKRGRRISVADVELTQGGR

SEQ ID NO: 1547793 - protein, 19 aa, Mycobacterium tuberculosis
RWLAEGVADFVARPKTPPP

SEQ ID NO: 1547794 - protein, 19 aa, Mycobacterium tuberculosis
SADLAAYVQIDRDVQVFGQ

SEQ ID NO: 1547795 - protein, 22 aa, Mycobacterium tuberculosis
SGPRWLALLLQPLSGPPSTSAK

SEQ ID NO: 1547796 - protein, 20 aa, Mycobacterium tuberculosis
SGSAKWNLLAPYAAKSDGGR

SEQ ID NO: 1547797 - protein, 24 aa, Mycobacterium tuberculosis
SSLNDMTHWLAMVLADGVYNGRRI

SEQ ID NO: 1547798 - protein, 19 aa, Mycobacterium tuberculosis
STGPSMGILPAGGVGGPGG

SEQ ID NO: 1547799 - protein, 23 aa, Mycobacterium tuberculosis
TPKLRARQLISQWERYRRGIYCG

SEQ ID NO: 1547800 - protein, 33 aa, Mycobacterium tuberculosis; identical to SEQ ID NO: 234379

SEQ ID NO: 1547801 - protein, 18 aa, Mycobacterium tuberculosis
TYKRNTLYFADPTGKTVV

SEQ ID NO: 1547802 - protein, 18 aa, Mycobacterium tuberculosis
VATSFSARLFNLLITNAP

SEQ ID NO: 1547803 - protein, 18 aa, Mycobacterium tuberculosis
VRDVACRRDFEDVALTLV

SEQ ID NO: 1547804 - protein, 19 aa, Mycobacterium tuberculosis
VTGGLFFSPTIDFLDHPPP

SEQ ID NO: 1547805 - protein, 20 aa, Mycobacterium tuberculosis
VVAAQPYLAWLTYTAESAAH

SEQ ID NO: 1547806 - protein, 17 aa, Mycobacterium tuberculosis
WNLLAPYAAKSDGGRNN

SEQ ID NO: 1547807 - protein, 30 aa, Mycobacterium tuberculosis; identical to SEQ ID NO: 1494104

SEQ ID NO: 1547808 - protein, 20 aa, Mycobacterium tuberculosis
YDRQSPWLATGFDRRMSQTV

SEQ ID NO: 1547809 - protein, 28 aa, Mycobacterium tuberculosis
AARAPRVSAVIKVDWRPGVTDAMTQKVA

SEQ ID NO: 1547810 - protein, 25 aa, Mycobacterium tuberculosis
ADRRLRLTRQALLAAAVVPLLAGCA

SEQ ID NO: 1547811 - protein, 23 aa, Mycobacterium tuberculosis
AGGLGGAFRRGRFAATERFTQPT

SEQ ID NO: 1547812 - protein, 21 aa, Mycobacterium tuberculosis
ALLQPTRPGGVSTLGALINTA

SEQ ID NO: 1547813 - protein, 20 aa, Mycobacterium tuberculosis
ALVCECAFCTFPDKNAAAQQ

SEQ ID NO: 1547814 - protein, 23 aa, Mycobacterium tuberculosis
APGQPGGPGGLLYGNGGNGGNGG

SEQ ID NO: 1547815 - protein, 24 aa, Mycobacterium tuberculosis
APVVLTSCTWRGIANVPLPVGRGM

SEQ ID NO: 1547816 - protein, 26 aa, Mycobacterium tuberculosis
AQAALFHEQFVHAMTAGAGAYAGAEA

SEQ ID NO: 1547817 - protein, 23 aa, Mycobacterium tuberculosis
AQLPCLPILFIVVDEFSELLSQH

SEQ ID NO: 1547818 - protein, 38 aa, Mycobacterium tuberculosis; identical to SEQ ID NO: 210565

SEQ ID NO: 1547819 - protein, 25 aa, Mycobacterium tuberculosis
ARFNKPGTFPLRFQTEVRDGCPSDC

SEQ ID NO: 1547820 - protein, 25 aa, Mycobacterium tuberculosis
ATEVARIGSALSLASAVAAAQTSAV

SEQ ID NO: 1547821 - protein, 25 aa, Mycobacterium tuberculosis
ATFPIAAHYFAVFPLAKHMESAGRR

SEQ ID NO: 1547822 - protein, 22 aa, Mycobacterium tuberculosis
AWPAFRAATRWESSPTPPADPT

SEQ ID NO: 1547823 - protein, 17 aa, Mycobacterium tuberculosis
AYARRILGWRVASTMAT

SEQ ID NO: 1547824 - protein, 20 aa, Mycobacterium tuberculosis
CRPAGIGGLGGRGSRLAVAC

SEQ ID NO: 1547825 - protein, 23 aa, Mycobacterium tuberculosis
DARTYLADHGWRTASASTTDLLA

SEQ ID NO: 1547826 - protein, 21 aa, Mycobacterium tuberculosis
DDVHVAPRVIFLPGPAAALTS

SEQ ID NO: 1547827 - protein, 23 aa, Mycobacterium tuberculosis
DEVSAAIAALFSAHGRDFQALSA

SEQ ID NO: 1547828 - protein, 19 aa, Mycobacterium tuberculosis
DNPTGIGGTGGDGGTGGAA

SEQ ID NO: 1547829 - protein, 18 aa, Mycobacterium tuberculosis
DTIVLRRSRPLQISLDGH

SEQ ID NO: 1547830 - protein, 17 aa, Mycobacterium tuberculosis
DYQQITDVVIARGLSQR

SEQ ID NO: 1547831 - protein, 20 aa, Mycobacterium tuberculosis
EPLPEEPWRSAVEATGSADV

SEQ ID NO: 1547832 - protein, 20 aa, Mycobacterium tuberculosis
EPYAVWLDDWYARESNNNSV

SEQ ID NO: 1547833 - protein, 22 aa, Mycobacterium tuberculosis
EVSTAISALFGAHAQAYQALSA

SEQ ID NO: 1547834 - protein, 21 aa, Mycobacterium tuberculosis
FADAMAIRTHYFDNFFLDATR

SEQ ID NO: 1547835 - protein, 17 aa, Mycobacterium tuberculosis
FCAYNSVGYREQVREQL

SEQ ID NO: 1547836 - protein, 17 aa, Mycobacterium tuberculosis
FDGQRRLVYRGQLDDSR

SEQ ID NO: 1547837 - protein, 18 aa, Mycobacterium tuberculosis
FEQSRHWSRTYAPGHELK

SEQ ID NO: 1547838 - protein, 18 aa, Mycobacterium tuberculosis
FGFAGSMSGFLYPSNTTT

SEQ ID NO: 1547839 - protein, 17 aa, Mycobacterium tuberculosis
FGPPGTVADISYFDVNS

SEQ ID NO: 1547840 - protein, 25 aa, Mycobacterium tuberculosis
FNAFPASYWRRWTTCKSVVLRVQVT

SEQ ID NO: 1547841 - protein, 23 aa, Mycobacterium tuberculosis
FSMDGCCKFAAISAHVYCPHQIT

SEQ ID NO: 1547842 - protein, 19 aa, Mycobacterium tuberculosis
FSYQFSFEQSRHWSRTYAP

SEQ ID NO: 1547843 - protein, 18 aa, Mycobacterium tuberculosis
GAAWLIVDVRDVAALHAA

SEQ ID NO: 1547844 - protein, 20 aa, Mycobacterium tuberculosis
GCSHPEFKRSSPPAPSLPPV

SEQ ID NO: 1547845 - protein, 23 aa, Mycobacterium tuberculosis
GDYRCRSYQAGLFCVNYAHQSAV

SEQ ID NO: 1547846 - protein, 25 aa, Mycobacterium tuberculosis
GMSSPIDCRDHFDRDEMRDQAQFQA

SEQ ID NO: 1547847 - protein, 24 aa, Mycobacterium tuberculosis
GNGGNGGNGGWLYGDGGSGGSTLQ

SEQ ID NO: 1547848 - protein, 19 aa, Mycobacterium tuberculosis
GPAPGSWRTRTWWTGTPDS

SEQ ID NO: 1547849 - protein, 17 aa, Mycobacterium tuberculosis
GQWRLRQQRHFGCGGQP

SEQ ID NO: 1547850 - protein, 18 aa, Mycobacterium tuberculosis
HDEIRAAASTDCQISRFT

SEQ ID NO: 1547851 - protein, 18 aa, Mycobacterium tuberculosis
HDGQLRLSLGPKNQTFDL

SEQ ID NO: 1547852 - protein, 21 aa, Mycobacterium tuberculosis
HGLDLDMSGLVYFGDRTDART

SEQ ID NO: 1547853 - protein, 27 aa, Mycobacterium tuberculosis
HGLNAGGLFGVLTNVVWTNHGPCAIDG

SEQ ID NO: 1547854 - protein, 17 aa, Mycobacterium tuberculosis
HPVHIYLQFDGLDEATH

SEQ ID NO: 1547855 - protein, 19 aa, Mycobacterium tuberculosis
HQSAVRFASAGIEPFGCLK

SEQ ID NO: 1547856 - protein, 23 aa, Mycobacterium tuberculosis
IENPCPPTGLGSVVVARDELVVV

SEQ ID NO: 1547857 - protein, 17 aa, Mycobacterium tuberculosis
IETKSGMTRCQINRDSV

SEQ ID NO: 1547858 - protein, 17 aa, Mycobacterium tuberculosis
IRTHYFDNFFLDATRAG

SEQ ID NO: 1547859 - protein, 17 aa, Mycobacterium tuberculosis
KLIRARFGVPVPNMTAW

SEQ ID NO: 1547860 - protein, 18 aa, Mycobacterium tuberculosis
KLLSSILTYHVIAGQASP

SEQ ID NO: 1547861 - protein, 17 aa, Mycobacterium tuberculosis
KLREIDGLLPTLIRGQG

SEQ ID NO: 1547862 - protein, 18 aa, Mycobacterium tuberculosis
KSGMTRCQINRDSVGCEA

SEQ ID NO: 1547863 - protein, 28 aa, Mycobacterium tuberculosis
LDSRAYRLRWPAGTIVFEVDQPQVIDFK

SEQ ID NO: 1547864 - protein, 17 aa, Mycobacterium tuberculosis
LLSGDRVIPQWVKIRNV

SEQ ID NO: 1547865 - protein, 22 aa, Mycobacterium tuberculosis
LLSGDRVIPQWVKIRNVDGFNG

SEQ ID NO: 1547866 - protein, 23 aa, Mycobacterium tuberculosis
LNDFAQLLAALGRRYDGDERLSV

SEQ ID NO: 1547867 - protein, 22 aa, Mycobacterium tuberculosis
LPAELTPLAAWVACIADARTVT

SEQ ID NO: 1547868 - protein, 18 aa, Mycobacterium tuberculosis
LPQVAALFLAGHLGARLF

SEQ ID NO: 1547869 - protein, 19 aa, Mycobacterium tuberculosis
LRLLWMCRERLLAELGDIS

SEQ ID NO: 1547870 - protein, 24 aa, Mycobacterium tuberculosis
LRTQSAALDRIWANISAVAEQLRG

SEQ ID NO: 1547871 - protein, 37 aa, Mycobacterium tuberculosis
LSDTFGYFKYHVFDEGLGFDPIECFGVVGVASTGAFD

SEQ ID NO: 1547872 - protein, 19 aa, Mycobacterium tuberculosis
LVRAVGVDFFVRMASGELD

SEQ ID NO: 1547873 - protein, 30 aa, Mycobacterium tuberculosis; identical to SEQ ID NO: 233897

SEQ ID NO: 1547874 - protein, 24 aa, Mycobacterium tuberculosis
NAHLRAAHHLSLCAQCAAEVDDQS

SEQ ID NO: 1547875 - protein, 18 aa, Mycobacterium tuberculosis
NPVTGWRLVEWDGIRNFT

SEQ ID NO: 1547876 - protein, 18 aa, Mycobacterium tuberculosis
NVPDAFVVIADRLGNSVY

SEQ ID NO: 1547877 - protein, 20 aa, Mycobacterium tuberculosis
PDIPIPAIHIDFDGAADAGF

SEQ ID NO: 1547878 - protein, 17 aa, Mycobacterium tuberculosis
PGHPVHIYLQFDGLDEA

SEQ ID NO: 1547879 - protein, 21 aa, Mycobacterium tuberculosis
PPCPERLATAVLPRSATPVLL

SEQ ID NO: 1547880 - protein, 20 aa, Mycobacterium tuberculosis
PRTPAALYWGARLTLVSRVD

SEQ ID NO: 1547881 - protein, 18 aa, Mycobacterium tuberculosis
QNAPAIAAAEAMYEQMWA

SEQ ID NO: 1547882 - protein, 20 aa, Mycobacterium tuberculosis
QQRYPPWPASYDASLRVSWR

SEQ ID NO: 1547883 - protein, 21 aa, Mycobacterium tuberculosis
RATVAAAVWLATVCLVASCAN

SEQ ID NO: 1547884 - protein, 19 aa, Mycobacterium tuberculosis
RDGCPSDCGLCPDHKQHAC

SEQ ID NO: 1547885 - protein, 19 aa, Mycobacterium tuberculosis
RHQLVSLVLSNLFGQNAPA

SEQ ID NO: 1547886 - protein, 19 aa, Mycobacterium tuberculosis
RLADRGMRLTLRVYAYSSC

SEQ ID NO: 1547887 - protein, 20 aa, Mycobacterium tuberculosis
RLATAPVITEWCELPTGSSP

SEQ ID NO: 1547888 - protein, 22 aa, Mycobacterium tuberculosis
RRRGDLPTTLRVDASGNPETGE

SEQ ID NO: 1547889 - protein, 18 aa, Mycobacterium tuberculosis
RRSNAPRLVDLVRRAQAS

SEQ ID NO: 1547890 - protein, 17 aa, Mycobacterium tuberculosis
SAHGRDFQALSARAAAF

SEQ ID NO: 1547891 - protein, 17 aa, Mycobacterium tuberculosis
SCRAAGIDPVRQPIPVV

SEQ ID NO: 1547892 - protein, 18 aa, Mycobacterium tuberculosis
SDCGLCPDHKQHACLGLI

SEQ ID NO: 1547893 - protein, 22 aa, Mycobacterium tuberculosis
SDEVLYRPLGMGSTSSRFTDFL

SEQ ID NO: 1547894 - protein, 22 aa, Mycobacterium tuberculosis
SFLVPQCVWYARADPPAPAPRP

SEQ ID NO: 1547895 - protein, 22 aa, Mycobacterium tuberculosis
SGSFNNGALWTGDHHGLVGFSY

SEQ ID NO: 1547896 - protein, 25 aa, Mycobacterium tuberculosis
SMLFPHLYGPLPVRAVIGAAAYPPA

SEQ ID NO: 1547897 - protein, 18 aa, Mycobacterium tuberculosis
SQWERYRRGIYCGTVGLA

SEQ ID NO: 1547898 - protein, 19 aa, Mycobacterium tuberculosis
SRLAIRTDTILGRKVLEIE

SEQ ID NO: 1547899 - protein, 24 aa, Mycobacterium tuberculosis
SRTVSGQLTLLVPFIDRVRARVDL

SEQ ID NO: 1547900 - protein, 20 aa, Mycobacterium tuberculosis
SYNGMLYFGINADRDAMSDV

SEQ ID NO: 1547901 - protein, 23 aa, Mycobacterium tuberculosis
TAGAFSRPGLPVEYLQVPSPSMG

SEQ ID NO: 1547902 - protein, 26 aa, Mycobacterium tuberculosis
TATPLRPGIWRAYADHRMAMAGAIIG

SEQ ID NO: 1547903 - protein, 27 aa, Mycobacterium tuberculosis
TFPMEFVSFKGGWQLSRQTAEMLLAMG

SEQ ID NO: 1547904 - protein, 19 aa, Mycobacterium tuberculosis
TGIVYPLAVTGVGQLFFGD

SEQ ID NO: 1547905 - protein, 17 aa, Mycobacterium tuberculosis
TIVLRRSRPLQISLDGH

SEQ ID NO: 1547906 - protein, 31 aa, Mycobacterium tuberculosis; identical to SEQ ID NO: 234369

SEQ ID NO: 1547907 - protein, 25 aa, Mycobacterium tuberculosis
TPRYAVGCKRPGFHNTYLSTFNRDN

SEQ ID NO: 1547908 - protein, 25 aa, Mycobacterium tuberculosis
VADAHGVPFLGIRGMSDGPGDPLHL

SEQ ID NO: 1547909 - protein, 26 aa, Mycobacterium tuberculosis
VAEELGQPLPLFIKWDDADYGLRAAE

SEQ ID NO: 1547910 - protein, 22 aa, Mycobacterium tuberculosis
VALPEAIPVPHVPPLGAEPGVQ

SEQ ID NO: 1547911 - protein, 25 aa, Mycobacterium tuberculosis
VARPAPACRIDWEPADRAAHRDGVL

SEQ ID NO: 1547912 - protein, 17 aa, Mycobacterium tuberculosis
VASTMATSMVLDAIEQA

SEQ ID NO: 1547913 - protein, 24 aa, Mycobacterium tuberculosis
VAVDLRDDWPTALQKAGFDNAQRT

SEQ ID NO: 1547914 - protein, 17 aa, Mycobacterium tuberculosis
VDFFVRMASGELDPDEL

SEQ ID NO: 1547915 - protein, 18 aa, Mycobacterium tuberculosis
VEPICAKLFAAAATISGV

SEQ ID NO: 1547916 - protein, 24 aa, Mycobacterium tuberculosis
VFQRTPIWCFPKFDVPLPTAVRWA

SEQ ID NO: 1547917 - protein, 23 aa, Mycobacterium tuberculosis
VHGFRFFDNRDLLGFVDGTENPS

SEQ ID NO: 1547918 - protein, 27 aa, Mycobacterium tuberculosis
VLNGPFQALFGRPLIGDGANGAPGQPG

SEQ ID NO: 1547919 - protein, 19 aa, Mycobacterium tuberculosis
VNQHDRLRVPIGVTPDGTA

SEQ ID NO: 1547920 - protein, 21 aa, Mycobacterium tuberculosis
VSAAVADLFGAHAQAYQALSA

SEQ ID NO: 1547921 - protein, 22 aa, Mycobacterium tuberculosis
VVLTSCTWRGIANVPLPVGRGM

SEQ ID NO: 1547922 - protein, 27 aa, Mycobacterium tuberculosis
VVVSLAGSGWCGWVLFEKHQTDVAAGQ

SEQ ID NO: 1547923 - protein, 30 aa, Mycobacterium tuberculosis; identical to SEQ ID NO: 234510

SEQ ID NO: 1547924 - protein, 19 aa, Mycobacterium tuberculosis
WDIEPDLTNAVAFLSAAVV

SEQ ID NO: 1547925 - protein, 19 aa, Mycobacterium tuberculosis
WQGWAGGPDGGWNKPPTPL

SEQ ID NO: 1547926 - protein, 17 aa, Mycobacterium tuberculosis
YDPAMRTLIAFGGKYPT

SEQ ID NO: 1547927 - protein, 25 aa, Mycobacterium tuberculosis
YYEKGLRDVIRYHVSMTSSVNFPDQ

SEQ ID NO: 1547928 - protein, 18 aa, Mycobacterium tuberculosis
AAAEAMYEQMWAADVAAM

SEQ ID NO: 1547929 - protein, 31 aa, Mycobacterium tuberculosis
AADEVSAAIAGLFGAHARQYQALSVQVAAFH

SEQ ID NO: 1547930 - protein, 25 aa, Mycobacterium tuberculosis
AALSAAGYLCWRGKDLATPRGWITA

SEQ ID NO: 1547931 - protein, 38 aa, Mycobacterium tuberculosis; identical to SEQ ID NO: 235029

SEQ ID NO: 1547932 - protein, 22 aa, Mycobacterium tuberculosis
AEQLMPHWMLSLRAADMRRGGT

SEQ ID NO: 1547933 - protein, 22 aa, Mycobacterium tuberculosis
AEQYLWWVPHNVAGLVTALGGR

SEQ ID NO: 1547934 - protein, 25 aa, Mycobacterium tuberculosis
AGEACARAIAWYLAMARRSQGNESA

SEQ ID NO: 1547935 - protein, 32 aa, Mycobacterium tuberculosis; identical to SEQ ID NO: 210562

SEQ ID NO: 1547936 - protein, 23 aa, Mycobacterium tuberculosis
AQAAMFHEQFVRALAAGGNSYAV

SEQ ID NO: 1547937 - protein, 18 aa, Mycobacterium tuberculosis
ARRHGWTFPYLYDETQDV

SEQ ID NO: 1547938 - protein, 18 aa, Mycobacterium tuberculosis
ASPAGWLFVSRWTAGGNS

SEQ ID NO: 1547939 - protein, 17 aa, Mycobacterium tuberculosis
ASRRLGMAAADAAWAEV

SEQ ID NO: 1547940 - protein, 18 aa, Mycobacterium tuberculosis
ATGCGPSGHGTRAGEEGP

SEQ ID NO: 1547941 - protein, 22 aa, Mycobacterium tuberculosis
AVAGCSRGGSSKAGRSSSVAGT

SEQ ID NO: 1547942 - protein, 25 aa, Mycobacterium tuberculosis
DADQPGATGGTGFAGGAGGAGGAGG

SEQ ID NO: 1547943 - protein, 24 aa, Mycobacterium tuberculosis
DVVHYGNGVSIVYADVPTTVDFGG

SEQ ID NO: 1547944 - protein, 25 aa, Mycobacterium tuberculosis
DVVHYGNGVSIVYADVPTTVDFGGG

SEQ ID NO: 1547945 - protein, 20 aa, Mycobacterium tuberculosis
EFVTAAAGDLTNLGSSISAA

SEQ ID NO: 1547946 - protein, 21 aa, Mycobacterium tuberculosis
EGAMTPGALAIRERVRPPSMT

SEQ ID NO: 1547947 - protein, 24 aa, Mycobacterium tuberculosis
EPGKRPRSSMAPTLVFDHSSAGRG

SEQ ID NO: 1547948 - protein, 20 aa, Mycobacterium tuberculosis
FGANMSGWWNQAHTALAGAG

SEQ ID NO: 1547949 - protein, 27 aa, Mycobacterium tuberculosis
FGFAVIVYLVWRFIVPLVGRLMSARQD

SEQ ID NO: 1547950 - protein, 18 aa, Mycobacterium tuberculosis
FGNFGANMSGWWNQAHTA

SEQ ID NO: 1547951 - protein, 26 aa, Mycobacterium tuberculosis
FHLRNRLVVAAMHWDGPKAQVIGLVR

SEQ ID NO: 1547952 - protein, 18 aa, Mycobacterium tuberculosis
FIVPLVGRLMSARQDTVR

SEQ ID NO: 1547953 - protein, 26 aa, Mycobacterium tuberculosis
GAGGNGGDGDGFIGGSGGTGGTGGDA

SEQ ID NO: 1547954 - protein, 17 aa, Mycobacterium tuberculosis
GAQALPPGGVLPVGQST

SEQ ID NO: 1547955 - protein, 25 aa, Mycobacterium tuberculosis
GDTDRVTLFRAWYSRRNFGQLSGSV

SEQ ID NO: 1547956 - protein, 22 aa, Mycobacterium tuberculosis
GERARTAIDAALARVGTTQEGV

SEQ ID NO: 1547957 - protein, 30 aa, Mycobacterium tuberculosis
GFDAFVGLVSRCLRFGSAVAGSYTVRILED

SEQ ID NO: 1547958 - protein, 19 aa, Mycobacterium tuberculosis
GGFGGVEGLRGWLREERID

SEQ ID NO: 1547959 - protein, 17 aa, Mycobacterium tuberculosis
GGQVLLPANGRAFTSGK

SEQ ID NO: 1547960 - protein, 17 aa, Mycobacterium tuberculosis
GPDGGWNKPPTPLWPDQ

SEQ ID NO: 1547961 - protein, 22 aa, Mycobacterium tuberculosis
GPGGAAVGLFGHGGAGGAGGLG

SEQ ID NO: 1547962 - protein, 25 aa, Mycobacterium tuberculosis
GRHCGRRLGCGGGSWGDDCRPAGIG

SEQ ID NO: 1547963 - protein, 21 aa, Mycobacterium tuberculosis
GRVPDRLAVVRVETGESLHDV

SEQ ID NO: 1547964 - protein, 17 aa, Mycobacterium tuberculosis
GSIDAITLFPGGLTFPA

SEQ ID NO: 1547965 - protein, 27 aa, Mycobacterium tuberculosis
GSSSGFKVRPSFSFFAVGPDGMPGGEV

SEQ ID NO: 1547966 - protein, 18 aa, Mycobacterium tuberculosis
GTCRETPDGLVITATPLR

SEQ ID NO: 1547967 - protein, 18 aa, Mycobacterium tuberculosis
GTQSVALYLGKGQMLEVG

SEQ ID NO: 1547968 - protein, 17 aa, Mycobacterium tuberculosis
GVYAWRLVRYYEDSTLA

SEQ ID NO: 1547969 - protein, 25 aa, Mycobacterium tuberculosis
HGLNAGGLFGVLTNVVWTNHGPCAI

SEQ ID NO: 1547970 - protein, 17 aa, Mycobacterium tuberculosis
HGVALPEAIPVPHVPPL

SEQ ID NO: 1547971 - protein, 21 aa, Mycobacterium tuberculosis
HIPSIPLGFAAIGHIGPISIP

SEQ ID NO: 1547972 - protein, 20 aa, Mycobacterium tuberculosis
HLRLLWMCRERLLAELGDIS

SEQ ID NO: 1547973 - protein, 26 aa, Mycobacterium tuberculosis
HRHLFTVLMDREWKHGVAAAVDVTLL

SEQ ID NO: 1547974 - protein, 21 aa, Mycobacterium tuberculosis
IDAITLFPGGLTFPANSLLNL

SEQ ID NO: 1547975 - protein, 20 aa, Mycobacterium tuberculosis
IDKRLDRIGSRQALELRGQA

SEQ ID NO: 1547976 - protein, 34 aa, Mycobacterium tuberculosis; identical to SEQ ID NO: 1485198

SEQ ID NO: 1547977 - protein, 19 aa, Mycobacterium tuberculosis
IIRCLKRARRTGATRIEVT

SEQ ID NO: 1547978 - protein, 37 aa, Mycobacterium tuberculosis; identical to SEQ ID NO: 1468864

SEQ ID NO: 1547979 - protein, 23 aa, Mycobacterium tuberculosis
ITIDRIPLNLGASVTVGPILING

SEQ ID NO: 1547980 - protein, 17 aa, Mycobacterium tuberculosis
ITKYIPLHTPAVVMSIN

SEQ ID NO: 1547981 - protein, 18 aa, Mycobacterium tuberculosis
KGAVSALLSAARSGDGPG

SEQ ID NO: 1547982 - protein, 22 aa, Mycobacterium tuberculosis
LALLGRPLIGDGTDAAPGSGGA

SEQ ID NO: 1547983 - protein, 22 aa, Mycobacterium tuberculosis
LATQVACRVLRDGGTAADAVVA

SEQ ID NO: 1547984 - protein, 21 aa, Mycobacterium tuberculosis
LCGAIQAASRLGGEQAAKLCV

SEQ ID NO: 1547985 - protein, 17 aa, Mycobacterium tuberculosis
LDHSSADLAAYVQIDRD

SEQ ID NO: 1547986 - protein, 23 aa, Mycobacterium tuberculosis
LGVRPPVEADWLLLVELAADHDQ

SEQ ID NO: 1547987 - protein, 17 aa, Mycobacterium tuberculosis
LLESGRGPRRYTAGGHR

SEQ ID NO: 1547988 - protein, 28 aa, Mycobacterium tuberculosis
LLHSQAAGSRACRWMRRNIRVTLGAATI

SEQ ID NO: 1547989 - protein, 27 aa, Mycobacterium tuberculosis
LPAGHYTLRAAIDWQQHKPNGSHVVNY

SEQ ID NO: 1547990 - protein, 23 aa, Mycobacterium tuberculosis
LPQQARKGDLIFYGPEGTQSVAL

SEQ ID NO: 1547991 - protein, 20 aa, Mycobacterium tuberculosis
LSAHVAAFHDQFVHTLTAGA

SEQ ID NO: 1547992 - protein, 18 aa, Mycobacterium tuberculosis
LTAARAVLDMAASVGATS

SEQ ID NO: 1547993 - protein, 17 aa, Mycobacterium tuberculosis
LTALVAGGLPMLAAAGL

SEQ ID NO: 1547994 - protein, 17 aa, Mycobacterium tuberculosis
LTGQANYGFAVPDIPIP

SEQ ID NO: 1547995 - protein, 17 aa, Mycobacterium tuberculosis
LTLRVYAYSSCCKASYP

SEQ ID NO: 1547996 - protein, 22 aa, Mycobacterium tuberculosis
MLRGRRALDVAGNGRYARQLVE

SEQ ID NO: 1547997 - protein, 19 aa, Mycobacterium tuberculosis
MSLHFQIGRRQVVKAEVSS

SEQ ID NO: 1547998 - protein, 27 aa, Mycobacterium tuberculosis
NAGMFGDGGNGGFSFFDGNGGDGGTGG

SEQ ID NO: 1547999 - protein, 29 aa, Mycobacterium tuberculosis
NDSNGILWRGNFEGLFGLNVGITIPEFPI

SEQ ID NO: 1548000 - protein, 24 aa, Mycobacterium tuberculosis
NISIIDIPALPGFGNSTELPSSGF

SEQ ID NO: 1548001 - protein, 23 aa, Mycobacterium tuberculosis
NRTALDAARARLATFQTAVNKVA

SEQ ID NO: 1548002 - protein, 20 aa, Mycobacterium tuberculosis
PAGGRAWDGLWDPTLPMIPS

SEQ ID NO: 1548003 - protein, 33 aa, Mycobacterium tuberculosis; identical to SEQ ID NO: 1468016

SEQ ID NO: 1548004 - protein, 25 aa, Mycobacterium tuberculosis
PGGLTFPANSLLNLDVFVGTPGATI

SEQ ID NO: 1548005 - protein, 24 aa, Mycobacterium tuberculosis
PQLLIDRLSVQRVMAHQMSTQMAR

SEQ ID NO: 1548006 - protein, 30 aa, Mycobacterium tuberculosis
PQPLRAKISFWFDRKYRVPADAAAAILSPQ

SEQ ID NO: 1548007 - protein, 19 aa, Mycobacterium tuberculosis
PRGDLAAAIYTTIEDQVET

SEQ ID NO: 1548008 - protein, 22 aa, Mycobacterium tuberculosis
PRSNLARYGIAPTYPGDFAADV

SEQ ID NO: 1548009 - protein, 22 aa, Mycobacterium tuberculosis
PTTLHFPGFTIPTGPIHIGLPL

SEQ ID NO: 1548010 - protein, 23 aa, Mycobacterium tuberculosis
QGPISRRLALTALGFGVLAPNVL

SEQ ID NO: 1548011 - protein, 25 aa, Mycobacterium tuberculosis
QIERYRAATLMARVRAAKGMKVAQP

SEQ ID NO: 1548012 - protein, 19 aa, Mycobacterium tuberculosis
QLSRQTAEMLLAMGNSPDS

SEQ ID NO: 1548013 - protein, 24 aa, Mycobacterium tuberculosis
QPGKPSWNLEPWRPVVDDSEMLAS

SEQ ID NO: 1548014 - protein, 21 aa, Mycobacterium tuberculosis
RATPGDGWASLASSIGGQVLL

SEQ ID NO: 1548015 - protein, 27 aa, Mycobacterium tuberculosis
RDHPDFPAAAARLGSRLSIHDQPNLGG

SEQ ID NO: 1548016 - protein, 18 aa, Mycobacterium tuberculosis
RDPDTMIPDVRYTPNPND

SEQ ID NO: 1548017 - protein, 29 aa, Mycobacterium tuberculosis
RLGGEQAAKLCVQYLAPIVKNRQYNYPPL

SEQ ID NO: 1548018 - protein, 22 aa, Mycobacterium tuberculosis
RLRLTRQALLAAAVVPLLAGCA

SEQ ID NO: 1548019 - protein, 23 aa, Mycobacterium tuberculosis
RLVKAGKVDKDWDADATKGIPFG

SEQ ID NO: 1548020 - protein, 19 aa, Mycobacterium tuberculosis
RPGSHAGVGCLRAGRHCGR

SEQ ID NO: 1548021 - protein, 19 aa, Mycobacterium tuberculosis
RPPVIQLWARPRGVAPDAL

SEQ ID NO: 1548022 - protein, 19 aa, Mycobacterium tuberculosis
RSVLATALVLVAGVILAMR

SEQ ID NO: 1548023 - protein, 20 aa, Mycobacterium tuberculosis
RTALDAARARLATFQTAVNK

SEQ ID NO: 1548024 - protein, 20 aa, Mycobacterium tuberculosis
SCAEGGVLGIICASVASVMG

SEQ ID NO: 1548025 - protein, 25 aa, Mycobacterium tuberculosis
SGILNRGAGISGVYNTGTLGLVTSA

SEQ ID NO: 1548026 - protein, 22 aa, Mycobacterium tuberculosis
SQTAEAIWPPARTLRYDRQSPW

SEQ ID NO: 1548027 - protein, 18 aa, Mycobacterium tuberculosis
TESLGRFSEVANRALAAT

SEQ ID NO: 1548028 - protein, 27 aa, Mycobacterium tuberculosis
TGGHGGVGGDGGWLAPGGAGGAGGQGG

SEQ ID NO: 1548029 - protein, 18 aa, Mycobacterium tuberculosis
TILARATPGDGWASLASS

SEQ ID NO: 1548030 - protein, 20 aa, Mycobacterium tuberculosis
TPETLLGCPGEIDIGHRTIP

SEQ ID NO: 1548031 - protein, 20 aa, Mycobacterium tuberculosis
TPPFDLPTVVIDRIPVELHA

SEQ ID NO: 1548032 - protein, 17 aa, Mycobacterium tuberculosis
TQLSGILNRGAGISGVY

SEQ ID NO: 1548033 - protein, 17 aa, Mycobacterium tuberculosis
TVLPIQILPTIPLNIHQ

SEQ ID NO: 1548034 - protein, 25 aa, Mycobacterium tuberculosis
TVRRDEFSRWLSAKPDYLVTTEQSV

SEQ ID NO: 1548035 - protein, 18 aa, Mycobacterium tuberculosis
VDHTEWAQWGSLPSLRVY

SEQ ID NO: 1548036 - protein, 17 aa, Mycobacterium tuberculosis
VFEKLASILGLVAAPLM

SEQ ID NO: 1548037 - protein, 19 aa, Mycobacterium tuberculosis
VKAARRARQEWLAERLATL

SEQ ID NO: 1548038 - protein, 41 aa, Mycobacterium tuberculosis
VLATQGRGAWPVCGRGLSNATPREVLPASAAMDAPLDAAAV

SEQ ID NO: 1548039 - protein, 20 aa, Mycobacterium tuberculosis
VPGAIRFPRDLGPHYDYQTE

SEQ ID NO: 1548040 - protein, 22 aa, Mycobacterium tuberculosis
VPRPLMGSLIQRVPLDGAALST

SEQ ID NO: 1548041 - protein, 18 aa, Mycobacterium tuberculosis
VRCSLVVSFLVPQCVWYA

SEQ ID NO: 1548042 - protein, 25 aa, Mycobacterium tuberculosis
VSLPIFGFGGAPGFGNDTTAPSSGF

SEQ ID NO: 1548043 - protein, 23 aa, Mycobacterium tuberculosis
VTLPGAAIWHMAWSDKDDAIDWQ

SEQ ID NO: 1548044 - protein, 19 aa, Mycobacterium tuberculosis
VYLRKRCREHGSFEALVYG

SEQ ID NO: 1548045 - protein, 20 aa, Mycobacterium tuberculosis
WAQWGSLPSLRVYPSQVGRT

SEQ ID NO: 1548046 - protein, 17 aa, Mycobacterium tuberculosis
WDGPKAQVIGLVRSHLK

SEQ ID NO: 1548047 - protein, 17 aa, Mycobacterium tuberculosis
WRGKDLATPRGWITALR

SEQ ID NO: 1548048 - protein, 23 aa, Mycobacterium tuberculosis
WTSSGAIGPTWYSVGRIYNAGDL

SEQ ID NO: 1548049 - protein, 17 aa, Mycobacterium tuberculosis
WTTCKSVVLRVQVTGAG

SEQ ID NO: 1548050 - protein, 23 aa, Mycobacterium tuberculosis
YDESACDAWIGRIRCGDTDRVTL

SEQ ID NO: 1548051 - protein, 21 aa, Mycobacterium tuberculosis
YPNFFTVFGPYGYVGSSYFAL

SEQ ID NO: 1548052 - protein, 27 aa, Mycobacterium tuberculosis
YSLDVPRITILDAHFTGAFGPVVVPPI

SEQ ID NO: 1548053 - protein, 20 aa, Mycobacterium tuberculosis
YVLHRAWVGPMVLVVLDDPN

SEQ ID NO: 1548054 - protein, 17 aa, Mycobacterium tuberculosis
YWSLPSIFDSGGNHGTL

SEQ ID NO: 1548055 - protein, 18 aa, Mycobacterium tuberculosis
AAAAMPTTEVVAAAADEV

SEQ ID NO: 1548056 - protein, 22 aa, Mycobacterium tuberculosis
AAALGLRGTRKAEEAAESARLK

SEQ ID NO: 1548057 - protein, 27 aa, Mycobacterium tuberculosis
AAGGAGGNGGWLWGNGGNGGVGGTSVA

SEQ ID NO: 1548058 - protein, 20 aa, Mycobacterium tuberculosis
AGPQRFRYSLTTTISAEPAD

SEQ ID NO: 1548059 - protein, 19 aa, Mycobacterium tuberculosis
AHSFVDAWNYGALSTNAQL

SEQ ID NO: 1548060 - protein, 26 aa, Mycobacterium tuberculosis
ALAVASPCAYFLVYESTETTERPEHH

SEQ ID NO: 1548061 - protein, 18 aa, Mycobacterium tuberculosis
ALLESGRGPRRYTAGGHR

SEQ ID NO: 1548062 - protein, 18 aa, Mycobacterium tuberculosis
ALPAILGFVPEKSLVLVS

SEQ ID NO: 1548063 - protein, 22 aa, Mycobacterium tuberculosis
ANGFDVGRRLGIGSRETYILAL

SEQ ID NO: 1548064 - protein, 20 aa, Mycobacterium tuberculosis
APDEPRAGAGACALQGADGR

SEQ ID NO: 1548065 - protein, 24 aa, Mycobacterium tuberculosis
APGQPGAAGGLLFGNGGNGAAGGF

SEQ ID NO: 1548066 - protein, 22 aa, Mycobacterium tuberculosis
ARRVADVLGIPFYVWDFAEKFK

SEQ ID NO: 1548067 - protein, 24 aa, Mycobacterium tuberculosis
ARVPQRFVPDLTKYQYWNGDSNSW

SEQ ID NO: 1548068 - protein, 28 aa, Mycobacterium tuberculosis
ASQAIDLLKGVLMPSIMQAVQNGGAAAP

SEQ ID NO: 1548069 - protein, 20 aa, Mycobacterium tuberculosis
DFDPAEAITHGYIDSQKLLA

SEQ ID NO: 1548070 - protein, 28 aa, Mycobacterium tuberculosis
DPKTAVLNWKGDQVIVFVELSGSGARYG

SEQ ID NO: 1548071 - protein, 18 aa, Mycobacterium tuberculosis
DSAFRAGWQGDYPSMIEF

SEQ ID NO: 1548072 - protein, 25 aa, Mycobacterium tuberculosis
DTAYFGNAFPPNYLVNSHTSAEQVG

SEQ ID NO: 1548073 - protein, 21 aa, Mycobacterium tuberculosis
DTNVPGPCRVVGSSDRTFGTD

SEQ ID NO: 1548074 - protein, 17 aa, Mycobacterium tuberculosis
DVDAVKFTQVLRGYKTS

SEQ ID NO: 1548075 - protein, 17 aa, Mycobacterium tuberculosis
EALAATATYLTGIGSAI

SEQ ID NO: 1548076 - protein, 22 aa, Mycobacterium tuberculosis
ELGQPMFTEYVWGRQYGENTIN

SEQ ID NO: 1548077 - protein, 27 aa, Mycobacterium tuberculosis
EVLGSAATDLAALGSVLGAADAAAAAT

SEQ ID NO: 1548078 - protein, 24 aa, Mycobacterium tuberculosis
FFQAAGPWLKNALISNLNIVSTVN

SEQ ID NO: 1548079 - protein, 19 aa, Mycobacterium tuberculosis
FLAPPGRAPVLVYGPGPAG

SEQ ID NO: 1548080 - protein, 24 aa, Mycobacterium tuberculosis
FLSAELPDWLAANRGLAPGGHAAV

SEQ ID NO: 1548081 - protein, 17 aa, Mycobacterium tuberculosis
FPTLSVKLIDAGKDYDE

SEQ ID NO: 1548082 - protein, 17 aa, Mycobacterium tuberculosis
FSFEQSRHWSRTYAPGH

SEQ ID NO: 1548083 - protein, 17 aa, Mycobacterium tuberculosis
FSKQLINSIKWARDETG

SEQ ID NO: 1548084 - protein, 27 aa, Mycobacterium tuberculosis
GAGGAGGRGALLLGAGGQGGLGGAGGQ

SEQ ID NO: 1548085 - protein, 19 aa, Mycobacterium tuberculosis
GAGGLFGIGGAGGGCGSAV

SEQ ID NO: 1548086 - protein, 25 aa, Mycobacterium tuberculosis
GAGGLLYGNGGNGFSQTTAGLTGGT

SEQ ID NO: 1548087 - protein, 23 aa, Mycobacterium tuberculosis
GALSQDGNGFAGGQGGQGGAGGN

SEQ ID NO: 1548088 - protein, 20 aa, Mycobacterium tuberculosis
GAVICSAVALGIALHSGDPA

SEQ ID NO: 1548089 - protein, 20 aa, Mycobacterium tuberculosis
GDGAPATLIGGPDGGDGGQG

SEQ ID NO: 1548090 - protein, 20 aa, Mycobacterium tuberculosis
GDGWTCQRALTARNNVTIDI

SEQ ID NO: 1548091 - protein, 22 aa, Mycobacterium tuberculosis
GGNGGNAGLFGHGGAGGTGGAG

SEQ ID NO: 1548092 - protein, 24 aa, Mycobacterium tuberculosis
GGVAQGDIASAFGGDGGNGSDGVA

SEQ ID NO: 1548093 - protein, 17 aa, Mycobacterium tuberculosis
GMHVRLAVTGDVPNLRV

SEQ ID NO: 1548094 - protein, 25 aa, Mycobacterium tuberculosis
GPIELVKTSGGWRIDRLPNGVFLDW

SEQ ID NO: 1548095 - protein, 18 aa, Mycobacterium tuberculosis
GPLISALLNPGARNAAPL

SEQ ID NO: 1548096 - protein, 26 aa, Mycobacterium tuberculosis
GQVVLGWKVSDLKSSTAVIPGYPVAG

SEQ ID NO: 1548097 - protein, 25 aa, Mycobacterium tuberculosis
GRPRGWPEWAEPDVVDAFADRGISS

SEQ ID NO: 1548098 - protein, 19 aa, Mycobacterium tuberculosis
GSAYLARVPQRFVPDLTKY

SEQ ID NO: 1548099 - protein, 21 aa, Mycobacterium tuberculosis
GSDAWDRLFAGPRPTELHPFV

SEQ ID NO: 1548100 - protein, 25 aa, Mycobacterium tuberculosis
GTGANGAPGGWLLGNGGAGGSAAAG

SEQ ID NO: 1548101 - protein, 25 aa, Mycobacterium tuberculosis
GVGGKGGASGMLIGNGGNGGSGGVG

SEQ ID NO: 1548102 - protein, 21 aa, Mycobacterium tuberculosis
GVGGTWHWNTYPGIAVDIPSF

SEQ ID NO: 1548103 - protein, 26 aa, Mycobacterium tuberculosis
GWRIDRLPNGVFLDWQQFQETYKRNT

SEQ ID NO: 1548104 - protein, 24 aa, Mycobacterium tuberculosis
HGVALPEAIPVPHVPPLGAEPGVQ

SEQ ID NO: 1548105 - protein, 23 aa, Mycobacterium tuberculosis
ILATLIYLGWRAARAQMNRPKTR

SEQ ID NO: 1548106 - protein, 17 aa, Mycobacterium tuberculosis
IMFHPLNTITAYKGQII

SEQ ID NO: 1548107 - protein, 29 aa, Mycobacterium tuberculosis
INAPTQALLGRPLIGDGANATTPGGAGGA

SEQ ID NO: 1548108 - protein, 23 aa, Mycobacterium tuberculosis
IPNTGFHLGRLHSMTSRLMCTLR

SEQ ID NO: 1548109 - protein, 17 aa, Mycobacterium tuberculosis
ISSPWSHQAEAAELAYA

SEQ ID NO: 1548110 - protein, 17 aa, Mycobacterium tuberculosis
KNLYTVYFAMKFSQPFS

SEQ ID NO: 1548111 - protein, 54 aa, Mycobacterium tuberculosis; identical to SEQ ID NO: 234774

SEQ ID NO: 1548112 - protein, 19 aa, Mycobacterium tuberculosis
LALAPRLAGMAELVQITDK

SEQ ID NO: 1548113 - protein, 17 aa, Mycobacterium tuberculosis
LENPQWCARVIGEHGDQ

SEQ ID NO: 1548114 - protein, 18 aa, Mycobacterium tuberculosis
LESRIIIDSMHLGRYLGI

SEQ ID NO: 1548115 - protein, 25 aa, Mycobacterium tuberculosis
LGACLALWLSGCSSPKPDAEEQGVP

SEQ ID NO: 1548116 - protein, 17 aa, Mycobacterium tuberculosis
LGLTAPFNIDEVPNVIR

SEQ ID NO: 1548117 - protein, 22 aa, Mycobacterium tuberculosis
LGQSVCPILAEPGGSFNTAVAS

SEQ ID NO: 1548118 - protein, 17 aa, Mycobacterium tuberculosis
LHSMTSRLMCTLRRQPN

SEQ ID NO: 1548119 - protein, 28 aa, Mycobacterium tuberculosis
LICVLPIALSPWPARAFVMLLVALAVAV

SEQ ID NO: 1548120 - protein, 18 aa, Mycobacterium tuberculosis
LLALICVLPIALSPWPAR

SEQ ID NO: 1548121 - protein, 18 aa, Mycobacterium tuberculosis
LMIGLAVPAHAGPSGDDA

SEQ ID NO: 1548122 - protein, 24 aa, Mycobacterium tuberculosis
LPIVNASGGPNCRGLPDIPTKQTG

SEQ ID NO: 1548123 - protein, 17 aa, Mycobacterium tuberculosis
LPLRRLLLDHYPSIERI

SEQ ID NO: 1548124 - protein, 18 aa, Mycobacterium tuberculosis
LRSTVPVTLTADRSGLVM

SEQ ID NO: 1548125 - protein, 18 aa, Mycobacterium tuberculosis
LRVGQPVLAIGSPLGLEG

SEQ ID NO: 1548126 - protein, 26 aa, Mycobacterium tuberculosis
LVSHYDVYPAFGFRFDLKKSGVSVTF

SEQ ID NO: 1548127 - protein, 20 aa, Mycobacterium tuberculosis
MPTTEVVAAAADEVSAAIAG

SEQ ID NO: 1548128 - protein, 21 aa, Mycobacterium tuberculosis
MQPYAAIYLHLMRAAVLRRAG

SEQ ID NO: 1548129 - protein, 21 aa, Mycobacterium tuberculosis
NGGAGGLLFGDGGNGGAGGAG

SEQ ID NO: 1548130 - protein, 20 aa, Mycobacterium tuberculosis
NGGAGGLLFGNGGNGGNAGA

SEQ ID NO: 1548131 - protein, 17 aa, Mycobacterium tuberculosis
NSPEVLNLLLVDFKGGA

SEQ ID NO: 1548132 - protein, 18 aa, Mycobacterium tuberculosis
PDNVARLILDSPIALGVS

SEQ ID NO: 1548133 - protein, 17 aa, Mycobacterium tuberculosis
PELVAAAAADLTGIGQA

SEQ ID NO: 1548134 - protein, 27 aa, Mycobacterium tuberculosis
PKFDVPLPTAVRWAMRIPGGKAVHRLL

SEQ ID NO: 1548135 - protein, 21 aa, Mycobacterium tuberculosis
PLPPDSNGYVFIETKSGMTRC

SEQ ID NO: 1548136 - protein, 20 aa, Mycobacterium tuberculosis
QEDFRKAAVVANVYADAAGD

SEQ ID NO: 1548137 - protein, 17 aa, Mycobacterium tuberculosis
QEMAAAVAHAFETGEHL

SEQ ID NO: 1548138 - protein, 20 aa, Mycobacterium tuberculosis
QLINSIKWARDETGIIPTAG

SEQ ID NO: 1548139 - protein, 26 aa, Mycobacterium tuberculosis
QLLATAALDLASIGSQVSAANAAAAM

SEQ ID NO: 1548140 - protein, 23 aa, Mycobacterium tuberculosis
QRDRAKMFALLWQSLRRQRQLLK

SEQ ID NO: 1548141 - protein, 17 aa, Mycobacterium tuberculosis
QVGSRIVHDALVGKSVV

SEQ ID NO: 1548142 - protein, 17 aa, Mycobacterium tuberculosis
QVRDAWPPSARAQPHTH

SEQ ID NO: 1548143 - protein, 19 aa, Mycobacterium tuberculosis
RALWIAALSFGLGGVAVAA

SEQ ID NO: 1548144 - protein, 18 aa, Mycobacterium tuberculosis
RARQEWLAERLATLNRSE

SEQ ID NO: 1548145 - protein, 17 aa, Mycobacterium tuberculosis
RLAIRTDTILGRKVLEI

SEQ ID NO: 1548146 - protein, 19 aa, Mycobacterium tuberculosis
RLFAGPRPTELHPFVELTG

SEQ ID NO: 1548147 - protein, 18 aa, Mycobacterium tuberculosis
RREVPFDVHLMIFGDSTA

SEQ ID NO: 1548148 - protein, 19 aa, Mycobacterium tuberculosis
SAGKWPDKFLAGAAGVAHG

SEQ ID NO: 1548149 - protein, 25 aa, Mycobacterium tuberculosis
SGGAGGASGWLMGNGGNGGNGGTGG

SEQ ID NO: 1548150 - protein, 23 aa, Mycobacterium tuberculosis
SGGAGGGAFVHIATATSTGGSGG

SEQ ID NO: 1548151 - protein, 21 aa, Mycobacterium tuberculosis
SGSGARYGRQGIEYWEHQGEV

SEQ ID NO: 1548152 - protein, 24 aa, Mycobacterium tuberculosis
SKLLRCILGDPVVDAVVAVRQLEH

SEQ ID NO: 1548153 - protein, 25 aa, Mycobacterium tuberculosis
SPLQALQLELLNAINAPTLALLGRP

SEQ ID NO: 1548154 - protein, 24 aa, Mycobacterium tuberculosis
SVAKIAFTGAVLGGGGIAMAAQAT

SEQ ID NO: 1548155 - protein, 23 aa, Mycobacterium tuberculosis
SVPMLFAKPSYYGQFTDSGGLHK

SEQ ID NO: 1548156 - protein, 18 aa, Mycobacterium tuberculosis
TDTILGRKVLEIEPRGAQ

SEQ ID NO: 1548157 - protein, 25 aa, Mycobacterium tuberculosis
TGAGAAAFLMDWAAPVIEKAYGAGP

SEQ ID NO: 1548158 - protein, 20 aa, Mycobacterium tuberculosis
TKGIPFGSVVTFVVRAGNPK

SEQ ID NO: 1548159 - protein, 18 aa, Mycobacterium tuberculosis
TKPATIVQQLVCHDRQLT

SEQ ID NO: 1548160 - protein, 22 aa, Mycobacterium tuberculosis
TNKLAAPVGVRSDCLGVDAPLP

SEQ ID NO: 1548161 - protein, 21 aa, Mycobacterium tuberculosis
TPETLLGCPGEIDIGHRTIPN

SEQ ID NO: 1548162 - protein, 18 aa, Mycobacterium tuberculosis
TSEVDWVLERLGRELEAL

SEQ ID NO: 1548163 - protein, 24 aa, Mycobacterium tuberculosis
TVEGLKIDGDHIVVKFSIGTNTIG

SEQ ID NO: 1548164 - protein, 23 aa, Mycobacterium tuberculosis
TVSSPRAGLVMEKGAKVKYRGIQ

SEQ ID NO: 1548165 - protein, 19 aa, Mycobacterium tuberculosis
VDYYNFFLSGGFLAPPGRA

SEQ ID NO: 1548166 - protein, 19 aa, Mycobacterium tuberculosis
VGISSVLKIGRDLYVIDCG

SEQ ID NO: 1548167 - protein, 17 aa, Mycobacterium tuberculosis
VGQKVLPQQARKGDLIF

SEQ ID NO: 1548168 - protein, 17 aa, Mycobacterium tuberculosis
VHIYLQFDGLDEATHRR

SEQ ID NO: 1548169 - protein, 17 aa, Mycobacterium tuberculosis
VHLARGHAVNWVLVTDD

SEQ ID NO: 1548170 - protein, 28 aa, Mycobacterium tuberculosis
VNAPTEALLGRPLIGNGADGTAPGQPGA

SEQ ID NO: 1548171 - protein, 26 aa, Mycobacterium tuberculosis
VPDSPEALPLLFGHIGEGNLHLNVLR

SEQ ID NO: 1548172 - protein, 17 aa, Mycobacterium tuberculosis
VPGYRLVDSTGQVVRTL

SEQ ID NO: 1548173 - protein, 20 aa, Mycobacterium tuberculosis
VPLPELPHGLRITDVSLAAD

SEQ ID NO: 1548174 - protein, 17 aa, Mycobacterium tuberculosis
VPSRPHLEWQLRRRVLQ

SEQ ID NO: 1548175 - protein, 20 aa, Mycobacterium tuberculosis
WEALSSALGGKVLQPDDGPQ

SEQ ID NO: 1548176 - protein, 17 aa, Mycobacterium tuberculosis
YDAEWIIILDDWTDGIG

SEQ ID NO: 1548177 - protein, 19 aa, Mycobacterium tuberculosis
YFIRMWNQAALAMEVYQAE

SEQ ID NO: 1548178 - protein, 21 aa, Mycobacterium tuberculosis
YPSMIEFLAPLFTAGAGSNDV

SEQ ID NO: 1548179 - protein, 17 aa, Mycobacterium tuberculosis
AAALGLLEASGFQVDTN

SEQ ID NO: 1548180 - protein, 17 aa, Mycobacterium tuberculosis
AAIGLMVPIGLAPPAMA

SEQ ID NO: 1548181 - protein, 31 aa, Mycobacterium tuberculosis; identical to SEQ ID NO: 195874

SEQ ID NO: 1548182 - protein, 20 aa, Mycobacterium tuberculosis
AASVCPTGSAAPMARKESTG

SEQ ID NO: 1548183 - protein, 18 aa, Mycobacterium tuberculosis
AATARPVFGDRFNTGNEE

SEQ ID NO: 1548184 - protein, 20 aa, Mycobacterium tuberculosis
ACASVDPMPARSEAAAANTS

SEQ ID NO: 1548185 - protein, 23 aa, Mycobacterium tuberculosis
ADEVSAAVAAVFSSYAQQYQALS

SEQ ID NO: 1548186 - protein, 29 aa, Mycobacterium tuberculosis
ADEVSIAVAALFGMHGQAYQALSVQASAF

SEQ ID NO: 1548187 - protein, 20 aa, Mycobacterium tuberculosis
AECLHKAAPIVGLPAATRTT

SEQ ID NO: 1548188 - protein, 17 aa, Mycobacterium tuberculosis
AEGLDVADGARLVDSIE

SEQ ID NO: 1548189 - protein, 20 aa, Mycobacterium tuberculosis
AELLVPHLAARFGRAARDIA

SEQ ID NO: 1548190 - protein, 24 aa, Mycobacterium tuberculosis
AFFNIYFCSVTIKINGPAGSDILL

SEQ ID NO: 1548191 - protein, 29 aa, Mycobacterium tuberculosis
AGFGVLLPSWWDRRRKLGLVLSAYTPVDG

SEQ ID NO: 1548192 - protein, 20 aa, Mycobacterium tuberculosis
AGGAGGWLLGNGGAGGAGGA

SEQ ID NO: 1548193 - protein, 19 aa, Mycobacterium tuberculosis
AGGDAGWLGSGGVGGAGGF

SEQ ID NO: 1548194 - protein, 66 aa, Mycobacterium tuberculosis
AGLALPPGPARPAGAAVPAVRCSAAPARPARTADPWLAPIFARSTLRHSHHLGGIAQTGAVADQQG

SEQ ID NO: 1548195 - protein, 17 aa, Mycobacterium tuberculosis
AGPRYAGPLFVTDLDSP

SEQ ID NO: 1548196 - protein, 26 aa, Mycobacterium tuberculosis
AKAGGLPGDLTFSWYAVDKTGQPWVV

SEQ ID NO: 1548197 - protein, 34 aa, Mycobacterium tuberculosis; identical to SEQ ID NO: 1472755

SEQ ID NO: 1548198 - protein, 38 aa, Mycobacterium tuberculosis; identical to SEQ ID NO: 1470374

SEQ ID NO: 1548199 - protein, 17 aa, Mycobacterium tuberculosis
ALNTGLGNIGSWNLGGG

SEQ ID NO: 1548200 - protein, 20 aa, Mycobacterium tuberculosis
ALTGRPLIGNGANGAPGTGA

SEQ ID NO: 1548201 - protein, 17 aa, Mycobacterium tuberculosis
APSCDRVVFRGNVAGRE

SEQ ID NO: 1548202 - protein, 26 aa, Mycobacterium tuberculosis
AQGILCGSIVFGLRMRPGNWAGIYAC

SEQ ID NO: 1548203 - protein, 20 aa, Mycobacterium tuberculosis
ARAAAFHHEFVQALAAGAGS

SEQ ID NO: 1548204 - protein, 21 aa, Mycobacterium tuberculosis
ARELFCSGLRTPKAVLSAERQ

SEQ ID NO: 1548205 - protein, 18 aa, Mycobacterium tuberculosis
ASFVFRHRTGNAVILVLM

SEQ ID NO: 1548206 - protein, 22 aa, Mycobacterium tuberculosis
ASIWNRRRVLLLNSTYEPLTAL

SEQ ID NO: 1548207 - protein, 24 aa, Mycobacterium tuberculosis
ATEFDYLEMWAQDVAAMVGYHAGA

SEQ ID NO: 1548208 - protein, 21 aa, Mycobacterium tuberculosis
AVAGCSRGGSSKAGRSSSVAG

SEQ ID NO: 1548209 - protein, 24 aa, Mycobacterium tuberculosis
AWDGLWDPTLPMIPSANIPGDPIA

SEQ ID NO: 1548210 - protein, 26 aa, Mycobacterium tuberculosis
CRQLDAFLKWHHGVREFLQSAIDANS

SEQ ID NO: 1548211 - protein, 19 aa, Mycobacterium tuberculosis
DAEPGRITVILALHDLING

SEQ ID NO: 1548212 - protein, 22 aa, Mycobacterium tuberculosis
DDLRAIATLTHRGVEGAIVGKA

SEQ ID NO: 1548213 - protein, 25 aa, Mycobacterium tuberculosis
DDPDGYRLSVDYAVRITSRGLYVHS

SEQ ID NO: 1548214 - protein, 24 aa, Mycobacterium tuberculosis
DLARIDVWDGYYCFAAELTSATLE

SEQ ID NO: 1548215 - protein, 17 aa, Mycobacterium tuberculosis
DNSAHVFVEADIVTADL

SEQ ID NO: 1548216 - protein, 23 aa, Mycobacterium tuberculosis
DREPRPGHRRMVFRFLTSPIEIK

SEQ ID NO: 1548217 - protein, 23 aa, Mycobacterium tuberculosis
DSILRVLAMHRFAKAPMLVGGQM

SEQ ID NO: 1548218 - protein, 17 aa, Mycobacterium tuberculosis
DVISCRIIVNGAVKDER

SEQ ID NO: 1548219 - protein, 20 aa, Mycobacterium tuberculosis
EAAARCPQLFIATADADRDA

SEQ ID NO: 1548220 - protein, 24 aa, Mycobacterium tuberculosis
EACECPSGCPSCVQSPKCGNGNDP

SEQ ID NO: 1548221 - protein, 17 aa, Mycobacterium tuberculosis
EASRLVATTSGYRAGLL

SEQ ID NO: 1548222 - protein, 23 aa, Mycobacterium tuberculosis
EATAVGIGWGRLLSADSYKKMVS

SEQ ID NO: 1548223 - protein, 19 aa, Mycobacterium tuberculosis
EAYFGAVGVDGVLGVGPNA

SEQ ID NO: 1548224 - protein, 21 aa, Mycobacterium tuberculosis
EDPRFRFFGNVVVGEHVQPGE

SEQ ID NO: 1548225 - protein, 17 aa, Mycobacterium tuberculosis
EELPAQLVVRSVGYRGV

SEQ ID NO: 1548226 - protein, 21 aa, Mycobacterium tuberculosis
EEPRLFYMHYWAVDDAVTLAR

SEQ ID NO: 1548227 - protein, 21 aa, Mycobacterium tuberculosis
EFLTAAAMDLASIGSTVSAAS

SEQ ID NO: 1548228 - protein, 20 aa, Mycobacterium tuberculosis
EFNGRHYAVPYARSTPLFYY

SEQ ID NO: 1548229 - protein, 17 aa, Mycobacterium tuberculosis
EHTCCRETPAAIPTGPD

SEQ ID NO: 1548230 - protein, 19 aa, Mycobacterium tuberculosis
EIDGLLPTLIRGQGTEFDS

SEQ ID NO: 1548231 - protein, 23 aa, Mycobacterium tuberculosis
ENRPDCIYLGAAGHVLGPGHTLR

SEQ ID NO: 1548232 - protein, 22 aa, Mycobacterium tuberculosis
EQLVEFRWELAVGDDPLSEEEI

SEQ ID NO: 1548233 - protein, 23 aa, Mycobacterium tuberculosis
ERFRTRYAIPIERHGHTEPAERL

SEQ ID NO: 1548234 - protein, 20 aa, Mycobacterium tuberculosis
ETDQAFGWVAFEFGVHRYGL

SEQ ID NO: 1548235 - protein, 27 aa, Mycobacterium tuberculosis
EVSAVVASLFARHAQAYQALSLQATAF

SEQ ID NO: 1548236 - protein, 23 aa, Mycobacterium tuberculosis
FARECLADGVAVLVEERVDLRRE

SEQ ID NO: 1548237 - protein, 19 aa, Mycobacterium tuberculosis
FFLSGGFLAPPGRAPVLVY

SEQ ID NO: 1548238 - protein, 24 aa, Mycobacterium tuberculosis
FHEDPVAGVWAVGGVGGDGGSGGS

SEQ ID NO: 1548239 - protein, 18 aa, Mycobacterium tuberculosis
FHPDRFGFAGSMSGFLYP

SEQ ID NO: 1548240 - protein, 23 aa, Mycobacterium tuberculosis
FQTLTGRPLIGNGANGTPGTGAD

SEQ ID NO: 1548241 - protein, 18 aa, Mycobacterium tuberculosis
FSVLSLPTTLIFDVDGRQ

SEQ ID NO: 1548242 - protein, 18 aa, Mycobacterium tuberculosis
FTGVTPFADAYKPRPCDA

SEQ ID NO: 1548243 - protein, 18 aa, Mycobacterium tuberculosis
GACPDVEVVFARGTGEPP

SEQ ID NO: 1548244 - protein, 24 aa, Mycobacterium tuberculosis
GAGAAAFLMDWAAPVIEKAYGAGP

SEQ ID NO: 1548245 - protein, 17 aa, Mycobacterium tuberculosis
GAGAWLLVRGHGPQQPE

SEQ ID NO: 1548246 - protein, 19 aa, Mycobacterium tuberculosis
GAKLRCRLTDGSKTYGISV

SEQ ID NO: 1548247 - protein, 18 aa, Mycobacterium tuberculosis
GALNSGIGNMGFGNSGNN

SEQ ID NO: 1548248 - protein, 28 aa, Mycobacterium tuberculosis
GDAGLFGFGGDGGWGGRGVDARFGAAGG

SEQ ID NO: 1548249 - protein, 23 aa, Mycobacterium tuberculosis
GDEVSAAIAALFGTHAQEYQALS

SEQ ID NO: 1548250 - protein, 18 aa, Mycobacterium tuberculosis
GDRVIPQWVKIRNVDGFN

SEQ ID NO: 1548251 - protein, 24 aa, Mycobacterium tuberculosis
GGAGGAGGLLFGNGGAGAAGAPGQ

SEQ ID NO: 1548252 - protein, 24 aa, Mycobacterium tuberculosis
GGAGGAGGWLLGDGGAGGIGGAST

SEQ ID NO: 1548253 - protein, 22 aa, Mycobacterium tuberculosis
GGAGGKAGLLIGNGGAGGAGGQ

SEQ ID NO: 1548254 - protein, 24 aa, Mycobacterium tuberculosis
GGAGGRGGLLYGGYGVSGPGGDGR

SEQ ID NO: 1548255 - protein, 23 aa, Mycobacterium tuberculosis
GGAGGSGGWLLGTGGVGGVGGLG

SEQ ID NO: 1548256 - protein, 25 aa, Mycobacterium tuberculosis
GGAIARLPAIFTHRDVGNTDCPGNA

SEQ ID NO: 1548257 - protein, 21 aa, Mycobacterium tuberculosis
GGGGVGGLWGAGGAGGAGGTG

SEQ ID NO: 1548258 - protein, 18 aa, Mycobacterium tuberculosis
GGHPRLGHNLALHPATML

SEQ ID NO: 1548259 - protein, 22 aa, Mycobacterium tuberculosis
GGLAVLRPGHTIPLARTQPALD

SEQ ID NO: 1548260 - protein, 21 aa, Mycobacterium tuberculosis
GGPDFPAPLDVATSPPNPDGP

SEQ ID NO: 1548261 - protein, 18 aa, Mycobacterium tuberculosis
GKLKRRAVAQAYRDGTLP

SEQ ID NO: 1548262 - protein, 17 aa, Mycobacterium tuberculosis
GNIGSWNLGGGNVGLLN

SEQ ID NO: 1548263 - protein, 25 aa, Mycobacterium tuberculosis
GPIHIGLPLSLTIPGFTIPGGTLIP

SEQ ID NO: 1548264 - protein, 29 aa, Mycobacterium tuberculosis
GQAGGPGGPAGLWGNGGPGGAGGSGGGTG

SEQ ID NO: 1548265 - protein, 18 aa, Mycobacterium tuberculosis
GQANYGFAVPDIPIPAIH

SEQ ID NO: 1548266 - protein, 19 aa, Mycobacterium tuberculosis
GQANYGFAVPDIPIPAIHI

SEQ ID NO: 1548267 - protein, 24 aa, Mycobacterium tuberculosis
GQGGEPRLTLPDAITGNPGDPRYP

SEQ ID NO: 1548268 - protein, 20 aa, Mycobacterium tuberculosis
GRDDRLRWWAGPWPDDERWW

SEQ ID NO: 1548269 - protein, 17 aa, Mycobacterium tuberculosis
GRLHSMTSRLMCTLRRQ

SEQ ID NO: 1548270 - protein, 28 aa, Mycobacterium tuberculosis
GRLRRLALSAAINRPQICQQIFAGTRSP

SEQ ID NO: 1548271 - protein, 25 aa, Mycobacterium tuberculosis
GSAPRRPPIPGSDAAGVHYLRSYND

SEQ ID NO: 1548272 - protein, 24 aa, Mycobacterium tuberculosis
GSLYHAGVKLDWMVATTLLTGRRT

SEQ ID NO: 1548273 - protein, 29 aa, Mycobacterium tuberculosis
GTGGAGGAGGWLFGVGGAGGVGGAGGGTG

SEQ ID NO: 1548274 - protein, 18 aa, Mycobacterium tuberculosis
GTGGGGGVGGLWGAGGAG

SEQ ID NO: 1548275 - protein, 25 aa, Mycobacterium tuberculosis
GTGQPGGAGGLLWGNGGNGGSGAAG

SEQ ID NO: 1548276 - protein, 18 aa, Mycobacterium tuberculosis
GTSEPFDLLAVVPPHVPS

SEQ ID NO: 1548277 - protein, 26 aa, Mycobacterium tuberculosis
HAGTGGRGGLLAGQHANSGNGGGGGT

SEQ ID NO: 1548278 - protein, 24 aa, Mycobacterium tuberculosis
HFTGAFGPVVVPPIPVPAINAHLT

SEQ ID NO: 1548279 - protein, 26 aa, Mycobacterium tuberculosis
HGTAFLAARGGYFVADLSSGHTARVN

SEQ ID NO: 1548280 - protein, 20 aa, Mycobacterium tuberculosis
HHGMLSVFGSPTWRTVTGGS

SEQ ID NO: 1548281 - protein, 21 aa, Mycobacterium tuberculosis
HLKATLKHLACLEYSTVAIQN

SEQ ID NO: 1548282 - protein, 23 aa, Mycobacterium tuberculosis
HPTSRRELLAALTKRGRDVVRQV

SEQ ID NO: 1548283 - protein, 26 aa, Mycobacterium tuberculosis
IGGDGGNAGFGAGVPGDGGDGGNAGF

SEQ ID NO: 1548284 - protein, 17 aa, Mycobacterium tuberculosis
IKLKNWVATLTLSLKKD

SEQ ID NO: 1548285 - protein, 19 aa, Mycobacterium tuberculosis
IPIPDEFKSRLSTAVNAIA

SEQ ID NO: 1548286 - protein, 23 aa, Mycobacterium tuberculosis
ISIIDIPALPGFGNSTELPSSGF

SEQ ID NO: 1548287 - protein, 26 aa, Mycobacterium tuberculosis
ISSIPPVPGKFYWMSPTQVRWRPFEF

SEQ ID NO: 1548288 - protein, 24 aa, Mycobacterium tuberculosis
KAPTIDFTLRLGHSSFYPLPDSAF

SEQ ID NO: 1548289 - protein, 22 aa, Mycobacterium tuberculosis
KARFVPGNENFQMGAYLKSNDG

SEQ ID NO: 1548290 - protein, 25 aa, Mycobacterium tuberculosis
KGGSGGNGGNAWLTGQGGNGGNAAF

SEQ ID NO: 1548291 - protein, 22 aa, Mycobacterium tuberculosis
KYGGLQFKPATWAAFGGVGNPA

SEQ ID NO: 1548292 - protein, 17 aa, Mycobacterium tuberculosis
LAAELAVAASSFGSVTS

SEQ ID NO: 1548293 - protein, 21 aa, Mycobacterium tuberculosis
LALLGRPLIGNGADGAAGTGQ

SEQ ID NO: 1548294 - protein, 25 aa, Mycobacterium tuberculosis
LALTCGAGLLKWQDGAVRDAAVARA

SEQ ID NO: 1548295 - protein, 17 aa, Mycobacterium tuberculosis
LAQYPSILVELGNMKNP

SEQ ID NO: 1548296 - protein, 31 aa, Mycobacterium tuberculosis; identical to SEQ ID NO: 202151

SEQ ID NO: 1548297 - protein, 22 aa, Mycobacterium tuberculosis
LEQSPPIWWTHIAGHGDAADLA

SEQ ID NO: 1548298 - protein, 25 aa, Mycobacterium tuberculosis
LFDIHELVNIGPFRIEPIDVPAVVL

SEQ ID NO: 1548299 - protein, 26 aa, Mycobacterium tuberculosis
LGEDYLRLSALGSYGAFFNIYFCSVT

SEQ ID NO: 1548300 - protein, 19 aa, Mycobacterium tuberculosis
LIVEPRLAKSVAAADRNSG

SEQ ID NO: 1548301 - protein, 19 aa, Mycobacterium tuberculosis
LKQVCNHPAQLLHDRSPVG

SEQ ID NO: 1548302 - protein, 17 aa, Mycobacterium tuberculosis
LLTELGWALRRAPLPPT

SEQ ID NO: 1548303 - protein, 31 aa, Mycobacterium tuberculosis
LLTGTRWECHLTQLELQWGRTIGQFPSPCTA

SEQ ID NO: 1548304 - protein, 18 aa, Mycobacterium tuberculosis
LPAQLVVRSVGYRGVPTP

SEQ ID NO: 1548305 - protein, 24 aa, Mycobacterium tuberculosis
LPGQNGGAGGLLWGNGGNGGAGDA

SEQ ID NO: 1548306 - protein, 17 aa, Mycobacterium tuberculosis
LPPPAALTGEWFGALAV

SEQ ID NO: 1548307 - protein, 20 aa, Mycobacterium tuberculosis
LRAGELLEWAYATVGSSQAG

SEQ ID NO: 1548308 - protein, 24 aa, Mycobacterium tuberculosis
LRLNRARPTPWRVPDVDSLPELVA

SEQ ID NO: 1548309 - protein, 17 aa, Mycobacterium tuberculosis
LRMFTGAGSAPMLAASV

SEQ ID NO: 1548310 - protein, 27 aa, Mycobacterium tuberculosis
LRMRPGNWAGIYACWGTENREAAVRFV

SEQ ID NO: 1548311 - protein, 22 aa, Mycobacterium tuberculosis
LRNVHIRPGVPPLVIAAPVELS

SEQ ID NO: 1548312 - protein, 22 aa, Mycobacterium tuberculosis
LRRWLDRPQELLLTELGRASRI

SEQ ID NO: 1548313 - protein, 17 aa, Mycobacterium tuberculosis
LRTGKLVRIAGVEVGKV

SEQ ID NO: 1548314 - protein, 17 aa, Mycobacterium tuberculosis
LSAARWAEIRPSLRDQI

SEQ ID NO: 1548315 - protein, 24 aa, Mycobacterium tuberculosis
LSAQMARFHQQFVQALTASVGSYA

SEQ ID NO: 1548316 - protein, 19 aa, Mycobacterium tuberculosis
LTEMDYFIRMWNQAALAME

SEQ ID NO: 1548317 - protein, 17 aa, Mycobacterium tuberculosis
LVAARFIQLTPVYTGGA

SEQ ID NO: 1548318 - protein, 25 aa, Mycobacterium tuberculosis
LVALAAKLVHDFDIAPGHVFATGMS

SEQ ID NO: 1548319 - protein, 20 aa, Mycobacterium tuberculosis
LYECDGQWVLAAGVQAMVEL

SEQ ID NO: 1548320 - protein, 22 aa, Mycobacterium tuberculosis
MANALRPNAIVSLHADGGPASG

SEQ ID NO: 1548321 - protein, 21 aa, Mycobacterium tuberculosis
MATGMACRTRFFDQFFLDATH

SEQ ID NO: 1548322 - protein, 29 aa, Mycobacterium tuberculosis
MGGQGGAGGNGWAAEGITVGIGEQGGQGG

SEQ ID NO: 1548323 - protein, 23 aa, Mycobacterium tuberculosis
MKHPPCSVVAAATAILAVVLAIG

SEQ ID NO: 1548324 - protein, 17 aa, Mycobacterium tuberculosis
MLVLVMVGLVVLGPERL

SEQ ID NO: 1548325 - protein, 28 aa, Mycobacterium tuberculosis
MLVSSWQMPGGIYAPMMHPWSTGKDVYF

SEQ ID NO: 1548326 - protein, 24 aa, Mycobacterium tuberculosis
MSIARCVGNTLLLNGRTYSPPYTI

SEQ ID NO: 1548327 - protein, 26 aa, Mycobacterium tuberculosis
MVVNLLPYQILQPWVDAAFKKRGIDP

SEQ ID NO: 1548328 - protein, 23 aa, Mycobacterium tuberculosis
NANLGGGNWGFANLGSGNIGNTN

SEQ ID NO: 1548329 - protein, 26 aa, Mycobacterium tuberculosis
NAPFRSALGRPLIGNGANGKPGTGQD

SEQ ID NO: 1548330 - protein, 20 aa, Mycobacterium tuberculosis
NGGAGGLIWGTAGTGGNGGF

SEQ ID NO: 1548331 - protein, 23 aa, Mycobacterium tuberculosis
NGGAGGNGGWLYGSGGNGGAGGA

SEQ ID NO: 1548332 - protein, 19 aa, Mycobacterium tuberculosis
NGGDGGWLIGNGGAGGSGA

SEQ ID NO: 1548333 - protein, 18 aa, Mycobacterium tuberculosis
NKAFACQYAMQFIAVLRG

SEQ ID NO: 1548334 - protein, 18 aa, Mycobacterium tuberculosis
NNFPGASVPFGMVQYSPD

SEQ ID NO: 1548335 - protein, 27 aa, Mycobacterium tuberculosis
NNREVRWRPEHFWKPGTAVDVAVNTYG

SEQ ID NO: 1548336 - protein, 23 aa, Mycobacterium tuberculosis
NPPEVKSVGLGNVNGVTLGYTSG

SEQ ID NO: 1548337 - protein, 23 aa, Mycobacterium tuberculosis
NRLAELWSIMDFLNPGLLGSSER

SEQ ID NO: 1548338 - protein, 19 aa, Mycobacterium tuberculosis
NVSNLRTGKLVRIAGVEVG

SEQ ID NO: 1548339 - protein, 18 aa, Mycobacterium tuberculosis
PAGSLWRLEFLLQSTQDP

SEQ ID NO: 1548340 - protein, 20 aa, Mycobacterium tuberculosis
PAIPDRSDVVWLEHEDNHES

SEQ ID NO: 1548341 - protein, 18 aa, Mycobacterium tuberculosis
PAVPNGQPVKGRLTVPPS

SEQ ID NO: 1548342 - protein, 17 aa, Mycobacterium tuberculosis
PDHSIDVAFAIDRSYTL

SEQ ID NO: 1548343 - protein, 32 aa, Mycobacterium tuberculosis
PDSSGLPLRAMVMVLLFLGVVFLLLVWQALGS

SEQ ID NO: 1548344 - protein, 17 aa, Mycobacterium tuberculosis
PGMSLFDIHELVNIGPF

SEQ ID NO: 1548345 - protein, 23 aa, Mycobacterium tuberculosis
PGQPGAAGGLLFGNGGNGAAGGF

SEQ ID NO: 1548346 - protein, 19 aa, Mycobacterium tuberculosis
PLHTLKQQALAAINAPTQT

SEQ ID NO: 1548347 - protein, 21 aa, Mycobacterium tuberculosis
PPGHKWARRSRVVSARELAQT

SEQ ID NO: 1548348 - protein, 21 aa, Mycobacterium tuberculosis
PPTGPHWRLLSAVKELDPSWA

SEQ ID NO: 1548349 - protein, 20 aa, Mycobacterium tuberculosis
PPTPSRVGISSVLKIGRDLY

SEQ ID NO: 1548350 - protein, 18 aa, Mycobacterium tuberculosis
PQAGRPRGWPEWAEPDVV

SEQ ID NO: 1548351 - protein, 21 aa, Mycobacterium tuberculosis
PRSNLARYGIAPTYPGDFAAD

SEQ ID NO: 1548352 - protein, 19 aa, Mycobacterium tuberculosis
PTQPRSITLTFIRNAQSQA

SEQ ID NO: 1548353 - protein, 20 aa, Mycobacterium tuberculosis
QAAAVHAQFVEALSAGAGAY

SEQ ID NO: 1548354 - protein, 22 aa, Mycobacterium tuberculosis
QLPCLPILFIVVDEFSELLSQH

SEQ ID NO: 1548355 - protein, 37 aa, Mycobacterium tuberculosis; identical to SEQ ID NO: 234076

SEQ ID NO: 1548356 - protein, 18 aa, Mycobacterium tuberculosis
QRDGKFAFDNPGAIEAFR

SEQ ID NO: 1548357 - protein, 21 aa, Mycobacterium tuberculosis
QTLTGRPLIGNGTPGAVGSGA

SEQ ID NO: 1548358 - protein, 43 aa, Mycobacterium tuberculosis
QVAAFHEQFVQALTAAAGRYASTEAAVERSLLGAVNAPTEALL

SEQ ID NO: 1548359 - protein, 31 aa, Mycobacterium tuberculosis; identical to SEQ ID NO: 234108

SEQ ID NO: 1548360 - protein, 20 aa, Mycobacterium tuberculosis
RARRDLNWRPRFDLNAVAAR

SEQ ID NO: 1548361 - protein, 24 aa, Mycobacterium tuberculosis
RDFTLPGERIHVVFRSDESGTTDN

SEQ ID NO: 1548362 - protein, 24 aa, Mycobacterium tuberculosis
REDLPSAIYHRFGRVHTYAKARKT

SEQ ID NO: 1548363 - protein, 24 aa, Mycobacterium tuberculosis
RFQSGDGPPIFLLSLKAGGTGLNL

SEQ ID NO: 1548364 - protein, 20 aa, Mycobacterium tuberculosis
RHCRRIAVLAAVSIAATVVA

SEQ ID NO: 1548365 - protein, 18 aa, Mycobacterium tuberculosis
RLAVVAGTAAAVTTPGLL

SEQ ID NO: 1548366 - protein, 20 aa, Mycobacterium tuberculosis
RMGRPTIAVNANFFDVRGQK

SEQ ID NO: 1548367 - protein, 17 aa, Mycobacterium tuberculosis
RNQFLAGKMALFQSGTY

SEQ ID NO: 1548368 - protein, 26 aa, Mycobacterium tuberculosis
RNVTHGCINLSPANAKWFYDNFGSGD

SEQ ID NO: 1548369 - protein, 18 aa, Mycobacterium tuberculosis
RQAGHTVAPFKVGPDFID

SEQ ID NO: 1548370 - protein, 31 aa, Mycobacterium tuberculosis; identical to SEQ ID NO: 210048

SEQ ID NO: 1548371 - protein, 24 aa, Mycobacterium tuberculosis
RSDPSRPVACIVRVRATNGSETGR

SEQ ID NO: 1548372 - protein, 23 aa, Mycobacterium tuberculosis
RVMRHRAWQGLVLLVLALLLSSC

SEQ ID NO: 1548373 - protein, 19 aa, Mycobacterium tuberculosis
RVQRPLWASTGVKNPDYSD

SEQ ID NO: 1548374 - protein, 25 aa, Mycobacterium tuberculosis
RVRAKRPDGDWGPWYQTEYETEPRD

SEQ ID NO: 1548375 - protein, 24 aa, Mycobacterium tuberculosis
RVVFAGAYHGWGFHEDGAASGLRA

SEQ ID NO: 1548376 - protein, 18 aa, Mycobacterium tuberculosis
SAEPCPDVEVVFARGTGE

SEQ ID NO: 1548377 - protein, 17 aa, Mycobacterium tuberculosis
SAQAAAVHAQFVEALSA

SEQ ID NO: 1548378 - protein, 38 aa, Mycobacterium tuberculosis; identical to SEQ ID NO: 234924

SEQ ID NO: 1548379 - protein, 20 aa, Mycobacterium tuberculosis
SEDAKFVYVDGHLYSDLGQP

SEQ ID NO: 1548380 - protein, 20 aa, Mycobacterium tuberculosis
SEWNAALSRIAVAGRGPGDV

SEQ ID NO: 1548381 - protein, 24 aa, Mycobacterium tuberculosis
SGATGAPGGWLLGDGGAGGSGAAG

SEQ ID NO: 1548382 - protein, 21 aa, Mycobacterium tuberculosis
SGEGCVVLLLKRLPDAVRDGD

SEQ ID NO: 1548383 - protein, 27 aa, Mycobacterium tuberculosis
SGGAGGAGGFGFLGGDGGAGGNAGLLL

SEQ ID NO: 1548384 - protein, 26 aa, Mycobacterium tuberculosis
SGNQARLKLAIDSGEMGFIPSNATVR

SEQ ID NO: 1548385 - protein, 22 aa, Mycobacterium tuberculosis
SGPFFKAMVVNLLPYQILQPWV

SEQ ID NO: 1548386 - protein, 26 aa, Mycobacterium tuberculosis
SGTPRASGPAGMTGMPMVPPGALGAG

SEQ ID NO: 1548387 - protein, 17 aa, Mycobacterium tuberculosis
SIGPLGLAGRQSSQSVP

SEQ ID NO: 1548388 - protein, 17 aa, Mycobacterium tuberculosis
SLPRGDLAAAIYTTIED

SEQ ID NO: 1548389 - protein, 19 aa, Mycobacterium tuberculosis
SSEVIRALDELDFGGIVEM

SEQ ID NO: 1548390 - protein, 19 aa, Mycobacterium tuberculosis
SSSDLRVGQPVLAIGSPLG

SEQ ID NO: 1548391 - protein, 23 aa, Mycobacterium tuberculosis
SYGLGIVISGHWLLQNPMFAGYA

SEQ ID NO: 1548392 - protein, 19 aa, Mycobacterium tuberculosis
TALDAARARLATFQTAVNK

SEQ ID NO: 1548393 - protein, 21 aa, Mycobacterium tuberculosis
TDGQWGGAMLVVAKSTVSDVD

SEQ ID NO: 1548394 - protein, 30 aa, Mycobacterium tuberculosis; identical to SEQ ID NO: 234327

SEQ ID NO: 1548395 - protein, 19 aa, Mycobacterium tuberculosis
TGAGYWVAHGALGGITISQ

SEQ ID NO: 1548396 - protein, 21 aa, Mycobacterium tuberculosis
TGATGGTGFSGGAGGAGGAGG

SEQ ID NO: 1548397 - protein, 28 aa, Mycobacterium tuberculosis
TGGAGGPGGLIWGGGGAGGVGGAGGGTG

SEQ ID NO: 1548398 - protein, 25 aa, Mycobacterium tuberculosis
TGKFEWLDNDVVQWVPDRFWPAHST

SEQ ID NO: 1548399 - protein, 23 aa, Mycobacterium tuberculosis
TGQPGGAGGLLWGNGGNGGSGAA

SEQ ID NO: 1548400 - protein, 17 aa, Mycobacterium tuberculosis
THYFDNFFLDATRAGIR

SEQ ID NO: 1548401 - protein, 19 aa, Mycobacterium tuberculosis
TKGIPFGSVVTFVVRAGNP

SEQ ID NO: 1548402 - protein, 23 aa, Mycobacterium tuberculosis
TKSICPVCKVVVDAQVNIRHDKV

SEQ ID NO: 1548403 - protein, 19 aa, Mycobacterium tuberculosis
TPAFEWYDQSGLSVVMPVG

SEQ ID NO: 1548404 - protein, 20 aa, Mycobacterium tuberculosis
TPHAIALVLQQLVLGNALPP

SEQ ID NO: 1548405 - protein, 28 aa, Mycobacterium tuberculosis
TTNPPVEGAFYWLNNREVRWRPEHFWKP

SEQ ID NO: 1548406 - protein, 32 aa, Mycobacterium tuberculosis; identical to SEQ ID NO: 1492700

SEQ ID NO: 1548407 - protein, 21 aa, Mycobacterium tuberculosis
TYPTLCRLFAELGVATQESEM

SEQ ID NO: 1548408 - protein, 19 aa, Mycobacterium tuberculosis
VADQGKRNVTHGCINLSPA

SEQ ID NO: 1548409 - protein, 18 aa, Mycobacterium tuberculosis
VAPGYIWGDTLKSYFDHQ

SEQ ID NO: 1548410 - protein, 27 aa, Mycobacterium tuberculosis
VGADFGASIYAEYRLSTTVRKAANLRS

SEQ ID NO: 1548411 - protein, 18 aa, Mycobacterium tuberculosis
VGFAMIVGVLVAAATPII

SEQ ID NO: 1548412 - protein, 23 aa, Mycobacterium tuberculosis
VGKLTPGFHGLHIHQVGKCEPNS

SEQ ID NO: 1548413 - protein, 21 aa, Mycobacterium tuberculosis
VKTVPTTVWIASDGSSHLVQI

SEQ ID NO: 1548414 - protein, 18 aa, Mycobacterium tuberculosis
VNQHDRLRVPIGVTPDGT

SEQ ID NO: 1548415 - protein, 25 aa, Mycobacterium tuberculosis
VNTHCNLDCPICFADSGHQPDGYAI

SEQ ID NO: 1548416 - protein, 18 aa, Mycobacterium tuberculosis
VPVVKVLAPGLVLSSASP

SEQ ID NO: 1548417 - protein, 25 aa, Mycobacterium tuberculosis
VPWWPWAPLVRLMWVLPPRLTRRFA

SEQ ID NO: 1548418 - protein, 25 aa, Mycobacterium tuberculosis
VRATADPAASGWEALSSALGGKVLQ

SEQ ID NO: 1548419 - protein, 21 aa, Mycobacterium tuberculosis
VTDDLRPGGPVMVETVSQAIA

SEQ ID NO: 1548420 - protein, 25 aa, Mycobacterium tuberculosis
VVFGDFRFGPTTVYHATFTDASRLK

SEQ ID NO: 1548421 - protein, 18 aa, Mycobacterium tuberculosis
WADEVYVFGYPRVPMTAE

SEQ ID NO: 1548422 - protein, 17 aa, Mycobacterium tuberculosis
WELAVGDDPLSEEEIAA

SEQ ID NO: 1548423 - protein, 23 aa, Mycobacterium tuberculosis
WGGRGVDARFGAAGGAAGAGGAG

SEQ ID NO: 1548424 - protein, 18 aa, Mycobacterium tuberculosis
WLRPRTVITGQRRWTLPA

SEQ ID NO: 1548425 - protein, 19 aa, Mycobacterium tuberculosis
WRDEFGLGLADPDQLGRRL

SEQ ID NO: 1548426 - protein, 18 aa, Mycobacterium tuberculosis
WTCMIPRQVAEELGQPLP

SEQ ID NO: 1548427 - protein, 17 aa, Mycobacterium tuberculosis
WTGDHHGLVGFSYSIEI

SEQ ID NO: 1548428 - protein, 24 aa, Mycobacterium tuberculosis
YAGALGARGLFACRQSLRPRYLCM

SEQ ID NO: 1548429 - protein, 17 aa, Mycobacterium tuberculosis
YDHVKRGDIVEVVNTVG

SEQ ID NO: 1548430 - protein, 17 aa, Mycobacterium tuberculosis
YILRRLKTDPAIIDDLP

SEQ ID NO: 1548431 - protein, 24 aa, Mycobacterium tuberculosis
YQQLGARAALFHEQFVQALTGAAS

SEQ ID NO: 1548432 - protein, 22 aa, Mycobacterium tuberculosis
YVHSAPWALPALGLENVSHGCI

SEQ ID NO: 1548433 - protein, 23 aa, Mycobacterium tuberculosis
YWGPPSKPGIILFRRAGAPAALA

SEQ ID NO: 1548434 - protein, 18 aa, Mycobacterium tuberculosis
AAAADVWRLLESADVLLA

SEQ ID NO: 1548435 - protein, 22 aa, Mycobacterium tuberculosis
AAALPLAGCSSTANPPAATTTP

SEQ ID NO: 1548436 - protein, 26 aa, Mycobacterium tuberculosis
AADEVSAAIAALFSSYARDYQTLSVQ

SEQ ID NO: 1548437 - protein, 26 aa, Mycobacterium tuberculosis
AADLTNRSTIRWTLHQMVASGVVSVY

SEQ ID NO: 1548438 - protein, 17 aa, Mycobacterium tuberculosis
AAENYGSVIARLTGMHW

SEQ ID NO: 1548439 - protein, 48 aa, Mycobacterium tuberculosis
AAGDEVSAAIAALFGTHAQEYQALSARVATFHEQFVRSLTAAGSAYAT

SEQ ID NO: 1548440 - protein, 17 aa, Mycobacterium tuberculosis
AAIEVAGTFALETQRRV

SEQ ID NO: 1548441 - protein, 22 aa, Mycobacterium tuberculosis
AALIDEPMFAKSVAAAATNSGT

SEQ ID NO: 1548442 - protein, 17 aa, Mycobacterium tuberculosis
AALYKKAFAPLNELAGS

SEQ ID NO: 1548443 - protein, 22 aa, Mycobacterium tuberculosis
AASDLGGIASMISEANAMAAVR

SEQ ID NO: 1548444 - protein, 21 aa, Mycobacterium tuberculosis
AAYPAAFPVGMLPTNQNDAGL

SEQ ID NO: 1548445 - protein, 23 aa, Mycobacterium tuberculosis
ADTPGLPKMGSFEVMNRTIDIAQ

SEQ ID NO: 1548446 - protein, 21 aa, Mycobacterium tuberculosis
AELGLRVCDWVDGDDPYGLVS

SEQ ID NO: 1548447 - protein, 26 aa, Mycobacterium tuberculosis
AERYGLRHRIRFGATVVSARFDDGRW

SEQ ID NO: 1548448 - protein, 25 aa, Mycobacterium tuberculosis
AFDRIDERLVVVGLDNTVTYKNGDP

SEQ ID NO: 1548449 - protein, 18 aa, Mycobacterium tuberculosis
AFTLGMVLTSTLMVRPVE

SEQ ID NO: 1548450 - protein, 27 aa, Mycobacterium tuberculosis
AGEPGRWSADRAHRWYQAHGWLVGANY

SEQ ID NO: 1548451 - protein, 20 aa, Mycobacterium tuberculosis
AGGAAGLWGTGGAGGAGGSS

SEQ ID NO: 1548452 - protein, 26 aa, Mycobacterium tuberculosis
AGGAGGAGGWIHGHGGAGGDGGAGGA

SEQ ID NO: 1548453 - protein, 22 aa, Mycobacterium tuberculosis
AGGAGGRLFGNGGAGGNGGTAG

SEQ ID NO: 1548454 - protein, 22 aa, Mycobacterium tuberculosis
AGGAGGWLSGNGGAGGNGGTGA

SEQ ID NO: 1548455 - protein, 26 aa, Mycobacterium tuberculosis
AGGNGGRGAVLFGHGGNAGHGGAGGN

SEQ ID NO: 1548456 - protein, 25 aa, Mycobacterium tuberculosis
AGIDDSWAALRWVGENAAELGGDPS

SEQ ID NO: 1548457 - protein, 17 aa, Mycobacterium tuberculosis
AGLWAALGAARRLDELA

SEQ ID NO: 1548458 - protein, 25 aa, Mycobacterium tuberculosis
AGSAPMLAASVAWDGLAAELAVAAS

SEQ ID NO: 1548459 - protein, 17 aa, Mycobacterium tuberculosis
AINRLRAPLKVTSDYSP

SEQ ID NO: 1548460 - protein, 18 aa, Mycobacterium tuberculosis
ALLGRPLIGNGADGTAPG

SEQ ID NO: 1548461 - protein, 29 aa, Mycobacterium tuberculosis
ALSLRDLLKFEFLFSGRAQFEKDLANEVL

SEQ ID NO: 1548462 - protein, 22 aa, Mycobacterium tuberculosis
ANGFDVGRRLGIGSRETYIPAL

SEQ ID NO: 1548463 - protein, 20 aa, Mycobacterium tuberculosis
ANNKIAFDRIDERLVVVGLD

SEQ ID NO: 1548464 - protein, 18 aa, Mycobacterium tuberculosis
APASASPLHTLKQQALAA

SEQ ID NO: 1548465 - protein, 17 aa, Mycobacterium tuberculosis
APGSFDGPDDWSANSVF

SEQ ID NO: 1548466 - protein, 25 aa, Mycobacterium tuberculosis
APTQALWGRPLIGNGADGTAANPNG

SEQ ID NO: 1548467 - protein, 23 aa, Mycobacterium tuberculosis
AQLRKAGLVISDRRGMHVFHRVH

SEQ ID NO: 1548468 - protein, 22 aa, Mycobacterium tuberculosis
ARFTQHLKLGYRDAVAVVDSAL

SEQ ID NO: 1548469 - protein, 25 aa, Mycobacterium tuberculosis
ASAASDLGGIASMISEANAMAAVRT

SEQ ID NO: 1548470 - protein, 18 aa, Mycobacterium tuberculosis
ASRILASFAPAIPDRSDV

SEQ ID NO: 1548471 - protein, 22 aa, Mycobacterium tuberculosis
ATAKFEFANGYATVTIATTGVG

SEQ ID NO: 1548472 - protein, 18 aa, Mycobacterium tuberculosis
ATLSVPFSAFPKPQNYPG

SEQ ID NO: 1548473 - protein, 26 aa, Mycobacterium tuberculosis
AVCLLTAFLLIAVFGEVRFGDGKTYY

SEQ ID NO: 1548474 - protein, 17 aa, Mycobacterium tuberculosis
AVRQKYDPSRVMFSGLN

SEQ ID NO: 1548475 - protein, 22 aa, Mycobacterium tuberculosis
DALRPMMRLVVTNGTAKEIAGC

SEQ ID NO: 1548476 - protein, 26 aa, Mycobacterium tuberculosis
DAPASTGLTGGTGFAGGAGGVGGQGG

SEQ ID NO: 1548477 - protein, 24 aa, Mycobacterium tuberculosis
DEVSAAIASLFSGYARDYQALSAQ

SEQ ID NO: 1548478 - protein, 22 aa, Mycobacterium tuberculosis
DGGGGLPPVPASPGGNGGGGDA

SEQ ID NO: 1548479 - protein, 25 aa, Mycobacterium tuberculosis
DGIPEVWPFAPAKHRAMLANLHPEE

SEQ ID NO: 1548480 - protein, 25 aa, Mycobacterium tuberculosis
DHPRPRLFSLLHEFVHVVLHTEGLC

SEQ ID NO: 1548481 - protein, 18 aa, Mycobacterium tuberculosis
DRDRLVVIIAGYSSDIDR

SEQ ID NO: 1548482 - protein, 29 aa, Mycobacterium tuberculosis
DVAQLCERAELAAHWLSHGRWTDGWDPHR

SEQ ID NO: 1548483 - protein, 20 aa, Mycobacterium tuberculosis
EAPPVPVAYSVNWDAIAQCE

SEQ ID NO: 1548484 - protein, 20 aa, Mycobacterium tuberculosis
EARCNAIAAAVLMPADVVRA

SEQ ID NO: 1548485 - protein, 19 aa, Mycobacterium tuberculosis
EARQALAAAPELQFKPGTR

SEQ ID NO: 1548486 - protein, 20 aa, Mycobacterium tuberculosis
EFLTAAAMDLASIGSTVSAA

SEQ ID NO: 1548487 - protein, 21 aa, Mycobacterium tuberculosis
EPEMPAPCPTQRPPVTPRHNL

SEQ ID NO: 1548488 - protein, 27 aa, Mycobacterium tuberculosis
EQAVQRSVVLSSGWDIMDFVRQLQKLA

SEQ ID NO: 1548489 - protein, 19 aa, Mycobacterium tuberculosis
EVLAAAASDLAGIGSTLAQ

SEQ ID NO: 1548490 - protein, 23 aa, Mycobacterium tuberculosis
FASGRVAYTLGLHGPAVTVDTAC

SEQ ID NO: 1548491 - protein, 24 aa, Mycobacterium tuberculosis
FDIHELVNIGPFRIEPIDVPAVVL

SEQ ID NO: 1548492 - protein, 17 aa, Mycobacterium tuberculosis
FEDGGWVWFDITTDTAV

SEQ ID NO: 1548493 - protein, 19 aa, Mycobacterium tuberculosis
FGNGLLTLPTSVNVVTSSS

SEQ ID NO: 1548494 - protein, 18 aa, Mycobacterium tuberculosis
FLTQNFGPVIGTGTAGYA

SEQ ID NO: 1548495 - protein, 17 aa, Mycobacterium tuberculosis
FNIKVIAGAGLFAAAIA

SEQ ID NO: 1548496 - protein, 22 aa, Mycobacterium tuberculosis
FSDNLPSCITKYIPLHTPAVVM

SEQ ID NO: 1548497 - protein, 27 aa, Mycobacterium tuberculosis
FSIEPGIYFPGRWGARIEDIVIVTEDG

SEQ ID NO: 1548498 - protein, 26 aa, Mycobacterium tuberculosis
GAAGGLGGNGGWLYGNGGAGGIGGAG

SEQ ID NO: 1548499 - protein, 26 aa, Mycobacterium tuberculosis
GADEVSAAIASLFGAHGQAYQAVSAQ

SEQ ID NO: 1548500 - protein, 49 aa, Mycobacterium tuberculosis; identical to SEQ ID NO: 233458

SEQ ID NO: 1548501 - protein, 25 aa, Mycobacterium tuberculosis
GADEVSAAVAALFSAHAGQYQQLGA

SEQ ID NO: 1548502 - protein, 29 aa, Mycobacterium tuberculosis
GADEVSLAISALFGQHAQAYQALSAQATI

SEQ ID NO: 1548503 - protein, 25 aa, Mycobacterium tuberculosis
GADEVSTAIAALFGAQGQAYQAASA

SEQ ID NO: 1548504 - protein, 29 aa, Mycobacterium tuberculosis
GADGLPGQNGGAGGLLWGNGGNGGAGDAA

SEQ ID NO: 1548505 - protein, 21 aa, Mycobacterium tuberculosis
GAGGAAGLWGSGGSGGQGGNG

SEQ ID NO: 1548506 - protein, 25 aa, Mycobacterium tuberculosis
GAGGAGGDAGMFFGSGGSGGAGGIS

SEQ ID NO: 1548507 - protein, 23 aa, Mycobacterium tuberculosis
GAGGKSGAFGLGGDGGAGGATGL

SEQ ID NO: 1548508 - protein, 20 aa, Mycobacterium tuberculosis
GARGYAHIGVIQALRERGYD

SEQ ID NO: 1548509 - protein, 21 aa, Mycobacterium tuberculosis
GERARTAIDAALARVGTTQEG

SEQ ID NO: 1548510 - protein, 17 aa, Mycobacterium tuberculosis
GFGGVEGLRGWLREERI

SEQ ID NO: 1548511 - protein, 25 aa, Mycobacterium tuberculosis
GFYNFGSAMSGWWNQAHSAAAGAGS

SEQ ID NO: 1548512 - protein, 19 aa, Mycobacterium tuberculosis
GGAAGLWGGGGAGGVGGTG

SEQ ID NO: 1548513 - protein, 27 aa, Mycobacterium tuberculosis
GGADALRYPARYLFVFLDHHGMLSVFG

SEQ ID NO: 1548514 - protein, 25 aa, Mycobacterium tuberculosis
GGAGGAAGWLYGSGGAGGAGGAGGL

SEQ ID NO: 1548515 - protein, 24 aa, Mycobacterium tuberculosis
GGAGGNAGMLFGAAGVGGVGGFSN

SEQ ID NO: 1548516 - protein, 24 aa, Mycobacterium tuberculosis
GGAGGSGGWLYGNGGNGGIGGNAI

SEQ ID NO: 1548517 - protein, 23 aa, Mycobacterium tuberculosis
GGAGGTGGWLYGGGGAAGSGGDG

SEQ ID NO: 1548518 - protein, 26 aa, Mycobacterium tuberculosis
GGDGGEGASGLGLGLSGFDGGQGGQG

SEQ ID NO: 1548519 - protein, 17 aa, Mycobacterium tuberculosis
GGEHVVATAGKGGTGGV

SEQ ID NO: 1548520 - protein, 25 aa, Mycobacterium tuberculosis
GGFGGPGLAGGLFGNPGNGGVGGIG

SEQ ID NO: 1548521 - protein, 24 aa, Mycobacterium tuberculosis
GGGDAGGAAGMFGTGGAGGTGGDG

SEQ ID NO: 1548522 - protein, 22 aa, Mycobacterium tuberculosis
GGIGGAGGLLFGSGGAGGSGGF

SEQ ID NO: 1548523 - protein, 25 aa, Mycobacterium tuberculosis
GGKGGDTPNGLAINPGIGGNGGDTG

SEQ ID NO: 1548524 - protein, 22 aa, Mycobacterium tuberculosis
GGMPMMLMPMSISGAGAGMPGG

SEQ ID NO: 1548525 - protein, 18 aa, Mycobacterium tuberculosis
GGNAGMLAGPGGAGGAGG

SEQ ID NO: 1548526 - protein, 19 aa, Mycobacterium tuberculosis
GGPPLVFQLLWYPTTMADL

SEQ ID NO: 1548527 - protein, 26 aa, Mycobacterium tuberculosis
GGRGGDGGSAGWLSGNGGDAGNGGGG

SEQ ID NO: 1548528 - protein, 26 aa, Mycobacterium tuberculosis
GGVGGHGSALFGHGGINGDGGTGGMG

SEQ ID NO: 1548529 - protein, 24 aa, Mycobacterium tuberculosis
GGVGGPAGLWGHGGAGGAGGAGVA

SEQ ID NO: 1548530 - protein, 19 aa, Mycobacterium tuberculosis
GKGGAGLIAGLDGAGGAGG

SEQ ID NO: 1548531 - protein, 18 aa, Mycobacterium tuberculosis
GKVDKDWDADATKGIPFG

SEQ ID NO: 1548532 - protein, 21 aa, Mycobacterium tuberculosis
GKVKADLGVDVFRRMVGDDFT

SEQ ID NO: 1548533 - protein, 17 aa, Mycobacterium tuberculosis
GLAEYFVHRTGHGIGLC

SEQ ID NO: 1548534 - protein, 21 aa, Mycobacterium tuberculosis
GLDVADGARLVDSIEGEPGLG

SEQ ID NO: 1548535 - protein, 23 aa, Mycobacterium tuberculosis
GLSARPVIEQALLDNGVETRTGV

SEQ ID NO: 1548536 - protein, 24 aa, Mycobacterium tuberculosis
GSAGIGGAGGRGGDGGDGASGLGL

SEQ ID NO: 1548537 - protein, 25 aa, Mycobacterium tuberculosis
GSDAWDRLFAGPRPTELHPFVELTG

SEQ ID NO: 1548538 - protein, 21 aa, Mycobacterium tuberculosis
GSFDGPDDWSANSVFGLPALG

SEQ ID NO: 1548539 - protein, 24 aa, Mycobacterium tuberculosis
GSGADNPTGAGFAGGAGGTGGAAG

SEQ ID NO: 1548540 - protein, 23 aa, Mycobacterium tuberculosis
GSQWPGMGTELLVAEPVFAATVA

SEQ ID NO: 1548541 - protein, 23 aa, Mycobacterium tuberculosis
GTAGYAGGLTYNYNTYSTTVDFG

SEQ ID NO: 1548542 - protein, 22 aa, Mycobacterium tuberculosis
GTYKMAKSVLLAMSHSLATELG

SEQ ID NO: 1548543 - protein, 20 aa, Mycobacterium tuberculosis
GVAGVSFGNAVGGDGGNGGN

SEQ ID NO: 1548544 - protein, 20 aa, Mycobacterium tuberculosis
GVDWKGTLTGLAGYASGDLD

SEQ ID NO: 1548545 - protein, 19 aa, Mycobacterium tuberculosis
HAAGRLDEFAHWAKSLTQR

SEQ ID NO: 1548546 - protein, 17 aa, Mycobacterium tuberculosis
HGLNAGGLFGVLTNVVW

SEQ ID NO: 1548547 - protein, 23 aa, Mycobacterium tuberculosis
HLGARLFSIIAWRTYLVRDPHAL

SEQ ID NO: 1548548 - protein, 23 aa, Mycobacterium tuberculosis
HLQMPVVGCGSALDRASSASRQR

SEQ ID NO: 1548549 - protein, 30 aa, Mycobacterium tuberculosis; identical to SEQ ID NO: 234753

SEQ ID NO: 1548550 - protein, 23 aa, Mycobacterium tuberculosis
HTFNYLDLVRYLAVGNLNPSPLG

SEQ ID NO: 1548551 - protein, 17 aa, Mycobacterium tuberculosis
IAIGGLYGDITYPVTSP

SEQ ID NO: 1548552 - protein, 19 aa, Mycobacterium tuberculosis
IDYFAEINLAGFYDLAQTL

SEQ ID NO: 1548553 - protein, 30 aa, Mycobacterium tuberculosis
IGGAGGNAGFGAGVPGDGGIGGTGGAGGAG

SEQ ID NO: 1548554 - protein, 17 aa, Mycobacterium tuberculosis
INTGNGYLGGLQFTQST

SEQ ID NO: 1548555 - protein, 18 aa, Mycobacterium tuberculosis
IPPRGTQAVVLKVYQNAG

SEQ ID NO: 1548556 - protein, 17 aa, Mycobacterium tuberculosis
IVSVVNWADCLVALQQR

SEQ ID NO: 1548557 - protein, 35 aa, Mycobacterium tuberculosis
KLEAQRPHGFKALDITLPMPPRWTQVPDPNVPDAF

SEQ ID NO: 1548558 - protein, 17 aa, Mycobacterium tuberculosis
LADALGVLPVLATDVLR

SEQ ID NO: 1548559 - protein, 28 aa, Mycobacterium tuberculosis
LANAKRWGVLHVIWRQGYYPGIGAPSWT

SEQ ID NO: 1548560 - protein, 25 aa, Mycobacterium tuberculosis
LAPVVLTSCTWRGIANVPLPVGRGM

SEQ ID NO: 1548561 - protein, 23 aa, Mycobacterium tuberculosis
LASSCTWQLSLFIPDGVPPPPGD

SEQ ID NO: 1548562 - protein, 17 aa, Mycobacterium tuberculosis
LATDVLRRLRMVKEETE

SEQ ID NO: 1548563 - protein, 19 aa, Mycobacterium tuberculosis
LFSSYARDYQTLSVQVTAF

SEQ ID NO: 1548564 - protein, 18 aa, Mycobacterium tuberculosis
LGLSGCSHPEFKRSSPPA

SEQ ID NO: 1548565 - protein, 19 aa, Mycobacterium tuberculosis
LGLSGCSHPEFKRSSPPAP

SEQ ID NO: 1548566 - protein, 34 aa, Mycobacterium tuberculosis; identical to SEQ ID NO: 234793

SEQ ID NO: 1548567 - protein, 17 aa, Mycobacterium tuberculosis
LGSHPKGAVSALLSAAR

SEQ ID NO: 1548568 - protein, 18 aa, Mycobacterium tuberculosis
LGVLPVLATDVLRRLRMV

SEQ ID NO: 1548569 - protein, 23 aa, Mycobacterium tuberculosis
LHHPRIPPIAGLDDFRGTVFHSA

SEQ ID NO: 1548570 - protein, 23 aa, Mycobacterium tuberculosis
LLEQSPPIWWTHIAGHGDAADLA

SEQ ID NO: 1548571 - protein, 26 aa, Mycobacterium tuberculosis
LLESADVLLAHLVLRPFLDAYHIVAD

SEQ ID NO: 1548572 - protein, 17 aa, Mycobacterium tuberculosis
LLRAMICQLAVWHSPEE

SEQ ID NO: 1548573 - protein, 19 aa, Mycobacterium tuberculosis
LLVACVPGLLMLATLGLGR

SEQ ID NO: 1548574 - protein, 23 aa, Mycobacterium tuberculosis
LNAGGLFGVLTNVVWTNHGPCAI

SEQ ID NO: 1548575 - protein, 25 aa, Mycobacterium tuberculosis
LNGPFQALFGRPLIGDGANGAPGQP

SEQ ID NO: 1548576 - protein, 17 aa, Mycobacterium tuberculosis
LPAWAESSTSHYVQTKD

SEQ ID NO: 1548577 - protein, 18 aa, Mycobacterium tuberculosis
LPAWAESSTSHYVQTKDP

SEQ ID NO: 1548578 - protein, 17 aa, Mycobacterium tuberculosis
LPGAAGLNGGDGSDGGN

SEQ ID NO: 1548579 - protein, 19 aa, Mycobacterium tuberculosis
LPLPTPVGMEIMPPQPPLP

SEQ ID NO: 1548580 - protein, 23 aa, Mycobacterium tuberculosis
LPSGGFVPAGTTISVYTSDGQTL

SEQ ID NO: 1548581 - protein, 18 aa, Mycobacterium tuberculosis
LQQAPVMFDSGGINGTIP

SEQ ID NO: 1548582 - protein, 19 aa, Mycobacterium tuberculosis
LSSRIDPRAAGSFWELTTD

SEQ ID NO: 1548583 - protein, 18 aa, Mycobacterium tuberculosis
LTALVLPAAGAPAVVLPR

SEQ ID NO: 1548584 - protein, 17 aa, Mycobacterium tuberculosis
LTPGLMGLGNIGFGNAG

SEQ ID NO: 1548585 - protein, 17 aa, Mycobacterium tuberculosis
LVTGIRGAIVVETASAS

SEQ ID NO: 1548586 - protein, 22 aa, Mycobacterium tuberculosis
LVYVRLARPFIAFYNNCANAIL

SEQ ID NO: 1548587 - protein, 24 aa, Mycobacterium tuberculosis
MISEANAMAAVRTTALAPAAADEV

SEQ ID NO: 1548588 - protein, 20 aa, Mycobacterium tuberculosis
MRGMCLYFDELPVIVLNGSD

SEQ ID NO: 1548589 - protein, 24 aa, Mycobacterium tuberculosis
MYEQMWAADVAAMVGYHGGASAAA

SEQ ID NO: 1548590 - protein, 19 aa, Mycobacterium tuberculosis
NAGVALSVGSTGGLGGNGG

SEQ ID NO: 1548591 - protein, 24 aa, Mycobacterium tuberculosis
NGGHGGSAAKLFGDGGAGGAGGMG

SEQ ID NO: 1548592 - protein, 27 aa, Mycobacterium tuberculosis
NGGIGGKGGDAFATFAKAGNGGAGGNG

SEQ ID NO: 1548593 - protein, 21 aa, Mycobacterium tuberculosis
NGQPVKGRLTVPPSVPVKSAD

SEQ ID NO: 1548594 - protein, 24 aa, Mycobacterium tuberculosis
NGWTIPAQTPVTLGLSGGNDPFTF

SEQ ID NO: 1548595 - protein, 17 aa, Mycobacterium tuberculosis
NNIGFGLTGDNLVGIGA

SEQ ID NO: 1548596 - protein, 20 aa, Mycobacterium tuberculosis
NRHQLVSLVLSNLFGQNAPA

SEQ ID NO: 1548597 - protein, 21 aa, Mycobacterium tuberculosis
NRYFGGLVHGLWRGGIGTTWE

SEQ ID NO: 1548598 - protein, 17 aa, Mycobacterium tuberculosis
NTGRPLIGNGANGAPGT

SEQ ID NO: 1548599 - protein, 26 aa, Mycobacterium tuberculosis
NYGSVIARLTGMHWWGPASTSMLAMS

SEQ ID NO: 1548600 - protein, 23 aa, Mycobacterium tuberculosis
PAKMLRLNAGLGNVGNYNVGLGN

SEQ ID NO: 1548601 - protein, 17 aa, Mycobacterium tuberculosis
PAMRTLIAFGGKYPTSV

SEQ ID NO: 1548602 - protein, 20 aa, Mycobacterium tuberculosis
PASTIKVLLALVALDELDLN

SEQ ID NO: 1548603 - protein, 24 aa, Mycobacterium tuberculosis
PASYDASLRVSWRQLQPTDPRTLP

SEQ ID NO: 1548604 - protein, 35 aa, Mycobacterium tuberculosis; identical to SEQ ID NO: 233978

SEQ ID NO: 1548605 - protein, 25 aa, Mycobacterium tuberculosis
PDRSGLPVVVSVVGLVHTPGLVTLA

SEQ ID NO: 1548606 - protein, 22 aa, Mycobacterium tuberculosis
PDSEAMLLAAIYVAALRSYGFA

SEQ ID NO: 1548607 - protein, 20 aa, Mycobacterium tuberculosis
PGQNGGAGGLLWGNGGNGGA

SEQ ID NO: 1548608 - protein, 22 aa, Mycobacterium tuberculosis
PLQALEQQVLGAINAPTQLWLG

SEQ ID NO: 1548609 - protein, 25 aa, Mycobacterium tuberculosis
PPARYFGPNLSRLSAVRQKYDPSRV

SEQ ID NO: 1548610 - protein, 18 aa, Mycobacterium tuberculosis
PPPFRPPTFNPVDGAMVG

SEQ ID NO: 1548611 - protein, 17 aa, Mycobacterium tuberculosis
PQVAALFLAGHLGARLF

SEQ ID NO: 1548612 - protein, 17 aa, Mycobacterium tuberculosis
PRFYSVILVVPFGPSSH

SEQ ID NO: 1548613 - protein, 33 aa, Mycobacterium tuberculosis; identical to SEQ ID NO: 234031

SEQ ID NO: 1548614 - protein, 23 aa, Mycobacterium tuberculosis
PSHDWPDRVLRVTAIDIATGELV

SEQ ID NO: 1548615 - protein, 25 aa, Mycobacterium tuberculosis
PTQTLFGRPLIGDGANGTAENPDGQ

SEQ ID NO: 1548616 - protein, 23 aa, Mycobacterium tuberculosis
QGWLVKGRSDTRLYYTPEDPTYD

SEQ ID NO: 1548617 - protein, 23 aa, Mycobacterium tuberculosis
QHASMLFLPVRILTSPITTLASM

SEQ ID NO: 1548618 - protein, 17 aa, Mycobacterium tuberculosis
QKAMAFAAANNLKVAPR

SEQ ID NO: 1548619 - protein, 40 aa, Mycobacterium tuberculosis; identical to SEQ ID NO: 234882

SEQ ID NO: 1548620 - protein, 23 aa, Mycobacterium tuberculosis
QTLVGRPLIGDGTHGAPGTGQNG

SEQ ID NO: 1548621 - protein, 17 aa, Mycobacterium tuberculosis
QVTAFHVQFAQTLTNAG

SEQ ID NO: 1548622 - protein, 22 aa, Mycobacterium tuberculosis
RAAMPNTVWTTGCDSWYLNKDG

SEQ ID NO: 1548623 - protein, 25 aa, Mycobacterium tuberculosis
RATHSRLATFALALAAAALPLAGCS

SEQ ID NO: 1548624 - protein, 19 aa, Mycobacterium tuberculosis
RAVAELALLAAAETTTNGS

SEQ ID NO: 1548625 - protein, 18 aa, Mycobacterium tuberculosis
REPLRVEGEVSYRVPSLS

SEQ ID NO: 1548626 - protein, 20 aa, Mycobacterium tuberculosis
RGLLRAMICQLAVWHSPEEL

SEQ ID NO: 1548627 - protein, 17 aa, Mycobacterium tuberculosis
RHHRARASWNYLVTPGQ

SEQ ID NO: 1548628 - protein, 20 aa, Mycobacterium tuberculosis
RHHRRPRPPVLSLASTGASA

SEQ ID NO: 1548629 - protein, 18 aa, Mycobacterium tuberculosis
RHRARPRPGSHAGVGCLR

SEQ ID NO: 1548630 - protein, 19 aa, Mycobacterium tuberculosis
RHRARPRPGSHAGVGCLRA

SEQ ID NO: 1548631 - protein, 17 aa, Mycobacterium tuberculosis
RLATFQTAVNKVAAATY

SEQ ID NO: 1548632 - protein, 20 aa, Mycobacterium tuberculosis
RLVKAGKVDKDWDADATKGI

SEQ ID NO: 1548633 - protein, 20 aa, Mycobacterium tuberculosis
RMGALALHVAKIARRRHPQH

SEQ ID NO: 1548634 - protein, 19 aa, Mycobacterium tuberculosis
RNAFVQLVLSNLFGQNAPA

SEQ ID NO: 1548635 - protein, 20 aa, Mycobacterium tuberculosis
RNVHIRPGVPPLVIAAPVEL

SEQ ID NO: 1548636 - protein, 18 aa, Mycobacterium tuberculosis
RPMPPEVADHVAAVTLFG

SEQ ID NO: 1548637 - protein, 24 aa, Mycobacterium tuberculosis
RPYQQRGLAWLAFLSSLGLGSCLA

SEQ ID NO: 1548638 - protein, 26 aa, Mycobacterium tuberculosis
RQRENLSWSAPRLHLVDLQYSDVRLD

SEQ ID NO: 1548639 - protein, 19 aa, Mycobacterium tuberculosis
RRLSTLGIVPVEVYRQRRA

SEQ ID NO: 1548640 - protein, 18 aa, Mycobacterium tuberculosis
RRSDAPRLVDLVRRAQAS

SEQ ID NO: 1548641 - protein, 18 aa, Mycobacterium tuberculosis
RSDIVTVVIGADKWREQL

SEQ ID NO: 1548642 - protein, 23 aa, Mycobacterium tuberculosis
RSDPSRPVACIVRVRATNGSETG

SEQ ID NO: 1548643 - protein, 20 aa, Mycobacterium tuberculosis
RTAQWVLPWPNPRYSKLARV

SEQ ID NO: 1548644 - protein, 19 aa, Mycobacterium tuberculosis
RVNSVAPGYIWGDTLKSYF

SEQ ID NO: 1548645 - protein, 20 aa, Mycobacterium tuberculosis
RVPDRLAVVRVETGESLYDV

SEQ ID NO: 1548646 - protein, 17 aa, Mycobacterium tuberculosis
RVRDPRLRRALTPDYEP

SEQ ID NO: 1548647 - protein, 18 aa, Mycobacterium tuberculosis
SAFPKPQNYPGLPTVSFV

SEQ ID NO: 1548648 - protein, 20 aa, Mycobacterium tuberculosis
SALASLPSGGFVPAGTTISV

SEQ ID NO: 1548649 - protein, 25 aa, Mycobacterium tuberculosis
SAQAAMFHEQFVRALAAGGNSYAVA

SEQ ID NO: 1548650 - protein, 20 aa, Mycobacterium tuberculosis
SAQMARFHQQFVQALTASVG

SEQ ID NO: 1548651 - protein, 21 aa, Mycobacterium tuberculosis
SARAAAFHHEFVQALAAGAGS

SEQ ID NO: 1548652 - protein, 25 aa, Mycobacterium tuberculosis
SATDHPDLFWALRGGGGGNFGVTTS

SEQ ID NO: 1548653 - protein, 19 aa, Mycobacterium tuberculosis
SCAEGGVLGIICASVASVM

SEQ ID NO: 1548654 - protein, 20 aa, Mycobacterium tuberculosis
SGDRVIPQWVKIRNVDGFNG

SEQ ID NO: 1548655 - protein, 25 aa, Mycobacterium tuberculosis
SGERLAAATVVWCAGMRASRLTEQL

SEQ ID NO: 1548656 - protein, 19 aa, Mycobacterium tuberculosis
SGFAGLWAALGAARRLDEL

SEQ ID NO: 1548657 - protein, 19 aa, Mycobacterium tuberculosis
SGGAASMFAAPAAATAAVT

SEQ ID NO: 1548658 - protein, 18 aa, Mycobacterium tuberculosis
SGGANFNGGTGGTGGTGG

SEQ ID NO: 1548659 - protein, 17 aa, Mycobacterium tuberculosis
SGNVGWANMGLGNIGFG

SEQ ID NO: 1548660 - protein, 19 aa, Mycobacterium tuberculosis
SKIRCALVPLIPKEDTAAR

SEQ ID NO: 1548661 - protein, 23 aa, Mycobacterium tuberculosis
SPLQALEQQVLAAINAPTQTLLG

SEQ ID NO: 1548662 - protein, 24 aa, Mycobacterium tuberculosis
SPSLRLARLRPALDAQEIHGAAAS

SEQ ID NO: 1548663 - protein, 18 aa, Mycobacterium tuberculosis
SQRVAVAVAVTYAPEAFD

SEQ ID NO: 1548664 - protein, 24 aa, Mycobacterium tuberculosis
SVDERLHHLFARMPDARVHLYGKA

SEQ ID NO: 1548665 - protein, 23 aa, Mycobacterium tuberculosis
SVRMGAAVTPYVEWLTTTAAQAR

SEQ ID NO: 1548666 - protein, 26 aa, Mycobacterium tuberculosis
SWQQALRGLPGLGQVASAISGGAASM

SEQ ID NO: 1548667 - protein, 25 aa, Mycobacterium tuberculosis
TAPSRSAFVAGPWGAVASLSPELFL

SEQ ID NO: 1548668 - protein, 26 aa, Mycobacterium tuberculosis
TAVKSCGYSDCKVLTSFTACGAVAAN

SEQ ID NO: 1548669 - protein, 24 aa, Mycobacterium tuberculosis
TEFNRGRVGMMGAVVTVLVVGVAQ

SEQ ID NO: 1548670 - protein, 20 aa, Mycobacterium tuberculosis
TEFNSQFSAAVRKIYDSGHN

SEQ ID NO: 1548671 - protein, 27 aa, Mycobacterium tuberculosis
TGANGGAGGNAWLFGAGGSGGAGTNGG

SEQ ID NO: 1548672 - protein, 24 aa, Mycobacterium tuberculosis
TGGAGGSGAWLYGNGGAAGAGGNG

SEQ ID NO: 1548673 - protein, 25 aa, Mycobacterium tuberculosis
TGGNGGRGGLLVGNGGAGGAGGVGG

SEQ ID NO: 1548674 - protein, 21 aa, Mycobacterium tuberculosis
TGGSAGWLSGNGGAGGSGGSA

SEQ ID NO: 1548675 - protein, 25 aa, Mycobacterium tuberculosis
TGLSGAFHIGGKGGVGGSAVLIGNG

SEQ ID NO: 1548676 - protein, 17 aa, Mycobacterium tuberculosis
TGNWGVFNSGSYNTGIG

SEQ ID NO: 1548677 - protein, 24 aa, Mycobacterium tuberculosis
TGQNGGAGGILWGNGGNGGSGAPG

SEQ ID NO: 1548678 - protein, 19 aa, Mycobacterium tuberculosis
TLLGRPLIGNGADGLPGQN

SEQ ID NO: 1548679 - protein, 18 aa, Mycobacterium tuberculosis
TPAVTSFIAPLVAMVGGG

SEQ ID NO: 1548680 - protein, 25 aa, Mycobacterium tuberculosis
TQALLGRPLIGNGADGTAANPNGGA

SEQ ID NO: 1548681 - protein, 27 aa, Mycobacterium tuberculosis
TQTLLGRPLIGNGADGLPGQNGGAGGL

SEQ ID NO: 1548682 - protein, 19 aa, Mycobacterium tuberculosis
TRGAPTVRIRGFSLWGDVG

SEQ ID NO: 1548683 - protein, 17 aa, Mycobacterium tuberculosis
TVAQVWFQDEESAARAF

SEQ ID NO: 1548684 - protein, 27 aa, Mycobacterium tuberculosis
VAADLTRGCGPAGAAITAGPAVTANAA

SEQ ID NO: 1548685 - protein, 19 aa, Mycobacterium tuberculosis
VAGSARFTQHLKLGYRDAV

SEQ ID NO: 1548686 - protein, 19 aa, Mycobacterium tuberculosis
VALALGSGGARGYAHIGVI

SEQ ID NO: 1548687 - protein, 26 aa, Mycobacterium tuberculosis
VDDYLRVIGVPAMFAAGDVAAARMDD

SEQ ID NO: 1548688 - protein, 34 aa, Mycobacterium tuberculosis; identical to SEQ ID NO: 234425

SEQ ID NO: 1548689 - protein, 25 aa, Mycobacterium tuberculosis
VGALRDGGCNDVILVLGAVEVSAPA

SEQ ID NO: 1548690 - protein, 17 aa, Mycobacterium tuberculosis
VGAQAIVVSVDYRLAPE

SEQ ID NO: 1548691 - protein, 27 aa, Mycobacterium tuberculosis
VGGAGGRAGLFGVGGLGGAGGDAGDSG

SEQ ID NO: 1548692 - protein, 20 aa, Mycobacterium tuberculosis
VGGNARLLGTGGAGGVGGGG

SEQ ID NO: 1548693 - protein, 25 aa, Mycobacterium tuberculosis
VGIQFSDDFIEWSVSFSQKPFPPPC

SEQ ID NO: 1548694 - protein, 31 aa, Mycobacterium tuberculosis; identical to SEQ ID NO: 234458

SEQ ID NO: 1548695 - protein, 20 aa, Mycobacterium tuberculosis
VLINNAFRVPSMKPLAGTTF

SEQ ID NO: 1548696 - protein, 20 aa, Mycobacterium tuberculosis
VTAMPGLLNNGVLIDESAGI

SEQ ID NO: 1548697 - protein, 24 aa, Mycobacterium tuberculosis
VVIARGLSQRGVPFSWAGGGISGP

SEQ ID NO: 1548698 - protein, 18 aa, Mycobacterium tuberculosis
VWFQRGPLDAAIRASIAI

SEQ ID NO: 1548699 - protein, 24 aa, Mycobacterium tuberculosis
VWLATVCLVASCANADPLGSATGS

SEQ ID NO: 1548700 - protein, 18 aa, Mycobacterium tuberculosis
VYAGTGWTAMRGQRLDDS

SEQ ID NO: 1548701 - protein, 18 aa, Mycobacterium tuberculosis
WEPPMFEMDTTGLASGNC

SEQ ID NO: 1548702 - protein, 18 aa, Mycobacterium tuberculosis
WLAEGVADFVARPKTPPP

SEQ ID NO: 1548703 - protein, 23 aa, Mycobacterium tuberculosis
WLATVCLVASCANADPLGSATGS

SEQ ID NO: 1548704 - protein, 17 aa, Mycobacterium tuberculosis
WMLSRASAMELLQAAGN

SEQ ID NO: 1548705 - protein, 29 aa, Mycobacterium tuberculosis
WMSPTQVRWRPFEFWPANTAVNIDAAGTK

SEQ ID NO: 1548706 - protein, 25 aa, Mycobacterium tuberculosis
WPASYDASLRVSWRQLQPTDPRTLP

SEQ ID NO: 1548707 - protein, 21 aa, Mycobacterium tuberculosis
WPVCGRGLSNATPREVLPASA

SEQ ID NO: 1548708 - protein, 22 aa, Mycobacterium tuberculosis
WRQGYYPGIGAPSWTADYGSET

SEQ ID NO: 1548709 - protein, 24 aa, Mycobacterium tuberculosis
WTRAKAAYFMIVFSGPIPDDKWLQ

SEQ ID NO: 1548710 - protein, 17 aa, Mycobacterium tuberculosis
WVDAAFKKRGIDPENFW

SEQ ID NO: 1548711 - protein, 30 aa, Mycobacterium tuberculosis; identical to SEQ ID NO: 235425

SEQ ID NO: 1548712 - protein, 31 aa, Mycobacterium tuberculosis; identical to SEQ ID NO: 235010

SEQ ID NO: 1548713 - protein, 26 aa, Mycobacterium tuberculosis
YEPMCKRLVMSGGFYRAIQRDDVELV

SEQ ID NO: 1548714 - protein, 23 aa, Mycobacterium tuberculosis
YEQMWAADVAAMVGYHGGASAAA

SEQ ID NO: 1548715 - protein, 20 aa, Mycobacterium tuberculosis
YFAQGELLPSFVGACQAQVP

SEQ ID NO: 1548716 - protein, 22 aa, Mycobacterium tuberculosis
YGVDPLILRQAYPVRQAPYGLA

SEQ ID NO: 1548717 - protein, 19 aa, Mycobacterium tuberculosis
YWDQLKWNALANIAGTPAT

SEQ ID NO: 1548718 - protein, 18 aa, Mycobacterium tuberculosis
YYVLEKFATVVMDSSTYG

SEQ ID NO: 1548719 - protein, 26 aa, Mycobacterium tuberculosis
AAADEVSAHIAALFSGHGEGYQAIAR

SEQ ID NO: 1548720 - protein, 21 aa, Mycobacterium tuberculosis
AAAPYAGWLAAAAARAAGASA

SEQ ID NO: 1548721 - protein, 18 aa, Mycobacterium tuberculosis
AAATTRLLPAAADEVSAH

SEQ ID NO: 1548722 - protein, 30 aa, Mycobacterium tuberculosis; identical to SEQ ID NO: 234570

SEQ ID NO: 1548723 - protein, 23 aa, Mycobacterium tuberculosis
AAEVYKRSLAVFFLSEPPEGFDT

SEQ ID NO: 1548724 - protein, 25 aa, Mycobacterium tuberculosis
AAGGNGGAGGWLYGNGGAGGAGGTS

SEQ ID NO: 1548725 - protein, 20 aa, Mycobacterium tuberculosis
AAIACGRADVVIPKLERLVA

SEQ ID NO: 1548726 - protein, 19 aa, Mycobacterium tuberculosis
AAIPRLRRALVAPCTTTIR

SEQ ID NO: 1548727 - protein, 29 aa, Mycobacterium tuberculosis
AASAQAAAFYAQFVQALSAGGGAYAAAEA

SEQ ID NO: 1548728 - protein, 25 aa, Mycobacterium tuberculosis
AATDMPGRFVVAAAMVRHLLTDPML

SEQ ID NO: 1548729 - protein, 18 aa, Mycobacterium tuberculosis
AATVHPMLVAANRNAFVQ

SEQ ID NO: 1548730 - protein, 28 aa, Mycobacterium tuberculosis
ADEVSAAIASLFSGYARDYQALSAQMAR

SEQ ID NO: 1548731 - protein, 20 aa, Mycobacterium tuberculosis
ADMRRMRAAAAKLVETEISD

SEQ ID NO: 1548732 - protein, 24 aa, Mycobacterium tuberculosis
ADQPGATGGTGFAGGAGGAGGAGG

SEQ ID NO: 1548733 - protein, 21 aa, Mycobacterium tuberculosis
ADRYRRLHVIIGDANLAETST

SEQ ID NO: 1548734 - protein, 27 aa, Mycobacterium tuberculosis
ADVVIPKLERLVAMHPYRESLWKQLML

SEQ ID NO: 1548735 - protein, 39 aa, Mycobacterium tuberculosis
AEAAAVSPLLAPINAQFVAATGRPLIGNGANGAPGTGAN

SEQ ID NO: 1548736 - protein, 21 aa, Mycobacterium tuberculosis
AECLHKAAPIVGLPAATRTTP

SEQ ID NO: 1548737 - protein, 19 aa, Mycobacterium tuberculosis
AEEGLRCHFDAGNYQMAVE

SEQ ID NO: 1548738 - protein, 22 aa, Mycobacterium tuberculosis
AEIGRRPVVVLSRDAAIPRLRR

SEQ ID NO: 1548739 - protein, 19 aa, Mycobacterium tuberculosis
AFEAARAATVHPMLVAANR

SEQ ID NO: 1548740 - protein, 31 aa, Mycobacterium tuberculosis; identical to SEQ ID NO: 235044

SEQ ID NO: 1548741 - protein, 21 aa, Mycobacterium tuberculosis
AGAFSRPGLPVEYLQVPSPSM

SEQ ID NO: 1548742 - protein, 24 aa, Mycobacterium tuberculosis
AGGAGGNGGWLWGNGGNGGVGGTS

SEQ ID NO: 1548743 - protein, 20 aa, Mycobacterium tuberculosis
AGGGGGWLFGNGGDGGAGGG

SEQ ID NO: 1548744 - protein, 20 aa, Mycobacterium tuberculosis
AGGISRSVGDGAAGGAGGAP

SEQ ID NO: 1548745 - protein, 19 aa, Mycobacterium tuberculosis
AGGNGGWLYGSGGNGGAGG

SEQ ID NO: 1548746 - protein, 23 aa, Mycobacterium tuberculosis
AGGSGGHALLWGAGGAGGNGGSG

SEQ ID NO: 1548747 - protein, 29 aa, Mycobacterium tuberculosis
AGHGGAGGSARLIGAGGHGGDGGAGGNTA

SEQ ID NO: 1548748 - protein, 24 aa, Mycobacterium tuberculosis
AGKRLPVPLFPGFDTLGTLEYITK

SEQ ID NO: 1548749 - protein, 18 aa, Mycobacterium tuberculosis
AGLKLPRSSGQMYKVGQK

SEQ ID NO: 1548750 - protein, 19 aa, Mycobacterium tuberculosis
AGQQCDRLAAVLMPDTATP

SEQ ID NO: 1548751 - protein, 31 aa, Mycobacterium tuberculosis; identical to SEQ ID NO: 233147

SEQ ID NO: 1548752 - protein, 26 aa, Mycobacterium tuberculosis
AGSAPMLAASVAWDGLAAELAVAASS

SEQ ID NO: 1548753 - protein, 24 aa, Mycobacterium tuberculosis
AHKVCRKLDGGMPVNDIVDGLRND

SEQ ID NO: 1548754 - protein, 37 aa, Mycobacterium tuberculosis; identical to SEQ ID NO: 196651

SEQ ID NO: 1548755 - protein, 19 aa, Mycobacterium tuberculosis
ANAAALAPTTALLAAGADE

SEQ ID NO: 1548756 - protein, 23 aa, Mycobacterium tuberculosis
ANMAPDLFAGILAQVPFVDPLTT

SEQ ID NO: 1548757 - protein, 25 aa, Mycobacterium tuberculosis
APILKGDKGEPCWPDGMVGSLTHCA

SEQ ID NO: 1548758 - protein, 18 aa, Mycobacterium tuberculosis
APLDAPRPMPPEVADHVA

SEQ ID NO: 1548759 - protein, 17 aa, Mycobacterium tuberculosis
APLGEPLPAAPAELAPP

SEQ ID NO: 1548760 - protein, 18 aa, Mycobacterium tuberculosis
APRTTVGVVEYVRRRKNG

SEQ ID NO: 1548761 - protein, 23 aa, Mycobacterium tuberculosis
APSRSAFVAGPWGAVASLSPELF

SEQ ID NO: 1548762 - protein, 24 aa, Mycobacterium tuberculosis
APTEALLGRPLIGNGADGTAPGQP

SEQ ID NO: 1548763 - protein, 20 aa, Mycobacterium tuberculosis
AQATIFHDQFVQALTSGGNL

SEQ ID NO: 1548764 - protein, 26 aa, Mycobacterium tuberculosis
AQDEVSAAIAALFSAHGRAYQVASAQ

SEQ ID NO: 1548765 - protein, 29 aa, Mycobacterium tuberculosis
AQDEVSAAIAALFSAHGRAYQVASAQAAA

SEQ ID NO: 1548766 - protein, 23 aa, Mycobacterium tuberculosis
AQGRIPRVYGRQASEYVIRRGMS

SEQ ID NO: 1548767 - protein, 18 aa, Mycobacterium tuberculosis
ARLATFQTAVNKVAAATY

SEQ ID NO: 1548768 - protein, 17 aa, Mycobacterium tuberculosis
ARMLRGHLERMVTSDST

SEQ ID NO: 1548769 - protein, 25 aa, Mycobacterium tuberculosis
ARTADRLKAAGFTVTDVGNLSLPDV

SEQ ID NO: 1548770 - protein, 19 aa, Mycobacterium tuberculosis
ASAEAAGAAVLANPAQSVQ

SEQ ID NO: 1548771 - protein, 26 aa, Mycobacterium tuberculosis
ASSPDGQDGGLLFGNGGAGYNSAATP

SEQ ID NO: 1548772 - protein, 27 aa, Mycobacterium tuberculosis
ASSPDGQDGGLLFGNGGAGYNSAATPG

SEQ ID NO: 1548773 - protein, 19 aa, Mycobacterium tuberculosis
ATGGAGFAGGAGGEGGAGG

SEQ ID NO: 1548774 - protein, 21 aa, Mycobacterium tuberculosis
ATQGRGAWPVCGRGLSNATPR

SEQ ID NO: 1548775 - protein, 22 aa, Mycobacterium tuberculosis
ATQGRGAWPVCGRGLSNATPRE

SEQ ID NO: 1548776 - protein, 17 aa, Mycobacterium tuberculosis
ATVHPMLVAANRNAFVQ

SEQ ID NO: 1548777 - protein, 18 aa, Mycobacterium tuberculosis
AVASRFPGAINDLQLSRD

SEQ ID NO: 1548778 - protein, 19 aa, Mycobacterium tuberculosis
AVGSAAPVFPGRTAPVHAV

SEQ ID NO: 1548779 - protein, 26 aa, Mycobacterium tuberculosis
AVSPLLDPINEFFLANTGRPLIGNGA

SEQ ID NO: 1548780 - protein, 28 aa, Mycobacterium tuberculosis
CAELLDWPAKLRLLDGFRQRENLSWSAP

SEQ ID NO: 1548781 - protein, 22 aa, Mycobacterium tuberculosis
CELADRGLRVLILDQENRANVG

SEQ ID NO: 1548782 - protein, 21 aa, Mycobacterium tuberculosis
CGGEYEWTRAKAAYFMIVFSG

SEQ ID NO: 1548783 - protein, 30 aa, Mycobacterium tuberculosis; identical to SEQ ID NO: 1467321

SEQ ID NO: 1548784 - protein, 25 aa, Mycobacterium tuberculosis
DAADEYRPVAATVRHQAFSGDLIDQ

SEQ ID NO: 1548785 - protein, 17 aa, Mycobacterium tuberculosis
DAIDWQAYFHLRNRLVV

SEQ ID NO: 1548786 - protein, 26 aa, Mycobacterium tuberculosis
DDGTRIPVSIVHRADIEFPAPALIYG

SEQ ID NO: 1548787 - protein, 21 aa, Mycobacterium tuberculosis
DDVGGFDCDFFGLTEREATAI

SEQ ID NO: 1548788 - protein, 25 aa, Mycobacterium tuberculosis
DEVSIAVAALFGMHGQAYQALSVQA

SEQ ID NO: 1548789 - protein, 22 aa, Mycobacterium tuberculosis
DEVSTAIAALFGAHGQAYQALS

SEQ ID NO: 1548790 - protein, 27 aa, Mycobacterium tuberculosis
DGGGAGGNGAWLFGNGGAGGGGGKGGN

SEQ ID NO: 1548791 - protein, 24 aa, Mycobacterium tuberculosis
DGGKGGAGDPSFAVNNGAGGNGGH

SEQ ID NO: 1548792 - protein, 27 aa, Mycobacterium tuberculosis
DGGNAGFGAGVPGDGGIGGTGGAGGAG

SEQ ID NO: 1548793 - protein, 24 aa, Mycobacterium tuberculosis
DIDALKGIALYLNFDMLASPNPGY

SEQ ID NO: 1548794 - protein, 18 aa, Mycobacterium tuberculosis
DPIWPRHGIRIIPGPSSL

SEQ ID NO: 1548795 - protein, 24 aa, Mycobacterium tuberculosis
DQRADWACDFWDCAAAEVAAALTI

SEQ ID NO: 1548796 - protein, 17 aa, Mycobacterium tuberculosis
DRDRLVVIIAGYSSDID

SEQ ID NO: 1548797 - protein, 21 aa, Mycobacterium tuberculosis
DRMGALALHVAKIARRRHPQH

SEQ ID NO: 1548798 - protein, 24 aa, Mycobacterium tuberculosis
DRQLARFALRGDRTMFLFVFRAEH

SEQ ID NO: 1548799 - protein, 24 aa, Mycobacterium tuberculosis
DSNIEPQTSVLIGTQGGDGTPGGA

SEQ ID NO: 1548800 - protein, 25 aa, Mycobacterium tuberculosis
DSRLGWPLRPPPAVVRQFDAASPNW

SEQ ID NO: 1548801 - protein, 19 aa, Mycobacterium tuberculosis
EGFLAEPWWCRMVVMSAER

SEQ ID NO: 1548802 - protein, 28 aa, Mycobacterium tuberculosis
EICEDPRFSIARLSLLDRGMVFVVAHVR

SEQ ID NO: 1548803 - protein, 18 aa, Mycobacterium tuberculosis
EKVRDTFDLARHRAPSAS

SEQ ID NO: 1548804 - protein, 22 aa, Mycobacterium tuberculosis
ELRKRLTGLLGAFRAFSYGSLY

SEQ ID NO: 1548805 - protein, 27 aa, Mycobacterium tuberculosis
EMLAAAATDLAGIRSAISAATAAAAAP

SEQ ID NO: 1548806 - protein, 19 aa, Mycobacterium tuberculosis
ENLEDAGVSWKVYQNKLLG

SEQ ID NO: 1548807 - protein, 28 aa, Mycobacterium tuberculosis
ENPDGQNGGLLFGNGGNGFTQTTAGVAG

SEQ ID NO: 1548808 - protein, 17 aa, Mycobacterium tuberculosis
EQLRILTDLLVDRKEDL

SEQ ID NO: 1548809 - protein, 21 aa, Mycobacterium tuberculosis
ESARAVLRVAPLSVAELLATQ

SEQ ID NO: 1548810 - protein, 17 aa, Mycobacterium tuberculosis
ETFVEAWATSHDFMAVT

SEQ ID NO: 1548811 - protein, 28 aa, Mycobacterium tuberculosis
ETGYLRVCRPGCVELVLAHPSGITEIEV

SEQ ID NO: 1548812 - protein, 17 aa, Mycobacterium tuberculosis
EVLPASAAMDAPLDAAA

SEQ ID NO: 1548813 - protein, 21 aa, Mycobacterium tuberculosis
EVSTAVAALFGAHGQAYQALS

SEQ ID NO: 1548814 - protein, 26 aa, Mycobacterium tuberculosis
FDPSKPCAWLAEGLVRYLPARAQDLL

SEQ ID NO: 1548815 - protein, 17 aa, Mycobacterium tuberculosis
FEAARAATVHPMLVAAN

SEQ ID NO: 1548816 - protein, 23 aa, Mycobacterium tuberculosis
FFQAAGPWLKNALISNLNIVSTV

SEQ ID NO: 1548817 - protein, 33 aa, Mycobacterium tuberculosis
FISGNFSNGVLWRGDYEGLWGLSGGSTIPAIPI

SEQ ID NO: 1548818 - protein, 17 aa, Mycobacterium tuberculosis
FMAARTAFFDEYFLATA

SEQ ID NO: 1548819 - protein, 35 aa, Mycobacterium tuberculosis
FVQWWGQPAWSWAVLGLRGRRPVKWNDPITLANNR

SEQ ID NO: 1548820 - protein, 26 aa, Mycobacterium tuberculosis
GAGGAGGRGGWLVGNGGNGGNGGNGA

SEQ ID NO: 1548821 - protein, 22 aa, Mycobacterium tuberculosis
GAGGSAGLWGTGGAGGDGGNGR

SEQ ID NO: 1548822 - protein, 19 aa, Mycobacterium tuberculosis
GALTMRRLVIAAAVSALLL

SEQ ID NO: 1548823 - protein, 25 aa, Mycobacterium tuberculosis
GDGGDGASGLGLGLSGFDGGQGGQG

SEQ ID NO: 1548824 - protein, 26 aa, Mycobacterium tuberculosis
GDGGDGASGLGLGLSGFDGGQGGQGG

SEQ ID NO: 1548825 - protein, 23 aa, Mycobacterium tuberculosis
GDGGKGGSGLGVGGAGGTGGAGG

SEQ ID NO: 1548826 - protein, 22 aa, Mycobacterium tuberculosis
GDKMRVTLHYSNKYQVPATATA

SEQ ID NO: 1548827 - protein, 17 aa, Mycobacterium tuberculosis
GDLLRPSTVSAQMHADA

SEQ ID NO: 1548828 - protein, 32 aa, Mycobacterium tuberculosis; identical to SEQ ID NO: 1464061

SEQ ID NO: 1548829 - protein, 19 aa, Mycobacterium tuberculosis
GFDAATLGSPGADGGMGGN

SEQ ID NO: 1548830 - protein, 21 aa, Mycobacterium tuberculosis
GFDARRVRQWGYNAANDPQAI

SEQ ID NO: 1548831 - protein, 17 aa, Mycobacterium tuberculosis
GGAAGLFGNGGSGGSGG

SEQ ID NO: 1548832 - protein, 26 aa, Mycobacterium tuberculosis
GGAGDRGGAGGTGFISSDGGAGGDGG

SEQ ID NO: 1548833 - protein, 22 aa, Mycobacterium tuberculosis
GGAGGAGGWLYGDAGAGGDGGV

SEQ ID NO: 1548834 - protein, 21 aa, Mycobacterium tuberculosis
GGAGGNGFDAATLGSPGADGG

SEQ ID NO: 1548835 - protein, 22 aa, Mycobacterium tuberculosis
GGAGGNGGWLYGSGGNGGAGGA

SEQ ID NO: 1548836 - protein, 23 aa, Mycobacterium tuberculosis
GGAGGTGGWLFGNGGAGGTGGAV

SEQ ID NO: 1548837 - protein, 22 aa, Mycobacterium tuberculosis
GGASGAGGWLLGTGGAGGAGGN

SEQ ID NO: 1548838 - protein, 24 aa, Mycobacterium tuberculosis
GGDGGKGGSGLGVGGAGGTGGAGG

SEQ ID NO: 1548839 - protein, 24 aa, Mycobacterium tuberculosis
GGEITARFLISACGILTVPKLPDI

SEQ ID NO: 1548840 - protein, 25 aa, Mycobacterium tuberculosis
GGEITARFLISACGILTVPKLPDID

SEQ ID NO: 1548841 - protein, 23 aa, Mycobacterium tuberculosis
GGGALNQAGFFGTGGKGGNGGNG

SEQ ID NO: 1548842 - protein, 27 aa, Mycobacterium tuberculosis
GGGGAAGPAGWLFGDGGAGGNGGAAAA

SEQ ID NO: 1548843 - protein, 17 aa, Mycobacterium tuberculosis
GGGGISLGGNGGLGGNG

SEQ ID NO: 1548844 - protein, 30 aa, Mycobacterium tuberculosis
GGGTGGAGGRAELLFGAGGAGGAGTDGGPG

SEQ ID NO: 1548845 - protein, 26 aa, Mycobacterium tuberculosis
GGKGGAGGAAFSINFTAGDGGAGGAG

SEQ ID NO: 1548846 - protein, 21 aa, Mycobacterium tuberculosis
GGKGGMGGIAGDGGPGGDGGN

SEQ ID NO: 1548847 - protein, 18 aa, Mycobacterium tuberculosis
GGNGGKGGAGLIAGLDGA

SEQ ID NO: 1548848 - protein, 17 aa, Mycobacterium tuberculosis
GGNWSINTGNGYLGGLQ

SEQ ID NO: 1548849 - protein, 20 aa, Mycobacterium tuberculosis
GGQGFAIPIGQAMAIAGQIR

SEQ ID NO: 1548850 - protein, 29 aa, Mycobacterium tuberculosis
GGTGGAGGRAELLFGAGGAGGAGTDGGPG

SEQ ID NO: 1548851 - protein, 18 aa, Mycobacterium tuberculosis
GHHPGDVISVTWQTKSGG

SEQ ID NO: 1548852 - protein, 22 aa, Mycobacterium tuberculosis
GIGGNGGDAGLFGNGGAGGAGA

SEQ ID NO: 1548853 - protein, 19 aa, Mycobacterium tuberculosis
GLAAELAVAASSFGSVTSG

SEQ ID NO: 1548854 - protein, 24 aa, Mycobacterium tuberculosis
GLRTRLFAAPGWLVSPGVRTALPA

SEQ ID NO: 1548855 - protein, 17 aa, Mycobacterium tuberculosis
GLVGFSYSIEITGSTLV

SEQ ID NO: 1548856 - protein, 19 aa, Mycobacterium tuberculosis
GNAGVGLTAKAGDGGAAGN

SEQ ID NO: 1548857 - protein, 22 aa, Mycobacterium tuberculosis
GNAGWLGFGGAGGVGGSAGLIG

SEQ ID NO: 1548858 - protein, 25 aa, Mycobacterium tuberculosis
GNGGNGATGGWLYGNGGAGGQGATA

SEQ ID NO: 1548859 - protein, 18 aa, Mycobacterium tuberculosis
GNGGSGFNSLTSSVGGAG

SEQ ID NO: 1548860 - protein, 17 aa, Mycobacterium tuberculosis
GNVPVTMGFYTRRDLPI

SEQ ID NO: 1548861 - protein, 18 aa, Mycobacterium tuberculosis
GPLGYSYNTGCHLPAAWR

SEQ ID NO: 1548862 - protein, 18 aa, Mycobacterium tuberculosis
GPLGYSYNTGCHPPAAWR

SEQ ID NO: 1548863 - protein, 19 aa, Mycobacterium tuberculosis
GPNGRPRYVTAIDADTATV

SEQ ID NO: 1548864 - protein, 21 aa, Mycobacterium tuberculosis
GQAFWSFGGLFLVNSPEQRRL

SEQ ID NO: 1548865 - protein, 28 aa, Mycobacterium tuberculosis
GQAGGPGGPAGLWGNGGPGGAGGSGGGT

SEQ ID NO: 1548866 - protein, 91 aa, Mycobacterium tuberculosis
GQSGGPRRQRWCRWQRRRWLGRQRRRRWCRWQRRCRRQRWRWRCRQRRLRRQWRQGRRRCRPWLHRRRGRQGRRWRQRRFQQRQRSRWQRR

SEQ ID NO: 1548867 - protein, 20 aa, Mycobacterium tuberculosis
GREICGMPSSGGVAVAATLG

SEQ ID NO: 1548868 - protein, 17 aa, Mycobacterium tuberculosis
GRVVSLFDRVEALRVTA

SEQ ID NO: 1548869 - protein, 26 aa, Mycobacterium tuberculosis
GSAQRWKAIRGEAGWMTTYAYPAEAI

SEQ ID NO: 1548870 - protein, 36 aa, Mycobacterium tuberculosis; identical to SEQ ID NO: 1464108

SEQ ID NO: 1548871 - protein, 18 aa, Mycobacterium tuberculosis
GSGNVGWANMGLGNIGFG

SEQ ID NO: 1548872 - protein, 19 aa, Mycobacterium tuberculosis
GTCRETPDGLVITATPLRP

SEQ ID NO: 1548873 - protein, 26 aa, Mycobacterium tuberculosis
GTGADGGAGGWLFGNGGNGGQGTIGG

SEQ ID NO: 1548874 - protein, 24 aa, Mycobacterium tuberculosis
GTGANGGDGGWLIGNGGAGGSGAA

SEQ ID NO: 1548875 - protein, 26 aa, Mycobacterium tuberculosis
GTGANGGPGGWLIGNGGAGGSGAPGA

SEQ ID NO: 1548876 - protein, 30 aa, Mycobacterium tuberculosis; identical to SEQ ID NO: 235206

SEQ ID NO: 1548877 - protein, 18 aa, Mycobacterium tuberculosis
GTGGVLLGLDGFTAPAST

SEQ ID NO: 1548878 - protein, 25 aa, Mycobacterium tuberculosis
GTTPNRLYWMSAWIDPDGTDGGPVL

SEQ ID NO: 1548879 - protein, 21 aa, Mycobacterium tuberculosis
HGFRFFDNRDLLGFVDGTENP

SEQ ID NO: 1548880 - protein, 24 aa, Mycobacterium tuberculosis
HGNSVPRFHITWGTGPALVDIFVR

SEQ ID NO: 1548881 - protein, 25 aa, Mycobacterium tuberculosis
HGTAFLAARGGYFVADLSSGHTGRV

SEQ ID NO: 1548882 - protein, 26 aa, Mycobacterium tuberculosis
HRGHEWKFAITKNGRHSLTHYDTLEA

SEQ ID NO: 1548883 - protein, 25 aa, Mycobacterium tuberculosis
HSARWDHTVPLLGRRIAVIGTGSTG

SEQ ID NO: 1548884 - protein, 19 aa, Mycobacterium tuberculosis
HTVAPFKVGPDFIDPGYHA

SEQ ID NO: 1548885 - protein, 18 aa, Mycobacterium tuberculosis
ICNHCPYVQHVAAGLATL

SEQ ID NO: 1548886 - protein, 21 aa, Mycobacterium tuberculosis
IDALSRPGSWLASNVPGAGFL

SEQ ID NO: 1548887 - protein, 19 aa, Mycobacterium tuberculosis
IDLRQDWPKALQKAGFDPS

SEQ ID NO: 1548888 - protein, 18 aa, Mycobacterium tuberculosis
IDWQAYFHLRNRLVVAAM

SEQ ID NO: 1548889 - protein, 19 aa, Mycobacterium tuberculosis
IGALNSGIGNLGFGNSGNN

SEQ ID NO: 1548890 - protein, 29 aa, Mycobacterium tuberculosis
IGDHSNALWCRWCLGYAQLMRGELAAAAA

SEQ ID NO: 1548891 - protein, 18 aa, Mycobacterium tuberculosis
ISLHFQIGRRQVVKAEVS

SEQ ID NO: 1548892 - protein, 24 aa, Mycobacterium tuberculosis
ITIDRIPLNLGASVTVGPILINGV

SEQ ID NO: 1548893 - protein, 23 aa, Mycobacterium tuberculosis
ITKSGHDYTWFVLNAKIIEKEFA

SEQ ID NO: 1548894 - protein, 17 aa, Mycobacterium tuberculosis
ITSPEALLPVYTPQVIS

SEQ ID NO: 1548895 - protein, 37 aa, Mycobacterium tuberculosis; identical to SEQ ID NO: 1485493

SEQ ID NO: 1548896 - protein, 19 aa, Mycobacterium tuberculosis
KGDRVRIAGLGVGTVEGLK

SEQ ID NO: 1548897 - protein, 25 aa, Mycobacterium tuberculosis
KNVRLPERTRYVLSITWSDVETPGP

SEQ ID NO: 1548898 - protein, 18 aa, Mycobacterium tuberculosis
LAAESFGLVTSGLAGGSG

SEQ ID NO: 1548899 - protein, 17 aa, Mycobacterium tuberculosis
LADLPPADLSRITVTIV

SEQ ID NO: 1548900 - protein, 40 aa, Mycobacterium tuberculosis; identical to SEQ ID NO: 234783

SEQ ID NO: 1548901 - protein, 17 aa, Mycobacterium tuberculosis
LDRGMVFVVAHVRGGGE

SEQ ID NO: 1548902 - protein, 18 aa, Mycobacterium tuberculosis
LESARSRLTGTFLDAYTQ

SEQ ID NO: 1548903 - protein, 22 aa, Mycobacterium tuberculosis
LGDLRSFMFVQMFSRALTEDEL

SEQ ID NO: 1548904 - protein, 17 aa, Mycobacterium tuberculosis
LHDQFVQALTGAGGSYA

SEQ ID NO: 1548905 - protein, 17 aa, Mycobacterium tuberculosis
LIGNGADGLPGQNGGAG

SEQ ID NO: 1548906 - protein, 20 aa, Mycobacterium tuberculosis
LKATLKHLACLEYSTVAIQN

SEQ ID NO: 1548907 - protein, 27 aa, Mycobacterium tuberculosis
LKLIRARFGVPVPNLTAWRDATVGDMT

SEQ ID NO: 1548908 - protein, 25 aa, Mycobacterium tuberculosis
LLGNGNFGFGNAFGDGNLGSGNVGS

SEQ ID NO: 1548909 - protein, 17 aa, Mycobacterium tuberculosis
LLGRPLIGNGADGTAAN

SEQ ID NO: 1548910 - protein, 17 aa, Mycobacterium tuberculosis
LMLDPRLAKSVAAAAIT

SEQ ID NO: 1548911 - protein, 25 aa, Mycobacterium tuberculosis
LNASGLFGVLTNVVWTNHGPCAIDG

SEQ ID NO: 1548912 - protein, 17 aa, Mycobacterium tuberculosis
LPAGESVLHTWNSTVAR

SEQ ID NO: 1548913 - protein, 18 aa, Mycobacterium tuberculosis
LPEEPWRSAVEATGSADV

SEQ ID NO: 1548914 - protein, 29 aa, Mycobacterium tuberculosis
LPIQILPTIPLNIHQTFSLGPLVVPDIVI

SEQ ID NO: 1548915 - protein, 30 aa, Mycobacterium tuberculosis; identical to SEQ ID NO: 1486711

SEQ ID NO: 1548916 - protein, 18 aa, Mycobacterium tuberculosis
LPPPAALTGEWFGALAVI

SEQ ID NO: 1548917 - protein, 19 aa, Mycobacterium tuberculosis
LPQCVPNAVLGTVTKTAIP

SEQ ID NO: 1548918 - protein, 19 aa, Mycobacterium tuberculosis
LPVGRGMGPDRMTIYVQMP

SEQ ID NO: 1548919 - protein, 18 aa, Mycobacterium tuberculosis
LQAFLHWAIIDGNKASFL

SEQ ID NO: 1548920 - protein, 17 aa, Mycobacterium tuberculosis
LQLRGAGGLPSAAIGGG

SEQ ID NO: 1548921 - protein, 19 aa, Mycobacterium tuberculosis
LRAPIQQMIDFMAARTAFF

SEQ ID NO: 1548922 - protein, 20 aa, Mycobacterium tuberculosis
LRGAGGLPSAAIGGGVAVGE

SEQ ID NO: 1548923 - protein, 19 aa, Mycobacterium tuberculosis
LRMFTGAGSAPMLAASVAW

SEQ ID NO: 1548924 - protein, 19 aa, Mycobacterium tuberculosis
LSNATPREVLPASAAMDAP

SEQ ID NO: 1548925 - protein, 19 aa, Mycobacterium tuberculosis
LVIPFWKIGWQNLGLPTGF

SEQ ID NO: 1548926 - protein, 19 aa, Mycobacterium tuberculosis
LVLVLVYKQFRGEFTPKTE

SEQ ID NO: 1548927 - protein, 20 aa, Mycobacterium tuberculosis
LVNLLVNRGPTVPILLDTGS

SEQ ID NO: 1548928 - protein, 17 aa, Mycobacterium tuberculosis
LWPAPYLVMDTGASLAP

SEQ ID NO: 1548929 - protein, 27 aa, Mycobacterium tuberculosis
MIGTLKRAWIPLLILVVVAIAGFTVQR

SEQ ID NO: 1548930 - protein, 21 aa, Mycobacterium tuberculosis
MSAPYVEWLERTAAQTKQTAT

SEQ ID NO: 1548931 - protein, 17 aa, Mycobacterium tuberculosis
NDLPWSVLKQLHAGDSD

SEQ ID NO: 1548932 - protein, 24 aa, Mycobacterium tuberculosis
NFGNPNPPAIGFFISNLSITGPQI

SEQ ID NO: 1548933 - protein, 24 aa, Mycobacterium tuberculosis
NGGAGGNGGWLFGNGGAGGSGGDG

SEQ ID NO: 1548934 - protein, 19 aa, Mycobacterium tuberculosis
NKAFACQYAMQFIAVLRGY

SEQ ID NO: 1548935 - protein, 23 aa, Mycobacterium tuberculosis
NKPSMPYRLRVIVHEDENGRMTG

SEQ ID NO: 1548936 - protein, 19 aa, Mycobacterium tuberculosis
NLHFCRLPDQLAEIDTELF

SEQ ID NO: 1548937 - protein, 25 aa, Mycobacterium tuberculosis
NNRLPKVSWVLPGFLLSEHPAFPVN

SEQ ID NO: 1548938 - protein, 28 aa, Mycobacterium tuberculosis
NVCWPTPRPPMRIWPRRFDAPPGPCRAS

SEQ ID NO: 1548939 - protein, 27 aa, Mycobacterium tuberculosis
PALSQDRFADFPALPLDPSAMVAQVGP

SEQ ID NO: 1548940 - protein, 30 aa, Mycobacterium tuberculosis
PASVESSVLRWARESCGLTEVAAARKLGLP

SEQ ID NO: 1548941 - protein, 21 aa, Mycobacterium tuberculosis
PDIPIPAIHIDFDGAADAGFT

SEQ ID NO: 1548942 - protein, 30 aa, Mycobacterium tuberculosis; identical to SEQ ID NO: 235286

SEQ ID NO: 1548943 - protein, 21 aa, Mycobacterium tuberculosis
PEALAAAASDVANIGSALSAA

SEQ ID NO: 1548944 - protein, 23 aa, Mycobacterium tuberculosis
PEDYWPEQWAHAYVDFAAGEKRS

SEQ ID NO: 1548945 - protein, 18 aa, Mycobacterium tuberculosis
PFEDGGWVWFDITTDTAV

SEQ ID NO: 1548946 - protein, 23 aa, Mycobacterium tuberculosis
PGGAGGTGGRGFLNDGGVGGAGG

SEQ ID NO: 1548947 - protein, 18 aa, Mycobacterium tuberculosis
PGTRRMYSNYGFTVLAES

SEQ ID NO: 1548948 - protein, 25 aa, Mycobacterium tuberculosis
PIRRASVTVMEWGLRGTRRAEAAAE

SEQ ID NO: 1548949 - protein, 17 aa, Mycobacterium tuberculosis
PKVAAALKDPSYRLKTT

SEQ ID NO: 1548950 - protein, 18 aa, Mycobacterium tuberculosis
PKVAAALKDPSYRLKTTT

SEQ ID NO: 1548951 - protein, 17 aa, Mycobacterium tuberculosis
PLTDWKLEFDLPAGESV

SEQ ID NO: 1548952 - protein, 25 aa, Mycobacterium tuberculosis
PNGGNGGDAGMFGNGGAGGAGYSPA

SEQ ID NO: 1548953 - protein, 24 aa, Mycobacterium tuberculosis
PNIQPLQHYSWRIMPENLEDAGVS

SEQ ID NO: 1548954 - protein, 22 aa, Mycobacterium tuberculosis
PPGHKWARRSRVVSARELAQTP

SEQ ID NO: 1548955 - protein, 18 aa, Mycobacterium tuberculosis
PPGVGGIGEDFIDALRSK

SEQ ID NO: 1548956 - protein, 26 aa, Mycobacterium tuberculosis
PQSARTETWINLQVGDCLADLPPADL

SEQ ID NO: 1548957 - protein, 22 aa, Mycobacterium tuberculosis
PRSNLARFGISPTYPLDFAADV

SEQ ID NO: 1548958 - protein, 17 aa, Mycobacterium tuberculosis
PTAQFSVVLPRRDGVEY

SEQ ID NO: 1548959 - protein, 20 aa, Mycobacterium tuberculosis
PTFEGYRQQLGIDFAGVVTA

SEQ ID NO: 1548960 - protein, 17 aa, Mycobacterium tuberculosis
PVGFDRPQFFGQYRDSR

SEQ ID NO: 1548961 - protein, 24 aa, Mycobacterium tuberculosis
RADIEFPAPALIYGYGAYEICEDP

SEQ ID NO: 1548962 - protein, 31 aa, Mycobacterium tuberculosis; identical to SEQ ID NO: 1477832

SEQ ID NO: 1548963 - protein, 17 aa, Mycobacterium tuberculosis
RATVAAAVRLATVCLVA

SEQ ID NO: 1548964 - protein, 19 aa, Mycobacterium tuberculosis
RDDWVPFTGVPGYNHIKIK

SEQ ID NO: 1548965 - protein, 19 aa, Mycobacterium tuberculosis
RDGRGCVIVEDMAIASKSA

SEQ ID NO: 1548966 - protein, 17 aa, Mycobacterium tuberculosis
RDPRLRRALTPDYEPMC

SEQ ID NO: 1548967 - protein, 23 aa, Mycobacterium tuberculosis
RDVIDAFLAWYVPGLDISDHTML

SEQ ID NO: 1548968 - protein, 21 aa, Mycobacterium tuberculosis
REIPGAWRLPLSGDEADADIA

SEQ ID NO: 1548969 - protein, 17 aa, Mycobacterium tuberculosis
RGDASRLAVSWFGHSTA

SEQ ID NO: 1548970 - protein, 19 aa, Mycobacterium tuberculosis
RGPTVPILLDTGSSSLVIP

SEQ ID NO: 1548971 - protein, 20 aa, Mycobacterium tuberculosis
RGTRAVIRYDNLFGDRYLAL

SEQ ID NO: 1548972 - protein, 24 aa, Mycobacterium tuberculosis
RLTDPKAGPLIAVKLHILTRKTLG

SEQ ID NO: 1548973 - protein, 22 aa, Mycobacterium tuberculosis
RREALPRVQLWPIGPDGNYGEP

SEQ ID NO: 1548974 - protein, 29 aa, Mycobacterium tuberculosis
RRELSALVARSPFGQGAAWPVVQTVQRDG

SEQ ID NO: 1548975 - protein, 19 aa, Mycobacterium tuberculosis
RRETWLIMRLPVIGNTQAL

SEQ ID NO: 1548976 - protein, 18 aa, Mycobacterium tuberculosis
RVLSRSVLILCWSLLGAA

SEQ ID NO: 1548977 - protein, 24 aa, Mycobacterium tuberculosis
SAQASAFHAQFVQALTGGGGAYAA

SEQ ID NO: 1548978 - protein, 23 aa, Mycobacterium tuberculosis
SAQMSAFHAQFMQALTGAGGAYA

SEQ ID NO: 1548979 - protein, 17 aa, Mycobacterium tuberculosis
SFQVAKVDNGRCDPVAG

SEQ ID NO: 1548980 - protein, 18 aa, Mycobacterium tuberculosis
SGGLLWGNGGAGGAGGNG

SEQ ID NO: 1548981 - protein, 19 aa, Mycobacterium tuberculosis
SGGNWSINTGNGYLGGLQF

SEQ ID NO: 1548982 - protein, 27 aa, Mycobacterium tuberculosis
SGLDSRAWRLPWPDGTVVYELDQPKVL

SEQ ID NO: 1548983 - protein, 17 aa, Mycobacterium tuberculosis
SGRFLSRNTTLWASWAF

SEQ ID NO: 1548984 - protein, 25 aa, Mycobacterium tuberculosis
SMELFKTALRLARHRELVDGADATD

SEQ ID NO: 1548985 - protein, 19 aa, Mycobacterium tuberculosis
SMGRPEYPTPVGSYTVLSK

SEQ ID NO: 1548986 - protein, 28 aa, Mycobacterium tuberculosis
SPGATAFPWRRQSALVQWYVETSGSPSE

SEQ ID NO: 1548987 - protein, 21 aa, Mycobacterium tuberculosis
SRQLLAAQIIWTLARADIRGP

SEQ ID NO: 1548988 - protein, 20 aa, Mycobacterium tuberculosis
SRSGGFGGAGGAGGDAGMFF

SEQ ID NO: 1548989 - protein, 18 aa, Mycobacterium tuberculosis
SSVGGLSVPAGWSTAAPA

SEQ ID NO: 1548990 - protein, 21 aa, Mycobacterium tuberculosis
STSSIPFDAHGGNGGAGGDAG

SEQ ID NO: 1548991 - protein, 18 aa, Mycobacterium tuberculosis
SVTVMALIVLLLLNATMT

SEQ ID NO: 1548992 - protein, 19 aa, Mycobacterium tuberculosis
SWYRGSPIGRERKTEELSR

SEQ ID NO: 1548993 - protein, 18 aa, Mycobacterium tuberculosis
TAFFDEYFLATADAGVRQ

SEQ ID NO: 1548994 - protein, 19 aa, Mycobacterium tuberculosis
TAIPYRVPFPQSMPTQETA

SEQ ID NO: 1548995 - protein, 19 aa, Mycobacterium tuberculosis
TALTFPFAGGLGLMSNRAS

SEQ ID NO: 1548996 - protein, 27 aa, Mycobacterium tuberculosis
TGGAGGPGGLIWGGGGAGGVGGAGGGT

SEQ ID NO: 1548997 - protein, 19 aa, Mycobacterium tuberculosis
TGGASRSGGFGGAGGAGGD

SEQ ID NO: 1548998 - protein, 20 aa, Mycobacterium tuberculosis
TLLGRPLIGNGADGLPGQNG

SEQ ID NO: 1548999 - protein, 21 aa, Mycobacterium tuberculosis
TLRERFGYDAWALIYDVDTVR

SEQ ID NO: 1549000 - protein, 18 aa, Mycobacterium tuberculosis
TLTGFGYHGPDGQVVADR

SEQ ID NO: 1549001 - protein, 17 aa, Mycobacterium tuberculosis
TPKTELTMVAFRAGLVM

SEQ ID NO: 1549002 - protein, 25 aa, Mycobacterium tuberculosis
TQALLGRPLIGDGANGGPGQDGGPG

SEQ ID NO: 1549003 - protein, 25 aa, Mycobacterium tuberculosis
TQALLGRPLIGDGAVGTASSPDGQD

SEQ ID NO: 1549004 - protein, 22 aa, Mycobacterium tuberculosis
TQLWLGRPLIGDGVHGAPGTGQ

SEQ ID NO: 1549005 - protein, 22 aa, Mycobacterium tuberculosis
TRLGPLLRHHRVLICTPAEHDE

SEQ ID NO: 1549006 - protein, 23 aa, Mycobacterium tuberculosis
TSTSSIPFDAHGGNGGAGGDAGH

SEQ ID NO: 1549007 - protein, 17 aa, Mycobacterium tuberculosis
TVRFAHRHQVDKLIVEG

SEQ ID NO: 1549008 - protein, 24 aa, Mycobacterium tuberculosis
VAANRNAFVQLVLSNLFGQNAPAI

SEQ ID NO: 1549009 - protein, 18 aa, Mycobacterium tuberculosis
VASDRGAGHLGFAGTARR

SEQ ID NO: 1549010 - protein, 18 aa, Mycobacterium tuberculosis
VAVLQLRGAGGLPSAAIG

SEQ ID NO: 1549011 - protein, 19 aa, Mycobacterium tuberculosis
VDAFPRGAGRMLAIMHALD

SEQ ID NO: 1549012 - protein, 20 aa, Mycobacterium tuberculosis
VENNFPLVNLLVNRGPTVPI

SEQ ID NO: 1549013 - protein, 19 aa, Mycobacterium tuberculosis
VEPRARWERLYHLVNHVLE

SEQ ID NO: 1549014 - protein, 24 aa, Mycobacterium tuberculosis
VFGDGWIGAQACMWVNKFHEESTV

SEQ ID NO: 1549015 - protein, 21 aa, Mycobacterium tuberculosis
VGGSGGFVYGNGGAGGIGGIG

SEQ ID NO: 1549016 - protein, 18 aa, Mycobacterium tuberculosis
VGKFEFRASAVIVASGGI

SEQ ID NO: 1549017 - protein, 17 aa, Mycobacterium tuberculosis
VHYPWLPLRRLLLDHYP

SEQ ID NO: 1549018 - protein, 25 aa, Mycobacterium tuberculosis
VLINNAFRVPSMKPLAGTTFEHIRD

SEQ ID NO: 1549019 - protein, 24 aa, Mycobacterium tuberculosis
VNTHCNLDCPICFADSGHQPDGYA

SEQ ID NO: 1549020 - protein, 19 aa, Mycobacterium tuberculosis
VPVTMGFYTRRDLPIHYLL

SEQ ID NO: 1549021 - protein, 22 aa, Mycobacterium tuberculosis
VQAALKDGYRVFGELAPHPLLT

SEQ ID NO: 1549022 - protein, 23 aa, Mycobacterium tuberculosis
VQAALKDGYRVFGELAPHPLLTY

SEQ ID NO: 1549023 - protein, 24 aa, Mycobacterium tuberculosis
VRLATVCLVASCANADPLGSATGS

SEQ ID NO: 1549024 - protein, 21 aa, Mycobacterium tuberculosis
VSAAIAGLFGAHARQYQALSV

SEQ ID NO: 1549025 - protein, 23 aa, Mycobacterium tuberculosis
VSGEGCVVLLLKRLPDAVRDGDR

SEQ ID NO: 1549026 - protein, 23 aa, Mycobacterium tuberculosis
VSPLLDPINEFFLANTGRPLIGN

SEQ ID NO: 1549027 - protein, 26 aa, Mycobacterium tuberculosis
VVAANRSAFVQLVLSNVFGQNAPAIA

SEQ ID NO: 1549028 - protein, 25 aa, Mycobacterium tuberculosis
VVAVPEALAAAASDVANIGSALSAA

SEQ ID NO: 1549029 - protein, 19 aa, Mycobacterium tuberculosis
VVFLLLVWQALGSSPNSED

SEQ ID NO: 1549030 - protein, 23 aa, Mycobacterium tuberculosis
VVYYHGGGWSLGGLDTHDPVARA

SEQ ID NO: 1549031 - protein, 24 aa, Mycobacterium tuberculosis
VWTAEFAEAGWALPLSDDPAGLAE

SEQ ID NO: 1549032 - protein, 19 aa, Mycobacterium tuberculosis
WIATLTLELEPTVRLPANA

SEQ ID NO: 1549033 - protein, 18 aa, Mycobacterium tuberculosis
WLRTADRGSWALADATVD

SEQ ID NO: 1549034 - protein, 19 aa, Mycobacterium tuberculosis
WRIMPENLEDAGVSWKVYQ

SEQ ID NO: 1549035 - protein, 17 aa, Mycobacterium tuberculosis
WTCMIPRQVAEELGQPL

SEQ ID NO: 1549036 - protein, 29 aa, Mycobacterium tuberculosis
YASAEAAAAEQIVLGVINAPTQALLGRPL

SEQ ID NO: 1549037 - protein, 20 aa, Mycobacterium tuberculosis
YASAEAAGAAVLANPAQSVQ

SEQ ID NO: 1549038 - protein, 18 aa, Mycobacterium tuberculosis
YECDGQWVVAAGVQAMVE

SEQ ID NO: 1549039 - protein, 23 aa, Mycobacterium tuberculosis
YERWKETAFQYGWLLATADSDRY

SEQ ID NO: 1549040 - protein, 19 aa, Mycobacterium tuberculosis
YKQFRGEFTPKTELTMVAF

SEQ ID NO: 1549041 - protein, 22 aa, Mycobacterium tuberculosis
YLRALPADGWLRVLCTCVEIGQ

SEQ ID NO: 1549042 - protein, 18 aa, Mycobacterium tuberculosis
YMIAVPDMLSSAAGDLAS

SEQ ID NO: 1549043 - protein, 19 aa, Mycobacterium tuberculosis
YNGMLYFGINADRDAMSDV

SEQ ID NO: 1549044 - protein, 18 aa, Mycobacterium tuberculosis
YQAIARQMAAFHDQFTLA

SEQ ID NO: 1549045 - protein, 18 aa, Mycobacterium tuberculosis
YQALSARVATFHEQFVRS

SEQ ID NO: 1549046 - protein, 23 aa, Mycobacterium tuberculosis
AAAAAPYAGWLAAAAARAAGASA

SEQ ID NO: 1549047 - protein, 19 aa, Mycobacterium tuberculosis
AAAEFDYELMWAQDVAAML

SEQ ID NO: 1549048 - protein, 30 aa, Mycobacterium tuberculosis
AAAGAARTADFAVRAVAALAAADATDTVAA

SEQ ID NO: 1549049 - protein, 18 aa, Mycobacterium tuberculosis
AAALWLVAPCTELYHDSR

SEQ ID NO: 1549050 - protein, 23 aa, Mycobacterium tuberculosis
AAESHTVEQMVLNAINAPTQTLF

SEQ ID NO: 1549051 - protein, 34 aa, Mycobacterium tuberculosis; identical to SEQ ID NO: 1379373

SEQ ID NO: 1549052 - protein, 18 aa, Mycobacterium tuberculosis
AAGADAPASTGLTGGTGF

SEQ ID NO: 1549053 - protein, 32 aa, Mycobacterium tuberculosis
AAGDACSTVAAFAAIAARPASPGGAAVGGAAV

SEQ ID NO: 1549054 - protein, 25 aa, Mycobacterium tuberculosis
AAGGNGGAGGWLFGNGGAGGAGGLG

SEQ ID NO: 1549055 - protein, 20 aa, Mycobacterium tuberculosis
AALDVARIGSSIGAANAAAA

SEQ ID NO: 1549056 - protein, 18 aa, Mycobacterium tuberculosis
AANALPLQKAQGVVSELA

SEQ ID NO: 1549057 - protein, 20 aa, Mycobacterium tuberculosis
AAPYAGWLAAAAARAAGASA

SEQ ID NO: 1549058 - protein, 18 aa, Mycobacterium tuberculosis
AAVADLFGAHAQAYQALS

SEQ ID NO: 1549059 - protein, 19 aa, Mycobacterium tuberculosis
AAVEGLKAIVLLANGADTY

SEQ ID NO: 1549060 - protein, 28 aa, Mycobacterium tuberculosis
AAVSPLLDPINEFFLANTGRPLIGNGAN

SEQ ID NO: 1549061 - protein, 17 aa, Mycobacterium tuberculosis
ADAAAAILSPQLVTGRA

SEQ ID NO: 1549062 - protein, 25 aa, Mycobacterium tuberculosis
ADEVSAAIAGLFGAHARQYQALSVQ

SEQ ID NO: 1549063 - protein, 25 aa, Mycobacterium tuberculosis
ADEVSAALASLFSGHAVSYQQVAAQ

SEQ ID NO: 1549064 - protein, 23 aa, Mycobacterium tuberculosis
ADEVSAAVAALFSAHAGQYQQLG

SEQ ID NO: 1549065 - protein, 24 aa, Mycobacterium tuberculosis
ADEVSAAVAALFSAHAGQYQQLGA

SEQ ID NO: 1549066 - protein, 18 aa, Mycobacterium tuberculosis
ADEVSAAVAAVFSSYAQQ

SEQ ID NO: 1549067 - protein, 20 aa, Mycobacterium tuberculosis
ADKWKNCAGKTVTVTNKAKT

SEQ ID NO: 1549068 - protein, 19 aa, Mycobacterium tuberculosis
AEVEYRAALGDVNAKEAAM

SEQ ID NO: 1549069 - protein, 17 aa, Mycobacterium tuberculosis
AFARIALTNAAAMLDSV

SEQ ID NO: 1549070 - protein, 17 aa, Mycobacterium tuberculosis
AGADAPASTGLTGGTGF

SEQ ID NO: 1549071 - protein, 28 aa, Mycobacterium tuberculosis
AGADEVSAAIAALFGAHGQAYQTVSAQA

SEQ ID NO: 1549072 - protein, 30 aa, Mycobacterium tuberculosis; identical to SEQ ID NO: 235043

SEQ ID NO: 1549073 - protein, 29 aa, Mycobacterium tuberculosis
AGADEVSTAIAALFGAHGQAYQALSAQAQ

SEQ ID NO: 1549074 - protein, 24 aa, Mycobacterium tuberculosis
AGDEVSAAIAALFGTHAQEYQALS

SEQ ID NO: 1549075 - protein, 25 aa, Mycobacterium tuberculosis
AGDEVSAAIAALFGTHAQEYQALSA

SEQ ID NO: 1549076 - protein, 20 aa, Mycobacterium tuberculosis
AGGAAGLWGSGGSGGQGGNG

SEQ ID NO: 1549077 - protein, 28 aa, Mycobacterium tuberculosis
AGGAGGNARLWGVGGAGGAGGDGGAGGA

SEQ ID NO: 1549078 - protein, 25 aa, Mycobacterium tuberculosis
AGGAGGNGGWLWGNGGNGGVGGTSV

SEQ ID NO: 1549079 - protein, 19 aa, Mycobacterium tuberculosis
AGLAGCTFRAELAEVAVAA

SEQ ID NO: 1549080 - protein, 27 aa, Mycobacterium tuberculosis
AGPPEHLQWIGQWGIFDALRPGREVVR

SEQ ID NO: 1549081 - protein, 30 aa, Mycobacterium tuberculosis; identical to SEQ ID NO: 1479604

SEQ ID NO: 1549082 - protein, 23 aa, Mycobacterium tuberculosis
AGTGFLAQLCVDWETATRPAQQS

SEQ ID NO: 1549083 - protein, 25 aa, Mycobacterium tuberculosis
AGTTAAACECTVAAGAAFAAGAAVA

SEQ ID NO: 1549084 - protein, 19 aa, Mycobacterium tuberculosis
AHCALWRALIGLDSMERIS

SEQ ID NO: 1549085 - protein, 27 aa, Mycobacterium tuberculosis
AHLEHPKMPLVPLIDGWETVVEMEAAL

SEQ ID NO: 1549086 - protein, 30 aa, Mycobacterium tuberculosis; identical to SEQ ID NO: 235814

SEQ ID NO: 1549087 - protein, 31 aa, Mycobacterium tuberculosis
AINAPTQLWLGRPLIGDGVHGAPGTGQPGGA

SEQ ID NO: 1549088 - protein, 18 aa, Mycobacterium tuberculosis
AIPCVALGKFADAVAAEC

SEQ ID NO: 1549089 - protein, 20 aa, Mycobacterium tuberculosis
AITAESFGSGAVGPITTGSA

SEQ ID NO: 1549090 - protein, 25 aa, Mycobacterium tuberculosis
AKAVAGAFEAARAAMVDPVVVAANR

SEQ ID NO: 1549091 - protein, 20 aa, Mycobacterium tuberculosis
AKQAPGWRVSTSVDENHTHT

SEQ ID NO: 1549092 - protein, 20 aa, Mycobacterium tuberculosis
AKVVVVGGLVVVLAVVAAAA

SEQ ID NO: 1549093 - protein, 19 aa, Mycobacterium tuberculosis
ALLGRPIIGNGANGLPNTG

SEQ ID NO: 1549094 - protein, 18 aa, Mycobacterium tuberculosis
ALLGRPLIGDGAVGTASS

SEQ ID NO: 1549095 - protein, 19 aa, Mycobacterium tuberculosis
ALLGRPLIGNGANGLPGTG

SEQ ID NO: 1549096 - protein, 26 aa, Mycobacterium tuberculosis
ALNPPPMFRWMAPDPSAPMPGCTLIC

SEQ ID NO: 1549097 - protein, 26 aa, Mycobacterium tuberculosis
ALSAQMARFHQQFVQALTASVGSYAA

SEQ ID NO: 1549098 - protein, 22 aa, Mycobacterium tuberculosis
ALTACGLIAVAVARADAAASYF

SEQ ID NO: 1549099 - protein, 17 aa, Mycobacterium tuberculosis
ALVQVHRDGEFVVATVT

SEQ ID NO: 1549100 - protein, 19 aa, Mycobacterium tuberculosis
AMFHEQFVRALAAGGNSYA

SEQ ID NO: 1549101 - protein, 19 aa, Mycobacterium tuberculosis
AMGVRVATSFSARLFNLLI

SEQ ID NO: 1549102 - protein, 17 aa, Mycobacterium tuberculosis
AMLQRLDGLDVDRLTDI

SEQ ID NO: 1549103 - protein, 17 aa, Mycobacterium tuberculosis
AMVIGGQVILAGVEQTQ

SEQ ID NO: 1549104 - protein, 20 aa, Mycobacterium tuberculosis
ANGGDGGWLIGNGGAGGSGA

SEQ ID NO: 1549105 - protein, 19 aa, Mycobacterium tuberculosis
ANTGRPLIGNGANGAPGTG

SEQ ID NO: 1549106 - protein, 17 aa, Mycobacterium tuberculosis
APPRPPTPPLPINSGPA

SEQ ID NO: 1549107 - protein, 19 aa, Mycobacterium tuberculosis
APPVPVAYSVNWDAIAQCE

SEQ ID NO: 1549108 - protein, 20 aa, Mycobacterium tuberculosis
APPYPPSILLTGIIVNKLGQ

SEQ ID NO: 1549109 - protein, 24 aa, Mycobacterium tuberculosis
APTQALWGRPLIGNGADGTAANPN

SEQ ID NO: 1549110 - protein, 26 aa, Mycobacterium tuberculosis
APVALAVLACPLAGPAGPAAPGGPAG

SEQ ID NO: 1549111 - protein, 24 aa, Mycobacterium tuberculosis
AQAALFHDRFVQILQEGAAAYAMA

SEQ ID NO: 1549112 - protein, 21 aa, Mycobacterium tuberculosis
AQKYPAILAMTSLNDTRVYYV

SEQ ID NO: 1549113 - protein, 17 aa, Mycobacterium tuberculosis
AQLAANVARWPSMTKAR

SEQ ID NO: 1549114 - protein, 17 aa, Mycobacterium tuberculosis
AQLCGYGPIPAAVARTM

SEQ ID NO: 1549115 - protein, 18 aa, Mycobacterium tuberculosis
ARAAGLPRIASTAVAATT

SEQ ID NO: 1549116 - protein, 27 aa, Mycobacterium tuberculosis
ARAQAGALPALFSGLARRPRRRQIDDT

SEQ ID NO: 1549117 - protein, 18 aa, Mycobacterium tuberculosis
ARLGSGRQYMSWISLEDE

SEQ ID NO: 1549118 - protein, 24 aa, Mycobacterium tuberculosis
ARLGSGRQYMSWISLEDEVRALQF

SEQ ID NO: 1549119 - protein, 18 aa, Mycobacterium tuberculosis
ARQALAAAPELQFKPGTR

SEQ ID NO: 1549120 - protein, 21 aa, Mycobacterium tuberculosis
ARTADRLKAAGFTVTDVGNLS

SEQ ID NO: 1549121 - protein, 23 aa, Mycobacterium tuberculosis
ARTADRLKAAGFTVTDVGNLSLP

SEQ ID NO: 1549122 - protein, 20 aa, Mycobacterium tuberculosis
ASGCAWKPPTTRPSPPNTCK

SEQ ID NO: 1549123 - protein, 18 aa, Mycobacterium tuberculosis
ATLDRYNAYAARGADPDF

SEQ ID NO: 1549124 - protein, 20 aa, Mycobacterium tuberculosis
ATPGDGWASLASSIGGQVLL

SEQ ID NO: 1549125 - protein, 17 aa, Mycobacterium tuberculosis
ATSFSARLFNLLITNAP

SEQ ID NO: 1549126 - protein, 20 aa, Mycobacterium tuberculosis
AVASDLAGIGSALAEANAAA

SEQ ID NO: 1549127 - protein, 18 aa, Mycobacterium tuberculosis
AVEAEYELMWAADVAAMA

SEQ ID NO: 1549128 - protein, 22 aa, Mycobacterium tuberculosis
AVKRMWLLLAIVVVAVVGGLGI

SEQ ID NO: 1549129 - protein, 17 aa, Mycobacterium tuberculosis
AVPDMLSSAAGDLASIG

SEQ ID NO: 1549130 - protein, 18 aa, Mycobacterium tuberculosis
AVPGRVVALGQTVQASDS

SEQ ID NO: 1549131 - protein, 21 aa, Mycobacterium tuberculosis
AWDGLWDPTLPMIPSANIPGD

SEQ ID NO: 1549132 - protein, 20 aa, Mycobacterium tuberculosis
AYPAAFPVGMLPTNQNDAGL

SEQ ID NO: 1549133 - protein, 24 aa, Mycobacterium tuberculosis
CESDEPYLPLNDGYNWKGDPNATV

SEQ ID NO: 1549134 - protein, 21 aa, Mycobacterium tuberculosis
CYGPCKGAVVALEPSTGKILA

SEQ ID NO: 1549135 - protein, 18 aa, Mycobacterium tuberculosis
DAEGGSVFGRLVNTSSEA

SEQ ID NO: 1549136 - protein, 22 aa, Mycobacterium tuberculosis
DEQLLLLPLTSLRGLRHTLKKL

SEQ ID NO: 1549137 - protein, 26 aa, Mycobacterium tuberculosis
DEVSIAVAALFGMHGQAYQALSVQAS

SEQ ID NO: 1549138 - protein, 17 aa, Mycobacterium tuberculosis
DGAPATLIGGPDGGDGG

SEQ ID NO: 1549139 - protein, 22 aa, Mycobacterium tuberculosis
DGGAGGAAFLMGSGGNGGSGGA

SEQ ID NO: 1549140 - protein, 23 aa, Mycobacterium tuberculosis
DGGDGGAGGIFFGTGGTGGAGGV

SEQ ID NO: 1549141 - protein, 18 aa, Mycobacterium tuberculosis
DGGKGGAGDPSFAVNNGA

SEQ ID NO: 1549142 - protein, 26 aa, Mycobacterium tuberculosis
DGGNAGFGAGVPGDGGIGGTGGAGGA

SEQ ID NO: 1549143 - protein, 17 aa, Mycobacterium tuberculosis
DGGRDEQLLLLPLTSLR

SEQ ID NO: 1549144 - protein, 20 aa, Mycobacterium tuberculosis
DGGSAGWLSGNGGDAGTGGG

SEQ ID NO: 1549145 - protein, 24 aa, Mycobacterium tuberculosis
DGQLQWVSIPAWALCVAFCDRPGG

SEQ ID NO: 1549146 - protein, 25 aa, Mycobacterium tuberculosis
DLSELPSHCRGLLVGRVAGAHTPAA

SEQ ID NO: 1549147 - protein, 25 aa, Mycobacterium tuberculosis
DLTDLLWRMGIRTIGQFAALSRTDV

SEQ ID NO: 1549148 - protein, 17 aa, Mycobacterium tuberculosis
DLVELGRSLQHMAAGHV

SEQ ID NO: 1549149 - protein, 18 aa, Mycobacterium tuberculosis
DQVARCESGGNWSINTGN

SEQ ID NO: 1549150 - protein, 20 aa, Mycobacterium tuberculosis
DSPQRLWEALLRGDDLVGEI

SEQ ID NO: 1549151 - protein, 19 aa, Mycobacterium tuberculosis
DSYQPAWVYQGQDVDDVRD

SEQ ID NO: 1549152 - protein, 18 aa, Mycobacterium tuberculosis
DVADGARLVDSIEGEPGL

SEQ ID NO: 1549153 - protein, 19 aa, Mycobacterium tuberculosis
DVLECLAGLASDAGTHHAA

SEQ ID NO: 1549154 - protein, 19 aa, Mycobacterium tuberculosis
EALAATATYLTGIGSAISA

SEQ ID NO: 1549155 - protein, 19 aa, Mycobacterium tuberculosis
EALGLARLGATVVVNDVAS

SEQ ID NO: 1549156 - protein, 20 aa, Mycobacterium tuberculosis
EALLGRPLIGNGADGTAPGQ

SEQ ID NO: 1549157 - protein, 17 aa, Mycobacterium tuberculosis
EALVADALLALAYTATG

SEQ ID NO: 1549158 - protein, 17 aa, Mycobacterium tuberculosis
EANWPQHLAGAYVSSGM

SEQ ID NO: 1549159 - protein, 25 aa, Mycobacterium tuberculosis
EDGWVRAQLLHYMRSAPDFYFDEMS

SEQ ID NO: 1549160 - protein, 18 aa, Mycobacterium tuberculosis
EEGLRCHFDAGNYQMAVE

SEQ ID NO: 1549161 - protein, 24 aa, Mycobacterium tuberculosis
EGAEGWECQRAMSVANNVVVDVNA

SEQ ID NO: 1549162 - protein, 22 aa, Mycobacterium tuberculosis
EGELRPQLLDRFGLTVDVQASR

SEQ ID NO: 1549163 - protein, 20 aa, Mycobacterium tuberculosis
EHKTRIRGASFVDRDGNELF

SEQ ID NO: 1549164 - protein, 21 aa, Mycobacterium tuberculosis
EKAYGAGPCSGHLTDIEHIVL

SEQ ID NO: 1549165 - protein, 22 aa, Mycobacterium tuberculosis
ELAVFWTARSIGCSWCVDFGAM

SEQ ID NO: 1549166 - protein, 24 aa, Mycobacterium tuberculosis
ELELYKRLPGDLSILTPSPASDTD

SEQ ID NO: 1549167 - protein, 17 aa, Mycobacterium tuberculosis
EPLPEEPWRSAVEATGS

SEQ ID NO: 1549168 - protein, 25 aa, Mycobacterium tuberculosis
EQFVKRLGTHAAIFTVPNFLELDYW

SEQ ID NO: 1549169 - protein, 26 aa, Mycobacterium tuberculosis
EQLELLVGLVCLQAAAVLGRPSAEDV

SEQ ID NO: 1549170 - protein, 27 aa, Mycobacterium tuberculosis
ERTLFRRLAVFVGCFFVDDAQAVACSG

SEQ ID NO: 1549171 - protein, 21 aa, Mycobacterium tuberculosis
ETPGCVAYIGISFLDQASQRG

SEQ ID NO: 1549172 - protein, 21 aa, Mycobacterium tuberculosis
EVIAAAATDLASLGSSISAAN

SEQ ID NO: 1549173 - protein, 22 aa, Mycobacterium tuberculosis
EVSAAIAALFSSYARDYQTLSV

SEQ ID NO: 1549174 - protein, 22 aa, Mycobacterium tuberculosis
EVSAAIAGLFGAHARQYQALSV

SEQ ID NO: 1549175 - protein, 21 aa, Mycobacterium tuberculosis
EVSAAVAALFSAHAGQYQQLG

SEQ ID NO: 1549176 - protein, 27 aa, Mycobacterium tuberculosis
EWDAVIAVHLRGHFLLTRNAAAYWRDK

SEQ ID NO: 1549177 - protein, 20 aa, Mycobacterium tuberculosis
FANIPPERYVQVNGTPGPDE

SEQ ID NO: 1549178 - protein, 20 aa, Mycobacterium tuberculosis
FDCSGLVRYAFAGVGVVIPR

SEQ ID NO: 1549179 - protein, 21 aa, Mycobacterium tuberculosis
FEQHLRAVLDYPLGDSDAVVP

SEQ ID NO: 1549180 - protein, 22 aa, Mycobacterium tuberculosis
FEQHLRAVLDYPLGDSDAVVPV

SEQ ID NO: 1549181 - protein, 20 aa, Mycobacterium tuberculosis
FGPYHLKRLLGRGGMGEVYE

SEQ ID NO: 1549182 - protein, 19 aa, Mycobacterium tuberculosis
FKTHGCQPWQNTGSEGAAP

SEQ ID NO: 1549183 - protein, 25 aa, Mycobacterium tuberculosis
FNTTFPVGPFFGLGVVNISGIEIKD

SEQ ID NO: 1549184 - protein, 25 aa, Mycobacterium tuberculosis
FQHVRAAMLSHGWIDGPPPGQYFHG

SEQ ID NO: 1549185 - protein, 17 aa, Mycobacterium tuberculosis
FSAYLGFTIEQFPLTYH

SEQ ID NO: 1549186 - protein, 20 aa, Mycobacterium tuberculosis
FSERARGAAGLADVVVTNHA

SEQ ID NO: 1549187 - protein, 17 aa, Mycobacterium tuberculosis
FSETGAIKAKSVIIAAG

SEQ ID NO: 1549188 - protein, 27 aa, Mycobacterium tuberculosis
FSGHGEGYQAIARQMAAFHDQFTLALT

SEQ ID NO: 1549189 - protein, 19 aa, Mycobacterium tuberculosis
FTQHLKLGYRDAVAVVDSA

SEQ ID NO: 1549190 - protein, 22 aa, Mycobacterium tuberculosis
FVTGVMSSGFFNFGTGNSGLLV

SEQ ID NO: 1549191 - protein, 18 aa, Mycobacterium tuberculosis
FYVWDFAEKFKEDVINDF

SEQ ID NO: 1549192 - protein, 20 aa, Mycobacterium tuberculosis
GAASPGRPTGTTAAALTSLP

SEQ ID NO: 1549193 - protein, 28 aa, Mycobacterium tuberculosis
GADEVSARIAALFGGFGLEYQAISAQVA

SEQ ID NO: 1549194 - protein, 25 aa, Mycobacterium tuberculosis
GADEVSTAIAALFGAHGQAYQALSA

SEQ ID NO: 1549195 - protein, 23 aa, Mycobacterium tuberculosis
GAGGAGGLLFGNGGAGAAGAPGQ

SEQ ID NO: 1549196 - protein, 26 aa, Mycobacterium tuberculosis
GAGGAGGRGALLLGAGGQGGLGGAGG

SEQ ID NO: 1549197 - protein, 21 aa, Mycobacterium tuberculosis
GAGGGGGWLFGNGGDGGAGGG

SEQ ID NO: 1549198 - protein, 18 aa, Mycobacterium tuberculosis
GAGGILWGNGGNGGSGAP

SEQ ID NO: 1549199 - protein, 17 aa, Mycobacterium tuberculosis
GAGGLLWGNGGNGGAGD

SEQ ID NO: 1549200 - protein, 20 aa, Mycobacterium tuberculosis
GAGGNAMLFGAGGAGGAGGG

SEQ ID NO: 1549201 - protein, 22 aa, Mycobacterium tuberculosis
GAGTVGFDCSGLVLYSFAGVGI

SEQ ID NO: 1549202 - protein, 29 aa, Mycobacterium tuberculosis
GAKTARFVKRYADVGGELRRAAMQYAQEV

SEQ ID NO: 1549203 - protein, 19 aa, Mycobacterium tuberculosis
GALALASSLLRVWMTRGRI

SEQ ID NO: 1549204 - protein, 23 aa, Mycobacterium tuberculosis
GALSQDGNGFAGGQGGQGGVGGN

SEQ ID NO: 1549205 - protein, 26 aa, Mycobacterium tuberculosis
GARSPRLRSPLALMVATRGARSPRLR

SEQ ID NO: 1549206 - protein, 18 aa, Mycobacterium tuberculosis
GATGGARGKRRQRWHREV

SEQ ID NO: 1549207 - protein, 29 aa, Mycobacterium tuberculosis
GDGGKGGFADEFTGGFAQGGRGGFGGNGN

SEQ ID NO: 1549208 - protein, 25 aa, Mycobacterium tuberculosis
GDGGNGRSGPVNVAGSAGGNGGAGG

SEQ ID NO: 1549209 - protein, 18 aa, Mycobacterium tuberculosis
GDRVRIAGLGVGTVEGLK

SEQ ID NO: 1549210 - protein, 24 aa, Mycobacterium tuberculosis
GDSSSWKGWGHVRWFIEEVPAGAA

SEQ ID NO: 1549211 - protein, 18 aa, Mycobacterium tuberculosis
GGAAGLWGSGGSGGQGGN

SEQ ID NO: 1549212 - protein, 18 aa, Mycobacterium tuberculosis
GGAAVQAKAVAGAFEAAR

SEQ ID NO: 1549213 - protein, 32 aa, Mycobacterium tuberculosis; identical to SEQ ID NO: 1473066

SEQ ID NO: 1549214 - protein, 27 aa, Mycobacterium tuberculosis
GGAGGAAGQLFSASGAAGNAGVGGAGG

SEQ ID NO: 1549215 - protein, 27 aa, Mycobacterium tuberculosis
GGAGGAGGDGGWLFGDGGAGGTGGNGG

SEQ ID NO: 1549216 - protein, 28 aa, Mycobacterium tuberculosis
GGAGGAGGDGGWLFGDGGAGGTGGNGGS

SEQ ID NO: 1549217 - protein, 21 aa, Mycobacterium tuberculosis
GGAGGGAFVHIATATSTGGSG

SEQ ID NO: 1549218 - protein, 19 aa, Mycobacterium tuberculosis
GGAGGLLFGDGGNGGAGGA

SEQ ID NO: 1549219 - protein, 21 aa, Mycobacterium tuberculosis
GGAGGRGGDAGLLFGAAGTGG

SEQ ID NO: 1549220 - protein, 23 aa, Mycobacterium tuberculosis
GGAGGSGGWLYGNGGNGGIGGNA

SEQ ID NO: 1549221 - protein, 22 aa, Mycobacterium tuberculosis
GGDARFLSLLSIRQLATEPSLS

SEQ ID NO: 1549222 - protein, 18 aa, Mycobacterium tuberculosis
GGEMGRLWYENGKLLDKK

SEQ ID NO: 1549223 - protein, 19 aa, Mycobacterium tuberculosis
GGGLPPVPASPGGNGGGGG

SEQ ID NO: 1549224 - protein, 31 aa, Mycobacterium tuberculosis
GGGTGGAGGRAELLFGAGGAGGAGTDGGPGA

SEQ ID NO: 1549225 - protein, 18 aa, Mycobacterium tuberculosis
GGLLYGNGGNGFSQTTAG

SEQ ID NO: 1549226 - protein, 20 aa, Mycobacterium tuberculosis
GGNAGTVFGSGGAGGNGGVG

SEQ ID NO: 1549227 - protein, 20 aa, Mycobacterium tuberculosis
GGNAGVGLTAKAGDGGAAGN

SEQ ID NO: 1549228 - protein, 27 aa, Mycobacterium tuberculosis
GGNGGKGGTGLMPGINGTGGAGGSRGQ

SEQ ID NO: 1549229 - protein, 26 aa, Mycobacterium tuberculosis
GGNGGSAARLFGGGGAGGAGGTGSTA

SEQ ID NO: 1549230 - protein, 27 aa, Mycobacterium tuberculosis
GGNGGSAARLFGGGGAGGAGGTGSTAG

SEQ ID NO: 1549231 - protein, 19 aa, Mycobacterium tuberculosis
GGVGQGFAGGIGGAGGTPG

SEQ ID NO: 1549232 - protein, 24 aa, Mycobacterium tuberculosis
GGVVCAVSAVAADPAVTAVAGVAV

SEQ ID NO: 1549233 - protein, 24 aa, Mycobacterium tuberculosis
GHAGRITAPRGWELVRHAGPLPSH

SEQ ID NO: 1549234 - protein, 29 aa, Mycobacterium tuberculosis
GHGGAGGAGGRAWLWGTGGAGGAGGDGGW

SEQ ID NO: 1549235 - protein, 18 aa, Mycobacterium tuberculosis
GHSWRKRPATGWESLTPT

SEQ ID NO: 1549236 - protein, 17 aa, Mycobacterium tuberculosis
GIANVPLPVGRGMGPDR

SEQ ID NO: 1549237 - protein, 19 aa, Mycobacterium tuberculosis
GKAGFSPGPTNFGLNGAGG

SEQ ID NO: 1549238 - protein, 20 aa, Mycobacterium tuberculosis
GKAGFSPGPTNFGLNGAGGG

SEQ ID NO: 1549239 - protein, 17 aa, Mycobacterium tuberculosis
GKAGWRVVSVNQNGVDV

SEQ ID NO: 1549240 - protein, 30 aa, Mycobacterium tuberculosis; identical to SEQ ID NO: 1471711

SEQ ID NO: 1549241 - protein, 18 aa, Mycobacterium tuberculosis
GLILAGWAGSVGLAGADP

SEQ ID NO: 1549242 - protein, 18 aa, Mycobacterium tuberculosis
GLLRAMICQLAVWHSPEE

SEQ ID NO: 1549243 - protein, 20 aa, Mycobacterium tuberculosis
GLQVKTIWVARAVSVLFPQI

SEQ ID NO: 1549244 - protein, 21 aa, Mycobacterium tuberculosis
GLTCFEIFLAIAEAGSLGGAA

SEQ ID NO: 1549245 - protein, 27 aa, Mycobacterium tuberculosis
GLTPFVPARPVPPCPPAPPDPNQLALP

SEQ ID NO: 1549246 - protein, 19 aa, Mycobacterium tuberculosis
GMAAVQLARQWGVEVFVTA

SEQ ID NO: 1549247 - protein, 27 aa, Mycobacterium tuberculosis
GMYGDFFAFYLCDVVLKVNGKGGQPVY

SEQ ID NO: 1549248 - protein, 19 aa, Mycobacterium tuberculosis
GNAGSFFGAAGTGGAGAST

SEQ ID NO: 1549249 - protein, 18 aa, Mycobacterium tuberculosis
GNAGTVFGSGGAGGNGGV

SEQ ID NO: 1549250 - protein, 18 aa, Mycobacterium tuberculosis
GNAGVGLTAKAGDGGAAG

SEQ ID NO: 1549251 - protein, 24 aa, Mycobacterium tuberculosis
GNGGKGGTGLMPGINGTGGAGGSR

SEQ ID NO: 1549252 - protein, 17 aa, Mycobacterium tuberculosis
GNGGNGFSQTTAGLTGG

SEQ ID NO: 1549253 - protein, 22 aa, Mycobacterium tuberculosis
GNGGSAGWLSGNGGTGGGGGTA

SEQ ID NO: 1549254 - protein, 26 aa, Mycobacterium tuberculosis
GNTAGRRADAIAGTGGDGGNGGNGGL

SEQ ID NO: 1549255 - protein, 28 aa, Mycobacterium tuberculosis
GPFTIPEIHIPKIPIDVLGSVGLGQTTI

SEQ ID NO: 1549256 - protein, 24 aa, Mycobacterium tuberculosis
GPIHIGLPLSLTIPGFTIPGGTLI

SEQ ID NO: 1549257 - protein, 25 aa, Mycobacterium tuberculosis
GPVGDGTCYWKRMGNPDGALIDNAL

SEQ ID NO: 1549258 - protein, 17 aa, Mycobacterium tuberculosis
GQANYGFAVPDIPIPAI

SEQ ID NO: 1549259 - protein, 18 aa, Mycobacterium tuberculosis
GQGFAIPIGQAMAIAGQI

SEQ ID NO: 1549260 - protein, 24 aa, Mycobacterium tuberculosis
GQHGDENFLLVGMDSRAGANANIG

SEQ ID NO: 1549261 - protein, 19 aa, Mycobacterium tuberculosis
GQNGGAGGLLWGNGGNGGA

SEQ ID NO: 1549262 - protein, 17 aa, Mycobacterium tuberculosis
GQNWLVEMEMFRAENRY

SEQ ID NO: 1549263 - protein, 17 aa, Mycobacterium tuberculosis
GQSRGAGGFGGVGQAGG

SEQ ID NO: 1549264 - protein, 21 aa, Mycobacterium tuberculosis
GRDVQRLTAWASTTVSGDRDD

SEQ ID NO: 1549265 - protein, 18 aa, Mycobacterium tuberculosis
GRGGDGGSAGWLSGNGGD

SEQ ID NO: 1549266 - protein, 19 aa, Mycobacterium tuberculosis
GRQYMSWISLEDEVRALQF

SEQ ID NO: 1549267 - protein, 18 aa, Mycobacterium tuberculosis
GRTQLLCEAVDYAGEHVA

SEQ ID NO: 1549268 - protein, 17 aa, Mycobacterium tuberculosis
GSACLAEGPPLGRNPQG

SEQ ID NO: 1549269 - protein, 24 aa, Mycobacterium tuberculosis
GSALLFPSLCHFSGGIPAPEADPP

SEQ ID NO: 1549270 - protein, 22 aa, Mycobacterium tuberculosis
GSFKFNDPFISIANFGNPNPPA

SEQ ID NO: 1549271 - protein, 25 aa, Mycobacterium tuberculosis
GSGGLPLDRAAVIIADLAQSTPTGI

SEQ ID NO: 1549272 - protein, 17 aa, Mycobacterium tuberculosis
GSGQAWQGAAAAAMVVA

SEQ ID NO: 1549273 - protein, 17 aa, Mycobacterium tuberculosis
GSGRQYMSWISLEDEVR

SEQ ID NO: 1549274 - protein, 22 aa, Mycobacterium tuberculosis
GSPRGARTVALWEPALRSDVIG

SEQ ID NO: 1549275 - protein, 28 aa, Mycobacterium tuberculosis
GSVEHFNWLEGLGFQFERSYFPGKAVIQ

SEQ ID NO: 1549276 - protein, 18 aa, Mycobacterium tuberculosis
GSVTSGLAGQSWQGAAAA

SEQ ID NO: 1549277 - protein, 25 aa, Mycobacterium tuberculosis
GTGADGGAGGWLFGNGANGTPGTGA

SEQ ID NO: 1549278 - protein, 18 aa, Mycobacterium tuberculosis
GTGGLLFGNGGAGGHGAA

SEQ ID NO: 1549279 - protein, 20 aa, Mycobacterium tuberculosis
GTMPNRLYWISATVNPDGDQ

SEQ ID NO: 1549280 - protein, 22 aa, Mycobacterium tuberculosis
GTSRAISAVAAIASDTVGARSG

SEQ ID NO: 1549281 - protein, 23 aa, Mycobacterium tuberculosis
GVAQGDIASAFGGDGGNGSDGVA

SEQ ID NO: 1549282 - protein, 24 aa, Mycobacterium tuberculosis
GVGGAGGLLFGYGGAGGAGGYSNI

SEQ ID NO: 1549283 - protein, 27 aa, Mycobacterium tuberculosis
GVGGNGATGPWLFGDGGAGGGGGAGGI

SEQ ID NO: 1549284 - protein, 28 aa, Mycobacterium tuberculosis
GVGGNGATGPWLFGDGGPTPGSTGAGAA

SEQ ID NO: 1549285 - protein, 21 aa, Mycobacterium tuberculosis
GVGGSGGWLNGNGGAGGAGGT

SEQ ID NO: 1549286 - protein, 21 aa, Mycobacterium tuberculosis
GVRLGLALRRAVVWNSGNENH

SEQ ID NO: 1549287 - protein, 17 aa, Mycobacterium tuberculosis
GYGPIPAAVARTMVASA

SEQ ID NO: 1549288 - protein, 17 aa, Mycobacterium tuberculosis
HDGQLRLSLGPKNQTFD

SEQ ID NO: 1549289 - protein, 21 aa, Mycobacterium tuberculosis
HFGQSGGFIWVDPKADLALVV

SEQ ID NO: 1549290 - protein, 28 aa, Mycobacterium tuberculosis
HGGAGGAGGRAWLWGTGGAGGAGGDGGW

SEQ ID NO: 1549291 - protein, 20 aa, Mycobacterium tuberculosis
HLACGCGKPDCPSGAGNDER

SEQ ID NO: 1549292 - protein, 24 aa, Mycobacterium tuberculosis
HSAAPLFHNIAGWLMQRENGPLSP

SEQ ID NO: 1549293 - protein, 18 aa, Mycobacterium tuberculosis
HTAGRAGAVAAVAAQAAE

SEQ ID NO: 1549294 - protein, 22 aa, Mycobacterium tuberculosis
HTSDAIAAWAAQLAAVTGQLQT

SEQ ID NO: 1549295 - protein, 17 aa, Mycobacterium tuberculosis
IAAAATDLASLGSSISA

SEQ ID NO: 1549296 - protein, 23 aa, Mycobacterium tuberculosis
IAAPEVIAAAATDLASLESSIAA

SEQ ID NO: 1549297 - protein, 19 aa, Mycobacterium tuberculosis
IADGCLVDGPLGRVGLEME

SEQ ID NO: 1549298 - protein, 17 aa, Mycobacterium tuberculosis
IAPRAALVQVHRDGEFV

SEQ ID NO: 1549299 - protein, 21 aa, Mycobacterium tuberculosis
IDTVLRAKVDAAWNLHQATSD

SEQ ID NO: 1549300 - protein, 18 aa, Mycobacterium tuberculosis
IGGEGRTGGNGGSGGDGG

SEQ ID NO: 1549301 - protein, 17 aa, Mycobacterium tuberculosis
IGLLGAVQTGAWQGPSA

SEQ ID NO: 1549302 - protein, 23 aa, Mycobacterium tuberculosis
IGSFKFNDPFISIANFGNPNPPA

SEQ ID NO: 1549303 - protein, 17 aa, Mycobacterium tuberculosis
IHRAMALPGGIEGALGV

SEQ ID NO: 1549304 - protein, 17 aa, Mycobacterium tuberculosis
IILFRRAGAPAALADSV

SEQ ID NO: 1549305 - protein, 28 aa, Mycobacterium tuberculosis
INAPTQALWGRPLIGNGADGTAANPNGG

SEQ ID NO: 1549306 - protein, 29 aa, Mycobacterium tuberculosis
INASTRAAAAATTRLLPAAADEVSAHIAA

SEQ ID NO: 1549307 - protein, 17 aa, Mycobacterium tuberculosis
INGTGGAGGSRGQISGN

SEQ ID NO: 1549308 - protein, 18 aa, Mycobacterium tuberculosis
IPEVLSKVRAVRKMVDAG

SEQ ID NO: 1549309 - protein, 21 aa, Mycobacterium tuberculosis
IQPLPPKRAGLLIRALYRIAK

SEQ ID NO: 1549310 - protein, 28 aa, Mycobacterium tuberculosis
IRADPGIPARGIVAVCDFGGSGTGITLV

SEQ ID NO: 1549311 - protein, 20 aa, Mycobacterium tuberculosis
IRTDTILGRKVLEIEPRGAQ

SEQ ID NO: 1549312 - protein, 31 aa, Mycobacterium tuberculosis
ISPEDFWRSAGLPAYRWPDPNGTRFPNGAPP

SEQ ID NO: 1549313 - protein, 25 aa, Mycobacterium tuberculosis
ISPTPRPASVITIARPGTSLSESDR

SEQ ID NO: 1549314 - protein, 17 aa, Mycobacterium tuberculosis
ITLWLGLVAQFGQMITG

SEQ ID NO: 1549315 - protein, 18 aa, Mycobacterium tuberculosis
IVQAVLFNAIDFVDGTVT

SEQ ID NO: 1549316 - protein, 18 aa, Mycobacterium tuberculosis
IYTKRMQKALNFEGDDVP

SEQ ID NO: 1549317 - protein, 20 aa, Mycobacterium tuberculosis
IYTYHSKTLGWCDIAYNALV

SEQ ID NO: 1549318 - protein, 24 aa, Mycobacterium tuberculosis
KAGPEIRSGVTFAAKGVATRGARS

SEQ ID NO: 1549319 - protein, 24 aa, Mycobacterium tuberculosis
KAKTYRWTFADVKGSPPTITVIDT

SEQ ID NO: 1549320 - protein, 19 aa, Mycobacterium tuberculosis
KIFRTRALRVPGVGTGAPG

SEQ ID NO: 1549321 - protein, 17 aa, Mycobacterium tuberculosis
KLLSSILTYHVIAGQAS

SEQ ID NO: 1549322 - protein, 23 aa, Mycobacterium tuberculosis
KNSRLNMVSALDPHSGDIVNPSG

SEQ ID NO: 1549323 - protein, 24 aa, Mycobacterium tuberculosis
KQDPEGWGKSPGFGTTVDFPAVPG

SEQ ID NO: 1549324 - protein, 23 aa, Mycobacterium tuberculosis
KRAALRCLKRRLARTVFQALRTV

SEQ ID NO: 1549325 - protein, 17 aa, Mycobacterium tuberculosis
KTGARYSFQVAKVDNGR

SEQ ID NO: 1549326 - protein, 22 aa, Mycobacterium tuberculosis
LAAAAARAGGAAVQAKAVAGAF

SEQ ID NO: 1549327 - protein, 18 aa, Mycobacterium tuberculosis
LAASRLRYARAMRERLPK

SEQ ID NO: 1549328 - protein, 17 aa, Mycobacterium tuberculosis
LAEGPPLGRNPQGAPAP

SEQ ID NO: 1549329 - protein, 17 aa, Mycobacterium tuberculosis
LAGIGSALAEANAAALA

SEQ ID NO: 1549330 - protein, 27 aa, Mycobacterium tuberculosis
LALALTCGAGLLKWQDGAVRDAAVARA

SEQ ID NO: 1549331 - protein, 22 aa, Mycobacterium tuberculosis
LANTGRPLIGNGANGAPGTGAN

SEQ ID NO: 1549332 - protein, 20 aa, Mycobacterium tuberculosis
LASSLLRVWMTRGRIQEGRA

SEQ ID NO: 1549333 - protein, 23 aa, Mycobacterium tuberculosis
LATQGRGAWPVCGRGLSNATPRE

SEQ ID NO: 1549334 - protein, 17 aa, Mycobacterium tuberculosis
LCGYGPIPAAVARTMVA

SEQ ID NO: 1549335 - protein, 20 aa, Mycobacterium tuberculosis
LDVLERMGLLAAAQEHKTRI

SEQ ID NO: 1549336 - protein, 20 aa, Mycobacterium tuberculosis
LELDLHYLPRLEGHGAPGVT

SEQ ID NO: 1549337 - protein, 20 aa, Mycobacterium tuberculosis
LESARSRLTGTFLDAYTQLT

SEQ ID NO: 1549338 - protein, 18 aa, Mycobacterium tuberculosis
LFGAHARQYQALSVQVAA

SEQ ID NO: 1549339 - protein, 25 aa, Mycobacterium tuberculosis
LFNLSRLNNVVNMFIGNSYVDNVKT

SEQ ID NO: 1549340 - protein, 18 aa, Mycobacterium tuberculosis
LFSAHGRAYQVASAQAAA

SEQ ID NO: 1549341 - protein, 25 aa, Mycobacterium tuberculosis
LGYTLSCRRAHRPVRTVVTASSFDE

SEQ ID NO: 1549342 - protein, 17 aa, Mycobacterium tuberculosis
LHKGDRVRIAGLGVGTV

SEQ ID NO: 1549343 - protein, 21 aa, Mycobacterium tuberculosis
LKTATGLTLPPTVIFDHPTPT

SEQ ID NO: 1549344 - protein, 19 aa, Mycobacterium tuberculosis
LLATAALDLASIGSQVSAA

SEQ ID NO: 1549345 - protein, 20 aa, Mycobacterium tuberculosis
LLGAWLEATMARWPRRRSMR

SEQ ID NO: 1549346 - protein, 24 aa, Mycobacterium tuberculosis
LLGNGNFGFGNAFGDGNLGSGNVG

SEQ ID NO: 1549347 - protein, 29 aa, Mycobacterium tuberculosis
LLPAAADEVSAHIAALFSGHGEGYQAIAR

SEQ ID NO: 1549348 - protein, 22 aa, Mycobacterium tuberculosis
LLSGDRVIPQWVKIRNVDRFNG

SEQ ID NO: 1549349 - protein, 25 aa, Mycobacterium tuberculosis
LMDRWSRGRVALVGDAGYCCSPLSG

SEQ ID NO: 1549350 - protein, 41 aa, Mycobacterium tuberculosis
LMPASSAARCAARIVGGRCLMPASSAARCAARIVGGPRLYG

SEQ ID NO: 1549351 - protein, 17 aa, Mycobacterium tuberculosis
LNDGYNWKGDPNATVPG

SEQ ID NO: 1549352 - protein, 22 aa, Mycobacterium tuberculosis
LNLPPPCTTGFLPAQQRRIPTF

SEQ ID NO: 1549353 - protein, 18 aa, Mycobacterium tuberculosis
LNLSFAIAVRKRAKADAQ

SEQ ID NO: 1549354 - protein, 18 aa, Mycobacterium tuberculosis
LNSSDGYLLTAHYAVRVT

SEQ ID NO: 1549355 - protein, 17 aa, Mycobacterium tuberculosis
LPWSVLKQLHAGDSDDG

SEQ ID NO: 1549356 - protein, 18 aa, Mycobacterium tuberculosis
LQGINFGFGNIGSLNLGS

SEQ ID NO: 1549357 - protein, 19 aa, Mycobacterium tuberculosis
LQPTVPILLANLVSVGQVA

SEQ ID NO: 1549358 - protein, 39 aa, Mycobacterium tuberculosis; identical to SEQ ID NO: 202983

SEQ ID NO: 1549359 - protein, 25 aa, Mycobacterium tuberculosis
LSALSRAVAVAWRRSLQLRVVALTL

SEQ ID NO: 1549360 - protein, 18 aa, Mycobacterium tuberculosis
LTDIPVRVYWPPVVRDNL

SEQ ID NO: 1549361 - protein, 19 aa, Mycobacterium tuberculosis
LTDIPVRVYWPPVVRDNLP

SEQ ID NO: 1549362 - protein, 20 aa, Mycobacterium tuberculosis
LTGGAWQWSASKNSRLNMVS

SEQ ID NO: 1549363 - protein, 17 aa, Mycobacterium tuberculosis
LTLPPTVIFDHPTPTAV

SEQ ID NO: 1549364 - protein, 31 aa, Mycobacterium tuberculosis
LTPIAAGPRRARSGAGTGLAGVAAVAAFTAG

SEQ ID NO: 1549365 - protein, 22 aa, Mycobacterium tuberculosis
LTPPRAVAIITQIASALDAAHA

SEQ ID NO: 1549366 - protein, 17 aa, Mycobacterium tuberculosis
LTRALRIRTRLVADVAV

SEQ ID NO: 1549367 - protein, 18 aa, Mycobacterium tuberculosis
LVAEILRIISGGRLIWDP

SEQ ID NO: 1549368 - protein, 21 aa, Mycobacterium tuberculosis
LVKTFWGWRDQQLPDGTLILT

SEQ ID NO: 1549369 - protein, 21 aa, Mycobacterium tuberculosis
LVLGAIGIWIAIRPKPVQPPQ

SEQ ID NO: 1549370 - protein, 17 aa, Mycobacterium tuberculosis
LYGNGGNGFSQTTAGLT

SEQ ID NO: 1549371 - protein, 25 aa, Mycobacterium tuberculosis
MFAALRAGQLVAAWTTTADPDIPAD

SEQ ID NO: 1549372 - protein, 18 aa, Mycobacterium tuberculosis
MGRPEYPTPVGSYTVLSK

SEQ ID NO: 1549373 - protein, 25 aa, Mycobacterium tuberculosis
MYEQMWAADVAAMVGYHGGASAAAA

SEQ ID NO: 1549374 - protein, 25 aa, Mycobacterium tuberculosis
MYGDFFAFYLCDVVLKVNGKGGQPV

SEQ ID NO: 1549375 - protein, 17 aa, Mycobacterium tuberculosis
NAGFFNMGIGNAGNEDM

SEQ ID NO: 1549376 - protein, 25 aa, Mycobacterium tuberculosis
NAPTEALLGRPLIGNGADGTAPGQP

SEQ ID NO: 1549377 - protein, 26 aa, Mycobacterium tuberculosis
NAPTQALWGRPLIGNGADGTAANPNG

SEQ ID NO: 1549378 - protein, 25 aa, Mycobacterium tuberculosis
NAPTQLWLGRPLIGDGVHGAPGTGQ

SEQ ID NO: 1549379 - protein, 26 aa, Mycobacterium tuberculosis
NAPTQLWLGRPLIGDGVHGAPGTGQP

SEQ ID NO: 1549380 - protein, 29 aa, Mycobacterium tuberculosis
NDSNGILWRGNFEGLFSAYLGFTIEQFPL

SEQ ID NO: 1549381 - protein, 17 aa, Mycobacterium tuberculosis
NDYVGVYANDSWGPATV

SEQ ID NO: 1549382 - protein, 19 aa, Mycobacterium tuberculosis
NFAGGQGGAGGRGGAGGNG

SEQ ID NO: 1549383 - protein, 20 aa, Mycobacterium tuberculosis
NGGSAGWLSGNGGTGGGGGT

SEQ ID NO: 1549384 - protein, 23 aa, Mycobacterium tuberculosis
NGPFQALFGRPLIGDGANGAPGQ

SEQ ID NO: 1549385 - protein, 21 aa, Mycobacterium tuberculosis
NKLAAPVGVRSDCLGVDAPLP

SEQ ID NO: 1549386 - protein, 18 aa, Mycobacterium tuberculosis
NNIGFGLTGDNLVGIGAL

SEQ ID NO: 1549387 - protein, 22 aa, Mycobacterium tuberculosis
NNTEARAALAFMDTELRIDYRD

SEQ ID NO: 1549388 - protein, 18 aa, Mycobacterium tuberculosis
NPTGIGGTGGDGGTGGAA

SEQ ID NO: 1549389 - protein, 17 aa, Mycobacterium tuberculosis
NPTGIGGTGGTGGKGGA

SEQ ID NO: 1549390 - protein, 25 aa, Mycobacterium tuberculosis
NPVEAFQFYFELLLFDYPTHIVQIV

SEQ ID NO: 1549391 - protein, 25 aa, Mycobacterium tuberculosis
NSTAECSGEICRRQAGGHQVDATDP

SEQ ID NO: 1549392 - protein, 17 aa, Mycobacterium tuberculosis
NTGRPLIGNGTNGAPGT

SEQ ID NO: 1549393 - protein, 17 aa, Mycobacterium tuberculosis
NTRIVLGGYSQGATVID

SEQ ID NO: 1549394 - protein, 25 aa, Mycobacterium tuberculosis
PADRHPHCAWTVIIDESYPEAEGIP

SEQ ID NO: 1549395 - protein, 27 aa, Mycobacterium tuberculosis
PARPAARFVRPAIPSALSVALLVCTPG

SEQ ID NO: 1549396 - protein, 21 aa, Mycobacterium tuberculosis
PDPRAADIVETWAHVLDQLER

SEQ ID NO: 1549397 - protein, 26 aa, Mycobacterium tuberculosis
PDPSAPMPGCTLICIGSHGPPVGAPP

SEQ ID NO: 1549398 - protein, 17 aa, Mycobacterium tuberculosis
PELPDWAQTVTVEQLMH

SEQ ID NO: 1549399 - protein, 18 aa, Mycobacterium tuberculosis
PGLVPRPGVPAAAAVPRV

SEQ ID NO: 1549400 - protein, 17 aa, Mycobacterium tuberculosis
PGPLQGINFGFGNIGSL

SEQ ID NO: 1549401 - protein, 18 aa, Mycobacterium tuberculosis
PGQPGGPGGLLYGNGGNG

SEQ ID NO: 1549402 - protein, 28 aa, Mycobacterium tuberculosis
PGVPGRSVSRWGAFLDDVGGFDCDFFGL

SEQ ID NO: 1549403 - protein, 19 aa, Mycobacterium tuberculosis
PHMERRFSADGTSWDPTEL

SEQ ID NO: 1549404 - protein, 20 aa, Mycobacterium tuberculosis
PLPPDSNGYVFIETKSGMTR

SEQ ID NO: 1549405 - protein, 24 aa, Mycobacterium tuberculosis
PLQALQLELLNAINAPTLALLGRP

SEQ ID NO: 1549406 - protein, 21 aa, Mycobacterium tuberculosis
PLTYHAVGGIGPLHVAPVPIS

SEQ ID NO: 1549407 - protein, 21 aa, Mycobacterium tuberculosis
PMLAAAAAWDGLAAELGLAAE

SEQ ID NO: 1549408 - protein, 18 aa, Mycobacterium tuberculosis
PQQARKGDLIFYGPEGTQ

SEQ ID NO: 1549409 - protein, 25 aa, Mycobacterium tuberculosis
PRAELLRPGLLVLPVRGPARFFGSE

SEQ ID NO: 1549410 - protein, 22 aa, Mycobacterium tuberculosis
PRASGPAGMTGMPMVPPGALGA

SEQ ID NO: 1549411 - protein, 22 aa, Mycobacterium tuberculosis
PRTSDMKALFTAIIDDDPLPLE

SEQ ID NO: 1549412 - protein, 17 aa, Mycobacterium tuberculosis
PSILLTGIIVNKLGQRF

SEQ ID NO: 1549413 - protein, 20 aa, Mycobacterium tuberculosis
PSTGPSMGILPAGGVGGPGG

SEQ ID NO: 1549414 - protein, 17 aa, Mycobacterium tuberculosis
PSVRELAVFWTARSIGC

SEQ ID NO: 1549415 - protein, 23 aa, Mycobacterium tuberculosis
PVAEERLSALLLNSSEVNAVMGS

SEQ ID NO: 1549416 - protein, 21 aa, Mycobacterium tuberculosis
PVHAECAGLLYLVSELDGHPM

SEQ ID NO: 1549417 - protein, 19 aa, Mycobacterium tuberculosis
PYLPLQVPQQLSLPADLPA

SEQ ID NO: 1549418 - protein, 22 aa, Mycobacterium tuberculosis
QACAAGARIISWARVERILHRA

SEQ ID NO: 1549419 - protein, 22 aa, Mycobacterium tuberculosis
QALLGRPLIGNGADGTAANPNG

SEQ ID NO: 1549420 - protein, 23 aa, Mycobacterium tuberculosis
QALLGRPLIGNGANGLPGTGQNG

SEQ ID NO: 1549421 - protein, 21 aa, Mycobacterium tuberculosis
QAQAFHAQFVQALTSGGGAYA

SEQ ID NO: 1549422 - protein, 17 aa, Mycobacterium tuberculosis
QGPLGAAINQAADTLDG

SEQ ID NO: 1549423 - protein, 19 aa, Mycobacterium tuberculosis
QLLIDRLSVQRVMAHQMST

SEQ ID NO: 1549424 - protein, 17 aa, Mycobacterium tuberculosis
QRLRIDLSALRIIGDGL

SEQ ID NO: 1549425 - protein, 22 aa, Mycobacterium tuberculosis
QSASGPLGLMKTILALRHGVVP

SEQ ID NO: 1549426 - protein, 19 aa, Mycobacterium tuberculosis
QSTDQRLLDLINGPTQALL

SEQ ID NO: 1549427 - protein, 20 aa, Mycobacterium tuberculosis
QTLTGRPLIGNGANGTPGTG

SEQ ID NO: 1549428 - protein, 26 aa, Mycobacterium tuberculosis
RAAGLPRLSWFAGLTWFAGGSTGAGC

SEQ ID NO: 1549429 - protein, 18 aa, Mycobacterium tuberculosis
RAASLGIQIRYETGATEL

SEQ ID NO: 1549430 - protein, 20 aa, Mycobacterium tuberculosis
RAGSAMPAVASAGCAGDADG

SEQ ID NO: 1549431 - protein, 17 aa, Mycobacterium tuberculosis
RALELDLHYLPRLEGHG

SEQ ID NO: 1549432 - protein, 26 aa, Mycobacterium tuberculosis
RARLFPRGLAAFIELRDQRCRTPYCD

SEQ ID NO: 1549433 - protein, 34 aa, Mycobacterium tuberculosis
RCAARIVGGRCLMPASSAARCAARIVGGRCLMPA

SEQ ID NO: 1549434 - protein, 22 aa, Mycobacterium tuberculosis
RDAYLQSWVHRTARFQDALQDP

SEQ ID NO: 1549435 - protein, 17 aa, Mycobacterium tuberculosis
RDGTCVLVIAPAPALPD

SEQ ID NO: 1549436 - protein, 18 aa, Mycobacterium tuberculosis
REPHSWDLCVGHAGRITA

SEQ ID NO: 1549437 - protein, 20 aa, Mycobacterium tuberculosis
RGAGHLGFAGTARREAVADA

SEQ ID NO: 1549438 - protein, 25 aa, Mycobacterium tuberculosis
RGHTRNCRLHWVQIIPTIASQSTPQ

SEQ ID NO: 1549439 - protein, 19 aa, Mycobacterium tuberculosis
RGLLRAMICQLAVWHSPEE

SEQ ID NO: 1549440 - protein, 18 aa, Mycobacterium tuberculosis
RGLSQRGVPFSWAGGGIS

SEQ ID NO: 1549441 - protein, 17 aa, Mycobacterium tuberculosis
RGLYSGAVVMLSADGGL

SEQ ID NO: 1549442 - protein, 17 aa, Mycobacterium tuberculosis
RGTRAVIRYDNLFGDRY

SEQ ID NO: 1549443 - protein, 20 aa, Mycobacterium tuberculosis
RGVASSRPAIWCNSDADNDR

SEQ ID NO: 1549444 - protein, 21 aa, Mycobacterium tuberculosis
RHRAWQGLVLLVLALLLSSCG

SEQ ID NO: 1549445 - protein, 28 aa, Mycobacterium tuberculosis
RHTLKKLSGLRARNGLLTASGDNASGSG

SEQ ID NO: 1549446 - protein, 17 aa, Mycobacterium tuberculosis
RKAARLTIDGVTHTTRP

SEQ ID NO: 1549447 - protein, 25 aa, Mycobacterium tuberculosis
RKPSRVPVWFMRQAGRSLPEYRALR

SEQ ID NO: 1549448 - protein, 18 aa, Mycobacterium tuberculosis
RLAVQAMTAVVARHVDLA

SEQ ID NO: 1549449 - protein, 21 aa, Mycobacterium tuberculosis
RLRLTRQALLAAAVVPLLAGC

SEQ ID NO: 1549450 - protein, 19 aa, Mycobacterium tuberculosis
RMRIGLMGIVVALLVVAVG

SEQ ID NO: 1549451 - protein, 18 aa, Mycobacterium tuberculosis
RMVEALGGVEVCSTTPLR

SEQ ID NO: 1549452 - protein, 19 aa, Mycobacterium tuberculosis
RPALGLSIGVTNLAAVAAD

SEQ ID NO: 1549453 - protein, 18 aa, Mycobacterium tuberculosis
RPGVPAAAAVPRVGPPAV

SEQ ID NO: 1549454 - protein, 17 aa, Mycobacterium tuberculosis
RPNARGAGHTGLTTAPA

SEQ ID NO: 1549455 - protein, 18 aa, Mycobacterium tuberculosis
RPRRVLLLCDVSRSMQPY

SEQ ID NO: 1549456 - protein, 23 aa, Mycobacterium tuberculosis
RQLCDTYKLVARAVHFDTNGNNP

SEQ ID NO: 1549457 - protein, 22 aa, Mycobacterium tuberculosis
RQMAAFHDQFTLALTSSAGAYA

SEQ ID NO: 1549458 - protein, 17 aa, Mycobacterium tuberculosis
RRMLALSAAAALIVALA

SEQ ID NO: 1549459 - protein, 26 aa, Mycobacterium tuberculosis
RRVSISCRVREGFVMRLAIVGTAAAA

SEQ ID NO: 1549460 - protein, 17 aa, Mycobacterium tuberculosis
RSGMAWCIQAFGRQEML

SEQ ID NO: 1549461 - protein, 19 aa, Mycobacterium tuberculosis
RSIGCSWCVDFGAMLQRLD

SEQ ID NO: 1549462 - protein, 26 aa, Mycobacterium tuberculosis
RTEAPDYLPVVLEFAATVDPEAGRRL

SEQ ID NO: 1549463 - protein, 29 aa, Mycobacterium tuberculosis
RVAPADMIGPIWRRDEVFEFNGSLIDSEE

SEQ ID NO: 1549464 - protein, 20 aa, Mycobacterium tuberculosis
RVGAASAVWVGLVVAPAGRV

SEQ ID NO: 1549465 - protein, 26 aa, Mycobacterium tuberculosis
RVGSMFGPYHLKRLLGRGGMGEVYEA

SEQ ID NO: 1549466 - protein, 19 aa, Mycobacterium tuberculosis
RVTGCAEWSTGQGPLNSTA

SEQ ID NO: 1549467 - protein, 18 aa, Mycobacterium tuberculosis
RYAFAGVGVVIPRFSGDQ

SEQ ID NO: 1549468 - protein, 24 aa, Mycobacterium tuberculosis
RYASTEAAVERSLLGAVNAPTEAL

SEQ ID NO: 1549469 - protein, 17 aa, Mycobacterium tuberculosis
SAAMTKRAATAAMVMLL

SEQ ID NO: 1549470 - protein, 18 aa, Mycobacterium tuberculosis
SAHAGQYQQLGARAALFH

SEQ ID NO: 1549471 - protein, 19 aa, Mycobacterium tuberculosis
SALLSFGLLLGGLPLAAPP

SEQ ID NO: 1549472 - protein, 19 aa, Mycobacterium tuberculosis
SAPMLAASVAWDGLAAELA

SEQ ID NO: 1549473 - protein, 32 aa, Mycobacterium tuberculosis
SDPFVAILRFPFIPQAMREHYAELEIKAFAVE

SEQ ID NO: 1549474 - protein, 24 aa, Mycobacterium tuberculosis
SEGTVRAVATLAAVTAVTDVAGVT

SEQ ID NO: 1549475 - protein, 24 aa, Mycobacterium tuberculosis
SGGSGGAGGFGFADGGQGGPGGNA

SEQ ID NO: 1549476 - protein, 28 aa, Mycobacterium tuberculosis
SGLPLRAMVMVLLFLGVVFLLLVWQALG

SEQ ID NO: 1549477 - protein, 21 aa, Mycobacterium tuberculosis
SGLRPEHIRDIAVIGYQRAEQ

SEQ ID NO: 1549478 - protein, 22 aa, Mycobacterium tuberculosis
SGSAKWNLLAPYAAKSDGGRNN

SEQ ID NO: 1549479 - protein, 19 aa, Mycobacterium tuberculosis
SIGSPIPLSLALGTTTWTL

SEQ ID NO: 1549480 - protein, 21 aa, Mycobacterium tuberculosis
SIPLMIGLAVPAHAGPSGDDA

SEQ ID NO: 1549481 - protein, 17 aa, Mycobacterium tuberculosis
SLPLTVTEWDEWGNPLN

SEQ ID NO: 1549482 - protein, 23 aa, Mycobacterium tuberculosis
SLRLPKLSAKVVVVGGLVVVLAV

SEQ ID NO: 1549483 - protein, 18 aa, Mycobacterium tuberculosis
SNATPREVLPASAAMDAP

SEQ ID NO: 1549484 - protein, 23 aa, Mycobacterium tuberculosis
SNIEPQTSVLIGTQGGDGTPGGA

SEQ ID NO: 1549485 - protein, 19 aa, Mycobacterium tuberculosis
SPAALRLLATDAIVVLVSA

SEQ ID NO: 1549486 - protein, 23 aa, Mycobacterium tuberculosis
SPACGKAGCQTYKWETFLTSELP

SEQ ID NO: 1549487 - protein, 22 aa, Mycobacterium tuberculosis
SPEEMYKYLVAVSREPDHDKIR

SEQ ID NO: 1549488 - protein, 21 aa, Mycobacterium tuberculosis
SQTAEAIWPPARTLRYDRQSP

SEQ ID NO: 1549489 - protein, 23 aa, Mycobacterium tuberculosis
SRETLGRNCWRGERRAWIEVRGL

SEQ ID NO: 1549490 - protein, 19 aa, Mycobacterium tuberculosis
SRGAGGFGGVGQAGGKGWD

SEQ ID NO: 1549491 - protein, 23 aa, Mycobacterium tuberculosis
SRGKWDTLRAMGFDDDHIGDSRT

SEQ ID NO: 1549492 - protein, 17 aa, Mycobacterium tuberculosis
SRILASFAPAIPDRSDV

SEQ ID NO: 1549493 - protein, 17 aa, Mycobacterium tuberculosis
SRLTGTFLDAYTQLTHD

SEQ ID NO: 1549494 - protein, 18 aa, Mycobacterium tuberculosis
SRPAIWCNSDADNDRLRA

SEQ ID NO: 1549495 - protein, 23 aa, Mycobacterium tuberculosis
SSPDGQDGGLLFGNGGAGYNSAA

SEQ ID NO: 1549496 - protein, 19 aa, Mycobacterium tuberculosis
STCRSLEFHRAVEVIAVGR

SEQ ID NO: 1549497 - protein, 26 aa, Mycobacterium tuberculosis
STPNRWQVRPGPVAARRWDIEPDLTN

SEQ ID NO: 1549498 - protein, 19 aa, Mycobacterium tuberculosis
STVARHRPTGATGSAGTAR

SEQ ID NO: 1549499 - protein, 23 aa, Mycobacterium tuberculosis
SVAKIAFTGAVLGGGGIAMAAQA

SEQ ID NO: 1549500 - protein, 25 aa, Mycobacterium tuberculosis
SVATDGRFRFLRVYPNPEVYAPVTG

SEQ ID NO: 1549501 - protein, 19 aa, Mycobacterium tuberculosis
SVFGSPTWRTVTGGSANYV

SEQ ID NO: 1549502 - protein, 20 aa, Mycobacterium tuberculosis
SVFGSPTWRTVTGGSANYVQ

SEQ ID NO: 1549503 - protein, 24 aa, Mycobacterium tuberculosis
SVQRESGIEFGRYLTEAVCEPLGM

SEQ ID NO: 1549504 - protein, 19 aa, Mycobacterium tuberculosis
SWDHPYRAPPKVWFHDLLH

SEQ ID NO: 1549505 - protein, 18 aa, Mycobacterium tuberculosis
SYETAGMRTTCGRRDLAD

SEQ ID NO: 1549506 - protein, 18 aa, Mycobacterium tuberculosis
TAAAGRYASTEAAVERSL

SEQ ID NO: 1549507 - protein, 17 aa, Mycobacterium tuberculosis
TAISALFGAHAQAYQAL

SEQ ID NO: 1549508 - protein, 19 aa, Mycobacterium tuberculosis
TARAAGLPRIASTAVAATT

SEQ ID NO: 1549509 - protein, 18 aa, Mycobacterium tuberculosis
TCRSLEFHRAVEVIAVGR

SEQ ID NO: 1549510 - protein, 19 aa, Mycobacterium tuberculosis
TCVMWTLALTRPPDVREAA

SEQ ID NO: 1549511 - protein, 30 aa, Mycobacterium tuberculosis; identical to SEQ ID NO: 235361

SEQ ID NO: 1549512 - protein, 17 aa, Mycobacterium tuberculosis
TDTILGRKVLEIEPRGA

SEQ ID NO: 1549513 - protein, 17 aa, Mycobacterium tuberculosis
TEVLEWLSPLPGGSVVS

SEQ ID NO: 1549514 - protein, 27 aa, Mycobacterium tuberculosis
TFVGAAARGGRRLVIAMMYGLVKEGGP

SEQ ID NO: 1549515 - protein, 24 aa, Mycobacterium tuberculosis
TGAAGGAGGWLFGNGGNGGHGATN

SEQ ID NO: 1549516 - protein, 22 aa, Mycobacterium tuberculosis
TGANGGDGGWLIGNGGAGGSGA

SEQ ID NO: 1549517 - protein, 17 aa, Mycobacterium tuberculosis
TGFGNAGFFNMGIGNAG

SEQ ID NO: 1549518 - protein, 18 aa, Mycobacterium tuberculosis
TGGTNFAGGQGGAGGRGG

SEQ ID NO: 1549519 - protein, 21 aa, Mycobacterium tuberculosis
TGIAGAGGRGGAGGSGGSGGD

SEQ ID NO: 1549520 - protein, 17 aa, Mycobacterium tuberculosis
TGQFRFGPITVSNVQLN

SEQ ID NO: 1549521 - protein, 20 aa, Mycobacterium tuberculosis
TGVMWKRFSETGAIKAKSVI

SEQ ID NO: 1549522 - protein, 21 aa, Mycobacterium tuberculosis
TIDRIPLNLGASVTVGPILIN

SEQ ID NO: 1549523 - protein, 17 aa, Mycobacterium tuberculosis
TILARATPGDGWASLAS

SEQ ID NO: 1549524 - protein, 27 aa, Mycobacterium tuberculosis
TIPAIPIGLELNGGVGPITVLPIQILP

SEQ ID NO: 1549525 - protein, 22 aa, Mycobacterium tuberculosis
TKDVHIGPSDHVGWLDDRKWAY

SEQ ID NO: 1549526 - protein, 22 aa, Mycobacterium tuberculosis
TKSICPVCKVVVDAQVNIRHDK

SEQ ID NO: 1549527 - protein, 20 aa, Mycobacterium tuberculosis
TLAAAAAWDGLAAELGQAAN

SEQ ID NO: 1549528 - protein, 17 aa, Mycobacterium tuberculosis
TLEAFLSRHHFSQYFVD

SEQ ID NO: 1549529 - protein, 17 aa, Mycobacterium tuberculosis
TLTGFGYHGPDGQVVAD

SEQ ID NO: 1549530 - protein, 17 aa, Mycobacterium tuberculosis
TPEALAWSRQRANLPPC

SEQ ID NO: 1549531 - protein, 23 aa, Mycobacterium tuberculosis
TPVRKACTVLAVLAATLLLGACG

SEQ ID NO: 1549532 - protein, 24 aa, Mycobacterium tuberculosis
TQALLGRPLIGDGAVGTASSPDGQ

SEQ ID NO: 1549533 - protein, 18 aa, Mycobacterium tuberculosis
TRAVIRYDNLFGDRYLAL

SEQ ID NO: 1549534 - protein, 28 aa, Mycobacterium tuberculosis
TRAYFRGECLRRFGADIAAASWDSVIFD

SEQ ID NO: 1549535 - protein, 22 aa, Mycobacterium tuberculosis
TSPLLAPINEFFLANTGRPLIG

SEQ ID NO: 1549536 - protein, 17 aa, Mycobacterium tuberculosis
TTEVVAAAADEVSAAIA

SEQ ID NO: 1549537 - protein, 20 aa, Mycobacterium tuberculosis
TVQRDGTCVLVIAPAPALPD

SEQ ID NO: 1549538 - protein, 23 aa, Mycobacterium tuberculosis
TVSLPDCQGALYTSQDPVYAGTG

SEQ ID NO: 1549539 - protein, 20 aa, Mycobacterium tuberculosis
TVTYPAHWGPAAVAALDSAL

SEQ ID NO: 1549540 - protein, 24 aa, Mycobacterium tuberculosis
VAAHDLRPGTALTPGDVRLEKRSA

SEQ ID NO: 1549541 - protein, 22 aa, Mycobacterium tuberculosis
VAAQLAPWAQAVRALPNPTAPA

SEQ ID NO: 1549542 - protein, 22 aa, Mycobacterium tuberculosis
VAGLGLELSRLIKGSAELAIDA

SEQ ID NO: 1549543 - protein, 26 aa, Mycobacterium tuberculosis
VAIFRARPSPFYIMDEVEAALDDVNL

SEQ ID NO: 1549544 - protein, 25 aa, Mycobacterium tuberculosis
VAMVLRRLLRLCARYSAHPTVIFAS

SEQ ID NO: 1549545 - protein, 23 aa, Mycobacterium tuberculosis
VATAKFEFANGYATVTIATTGVG

SEQ ID NO: 1549546 - protein, 18 aa, Mycobacterium tuberculosis
VCGRGLSNATPREVLPAS

SEQ ID NO: 1549547 - protein, 23 aa, Mycobacterium tuberculosis
VDASLRLLVRGGRFLEMGKTDIR

SEQ ID NO: 1549548 - protein, 20 aa, Mycobacterium tuberculosis
VELRNRLKTATGLTLPPTVI

SEQ ID NO: 1549549 - protein, 22 aa, Mycobacterium tuberculosis
VEPEMPAPCPTQRPPVTPRHNL

SEQ ID NO: 1549550 - protein, 22 aa, Mycobacterium tuberculosis
VEREFRGVFTALFPGGEGRLRL

SEQ ID NO: 1549551 - protein, 40 aa, Mycobacterium tuberculosis
VFGNGGDGGCRRVWRRYRRQRWCRRQRRADRQRRQRRQRR

SEQ ID NO: 1549552 - protein, 17 aa, Mycobacterium tuberculosis
VGANWQASGGWTDGAHR

SEQ ID NO: 1549553 - protein, 32 aa, Mycobacterium tuberculosis
VGARSGTGAARARVSALSAAAARAAAVAGGAA

SEQ ID NO: 1549554 - protein, 20 aa, Mycobacterium tuberculosis
VGFHPRKALARVDEAARTMH

SEQ ID NO: 1549555 - protein, 18 aa, Mycobacterium tuberculosis
VGSMFGPYHLKRLLGRGG

SEQ ID NO: 1549556 - protein, 22 aa, Mycobacterium tuberculosis
VIDLLLKRAASLGIQIRYETGA

SEQ ID NO: 1549557 - protein, 31 aa, Mycobacterium tuberculosis
VINAPTQALLGRPLIGDGANATTPGGAGGAG

SEQ ID NO: 1549558 - protein, 25 aa, Mycobacterium tuberculosis
VLASDRGAGALGFVGTAGKESVGQP

SEQ ID NO: 1549559 - protein, 17 aa, Mycobacterium tuberculosis
VLGWRIDHELKHLDEAE

SEQ ID NO: 1549560 - protein, 18 aa, Mycobacterium tuberculosis
VLILCWSLLGAAPAHADD

SEQ ID NO: 1549561 - protein, 20 aa, Mycobacterium tuberculosis
VLVALPARLANTVAGAALGQ

SEQ ID NO: 1549562 - protein, 17 aa, Mycobacterium tuberculosis
VMSFVVAVPEALAAAAS

SEQ ID NO: 1549563 - protein, 26 aa, Mycobacterium tuberculosis
VNSGTCFRPSLAVQRRWRDEFGLGLA

SEQ ID NO: 1549564 - protein, 25 aa, Mycobacterium tuberculosis
VNVPRRCCRPGCPHYAVATLTFVYS

SEQ ID NO: 1549565 - protein, 23 aa, Mycobacterium tuberculosis
VQALTAAAGRYASTEAAVERSLL

SEQ ID NO: 1549566 - protein, 21 aa, Mycobacterium tuberculosis
VSAAIASLFSGYARDYQALSA

SEQ ID NO: 1549567 - protein, 19 aa, Mycobacterium tuberculosis
VSAAVAAVFSSYAQQYQAL

SEQ ID NO: 1549568 - protein, 20 aa, Mycobacterium tuberculosis
VSAGIAALFGARAQAYQAIS

SEQ ID NO: 1549569 - protein, 20 aa, Mycobacterium tuberculosis
VSALNRPVSTTGEAGNQNTV

SEQ ID NO: 1549570 - protein, 20 aa, Mycobacterium tuberculosis
VSLAISALFGQHAQAYQALS

SEQ ID NO: 1549571 - protein, 20 aa, Mycobacterium tuberculosis
VSTAVAALFGAHGQAYQALS

SEQ ID NO: 1549572 - protein, 19 aa, Mycobacterium tuberculosis
VTFADSYQPAWVYQGQDVD

SEQ ID NO: 1549573 - protein, 20 aa, Mycobacterium tuberculosis
VTLGGTMAKYDWTINGEPYS

SEQ ID NO: 1549574 - protein, 24 aa, Mycobacterium tuberculosis
VVAAAPYAGWLAAAAARAGGAAVQ

SEQ ID NO: 1549575 - protein, 20 aa, Mycobacterium tuberculosis
VVAGSARFTQHLKLGYRDAV

SEQ ID NO: 1549576 - protein, 18 aa, Mycobacterium tuberculosis
VYANDYWGPATVTYHDGQ

SEQ ID NO: 1549577 - protein, 26 aa, Mycobacterium tuberculosis
VYTETKLNSAFSFGGPKCLVKVIQKL

SEQ ID NO: 1549578 - protein, 19 aa, Mycobacterium tuberculosis
WAADVAAMVSYHSGASAVA

SEQ ID NO: 1549579 - protein, 19 aa, Mycobacterium tuberculosis
WDGTVLFGPIQIPIINVPP

SEQ ID NO: 1549580 - protein, 20 aa, Mycobacterium tuberculosis
WDIEPDLTNAVAFLSAAVVS

SEQ ID NO: 1549581 - protein, 23 aa, Mycobacterium tuberculosis
WDVRCAPAAFRFMSQARHIGKVV

SEQ ID NO: 1549582 - protein, 18 aa, Mycobacterium tuberculosis
WGAFDMSLGKAMYAGFTL

SEQ ID NO: 1549583 - protein, 23 aa, Mycobacterium tuberculosis
WLDDRKWAYVRLEGRAFGDVPLN

SEQ ID NO: 1549584 - protein, 19 aa, Mycobacterium tuberculosis
WQQIWACTDRTLTISCEDS

SEQ ID NO: 1549585 - protein, 19 aa, Mycobacterium tuberculosis
WQQIWACTDRTLTITCEDS

SEQ ID NO: 1549586 - protein, 19 aa, Mycobacterium tuberculosis
YLPRLEGHGAPGVTVCHGL

SEQ ID NO: 1549587 - protein, 17 aa, Mycobacterium tuberculosis
YMIAVPDMLSSAAGDLA

SEQ ID NO: 1549588 - protein, 17 aa, Mycobacterium tuberculosis
YQTEWWYYTGNLETADG

SEQ ID NO: 1549589 - protein, 22 aa, Mycobacterium tuberculosis
AAAAPYAGWLAAAAARAAGASA

SEQ ID NO: 1549590 - protein, 24 aa, Mycobacterium tuberculosis
AAACARATLVARAMRVEHAQCRVV

SEQ ID NO: 1549591 - protein, 25 aa, Mycobacterium tuberculosis
AAAEAEYELMWAADVAAMAGYHSGA

SEQ ID NO: 1549592 - protein, 17 aa, Mycobacterium tuberculosis
AAAEALAPFGSPLASLA

SEQ ID NO: 1549593 - protein, 22 aa, Mycobacterium tuberculosis
AAAEALAPFGSPLASLAAAAEP

SEQ ID NO: 1549594 - protein, 21 aa, Mycobacterium tuberculosis
AAAFLMDWAAPVIEKAYGAGP

SEQ ID NO: 1549595 - protein, 25 aa, Mycobacterium tuberculosis
AAAGRAAPRLTVWVPVAVNPGAAAH

SEQ ID NO: 1549596 - protein, 26 aa, Mycobacterium tuberculosis
AAAHGGPHYLCLAIHAMVTDDSSRQI

SEQ ID NO: 1549597 - protein, 30 aa, Mycobacterium tuberculosis
AAAIAFATDCARIARVRPCGAVGAVAAGPA

SEQ ID NO: 1549598 - protein, 25 aa, Mycobacterium tuberculosis
AAAPRIPVVMGVRVGPVVLVGGCLV

SEQ ID NO: 1549599 - protein, 18 aa, Mycobacterium tuberculosis
AAAPVCGVVGFGGGAGRG

SEQ ID NO: 1549600 - protein, 17 aa, Mycobacterium tuberculosis
AAARAADLWRFTAGAVD

SEQ ID NO: 1549601 - protein, 19 aa, Mycobacterium tuberculosis
AAASAWTGLAGDLGSAAAS

SEQ ID NO: 1549602 - protein, 18 aa, Mycobacterium tuberculosis
AAAVLALNSLRVHSASVN

SEQ ID NO: 1549603 - protein, 22 aa, Mycobacterium tuberculosis
AACRSRCAGSASCRHRSSRPVR

SEQ ID NO: 1549604 - protein, 24 aa, Mycobacterium tuberculosis
AADEVSAHIAALFSGHGEGYQAIA

SEQ ID NO: 1549605 - protein, 25 aa, Mycobacterium tuberculosis
AADEVSAHIAALFSGHGEGYQAIAR

SEQ ID NO: 1549606 - protein, 25 aa, Mycobacterium tuberculosis
AADLTRGCGPAGAAITAGPAVTANA

SEQ ID NO: 1549607 - protein, 17 aa, Mycobacterium tuberculosis
AADVAAMLGYHGEASAV

SEQ ID NO: 1549608 - protein, 17 aa, Mycobacterium tuberculosis
AADVAAMVSYHSGASAV

SEQ ID NO: 1549609 - protein, 20 aa, Mycobacterium tuberculosis
AAEALSWGLVSAVYPAADFD

SEQ ID NO: 1549610 - protein, 18 aa, Mycobacterium tuberculosis
AAELSRWTFAGHTHYLII

SEQ ID NO: 1549611 - protein, 22 aa, Mycobacterium tuberculosis
AAEVYKRSLAVFFLSEPPEGFD

SEQ ID NO: 1549612 - protein, 17 aa, Mycobacterium tuberculosis
AAFEVSQTSRSAPCVLG

SEQ ID NO: 1549613 - protein, 18 aa, Mycobacterium tuberculosis
AAFSAVKPSLAWAETYPG

SEQ ID NO: 1549614 - protein, 18 aa, Mycobacterium tuberculosis
AAGADCRRQVAIRRVDAG

SEQ ID NO: 1549615 - protein, 24 aa, Mycobacterium tuberculosis
AAGGGWWPAVRQWRRRRQRRHRWP

SEQ ID NO: 1549616 - protein, 17 aa, Mycobacterium tuberculosis
AAGGLLFGNGGNGAAGG

SEQ ID NO: 1549617 - protein, 26 aa, Mycobacterium tuberculosis
AAGGNGGAGGWLFGNGGAGGAGGLGV

SEQ ID NO: 1549618 - protein, 23 aa, Mycobacterium tuberculosis
AAGGNGGAVGWLDGNGGAGGAGG

SEQ ID NO: 1549619 - protein, 24 aa, Mycobacterium tuberculosis
AAGGRGAVRPGRTVQGRVRANTAG

SEQ ID NO: 1549620 - protein, 24 aa, Mycobacterium tuberculosis
AAGIGGAGGNVWHTCKYSRRGPLS

SEQ ID NO: 1549621 - protein, 25 aa, Mycobacterium tuberculosis
AAHHKPQLAFLPRQAFLDTNIIGTQ

SEQ ID NO: 1549622 - protein, 18 aa, Mycobacterium tuberculosis
AAHPPWDPVIAVGNTARQ

SEQ ID NO: 1549623 - protein, 26 aa, Mycobacterium tuberculosis
AAHQKLCEVYKLAARAVQIATNGDNP

SEQ ID NO: 1549624 - protein, 17 aa, Mycobacterium tuberculosis
AAIAALFGAHGQAYQTV

SEQ ID NO: 1549625 - protein, 18 aa, Mycobacterium tuberculosis
AAIAGLFGAHARQYQALS

SEQ ID NO: 1549626 - protein, 17 aa, Mycobacterium tuberculosis
AAIATLFGSHAREYQAI

SEQ ID NO: 1549627 - protein, 19 aa, Mycobacterium tuberculosis
AAINARFERIFGRPLIGDG

SEQ ID NO: 1549628 - protein, 26 aa, Mycobacterium tuberculosis
AAKPFVRWLTDLCVQLSEVERQIHEI

SEQ ID NO: 1549629 - protein, 24 aa, Mycobacterium tuberculosis
AALAAVPARAGRRSAVAADAAVAA

SEQ ID NO: 1549630 - protein, 26 aa, Mycobacterium tuberculosis
AALAGWGVAASGMWPSPANSPDVGSS

SEQ ID NO: 1549631 - protein, 17 aa, Mycobacterium tuberculosis
AALAPASGFGRRRSAHT

SEQ ID NO: 1549632 - protein, 19 aa, Mycobacterium tuberculosis
AALARLEARIVLRLLLDRT

SEQ ID NO: 1549633 - protein, 18 aa, Mycobacterium tuberculosis
AALARVTSAIGVVAGLGM

SEQ ID NO: 1549634 - protein, 17 aa, Mycobacterium tuberculosis
AALFHEQFVHAMTAGAG

SEQ ID NO: 1549635 - protein, 18 aa, Mycobacterium tuberculosis
AALFHEQFVHAMTAGAGA

SEQ ID NO: 1549636 - protein, 19 aa, Mycobacterium tuberculosis
AALGPRVLGLSARRSAGAH

SEQ ID NO: 1549637 - protein, 19 aa, Mycobacterium tuberculosis
AALYKKAFAPLNELAGSLV

SEQ ID NO: 1549638 - protein, 19 aa, Mycobacterium tuberculosis
AAMASRLVGAVLIGRDRAA

SEQ ID NO: 1549639 - protein, 53 aa, Mycobacterium tuberculosis
AANSCRPRGSPRRHAAMLLPVGRYPPTSRHGIGRRTGLPGSPTRGPANSITSA

SEQ ID NO: 1549640 - protein, 18 aa, Mycobacterium tuberculosis
AAPAEVPAALATADNCVA

SEQ ID NO: 1549641 - protein, 21 aa, Mycobacterium tuberculosis
AAPYAAWLAAAAVQAEQTAAQ

SEQ ID NO: 1549642 - protein, 19 aa, Mycobacterium tuberculosis
AAQALAWAAVGAAKVLVNQ

SEQ ID NO: 1549643 - protein, 17 aa, Mycobacterium tuberculosis
AAQSGRFPGFDAATQAG

SEQ ID NO: 1549644 - protein, 19 aa, Mycobacterium tuberculosis
AARACPATATACAATEPNH

SEQ ID NO: 1549645 - protein, 23 aa, Mycobacterium tuberculosis
AARAGKMTNWAIARPPGQTQALR

SEQ ID NO: 1549646 - protein, 27 aa, Mycobacterium tuberculosis
AARARDGGIPLTARMVFEHPVLCELAA

SEQ ID NO: 1549647 - protein, 26 aa, Mycobacterium tuberculosis
AARDFAAEAAFVFAMIAVDLSRLAED

SEQ ID NO: 1549648 - protein, 17 aa, Mycobacterium tuberculosis
AARLARSAAVASGARAT

SEQ ID NO: 1549649 - protein, 19 aa, Mycobacterium tuberculosis
AARRGRPSTDHSLASVNTD

SEQ ID NO: 1549650 - protein, 28 aa, Mycobacterium tuberculosis
AASAQAAAFYAQFVQALSAGGGAYAAAE

SEQ ID NO: 1549651 - protein, 17 aa, Mycobacterium tuberculosis
AASVAWDGLAAELAVAA

SEQ ID NO: 1549652 - protein, 18 aa, Mycobacterium tuberculosis
AATVVIVAWIANRPPASS

SEQ ID NO: 1549653 - protein, 17 aa, Mycobacterium tuberculosis
AAVAALFSAHAGQYQQL

SEQ ID NO: 1549654 - protein, 17 aa, Mycobacterium tuberculosis
AAVADLFGAHAQAYQAL

SEQ ID NO: 1549655 - protein, 17 aa, Mycobacterium tuberculosis
AAVEQHLLEVLGASVDV

SEQ ID NO: 1549656 - protein, 18 aa, Mycobacterium tuberculosis
AAVHAQFVEALSAGAGAY

SEQ ID NO: 1549657 - protein, 19 aa, Mycobacterium tuberculosis
AAVVGRLRVVVCAPACAVD

SEQ ID NO: 1549658 - protein, 17 aa, Mycobacterium tuberculosis
AAWLIVDVRDVAALHAA

SEQ ID NO: 1549659 - protein, 28 aa, Mycobacterium tuberculosis
AAWPPRVSVLVTLLGCWPASRWEIAPTA

SEQ ID NO: 1549660 - protein, 18 aa, Mycobacterium tuberculosis
AAYQVGGRTWLRAGAGII

SEQ ID NO: 1549661 - protein, 23 aa, Mycobacterium tuberculosis
ACCCAVCSGLVLAGALAPSKPNN

SEQ ID NO: 1549662 - protein, 26 aa, Mycobacterium tuberculosis
ACCCAVCSGLVLAGALAPSKPNNSPP

SEQ ID NO: 1549663 - protein, 19 aa, Mycobacterium tuberculosis
ACHAARLWMDAQPGSGESL

SEQ ID NO: 1549664 - protein, 17 aa, Mycobacterium tuberculosis
ACLAEGPPLGRNPQGAP

SEQ ID NO: 1549665 - protein, 26 aa, Mycobacterium tuberculosis
ACQKWPRRMRKMFLSLIQRQLPEGYD

SEQ ID NO: 1549666 - protein, 20 aa, Mycobacterium tuberculosis
ADAGGLRIGNTVEVSGYPVG

SEQ ID NO: 1549667 - protein, 17 aa, Mycobacterium tuberculosis
ADAHRRSPGLLSYAVLG

SEQ ID NO: 1549668 - protein, 21 aa, Mycobacterium tuberculosis
ADAISPWSGRYAIAYNADAGH

SEQ ID NO: 1549669 - protein, 27 aa, Mycobacterium tuberculosis
ADAPASTGLTGGTGFAGGAGGAGGAGG

SEQ ID NO: 1549670 - protein, 23 aa, Mycobacterium tuberculosis
ADEVSAAIAALFGAHGQAYQTVS

SEQ ID NO: 1549671 - protein, 24 aa, Mycobacterium tuberculosis
ADEVSAAIAALFGAHGQAYQTVSA

SEQ ID NO: 1549672 - protein, 24 aa, Mycobacterium tuberculosis
ADEVSAAIAALFSAHGRDFQALSA

SEQ ID NO: 1549673 - protein, 24 aa, Mycobacterium tuberculosis
ADEVSAAIAALFSSYARDYQTLSV

SEQ ID NO: 1549674 - protein, 29 aa, Mycobacterium tuberculosis
ADEVSAAIAGLFGAHARQYQALSVQVAAF

SEQ ID NO: 1549675 - protein, 25 aa, Mycobacterium tuberculosis
ADEVSAAIASLFSGYARDYQALSAQ

SEQ ID NO: 1549676 - protein, 24 aa, Mycobacterium tuberculosis
ADEVSAAIATLFGSHAREYQAIST

SEQ ID NO: 1549677 - protein, 26 aa, Mycobacterium tuberculosis
ADEVSAALASLFSGHAVSYQQVAAQA

SEQ ID NO: 1549678 - protein, 25 aa, Mycobacterium tuberculosis
ADEVSAAVAALFGSYAQSYQAFGAQ

SEQ ID NO: 1549679 - protein, 23 aa, Mycobacterium tuberculosis
ADEVSAHIAALFSGHGEGYQAIA

SEQ ID NO: 1549680 - protein, 27 aa, Mycobacterium tuberculosis
ADEVSIAVAALFGMHGQAYQALSVQAS

SEQ ID NO: 1549681 - protein, 23 aa, Mycobacterium tuberculosis
ADEVSTAIAALFGAHGQAYQALS

SEQ ID NO: 1549682 - protein, 24 aa, Mycobacterium tuberculosis
ADFKRPAPHWWFDDATLYGPDGLA

SEQ ID NO: 1549683 - protein, 17 aa, Mycobacterium tuberculosis
ADGCPDAEVTFARGTGE

SEQ ID NO: 1549684 - protein, 31 aa, Mycobacterium tuberculosis; identical to SEQ ID NO: 195980

SEQ ID NO: 1549685 - protein, 20 aa, Mycobacterium tuberculosis
ADGGFSYALAPPRAGALKDF

SEQ ID NO: 1549686 - protein, 25 aa, Mycobacterium tuberculosis
ADGGRAVLVLSDWPAPQAPQSASGE

SEQ ID NO: 1549687 - protein, 19 aa, Mycobacterium tuberculosis
ADGVIWARYNVPWQPAFVF

SEQ ID NO: 1549688 - protein, 24 aa, Mycobacterium tuberculosis
ADPVMPGCRWAAGSSMRWWRSARS

SEQ ID NO: 1549689 - protein, 17 aa, Mycobacterium tuberculosis
ADPVSLQTAAGFSAQGV

SEQ ID NO: 1549690 - protein, 17 aa, Mycobacterium tuberculosis
ADQGKRNVTHGCINLSP

SEQ ID NO: 1549691 - protein, 25 aa, Mycobacterium tuberculosis
ADQPGRPAGTPGLANRPGTAIAAIA

SEQ ID NO: 1549692 - protein, 19 aa, Mycobacterium tuberculosis
ADRLRCQVVAATGLQLDEL

SEQ ID NO: 1549693 - protein, 23 aa, Mycobacterium tuberculosis
ADRRYSAAITRLAPETDVRIVTY

SEQ ID NO: 1549694 - protein, 20 aa, Mycobacterium tuberculosis
ADRYRRLHVIIGDANLAETS

SEQ ID NO: 1549695 - protein, 25 aa, Mycobacterium tuberculosis
ADSRGQFPGRYRLAVLEKLSRVSSR

SEQ ID NO: 1549696 - protein, 17 aa, Mycobacterium tuberculosis
ADVYLCGPVAMVDAART

SEQ ID NO: 1549697 - protein, 22 aa, Mycobacterium tuberculosis
ADYPTVLLSGAWLSQEQTSAAS

SEQ ID NO: 1549698 - protein, 17 aa, Mycobacterium tuberculosis
AEAGVRVTLCEAASEAG

SEQ ID NO: 1549699 - protein, 19 aa, Mycobacterium tuberculosis
AEALAPFGSPLASLAAAAE

SEQ ID NO: 1549700 - protein, 27 aa, Mycobacterium tuberculosis
AEAPQTAGAAFRGTRTVGETLSARAAD

SEQ ID NO: 1549701 - protein, 23 aa, Mycobacterium tuberculosis
AEDPRVAGLIARVQLPPSPAGAV

SEQ ID NO: 1549702 - protein, 21 aa, Mycobacterium tuberculosis
AEELRPGDIIEVRTHEVVPAD

SEQ ID NO: 1549703 - protein, 18 aa, Mycobacterium tuberculosis
AEFTRIAAGISVSKPRIP

SEQ ID NO: 1549704 - protein, 21 aa, Mycobacterium tuberculosis
AEGDGGWDLTLRNMAKGYPHL

SEQ ID NO: 1549705 - protein, 18 aa, Mycobacterium tuberculosis
AEGVAGAAGEDLSPHGTS

SEQ ID NO: 1549706 - protein, 21 aa, Mycobacterium tuberculosis
AELDFPVPSFAEFWRTGRLEL

SEQ ID NO: 1549707 - protein, 20 aa, Mycobacterium tuberculosis
AELLPADWPGAGLRAAYHDF

SEQ ID NO: 1549708 - protein, 27 aa, Mycobacterium tuberculosis
AELVIPVCTRLGLSPPDVRTLSKLVRH

SEQ ID NO: 1549709 - protein, 17 aa, Mycobacterium tuberculosis
AEPRYRDRIPILIGGGG

SEQ ID NO: 1549710 - protein, 20 aa, Mycobacterium tuberculosis
AEQLGGRSAVAAVTGVAGVC

SEQ ID NO: 1549711 - protein, 22 aa, Mycobacterium tuberculosis
AERAETPVPVVPRAATAVPSAP

SEQ ID NO: 1549712 - protein, 23 aa, Mycobacterium tuberculosis
AESFAAACLPYLSWLTQASADCA

SEQ ID NO: 1549713 - protein, 23 aa, Mycobacterium tuberculosis
AESGGLFGFGGGRAGHGGLRQCR

SEQ ID NO: 1549714 - protein, 17 aa, Mycobacterium tuberculosis
AESHTVEQMVLNAINAP

SEQ ID NO: 1549715 - protein, 18 aa, Mycobacterium tuberculosis
AESHTVEQMVLNAINAPT

SEQ ID NO: 1549716 - protein, 18 aa, Mycobacterium tuberculosis
AETVRGWLRRFAERVEAG

SEQ ID NO: 1549717 - protein, 17 aa, Mycobacterium tuberculosis
AETYPGTLSYYLASAFG

SEQ ID NO: 1549718 - protein, 21 aa, Mycobacterium tuberculosis
AEVPAAGGPMGMMPMPMGMGG

SEQ ID NO: 1549719 - protein, 17 aa, Mycobacterium tuberculosis
AEVRRIEHQVAHEVVAE

SEQ ID NO: 1549720 - protein, 19 aa, Mycobacterium tuberculosis
AEVTRLRQGWGAWPVCAAR

SEQ ID NO: 1549721 - protein, 24 aa, Mycobacterium tuberculosis
AFHPDRFGFAGSMSGFLYPSNTTT

SEQ ID NO: 1549722 - protein, 18 aa, Mycobacterium tuberculosis
AFQDASCPDVQMISVPGT

SEQ ID NO: 1549723 - protein, 29 aa, Mycobacterium tuberculosis
AFQTRPSGLPGLRHKYSLDIAPGNFVTIN

SEQ ID NO: 1549724 - protein, 25 aa, Mycobacterium tuberculosis
AFRIDGCSGTGWLRSVAPPCRCCAT

SEQ ID NO: 1549725 - protein, 19 aa, Mycobacterium tuberculosis
AFSIVWDGQKLHGLNASGR

SEQ ID NO: 1549726 - protein, 17 aa, Mycobacterium tuberculosis
AFTIPGFSIPEQPLPLA

SEQ ID NO: 1549727 - protein, 27 aa, Mycobacterium tuberculosis
AGAAAEADCALSAVSAGPAVAVEPSAT

SEQ ID NO: 1549728 - protein, 19 aa, Mycobacterium tuberculosis
AGAAAPYVGWLSAAAGQAE

SEQ ID NO: 1549729 - protein, 29 aa, Mycobacterium tuberculosis
AGADEVSAAIAALFGAHGQAYQTVSAQAS

SEQ ID NO: 1549730 - protein, 57 aa, Mycobacterium tuberculosis; identical to SEQ ID NO: 233120

SEQ ID NO: 1549731 - protein, 30 aa, Mycobacterium tuberculosis
AGADEVSARIAALFGGFGLEYQAISAQVAA

SEQ ID NO: 1549732 - protein, 31 aa, Mycobacterium tuberculosis
AGADEVSARIAALFGGFGLEYQAISAQVAAY

SEQ ID NO: 1549733 - protein, 31 aa, Mycobacterium tuberculosis
AGADEVSVLIAALFEAYAQEYQALSAQALAF

SEQ ID NO: 1549734 - protein, 20 aa, Mycobacterium tuberculosis
AGADMLVRAWVRSYGVGATI

SEQ ID NO: 1549735 - protein, 21 aa, Mycobacterium tuberculosis
AGAGLKLPRSSGQMYKVGQKV

SEQ ID NO: 1549736 - protein, 20 aa, Mycobacterium tuberculosis
AGALKDFRVAVWAEDPHCPI

SEQ ID NO: 1549737 - protein, 18 aa, Mycobacterium tuberculosis
AGAPPWYADVLLPDLGAA

SEQ ID NO: 1549738 - protein, 25 aa, Mycobacterium tuberculosis
AGGAAGQLFSAGGAAGAVGVGGTGG

SEQ ID NO: 1549739 - protein, 24 aa, Mycobacterium tuberculosis
AGGAAGQLFSASGAAGNAGVGGAG

SEQ ID NO: 1549740 - protein, 21 aa, Mycobacterium tuberculosis
AGGAGGNAWLIGDGGAGGNGG

SEQ ID NO: 1549741 - protein, 24 aa, Mycobacterium tuberculosis
AGGAGGTGGWLFGNGGAGGTGGAV

SEQ ID NO: 1549742 - protein, 19 aa, Mycobacterium tuberculosis
AGGAGGTRGLIFGNAGTPG

SEQ ID NO: 1549743 - protein, 22 aa, Mycobacterium tuberculosis
AGGFGDHRWGPAGLAGPAGCSA

SEQ ID NO: 1549744 - protein, 19 aa, Mycobacterium tuberculosis
AGGHPEVFAFSTSLTRLTS

SEQ ID NO: 1549745 - protein, 18 aa, Mycobacterium tuberculosis
AGGLFGIGGAGGGCGSAV

SEQ ID NO: 1549746 - protein, 19 aa, Mycobacterium tuberculosis
AGGNAMLFGAGGAGGAGGA

SEQ ID NO: 1549747 - protein, 22 aa, Mycobacterium tuberculosis
AGGNGAIVWYRWCRRRPRQPGR

SEQ ID NO: 1549748 - protein, 19 aa, Mycobacterium tuberculosis
AGGNGGWLWGNGGNGGVGG

SEQ ID NO: 1549749 - protein, 19 aa, Mycobacterium tuberculosis
AGGNGGWLYGSGGNGGSGG

SEQ ID NO: 1549750 - protein, 22 aa, Mycobacterium tuberculosis
AGGPGGLIWGGGGAGGVGGAGG

SEQ ID NO: 1549751 - protein, 28 aa, Mycobacterium tuberculosis
AGGRWSADAGGRWSAGWSGGGGSGDAGC

SEQ ID NO: 1549752 - protein, 19 aa, Mycobacterium tuberculosis
AGGSGGWLLGTGGVGGVGG

SEQ ID NO: 1549753 - protein, 19 aa, Mycobacterium tuberculosis
AGGSGGWLYGNGGNGGIGG

SEQ ID NO: 1549754 - protein, 20 aa, Mycobacterium tuberculosis
AGGSGGWLYGNGGNGGIGGN

SEQ ID NO: 1549755 - protein, 23 aa, Mycobacterium tuberculosis
AGGSGRVGGGCAGSGANGGEIGI

SEQ ID NO: 1549756 - protein, 27 aa, Mycobacterium tuberculosis
AGGTGAPACRWERGVVVGQRRQRRCRR

SEQ ID NO: 1549757 - protein, 19 aa, Mycobacterium tuberculosis
AGIASGFALAACASKPTAS

SEQ ID NO: 1549758 - protein, 18 aa, Mycobacterium tuberculosis
AGIRRWLDSPSLMVADMF

SEQ ID NO: 1549759 - protein, 23 aa, Mycobacterium tuberculosis
AGKAGPAGSILHDGGNGGHGGHG

SEQ ID NO: 1549760 - protein, 18 aa, Mycobacterium tuberculosis
AGKSGCKSWLGSVGWRRA

SEQ ID NO: 1549761 - protein, 21 aa, Mycobacterium tuberculosis
AGLAVRPGYVLSDGFRVPGLP

SEQ ID NO: 1549762 - protein, 17 aa, Mycobacterium tuberculosis
AGLPGAAGLNGGDGSDG

SEQ ID NO: 1549763 - protein, 17 aa, Mycobacterium tuberculosis
AGLPKHKIRVISPDIGG

SEQ ID NO: 1549764 - protein, 24 aa, Mycobacterium tuberculosis
AGNGGIPGGSWAQPGVAATVAPAA

SEQ ID NO: 1549765 - protein, 20 aa, Mycobacterium tuberculosis
AGPAGRRSPAPGQLETGWVG

SEQ ID NO: 1549766 - protein, 23 aa, Mycobacterium tuberculosis
AGPATLSRPICRANSTKAPSSTF

SEQ ID NO: 1549767 - protein, 26 aa, Mycobacterium tuberculosis
AGPPEHLQWIGQWGIFDALRAGREVV

SEQ ID NO: 1549768 - protein, 20 aa, Mycobacterium tuberculosis
AGPQRFRYSLTTTISVEPAD

SEQ ID NO: 1549769 - protein, 20 aa, Mycobacterium tuberculosis
AGPRRFRNARRRQRRLRRRM

SEQ ID NO: 1549770 - protein, 30 aa, Mycobacterium tuberculosis
AGQYQQLGARAALFHEQFVQALTGAASAYA

SEQ ID NO: 1549771 - protein, 21 aa, Mycobacterium tuberculosis
AGRDFTVDWVHLKLNDQAQRT

SEQ ID NO: 1549772 - protein, 18 aa, Mycobacterium tuberculosis
AGSPEERAAVLGILAELL

SEQ ID NO: 1549773 - protein, 19 aa, Mycobacterium tuberculosis
AGSRCPAKGFSRVGRPHRR

SEQ ID NO: 1549774 - protein, 18 aa, Mycobacterium tuberculosis
AGTGNWGIGNSGAGNFGI

SEQ ID NO: 1549775 - protein, 19 aa, Mycobacterium tuberculosis
AGTSGWWNQGHDVLAGAGS

SEQ ID NO: 1549776 - protein, 30 aa, Mycobacterium tuberculosis; identical to SEQ ID NO: 196409

SEQ ID NO: 1549777 - protein, 19 aa, Mycobacterium tuberculosis
AGVAQCWHQLVGDTGEIVS

SEQ ID NO: 1549778 - protein, 20 aa, Mycobacterium tuberculosis
AGVRRLVLASSMVVYGQGRY

SEQ ID NO: 1549779 - protein, 20 aa, Mycobacterium tuberculosis
AGVVCPVHLGIMRGALQTWG

SEQ ID NO: 1549780 - protein, 17 aa, Mycobacterium tuberculosis
AHAGIAVGGFPVAARAA

SEQ ID NO: 1549781 - protein, 17 aa, Mycobacterium tuberculosis
AHAGQYQQLGARAALFH

SEQ ID NO: 1549782 - protein, 17 aa, Mycobacterium tuberculosis
AHATGLVSAGAATAKKN

SEQ ID NO: 1549783 - protein, 25 aa, Mycobacterium tuberculosis
AHAYSRASAMASVFHRDDPEWRSTV

SEQ ID NO: 1549784 - protein, 24 aa, Mycobacterium tuberculosis
AHHKPQLAFLPRQAFLDTNIIGTQ

SEQ ID NO: 1549785 - protein, 21 aa, Mycobacterium tuberculosis
AHPAMKALVVCIELCSVNAVF

SEQ ID NO: 1549786 - protein, 17 aa, Mycobacterium tuberculosis
AHPPWDPVIAVGNTARQ

SEQ ID NO: 1549787 - protein, 20 aa, Mycobacterium tuberculosis
AHRCARDGADLVLAARSAER

SEQ ID NO: 1549788 - protein, 24 aa, Mycobacterium tuberculosis
AIASCPPGRVEVVANYTAFLQLQR

SEQ ID NO: 1549789 - protein, 28 aa, Mycobacterium tuberculosis
AIDIPAIRPEFSANVAIDSFTVPSIPIP

SEQ ID NO: 1549790 - protein, 23 aa, Mycobacterium tuberculosis
AIDPSAAINMAWRAAGGAAGPLG

SEQ ID NO: 1549791 - protein, 33 aa, Mycobacterium tuberculosis
AIDSAFRAGWRGDYPSMIEFLAPLFTAGAGSND

SEQ ID NO: 1549792 - protein, 19 aa, Mycobacterium tuberculosis
AIELWKIVDRPNLFIKIPA

SEQ ID NO: 1549793 - protein, 18 aa, Mycobacterium tuberculosis
AIGLGAALLIAALLLSTY

SEQ ID NO: 1549794 - protein, 19 aa, Mycobacterium tuberculosis
AIPDRSDVVWLEHEDNHES

SEQ ID NO: 1549795 - protein, 29 aa, Mycobacterium tuberculosis
AIRADPGIPARGIVAVCDFGGSGTGITLV

SEQ ID NO: 1549796 - protein, 17 aa, Mycobacterium tuberculosis
AISKGQRGGNLWLSEVF

SEQ ID NO: 1549797 - protein, 19 aa, Mycobacterium tuberculosis
AITAESFGSGAVGPITTGS

SEQ ID NO: 1549798 - protein, 22 aa, Mycobacterium tuberculosis
AITLWLGMVAQFGQMITGGSAD

SEQ ID NO: 1549799 - protein, 19 aa, Mycobacterium tuberculosis
AKAGLLAGHPTNFATNTMV

SEQ ID NO: 1549800 - protein, 17 aa, Mycobacterium tuberculosis
AKALRDFASQYGVPMEQ

SEQ ID NO: 1549801 - protein, 20 aa, Mycobacterium tuberculosis
AKAVAGAFEAARAAMVDPVV

SEQ ID NO: 1549802 - protein, 21 aa, Mycobacterium tuberculosis
AKCSPPLRQRDPVVVKTLSGL

SEQ ID NO: 1549803 - protein, 35 aa, Mycobacterium tuberculosis; identical to SEQ ID NO: 196570

SEQ ID NO: 1549804 - protein, 18 aa, Mycobacterium tuberculosis
ALALYPGDKVQIMGVRVG

SEQ ID NO: 1549805 - protein, 29 aa, Mycobacterium tuberculosis
ALANAKRWGVLHVIWRQGYYPGIGAPSWT

SEQ ID NO: 1549806 - protein, 36 aa, Mycobacterium tuberculosis
ALANAKRWGVLHVIWRQGYYPGIGAPSWTADYGSEP

SEQ ID NO: 1549807 - protein, 21 aa, Mycobacterium tuberculosis
ALAQRPAWLAAAEALTTEGAD

SEQ ID NO: 1549808 - protein, 31 aa, Mycobacterium tuberculosis; identical to SEQ ID NO: 156156

SEQ ID NO: 1549809 - protein, 22 aa, Mycobacterium tuberculosis
ALAVLACPLAGPAGPAAPGGPA

SEQ ID NO: 1549810 - protein, 19 aa, Mycobacterium tuberculosis
ALCAFTAVLTVLAVTGLVE

SEQ ID NO: 1549811 - protein, 37 aa, Mycobacterium tuberculosis
ALDVAAMAGYHFDASAAVAQLAPWQQVLRNLGIDIGK

SEQ ID NO: 1549812 - protein, 20 aa, Mycobacterium tuberculosis
ALEDGYRVFTELTPHPLLTH

SEQ ID NO: 1549813 - protein, 22 aa, Mycobacterium tuberculosis
ALEGAGAGIVWAKVNTFGSTAA

SEQ ID NO: 1549814 - protein, 18 aa, Mycobacterium tuberculosis
ALEHGRIAVAIAGVPFKC

SEQ ID NO: 1549815 - protein, 28 aa, Mycobacterium tuberculosis
ALGGRALRWPRFPLVIEAAVAAVDHQPL

SEQ ID NO: 1549816 - protein, 20 aa, Mycobacterium tuberculosis
ALGLSRAWDKATLRIVSKAR

SEQ ID NO: 1549817 - protein, 18 aa, Mycobacterium tuberculosis
ALGLVGVGGNGGNAGTGF

SEQ ID NO: 1549818 - protein, 17 aa, Mycobacterium tuberculosis
ALGRPLIGNGANGKPGT

SEQ ID NO: 1549819 - protein, 24 aa, Mycobacterium tuberculosis
ALHLTAWRTAFGFSERWENGQPSG

SEQ ID NO: 1549820 - protein, 24 aa, Mycobacterium tuberculosis
ALKAAECRAGARAWRRHEPQLALH

SEQ ID NO: 1549821 - protein, 26 aa, Mycobacterium tuberculosis
ALKAAECRAGARAWRRHEPQLALHAD

SEQ ID NO: 1549822 - protein, 22 aa, Mycobacterium tuberculosis
ALLCGDLSAPVTFAVDRTGWAP

SEQ ID NO: 1549823 - protein, 19 aa, Mycobacterium tuberculosis
ALLGRPLIGDGAVGTASSP

SEQ ID NO: 1549824 - protein, 19 aa, Mycobacterium tuberculosis
ALLGRPLIGDGTDAAPGSG

SEQ ID NO: 1549825 - protein, 19 aa, Mycobacterium tuberculosis
ALLGRPLIGNGADGAAGTG

SEQ ID NO: 1549826 - protein, 18 aa, Mycobacterium tuberculosis
ALLHHARCPVAIIHSGNG

SEQ ID NO: 1549827 - protein, 17 aa, Mycobacterium tuberculosis
ALLMLPGVRGLGPGPVT

SEQ ID NO: 1549828 - protein, 20 aa, Mycobacterium tuberculosis
ALLQPTRPGGVSTLGALINT

SEQ ID NO: 1549829 - protein, 17 aa, Mycobacterium tuberculosis
ALMDIDTIYVWTHDSIG

SEQ ID NO: 1549830 - protein, 25 aa, Mycobacterium tuberculosis
ALNDNRVDAIVGWRQAGGNLATLLA

SEQ ID NO: 1549831 - protein, 26 aa, Mycobacterium tuberculosis
ALPGPPRLAATVGPAPARPAATAAEA

SEQ ID NO: 1549832 - protein, 19 aa, Mycobacterium tuberculosis
ALPSRLCTPGFGPIGVCIP

SEQ ID NO: 1549833 - protein, 26 aa, Mycobacterium tuberculosis
ALSAQMARFHQQFVHALTASVGSYAA

SEQ ID NO: 1549834 - protein, 17 aa, Mycobacterium tuberculosis
ALSGYSCPPDVRIRANI

SEQ ID NO: 1549835 - protein, 22 aa, Mycobacterium tuberculosis
ALSQDGNGFAGGQGGQGGAGGN

SEQ ID NO: 1549836 - protein, 19 aa, Mycobacterium tuberculosis
ALTGRPLIGNGANGAPGTG

SEQ ID NO: 1549837 - protein, 26 aa, Mycobacterium tuberculosis
ALVAANRARLVALAVSNLLGQNTPAI

SEQ ID NO: 1549838 - protein, 18 aa, Mycobacterium tuberculosis
ALVSMLKDHGVGFHPRKA

SEQ ID NO: 1549839 - protein, 21 aa, Mycobacterium tuberculosis
AMAATVVIVAWIANRPPASSH

SEQ ID NO: 1549840 - protein, 19 aa, Mycobacterium tuberculosis
AMLAPARILTRLPKPPTSL

SEQ ID NO: 1549841 - protein, 17 aa, Mycobacterium tuberculosis
AMQSGWMTWSRRGMMRW

SEQ ID NO: 1549842 - protein, 22 aa, Mycobacterium tuberculosis
AMSAPYVEWLERTAAQTKQTAT

SEQ ID NO: 1549843 - protein, 23 aa, Mycobacterium tuberculosis
AMVAAAQPYLAWLTYTAEAAAHA

SEQ ID NO: 1549844 - protein, 24 aa, Mycobacterium tuberculosis
AMVLPASVAGAGWVAPGAPAAPAT

SEQ ID NO: 1549845 - protein, 18 aa, Mycobacterium tuberculosis
AMVSGGWNQAPSALLGGG

SEQ ID NO: 1549846 - protein, 17 aa, Mycobacterium tuberculosis
ANARLAYAAYREVFEDS

SEQ ID NO: 1549847 - protein, 19 aa, Mycobacterium tuberculosis
ANDLLPPGGLIPLSRTSPA

SEQ ID NO: 1549848 - protein, 22 aa, Mycobacterium tuberculosis
ANLAGLFLDNTGNLTLNFGVAN

SEQ ID NO: 1549849 - protein, 22 aa, Mycobacterium tuberculosis
ANRGRLRSLVASNLLGQNAPAI

SEQ ID NO: 1549850 - protein, 25 aa, Mycobacterium tuberculosis
ANVVGGIDWDGHGLLGLEDSLDAVL

SEQ ID NO: 1549851 - protein, 18 aa, Mycobacterium tuberculosis
APAARLLSIRAMSTKFSP

SEQ ID NO: 1549852 - protein, 17 aa, Mycobacterium tuberculosis
APADGFVALRVADDRTV

SEQ ID NO: 1549853 - protein, 21 aa, Mycobacterium tuberculosis
APADKAGWGVLAGPAPITPPA

SEQ ID NO: 1549854 - protein, 25 aa, Mycobacterium tuberculosis
APARLDNARFLLPVVGVPPDQATDF

SEQ ID NO: 1549855 - protein, 22 aa, Mycobacterium tuberculosis
APDGYPIINCEYAIVNNRQKDA

SEQ ID NO: 1549856 - protein, 21 aa, Mycobacterium tuberculosis
APEEMPIKIILLGATPPGAMV

SEQ ID NO: 1549857 - protein, 23 aa, Mycobacterium tuberculosis
APEYISTELISGGRTGKFNRPYL

SEQ ID NO: 1549858 - protein, 20 aa, Mycobacterium tuberculosis
APGCRGCCQCAIGCPSNAKF

SEQ ID NO: 1549859 - protein, 21 aa, Mycobacterium tuberculosis
APGGPGGLLLGNGGNGGSGAP

SEQ ID NO: 1549860 - protein, 19 aa, Mycobacterium tuberculosis
APGVACGAGGAGGTAGLFG

SEQ ID NO: 1549861 - protein, 19 aa, Mycobacterium tuberculosis
APHAACTAATANCRSPAGG

SEQ ID NO: 1549862 - protein, 18 aa, Mycobacterium tuberculosis
APHSTCWPTRSSSPPVRR

SEQ ID NO: 1549863 - protein, 23 aa, Mycobacterium tuberculosis
APIPGRLFAGPGLSQPSDVLPAD

SEQ ID NO: 1549864 - protein, 19 aa, Mycobacterium tuberculosis
APIVEPMLAKSVAAAAIAS

SEQ ID NO: 1549865 - protein, 36 aa, Mycobacterium tuberculosis
APLLRPRKPWGNGRGGNAWVLLGMFATRPRWHPPVT

SEQ ID NO: 1549866 - protein, 18 aa, Mycobacterium tuberculosis
APNFAYALLAKRLRRQAK

SEQ ID NO: 1549867 - protein, 20 aa, Mycobacterium tuberculosis
APPCRCCATPTSAGTKVAVI

SEQ ID NO: 1549868 - protein, 24 aa, Mycobacterium tuberculosis
APPGHARCPFGPAPGPAPPPAAPG

SEQ ID NO: 1549869 - protein, 17 aa, Mycobacterium tuberculosis
APPLRLRGPVTRADGGK

SEQ ID NO: 1549870 - protein, 17 aa, Mycobacterium tuberculosis
APPSKIFRTRALRVPGV

SEQ ID NO: 1549871 - protein, 21 aa, Mycobacterium tuberculosis
APPSPIGMASRPPVPPAPPAP

SEQ ID NO: 1549872 - protein, 18 aa, Mycobacterium tuberculosis
APSCMRIDYELITQNHRA

SEQ ID NO: 1549873 - protein, 19 aa, Mycobacterium tuberculosis
APTEFMFGRSLIGDGADGT

SEQ ID NO: 1549874 - protein, 29 aa, Mycobacterium tuberculosis
APVAPAVAAHCCWALADRAASAAPADKAG

SEQ ID NO: 1549875 - protein, 25 aa, Mycobacterium tuberculosis
APVPMLPGSWGPDLVGVAGDGGLVS

SEQ ID NO: 1549876 - protein, 19 aa, Mycobacterium tuberculosis
APVVVGWPVGQLYANMTEW

SEQ ID NO: 1549877 - protein, 22 aa, Mycobacterium tuberculosis
AQARSGEFSWRQSAEALRSVLE

SEQ ID NO: 1549878 - protein, 19 aa, Mycobacterium tuberculosis
AQATIFHDQFVQALTSGGN

SEQ ID NO: 1549879 - protein, 28 aa, Mycobacterium tuberculosis
AQCRQCAHPGIVGRPLIGDGANGGPGQP

SEQ ID NO: 1549880 - protein, 29 aa, Mycobacterium tuberculosis
AQCRQCAHPGIVGRPLIGDGANGGPGQPG

SEQ ID NO: 1549881 - protein, 17 aa, Mycobacterium tuberculosis
AQHPDHRLTAMLGTHGK

SEQ ID NO: 1549882 - protein, 26 aa, Mycobacterium tuberculosis
AQLFSMPIHQVMVMPGSVMTIPGMRL

SEQ ID NO: 1549883 - protein, 20 aa, Mycobacterium tuberculosis
AQLTRQLRLELGHESVRQAR

SEQ ID NO: 1549884 - protein, 17 aa, Mycobacterium tuberculosis
AQMARFHQQFVQALTAS

SEQ ID NO: 1549885 - protein, 24 aa, Mycobacterium tuberculosis
AQNFNQTITLAWPVSSITIPQIQQ

SEQ ID NO: 1549886 - protein, 23 aa, Mycobacterium tuberculosis
AQVTEFDGGVLVNWDVREGVFAP

SEQ ID NO: 1549887 - protein, 19 aa, Mycobacterium tuberculosis
AQYRIRLGGTWKKPGTSDI

SEQ ID NO: 1549888 - protein, 20 aa, Mycobacterium tuberculosis
ARAADLWRFTAGAVDQPNPV

SEQ ID NO: 1549889 - protein, 17 aa, Mycobacterium tuberculosis
ARAARPAGAPKSAGATL

SEQ ID NO: 1549890 - protein, 23 aa, Mycobacterium tuberculosis
ARAMGPMQFLPGTRARYATDGDD

SEQ ID NO: 1549891 - protein, 23 aa, Mycobacterium tuberculosis
ARCAQRLWLGVCPVPGSRAARRC

SEQ ID NO: 1549892 - protein, 26 aa, Mycobacterium tuberculosis
AREKLFPLICRYAVAYHVVFIPSAEV

SEQ ID NO: 1549893 - protein, 21 aa, Mycobacterium tuberculosis
ARELSGSSNLLFRRNSVSGAV

SEQ ID NO: 1549894 - protein, 21 aa, Mycobacterium tuberculosis
ARFGVPVPNLTAWRDAEPPRH

SEQ ID NO: 1549895 - protein, 25 aa, Mycobacterium tuberculosis
ARFPDAVRYSVRFAKPVLLPATAGL

SEQ ID NO: 1549896 - protein, 17 aa, Mycobacterium tuberculosis
ARIAIGGLYGDITYPVT

SEQ ID NO: 1549897 - protein, 18 aa, Mycobacterium tuberculosis
ARLAPIRLRIGVHTGEVA

SEQ ID NO: 1549898 - protein, 20 aa, Mycobacterium tuberculosis
ARLAVQAMTAVVARHVDLAA

SEQ ID NO: 1549899 - protein, 22 aa, Mycobacterium tuberculosis
ARLELTLLVGEWLNQIPDFELA

SEQ ID NO: 1549900 - protein, 19 aa, Mycobacterium tuberculosis
ARLSARRFWVRYAAEATGA

SEQ ID NO: 1549901 - protein, 22 aa, Mycobacterium tuberculosis
ARPADCVGVGYLTQRNVYRSVE

SEQ ID NO: 1549902 - protein, 28 aa, Mycobacterium tuberculosis
ARPCLPHRPCRTWPRRAYLASASRGIGI

SEQ ID NO: 1549903 - protein, 19 aa, Mycobacterium tuberculosis
ARPGDLLYGLHAMMFNRSR

SEQ ID NO: 1549904 - protein, 30 aa, Mycobacterium tuberculosis
ARPPGWRATMARWPRRRSMRFESSPHGKRI

SEQ ID NO: 1549905 - protein, 21 aa, Mycobacterium tuberculosis
ARPTPIKALVRTVSPMSPCSS

SEQ ID NO: 1549906 - protein, 20 aa, Mycobacterium tuberculosis
ARQRHWVEPNHTVWAQAPGA

SEQ ID NO: 1549907 - protein, 18 aa, Mycobacterium tuberculosis
ARRRVDLLVPTRHTQAST

SEQ ID NO: 1549908 - protein, 26 aa, Mycobacterium tuberculosis
ARSARWPRRLGRRCVSEFAKCRVGTS

SEQ ID NO: 1549909 - protein, 18 aa, Mycobacterium tuberculosis
ARSGCGMAVMTPRSGQVP

SEQ ID NO: 1549910 - protein, 30 aa, Mycobacterium tuberculosis; identical to SEQ ID NO: 1480307

SEQ ID NO: 1549911 - protein, 17 aa, Mycobacterium tuberculosis
ARTRCRCGKTFSGSART

SEQ ID NO: 1549912 - protein, 23 aa, Mycobacterium tuberculosis
ARTVGRQALDMYFNLANYRNNWK

SEQ ID NO: 1549913 - protein, 22 aa, Mycobacterium tuberculosis
ARVHCDRFFGWYNHEHKHSGIG

SEQ ID NO: 1549914 - protein, 23 aa, Mycobacterium tuberculosis
ARVVSMPCLEWFEAQPYEYRDAV

SEQ ID NO: 1549915 - protein, 25 aa, Mycobacterium tuberculosis
ARVYRRLPPCPGWVRPAVSGLPNLS

SEQ ID NO: 1549916 - protein, 18 aa, Mycobacterium tuberculosis
ARYLFVFLDHHGMLSVFG

SEQ ID NO: 1549917 - protein, 24 aa, Mycobacterium tuberculosis
ARYNVPWQPAFVFYRADGTSTFVN

SEQ ID NO: 1549918 - protein, 27 aa, Mycobacterium tuberculosis
ASAISGGAARMFAAPAAATAAVTPPAL

SEQ ID NO: 1549919 - protein, 24 aa, Mycobacterium tuberculosis
ASAQAAAFYAQFVQALSAGGGAYA

SEQ ID NO: 1549920 - protein, 24 aa, Mycobacterium tuberculosis
ASCSVPGAWPPVTIAGRRYMDGGV

SEQ ID NO: 1549921 - protein, 19 aa, Mycobacterium tuberculosis
ASGPKYMLDMTFPVDYPDQ

SEQ ID NO: 1549922 - protein, 20 aa, Mycobacterium tuberculosis
ASGPLGLMKTILALRHGVVP

SEQ ID NO: 1549923 - protein, 24 aa, Mycobacterium tuberculosis
ASKLMQCVADGPGYAGSSPTLGPT

SEQ ID NO: 1549924 - protein, 20 aa, Mycobacterium tuberculosis
ASLGGFNFGGATIGHNNVGI

SEQ ID NO: 1549925 - protein, 20 aa, Mycobacterium tuberculosis
ASTEAAVERSLLGAVNAPTE

SEQ ID NO: 1549926 - protein, 21 aa, Mycobacterium tuberculosis
ASTEAAVERSLLGAVNAPTEA

SEQ ID NO: 1549927 - protein, 21 aa, Mycobacterium tuberculosis
ASTWSVCKGLAAVVITSAAAF

SEQ ID NO: 1549928 - protein, 29 aa, Mycobacterium tuberculosis
ASVESSVLRWARESCGLTEVAAARKLGLP

SEQ ID NO: 1549929 - protein, 17 aa, Mycobacterium tuberculosis
ASVPPSWAWPKPAVAPP

SEQ ID NO: 1549930 - protein, 23 aa, Mycobacterium tuberculosis
ATAASRRPGTSGGDGGIGGAGGI

SEQ ID NO: 1549931 - protein, 20 aa, Mycobacterium tuberculosis
ATAGFSRPVRAGRWPRGAGC

SEQ ID NO: 1549932 - protein, 23 aa, Mycobacterium tuberculosis
ATALEGSGWTVAAEEAGPVTGMM

SEQ ID NO: 1549933 - protein, 18 aa, Mycobacterium tuberculosis
ATALRVGLVAGCSAWRRR

SEQ ID NO: 1549934 - protein, 17 aa, Mycobacterium tuberculosis
ATARPVFGDRFNTGNEE

SEQ ID NO: 1549935 - protein, 17 aa, Mycobacterium tuberculosis
ATASWPRSSRAVVVALR

SEQ ID NO: 1549936 - protein, 22 aa, Mycobacterium tuberculosis
ATAVLPRSATPVLLPDVVAAAP

SEQ ID NO: 1549937 - protein, 26 aa, Mycobacterium tuberculosis
ATDLAEWLVRQGVPFRSAHEAAGAAV

SEQ ID NO: 1549938 - protein, 20 aa, Mycobacterium tuberculosis
ATESLGRFSEVANRALAATR

SEQ ID NO: 1549939 - protein, 24 aa, Mycobacterium tuberculosis
ATEVARIGSALSLASAVAAAQTSA

SEQ ID NO: 1549940 - protein, 34 aa, Mycobacterium tuberculosis
ATGFLGRYLALEWLDRMDLVNGKLICLVRARSDE

SEQ ID NO: 1549941 - protein, 25 aa, Mycobacterium tuberculosis
ATGQWARTAVGLARDVAEAFARDPE

SEQ ID NO: 1549942 - protein, 17 aa, Mycobacterium tuberculosis
ATLRAVRSLTGVPIDYF

SEQ ID NO: 1549943 - protein, 17 aa, Mycobacterium tuberculosis
ATLTPAPSTSGFDNNAR

SEQ ID NO: 1549944 - protein, 19 aa, Mycobacterium tuberculosis
ATMLPFSWQGVSLHAAGAS

SEQ ID NO: 1549945 - protein, 18 aa, Mycobacterium tuberculosis
ATNAAPLATLEHNVLNAL

SEQ ID NO: 1549946 - protein, 20 aa, Mycobacterium tuberculosis
ATPANIAGMVVFIDPGHNGA

SEQ ID NO: 1549947 - protein, 19 aa, Mycobacterium tuberculosis
ATQVRRGPCGGLCGERTQK

SEQ ID NO: 1549948 - protein, 20 aa, Mycobacterium tuberculosis
ATRRSWAVLGEMAELGEDAI

SEQ ID NO: 1549949 - protein, 19 aa, Mycobacterium tuberculosis
ATSAAPLQDLLGVVNAPAQ

SEQ ID NO: 1549950 - protein, 18 aa, Mycobacterium tuberculosis
ATSFKAKPGQRIRIRIIN

SEQ ID NO: 1549951 - protein, 23 aa, Mycobacterium tuberculosis
ATSPLLAPINEFFLANTGRPLIG

SEQ ID NO: 1549952 - protein, 25 aa, Mycobacterium tuberculosis
ATSPLLAPINEFFLANTGRPLIGNG

SEQ ID NO: 1549953 - protein, 17 aa, Mycobacterium tuberculosis
ATSTPHCRGSPGCWASR

SEQ ID NO: 1549954 - protein, 18 aa, Mycobacterium tuberculosis
ATTTSAPCPAGMSGLPLA

SEQ ID NO: 1549955 - protein, 25 aa, Mycobacterium tuberculosis
ATVPVGILCLEFLVHAWDFAIATGS

SEQ ID NO: 1549956 - protein, 26 aa, Mycobacterium tuberculosis
AVAAFAPGVCKVGGRTLRGAGHAVTA

SEQ ID NO: 1549957 - protein, 25 aa, Mycobacterium tuberculosis
AVAAGRAVAAEGMVAVAAVAAVAAV

SEQ ID NO: 1549958 - protein, 24 aa, Mycobacterium tuberculosis
AVAAQLAPWAQAVRALPNPTAPAL

SEQ ID NO: 1549959 - protein, 23 aa, Mycobacterium tuberculosis
AVADCGRLLAGRLHRAVDGASQL

SEQ ID NO: 1549960 - protein, 24 aa, Mycobacterium tuberculosis
AVADCGRLLAGRLHRAVDGASQLR

SEQ ID NO: 1549961 - protein, 23 aa, Mycobacterium tuberculosis
AVASPCAYFLVYESTETTERPEH

SEQ ID NO: 1549962 - protein, 22 aa, Mycobacterium tuberculosis
AVDPAVVVLLNLSRDQLDRVGE

SEQ ID NO: 1549963 - protein, 24 aa, Mycobacterium tuberculosis
AVEAEYELMWAADVAAMAGYHSGA

SEQ ID NO: 1549964 - protein, 25 aa, Mycobacterium tuberculosis
AVEPRLWNMSTVLPILQDTTIVAAG

SEQ ID NO: 1549965 - protein, 27 aa, Mycobacterium tuberculosis
AVGADFGASIYAEYRLSTTARKAANLR

SEQ ID NO: 1549966 - protein, 18 aa, Mycobacterium tuberculosis
AVGLYPGDQVRVLGVPVG

SEQ ID NO: 1549967 - protein, 30 aa, Mycobacterium tuberculosis
AVKWALAARVGPAVLARTPALNGSAGANGT

SEQ ID NO: 1549968 - protein, 17 aa, Mycobacterium tuberculosis
AVLGLGFGGAAGAGGAA

SEQ ID NO: 1549969 - protein, 24 aa, Mycobacterium tuberculosis
AVMVGFCTATAATAFSQTTAGVAG

SEQ ID NO: 1549970 - protein, 18 aa, Mycobacterium tuberculosis
AVNTAAWYVNAAIPTAIF

SEQ ID NO: 1549971 - protein, 17 aa, Mycobacterium tuberculosis
AVRPELQQALANQNWAA

SEQ ID NO: 1549972 - protein, 25 aa, Mycobacterium tuberculosis
AVRTFARRRIDAILADVAPADGPDD

SEQ ID NO: 1549973 - protein, 25 aa, Mycobacterium tuberculosis
AVRVARAALAAALRARPASAVTAVT

SEQ ID NO: 1549974 - protein, 17 aa, Mycobacterium tuberculosis
AVSPPPIDERWLPESAL

SEQ ID NO: 1549975 - protein, 20 aa, Mycobacterium tuberculosis
AVTGQFLWQNVFGVWPVSGE

SEQ ID NO: 1549976 - protein, 24 aa, Mycobacterium tuberculosis
AVTSFRVGRHRAEVVAVADGITYV

SEQ ID NO: 1549977 - protein, 23 aa, Mycobacterium tuberculosis
AVVLAGFPGRWPRSGSSEPVGRR

SEQ ID NO: 1549978 - protein, 18 aa, Mycobacterium tuberculosis
AVVQPMLVAANRADLVSL

SEQ ID NO: 1549979 - protein, 18 aa, Mycobacterium tuberculosis
AWGKLGYPRRAKRLHECA

SEQ ID NO: 1549980 - protein, 22 aa, Mycobacterium tuberculosis
AWLVWFGGGFIPLVPGAPTPPT

SEQ ID NO: 1549981 - protein, 31 aa, Mycobacterium tuberculosis
AYASAEAAAAEQIVLGVINAPTQALLGRPLI

SEQ ID NO: 1549982 - protein, 18 aa, Mycobacterium tuberculosis
AYFGAVGVDGVLGVGPNA

SEQ ID NO: 1549983 - protein, 18 aa, Mycobacterium tuberculosis
AYGAGPCPGHLTDIEHIV

SEQ ID NO: 1549984 - protein, 17 aa, Mycobacterium tuberculosis
AYLQSWVHRTAVPGCVA

SEQ ID NO: 1549985 - protein, 18 aa, Mycobacterium tuberculosis
CASVDPMPARSEAAAANT

SEQ ID NO: 1549986 - protein, 22 aa, Mycobacterium tuberculosis
CATARACLVEAHLQRLTQSARL

SEQ ID NO: 1549987 - protein, 25 aa, Mycobacterium tuberculosis
CDGPRFRWVNGMRVSFENGFPDSTL

SEQ ID NO: 1549988 - protein, 19 aa, Mycobacterium tuberculosis
CDLQIKWNGFQAGGPVRTV

SEQ ID NO: 1549989 - protein, 23 aa, Mycobacterium tuberculosis
CELPGRLHALFARGDGVTPRVVL

SEQ ID NO: 1549990 - protein, 17 aa, Mycobacterium tuberculosis
CGCFGQRPDPGGEPAGF

SEQ ID NO: 1549991 - protein, 23 aa, Mycobacterium tuberculosis
CGGDGGLSRWGIGGGGGVGAMAA

SEQ ID NO: 1549992 - protein, 19 aa, Mycobacterium tuberculosis
CGKLAVPVDYDRPDGDVAA

SEQ ID NO: 1549993 - protein, 17 aa, Mycobacterium tuberculosis
CGYSRLQGAHQFHPPAA

SEQ ID NO: 1549994 - protein, 31 aa, Mycobacterium tuberculosis; identical to SEQ ID NO: 159922

SEQ ID NO: 1549995 - protein, 18 aa, Mycobacterium tuberculosis
CIFAIREDSCPNHATYRT

SEQ ID NO: 1549996 - protein, 19 aa, Mycobacterium tuberculosis
CKNIIALACGMAVGIGLGE

SEQ ID NO: 1549997 - protein, 23 aa, Mycobacterium tuberculosis
CLDLKRGEPVLITAHTNLEFLSC

SEQ ID NO: 1549998 - protein, 17 aa, Mycobacterium tuberculosis
CNTAFVQLGIKHRRRRP

SEQ ID NO: 1549999 - protein, 19 aa, Mycobacterium tuberculosis
CPPAGTGTHHYRFTLYHLP

SEQ ID NO: 1550000 - protein, 21 aa, Mycobacterium tuberculosis
CRAKHRLPGLQFVQGDAQNLP

SEQ ID NO: 1550001 - protein, 19 aa, Mycobacterium tuberculosis
CRAWLAALPPVLPGHPIGS

SEQ ID NO: 1550002 - protein, 18 aa, Mycobacterium tuberculosis
CRRCRRWRVGTPTRYGWC

SEQ ID NO: 1550003 - protein, 18 aa, Mycobacterium tuberculosis
CRRRRRPLDRLARERTPR

SEQ ID NO: 1550004 - protein, 17 aa, Mycobacterium tuberculosis
CRVREGFVMRLAIVGTA

SEQ ID NO: 1550005 - protein, 18 aa, Mycobacterium tuberculosis
CSAARRHAVKVAKDQREQ

SEQ ID NO: 1550006 - protein, 27 aa, Mycobacterium tuberculosis
CSPDLPWDLLQRSRISAVSVDASTLQA

SEQ ID NO: 1550007 - protein, 22 aa, Mycobacterium tuberculosis
CSTRSTSRYRTPAGCTRAPTTR

SEQ ID NO: 1550008 - protein, 26 aa, Mycobacterium tuberculosis
CTAATANCRSPAGGGTRAAGATVAAG

SEQ ID NO: 1550009 - protein, 18 aa, Mycobacterium tuberculosis
CTGEVRWVSARDLRFGYR

SEQ ID NO: 1550010 - protein, 24 aa, Mycobacterium tuberculosis
CVDQCKPLRAMFCRHWFGFVVRLH

SEQ ID NO: 1550011 - protein, 18 aa, Mycobacterium tuberculosis
CYKVSRPIDETSLGASID

SEQ ID NO: 1550012 - protein, 32 aa, Mycobacterium tuberculosis
DAAPGSGGATCFRYPPKLWTKTDLAGWFYVYI

SEQ ID NO: 1550013 - protein, 27 aa, Mycobacterium tuberculosis
DAAQPIWWVVRAIEFSKDFETFVQKLF

SEQ ID NO: 1550014 - protein, 23 aa, Mycobacterium tuberculosis
DAARGRMGAVRFGIYQAGCNSSL

SEQ ID NO: 1550015 - protein, 25 aa, Mycobacterium tuberculosis
DADQPGATGGTGFAGGAGGAGGSGG

SEQ ID NO: 1550016 - protein, 26 aa, Mycobacterium tuberculosis
DADQPGATGGTGFAGGAGGAGKAGGS

SEQ ID NO: 1550017 - protein, 23 aa, Mycobacterium tuberculosis
DAGCGAAGAGGRPAGTASGSAAV

SEQ ID NO: 1550018 - protein, 25 aa, Mycobacterium tuberculosis
DAGLFGFGGDGGWGGRGVDARFGAA

SEQ ID NO: 1550019 - protein, 22 aa, Mycobacterium tuberculosis
DAIDWQAYFHLRNRLVVAAMHW

SEQ ID NO: 1550020 - protein, 24 aa, Mycobacterium tuberculosis
DAKPAQVALAWLISLPGVVAIPGA

SEQ ID NO: 1550021 - protein, 19 aa, Mycobacterium tuberculosis
DAPLIGWGGNGGPGGFAAF

SEQ ID NO: 1550022 - protein, 20 aa, Mycobacterium tuberculosis
DARLVVKLPNRWPLTDAAGV

SEQ ID NO: 1550023 - protein, 22 aa, Mycobacterium tuberculosis
DARRVADVLGIPFYVWDFAEKF

SEQ ID NO: 1550024 - protein, 23 aa, Mycobacterium tuberculosis
DASHELRTPLALLTTELELRCAG

SEQ ID NO: 1550025 - protein, 22 aa, Mycobacterium tuberculosis
DASLRLLPRGGRFIEMGKTEFG

SEQ ID NO: 1550026 - protein, 23 aa, Mycobacterium tuberculosis
DDGIGLDEFVDWLNSPTSGSGCT

SEQ ID NO: 1550027 - protein, 17 aa, Mycobacterium tuberculosis
DDIDGLRFHRGSWARAT

SEQ ID NO: 1550028 - protein, 22 aa, Mycobacterium tuberculosis
DDLVRRCRMVMAGESLPQAEPT

SEQ ID NO: 1550029 - protein, 17 aa, Mycobacterium tuberculosis
DDQAWRAARQALGGEDV

SEQ ID NO: 1550030 - protein, 27 aa, Mycobacterium tuberculosis
DDSRLGWPLRPPPAVVRQFDAASPNWN

SEQ ID NO: 1550031 - protein, 22 aa, Mycobacterium tuberculosis
DEVSAAIAALFGAHARAYQALS

SEQ ID NO: 1550032 - protein, 23 aa, Mycobacterium tuberculosis
DEVSAAIAALFSAHGRAYQVASA

SEQ ID NO: 1550033 - protein, 23 aa, Mycobacterium tuberculosis
DEVSAAIAALFSSYARDYQTLSV

SEQ ID NO: 1550034 - protein, 22 aa, Mycobacterium tuberculosis
DEVSAAIASLFGAHGQAYQAVS

SEQ ID NO: 1550035 - protein, 23 aa, Mycobacterium tuberculosis
DEVSAAIATLFGSHAREYQAIST

SEQ ID NO: 1550036 - protein, 22 aa, Mycobacterium tuberculosis
DEVSAAVAALFSAHAGQYQQLG

SEQ ID NO: 1550037 - protein, 22 aa, Mycobacterium tuberculosis
DEVSTAIAALFGAQGQAYQAAS

SEQ ID NO: 1550038 - protein, 17 aa, Mycobacterium tuberculosis
DFADLFPVPAKLWTIAD

SEQ ID NO: 1550039 - protein, 27 aa, Mycobacterium tuberculosis
DFISEKRFDFAFSLNVMEHIDLPDEAV

SEQ ID NO: 1550040 - protein, 19 aa, Mycobacterium tuberculosis
DFVARFPLLKPLDMSDAIC

SEQ ID NO: 1550041 - protein, 23 aa, Mycobacterium tuberculosis
DGACPDVEVVFARRTGEPPGVGG

SEQ ID NO: 1550042 - protein, 19 aa, Mycobacterium tuberculosis
DGAPIPVQFSCKGANVAPP

SEQ ID NO: 1550043 - protein, 18 aa, Mycobacterium tuberculosis
DGAVFRKRVPGPHFDAGI

SEQ ID NO: 1550044 - protein, 20 aa, Mycobacterium tuberculosis
DGCRFACDYALLAVPYLTLR

SEQ ID NO: 1550045 - protein, 23 aa, Mycobacterium tuberculosis
DGGDGGGLFSIGVGGDGGNAGNG

SEQ ID NO: 1550046 - protein, 68 aa, Mycobacterium tuberculosis
DGGGRGRRPRRVAVRRWRGWRERRGRGRRRRRRPSRRWRRERRQWRQRRQWRQWRQRRHRGVAVRQRR

SEQ ID NO: 1550047 - protein, 24 aa, Mycobacterium tuberculosis
DGGNGRSGPVNVAGSAGGNGGAGG

SEQ ID NO: 1550048 - protein, 24 aa, Mycobacterium tuberculosis
DGGTGGRGGWLAGAGGAGGAGGVG

SEQ ID NO: 1550049 - protein, 23 aa, Mycobacterium tuberculosis
DGHPMCVCGRIGAFTQHLKLGYR

SEQ ID NO: 1550050 - protein, 21 aa, Mycobacterium tuberculosis
DGINSRVLWQAAGPDTISGAT

SEQ ID NO: 1550051 - protein, 18 aa, Mycobacterium tuberculosis
DGQIGFGSLNSGSGNIGL

SEQ ID NO: 1550052 - protein, 18 aa, Mycobacterium tuberculosis
DGQLQWVSIPAWALCVAF

SEQ ID NO: 1550053 - protein, 20 aa, Mycobacterium tuberculosis
DGQWRLRQQRHFGCGGQPEF

SEQ ID NO: 1550054 - protein, 18 aa, Mycobacterium tuberculosis
DGSVYKIGFARSDLSVQT

SEQ ID NO: 1550055 - protein, 17 aa, Mycobacterium tuberculosis
DGTVLFGPIQIPIINVP

SEQ ID NO: 1550056 - protein, 24 aa, Mycobacterium tuberculosis
DHFARRGRRVHRLAVSHAFHSLLM

SEQ ID NO: 1550057 - protein, 17 aa, Mycobacterium tuberculosis
DIERLRKLWDVPALAFV

SEQ ID NO: 1550058 - protein, 21 aa, Mycobacterium tuberculosis
DIGGGFGNKVPIYPGYVCAIV

SEQ ID NO: 1550059 - protein, 17 aa, Mycobacterium tuberculosis
DINTGWFNTGIMNTGTR

SEQ ID NO: 1550060 - protein, 23 aa, Mycobacterium tuberculosis
DIVIPAFGGGIGIPINIGPLTIT

SEQ ID NO: 1550061 - protein, 23 aa, Mycobacterium tuberculosis
DKDIPHLTAAIIAKYISNLRLLG

SEQ ID NO: 1550062 - protein, 17 aa, Mycobacterium tuberculosis
DKMRVTLHYSNKYQVPA

SEQ ID NO: 1550063 - protein, 17 aa, Mycobacterium tuberculosis
DKNTAYRIGLKVASPSV

SEQ ID NO: 1550064 - protein, 24 aa, Mycobacterium tuberculosis
DKRRFSRRGFLGAGIASGFALAAC

SEQ ID NO: 1550065 - protein, 20 aa, Mycobacterium tuberculosis
DLATPGFLSGIGNFGTNLAG

SEQ ID NO: 1550066 - protein, 19 aa, Mycobacterium tuberculosis
DLDQVWRLTRGAGQRVAVI

SEQ ID NO: 1550067 - protein, 17 aa, Mycobacterium tuberculosis
DLNQCVFWLPAVNRPGG

SEQ ID NO: 1550068 - protein, 24 aa, Mycobacterium tuberculosis
DLPGELMSALSQGLSQFGINIPPV

SEQ ID NO: 1550069 - protein, 27 aa, Mycobacterium tuberculosis
DLVTPAFASGLMRDGMGTMTLNLGLAN

SEQ ID NO: 1550070 - protein, 29 aa, Mycobacterium tuberculosis
DMNNGVFYRGVGQGSLQFSITTPDLTLPP

SEQ ID NO: 1550071 - protein, 18 aa, Mycobacterium tuberculosis
DNHIFDWETGDAAATEAV

SEQ ID NO: 1550072 - protein, 27 aa, Mycobacterium tuberculosis
DNPYPVVVNGRIVWIVDAYTTLDTYPY

SEQ ID NO: 1550073 - protein, 19 aa, Mycobacterium tuberculosis
DPAASGWEALSSALGGKVL

SEQ ID NO: 1550074 - protein, 23 aa, Mycobacterium tuberculosis
DPARAARVLGFRAAVDPGEGLRE

SEQ ID NO: 1550075 - protein, 21 aa, Mycobacterium tuberculosis
DPCSDIAVVFARGTHQASGLG

SEQ ID NO: 1550076 - protein, 26 aa, Mycobacterium tuberculosis
DPDAVGGLYVHWIVTGIAPGSGSTAD

SEQ ID NO: 1550077 - protein, 28 aa, Mycobacterium tuberculosis
DPDGAVGRALCLAIDPDLLITVNAMTGG

SEQ ID NO: 1550078 - protein, 17 aa, Mycobacterium tuberculosis
DPFRRPSWEEITEVLEW

SEQ ID NO: 1550079 - protein, 20 aa, Mycobacterium tuberculosis
DPIVWAFNCALNVVSTTPQQ

SEQ ID NO: 1550080 - protein, 23 aa, Mycobacterium tuberculosis
DPPGHRPGRRIQLAGSIADASPP

SEQ ID NO: 1550081 - protein, 18 aa, Mycobacterium tuberculosis
DPQHRLLLEVSWEAIEHA

SEQ ID NO: 1550082 - protein, 22 aa, Mycobacterium tuberculosis
DPSRLHPLATMERTFIAPSRFH

SEQ ID NO: 1550083 - protein, 22 aa, Mycobacterium tuberculosis
DPVLRTWMRAFPGTVKSEDQIP

SEQ ID NO: 1550084 - protein, 19 aa, Mycobacterium tuberculosis
DQIERWARKLNNLAAQTAT

SEQ ID NO: 1550085 - protein, 34 aa, Mycobacterium tuberculosis
DQLFRFSRILDVQPRLAILLGECAVPAEGRVRLL

SEQ ID NO: 1550086 - protein, 19 aa, Mycobacterium tuberculosis
DQRALGAAVHYAAVDKDAV

SEQ ID NO: 1550087 - protein, 18 aa, Mycobacterium tuberculosis
DQVARCKSGGNWSINTGN

SEQ ID NO: 1550088 - protein, 22 aa, Mycobacterium tuberculosis
DQWMMQAEVAITNFVTTMDVAA

SEQ ID NO: 1550089 - protein, 29 aa, Mycobacterium tuberculosis
DRFYPPRWKTAGDRRGLVWGNGGTGGERW

SEQ ID NO: 1550090 - protein, 21 aa, Mycobacterium tuberculosis
DRGAGHLGFAGTARREAVADA

SEQ ID NO: 1550091 - protein, 26 aa, Mycobacterium tuberculosis
DRKLGACRRVRRVARVRVLRADTMRS

SEQ ID NO: 1550092 - protein, 19 aa, Mycobacterium tuberculosis
DRSTLQTSLLLTVMIDETL

SEQ ID NO: 1550093 - protein, 20 aa, Mycobacterium tuberculosis
DSAARNSAGFGARATASNPS

SEQ ID NO: 1550094 - protein, 20 aa, Mycobacterium tuberculosis
DSEAMLLAAIYVAALRSYGF

SEQ ID NO: 1550095 - protein, 22 aa, Mycobacterium tuberculosis
DSILRVLAMHRFAKAPMLVGGQ

SEQ ID NO: 1550096 - protein, 17 aa, Mycobacterium tuberculosis
DSLAITWAHPELPQRAF

SEQ ID NO: 1550097 - protein, 23 aa, Mycobacterium tuberculosis
DSMRAGLQALAWIAHQPEATRRS

SEQ ID NO: 1550098 - protein, 19 aa, Mycobacterium tuberculosis
DSPQRLWEALLRGDDLVGE

SEQ ID NO: 1550099 - protein, 25 aa, Mycobacterium tuberculosis
DSQLPAGVVPTRWTPTMVTTTKDLQ

SEQ ID NO: 1550100 - protein, 24 aa, Mycobacterium tuberculosis
DSRPSRYTNIVGCVSDRALLRDVM

SEQ ID NO: 1550101 - protein, 23 aa, Mycobacterium tuberculosis
DSVSCPRSGEVIVRKAPSQEDHW

SEQ ID NO: 1550102 - protein, 19 aa, Mycobacterium tuberculosis
DTIVLRRSRPLQISLDGHD

SEQ ID NO: 1550103 - protein, 17 aa, Mycobacterium tuberculosis
DTLPVALRYRLQSNPLV

SEQ ID NO: 1550104 - protein, 24 aa, Mycobacterium tuberculosis
DTQLPNWWGPILAPALAGVGALRG

SEQ ID NO: 1550105 - protein, 29 aa, Mycobacterium tuberculosis
DTRAYFRGECLRRFGADIAAASWDSVIFD

SEQ ID NO: 1550106 - protein, 30 aa, Mycobacterium tuberculosis; identical to SEQ ID NO: 87610

SEQ ID NO: 1550107 - protein, 27 aa, Mycobacterium tuberculosis
DTRPRHRIRFAARVCRRRRRPLDRLAR

SEQ ID NO: 1550108 - protein, 25 aa, Mycobacterium tuberculosis
DTSPRPLPSGTYCKIPQDAQLQVRG

SEQ ID NO: 1550109 - protein, 18 aa, Mycobacterium tuberculosis
DVAHPVYLLYGVERTEDL

SEQ ID NO: 1550110 - protein, 25 aa, Mycobacterium tuberculosis
DVDTFYTCLYRSLLHPNTFNDVDGR

SEQ ID NO: 1550111 - protein, 19 aa, Mycobacterium tuberculosis
DVGGFDCDFFGLTEREATA

SEQ ID NO: 1550112 - protein, 22 aa, Mycobacterium tuberculosis
DVKTVPTTVWIASDGSSHLVQI

SEQ ID NO: 1550113 - protein, 20 aa, Mycobacterium tuberculosis
DVLECLAGLASDAGTHHAAA

SEQ ID NO: 1550114 - protein, 22 aa, Mycobacterium tuberculosis
DVMPARGVGVIELRGESLTPGY

SEQ ID NO: 1550115 - protein, 25 aa, Mycobacterium tuberculosis
DVNIPIHIPITASFTDIVYSGLDLP

SEQ ID NO: 1550116 - protein, 21 aa, Mycobacterium tuberculosis
DVPVELAALIGRDDDRRTETI

SEQ ID NO: 1550117 - protein, 24 aa, Mycobacterium tuberculosis
DVRANRLPKVSWLVPNILQSEHPA

SEQ ID NO: 1550118 - protein, 18 aa, Mycobacterium tuberculosis
DVRQICCRRCDQLRHHDE

SEQ ID NO: 1550119 - protein, 20 aa, Mycobacterium tuberculosis
DVRTARIVTPRVMQFTLRAN

SEQ ID NO: 1550120 - protein, 23 aa, Mycobacterium tuberculosis
DVTEQFGTPGWIISQGPQVLLDA

SEQ ID NO: 1550121 - protein, 28 aa, Mycobacterium tuberculosis
DVVIARGLSQRGVPFSWAGGGISGPTRG

SEQ ID NO: 1550122 - protein, 28 aa, Mycobacterium tuberculosis
DWAARARWANPAAWRLPGDDVTALRGTA

SEQ ID NO: 1550123 - protein, 26 aa, Mycobacterium tuberculosis
DWRRRGVCGCRGRQRLGGAEHRPAAA

SEQ ID NO: 1550124 - protein, 17 aa, Mycobacterium tuberculosis
DYADAFEPYFSVPATGI

SEQ ID NO: 1550125 - protein, 20 aa, Mycobacterium tuberculosis
DYFIRMWNQAALAMEVYQAE

SEQ ID NO: 1550126 - protein, 38 aa, Mycobacterium tuberculosis; identical to SEQ ID NO: 233339

SEQ ID NO: 1550127 - protein, 25 aa, Mycobacterium tuberculosis
EAAELGEYFAGMGLLGVDHGRGWPP

SEQ ID NO: 1550128 - protein, 20 aa, Mycobacterium tuberculosis
EAEGGMGPHGLMIGMTGSGK

SEQ ID NO: 1550129 - protein, 25 aa, Mycobacterium tuberculosis
EAGGAGGSGGWLLGTGGVGGVGGLG

SEQ ID NO: 1550130 - protein, 25 aa, Mycobacterium tuberculosis
EAHYGEMWAQDALAMYGYAASSAAA

SEQ ID NO: 1550131 - protein, 17 aa, Mycobacterium tuberculosis
EAKAVDVLARIMGSSYQ

SEQ ID NO: 1550132 - protein, 18 aa, Mycobacterium tuberculosis
EALVAVASDLAGIGSALA

SEQ ID NO: 1550133 - protein, 19 aa, Mycobacterium tuberculosis
EALVAVASDLAGIGSALAE

SEQ ID NO: 1550134 - protein, 26 aa, Mycobacterium tuberculosis
EALVAVASDLAGIGSALAEANAAALA

SEQ ID NO: 1550135 - protein, 26 aa, Mycobacterium tuberculosis
EALYAEMWAQDALAMYGYAAASGAAG

SEQ ID NO: 1550136 - protein, 26 aa, Mycobacterium tuberculosis
EAQLDRFAIRLELRYLSERDETSMLR

SEQ ID NO: 1550137 - protein, 20 aa, Mycobacterium tuberculosis
EAQRCRCRGIDLRLVSHQPI

SEQ ID NO: 1550138 - protein, 25 aa, Mycobacterium tuberculosis
EATLVGRLSVPAAWSTAAPATTAGA

SEQ ID NO: 1550139 - protein, 29 aa, Mycobacterium tuberculosis
EATREAYRIGGDWVQYRSYPGIGTKQPRD

SEQ ID NO: 1550140 - protein, 23 aa, Mycobacterium tuberculosis
EAVARLRRAGAIIMGKTNMPTGN

SEQ ID NO: 1550141 - protein, 17 aa, Mycobacterium tuberculosis
EAVEMFCYRAQRVRPDF

SEQ ID NO: 1550142 - protein, 26 aa, Mycobacterium tuberculosis
EAVLPSAFFFEIAQWADGDGEPVAMQ

SEQ ID NO: 1550143 - protein, 24 aa, Mycobacterium tuberculosis
ECAGIPTDQRAGGRVSRAVCRGPN

SEQ ID NO: 1550144 - protein, 19 aa, Mycobacterium tuberculosis
ECLHKAAPIVGLPAATRTT

SEQ ID NO: 1550145 - protein, 23 aa, Mycobacterium tuberculosis
EDVKTVPTTVWIASDGSSHSVQI

SEQ ID NO: 1550146 - protein, 28 aa, Mycobacterium tuberculosis
EEVTVIVAPMFHAWGFSQLVLASSLACT

SEQ ID NO: 1550147 - protein, 23 aa, Mycobacterium tuberculosis
EEYLRELTIWSGRYGSVAGVPAR

SEQ ID NO: 1550148 - protein, 22 aa, Mycobacterium tuberculosis
EFGRLPEPLAMLSPDEGLLTAG

SEQ ID NO: 1550149 - protein, 19 aa, Mycobacterium tuberculosis
EFQPRAGSMAATLPYCDLF

SEQ ID NO: 1550150 - protein, 20 aa, Mycobacterium tuberculosis
EFSARVFKAEKGVVTLGGNT

SEQ ID NO: 1550151 - protein, 21 aa, Mycobacterium tuberculosis
EFVTAAAGDLTNLGSSISAAN

SEQ ID NO: 1550152 - protein, 19 aa, Mycobacterium tuberculosis
EGAAAYGVLVTRPDGTRVE

SEQ ID NO: 1550153 - protein, 23 aa, Mycobacterium tuberculosis
EGELRPQLLDRFGLTVDVQASRD

SEQ ID NO: 1550154 - protein, 21 aa, Mycobacterium tuberculosis
EGGGAGFGSGVAGAAGAGGNG

SEQ ID NO: 1550155 - protein, 27 aa, Mycobacterium tuberculosis
EGGLMPGFGGAPWVGGHWGLGGEGHSG

SEQ ID NO: 1550156 - protein, 28 aa, Mycobacterium tuberculosis
EGGLMPGFGGAPWVGGHWGLGGEGHSGA

SEQ ID NO: 1550157 - protein, 23 aa, Mycobacterium tuberculosis
EGLQVKTIWVARAVSVLFPQITN

SEQ ID NO: 1550158 - protein, 20 aa, Mycobacterium tuberculosis
EGRHGPFFPQCGGVSDQRAL

SEQ ID NO: 1550159 - protein, 21 aa, Mycobacterium tuberculosis
EGRPTQLPYLPLQVPQQLSLP

SEQ ID NO: 1550160 - protein, 18 aa, Mycobacterium tuberculosis
EGWAERVRLAHALGPTMI

SEQ ID NO: 1550161 - protein, 25 aa, Mycobacterium tuberculosis
EHLSALRAIPRLSVVRPADANETAY

SEQ ID NO: 1550162 - protein, 19 aa, Mycobacterium tuberculosis
EIDGYRVLTDPVWSDRCSP

SEQ ID NO: 1550163 - protein, 20 aa, Mycobacterium tuberculosis
EIPGAWRLPLSGDEADADIA

SEQ ID NO: 1550164 - protein, 20 aa, Mycobacterium tuberculosis
EITEVLEWLSPLPGGSVVSV

SEQ ID NO: 1550165 - protein, 17 aa, Mycobacterium tuberculosis
EKKTFAIAARFADHLNI

SEQ ID NO: 1550166 - protein, 17 aa, Mycobacterium tuberculosis
ELAPLLRHPLDLELDSI

SEQ ID NO: 1550167 - protein, 18 aa, Mycobacterium tuberculosis
ELDARAAVEQHLLEVLGA

SEQ ID NO: 1550168 - protein, 17 aa, Mycobacterium tuberculosis
ELDRRQKIVNGRPDLET

SEQ ID NO: 1550169 - protein, 18 aa, Mycobacterium tuberculosis
ELLPADWPGAGLRAAYHD

SEQ ID NO: 1550170 - protein, 23 aa, Mycobacterium tuberculosis
ELLQRPGQRLAYNGRLLELPDIK

SEQ ID NO: 1550171 - protein, 24 aa, Mycobacterium tuberculosis
ELQHLDIGNALALGNVGGVNLGLA

SEQ ID NO: 1550172 - protein, 20 aa, Mycobacterium tuberculosis
ELRVPIGVTGTGEPLMFDLK

SEQ ID NO: 1550173 - protein, 24 aa, Mycobacterium tuberculosis
ELSENLPGYIFSGVAPVVTEMLWD

SEQ ID NO: 1550174 - protein, 24 aa, Mycobacterium tuberculosis
ELTARLNSLGEAWTGGGSDKALAA

SEQ ID NO: 1550175 - protein, 17 aa, Mycobacterium tuberculosis
ELTGLALQRIYLDRVAK

SEQ ID NO: 1550176 - protein, 18 aa, Mycobacterium tuberculosis
ELTGLALQRIYLDRVAKL

SEQ ID NO: 1550177 - protein, 26 aa, Mycobacterium tuberculosis
ELVIPVCTRLGLSPPDVRTLSKLVRH

SEQ ID NO: 1550178 - protein, 17 aa, Mycobacterium tuberculosis
ELVVAAAADLAGIGSAI

SEQ ID NO: 1550179 - protein, 21 aa, Mycobacterium tuberculosis
EMLAAAATDLAGIRSAISAAT

SEQ ID NO: 1550180 - protein, 20 aa, Mycobacterium tuberculosis
EMRPTEAAFWGRPVDPENGR

SEQ ID NO: 1550181 - protein, 18 aa, Mycobacterium tuberculosis
ENLREHRRGLLVDLVTNV

SEQ ID NO: 1550182 - protein, 27 aa, Mycobacterium tuberculosis
ENPDGQNGGLLFGNGGNGFTQTTAGVA

SEQ ID NO: 1550183 - protein, 24 aa, Mycobacterium tuberculosis
ENRPDCIYLGAAGHVLGTGHTLRK

SEQ ID NO: 1550184 - protein, 19 aa, Mycobacterium tuberculosis
EPAGFRRKPTGGTRAVPAG

SEQ ID NO: 1550185 - protein, 17 aa, Mycobacterium tuberculosis
EPIHILPDIPININETL

SEQ ID NO: 1550186 - protein, 17 aa, Mycobacterium tuberculosis
EPNHTVWAQAPGANNGS

SEQ ID NO: 1550187 - protein, 17 aa, Mycobacterium tuberculosis
EPPMFEMDTTGLASGNC

SEQ ID NO: 1550188 - protein, 22 aa, Mycobacterium tuberculosis
EPPNRMRIGLMGIVVALLVVAV

SEQ ID NO: 1550189 - protein, 23 aa, Mycobacterium tuberculosis
EPPNRMRIGLMGIVVALLVVAVG

SEQ ID NO: 1550190 - protein, 24 aa, Mycobacterium tuberculosis
EPRFPSRDLLGIALLSNADPAAPT

SEQ ID NO: 1550191 - protein, 21 aa, Mycobacterium tuberculosis
EPSRLAELMQRAFTELQTEAG

SEQ ID NO: 1550192 - protein, 17 aa, Mycobacterium tuberculosis
EPVSTGWREWSLRCAAL

SEQ ID NO: 1550193 - protein, 17 aa, Mycobacterium tuberculosis
EQFVHAMTAGAGAYAGA

SEQ ID NO: 1550194 - protein, 37 aa, Mycobacterium tuberculosis
EQFVQALTAAAGRYASTEAAVERSLLGAVNAPTEALL

SEQ ID NO: 1550195 - protein, 31 aa, Mycobacterium tuberculosis
EQLMPHWMLSCGPSTCARGGTVSEVILTATN

SEQ ID NO: 1550196 - protein, 17 aa, Mycobacterium tuberculosis
EQPRLFYMHFWAENDAV

SEQ ID NO: 1550197 - protein, 20 aa, Mycobacterium tuberculosis
EQYLWWVPHNVAGLVTALGG

SEQ ID NO: 1550198 - protein, 22 aa, Mycobacterium tuberculosis
ERARTAIDAALARVWHHPGGSR

SEQ ID NO: 1550199 - protein, 18 aa, Mycobacterium tuberculosis
ERDGRLAAKLVLDVNPRY

SEQ ID NO: 1550200 - protein, 19 aa, Mycobacterium tuberculosis
ERIGRCSRLARQIHRGPDR

SEQ ID NO: 1550201 - protein, 24 aa, Mycobacterium tuberculosis
ERPGRGAVVGVDWRTPLTDAAARV

SEQ ID NO: 1550202 - protein, 17 aa, Mycobacterium tuberculosis
ERQGWHALVTMRLDGDV

SEQ ID NO: 1550203 - protein, 17 aa, Mycobacterium tuberculosis
ERRAWIEVRGLRSGGDD

SEQ ID NO: 1550204 - protein, 20 aa, Mycobacterium tuberculosis
ERRYDARLGVYVPATGTTAA

SEQ ID NO: 1550205 - protein, 25 aa, Mycobacterium tuberculosis
ESAAAFQGAHARFVAAAAKVNTLLD

SEQ ID NO: 1550206 - protein, 26 aa, Mycobacterium tuberculosis
ESAAAFQGAHARFVAAAAKVNTLLDI

SEQ ID NO: 1550207 - protein, 31 aa, Mycobacterium tuberculosis
ESEWPRPRPDLRPPSRLRSVRALAGSARHRA

SEQ ID NO: 1550208 - protein, 19 aa, Mycobacterium tuberculosis
ESFLGGAYHPVFAAGPAAD

SEQ ID NO: 1550209 - protein, 29 aa, Mycobacterium tuberculosis
ESLPLASIFKLYVLHALGRCGSSTTRVSW

SEQ ID NO: 1550210 - protein, 19 aa, Mycobacterium tuberculosis
ESPDAYDLELMWDANDDNQ

SEQ ID NO: 1550211 - protein, 19 aa, Mycobacterium tuberculosis
ESRLNRLLAQQIPPARKVL

SEQ ID NO: 1550212 - protein, 18 aa, Mycobacterium tuberculosis
ETAYAWRTILARRNGSGP

SEQ ID NO: 1550213 - protein, 20 aa, Mycobacterium tuberculosis
ETDQAFGWVALEFGVHRYGL

SEQ ID NO: 1550214 - protein, 18 aa, Mycobacterium tuberculosis
ETSMLRRRLERGSADPTV

SEQ ID NO: 1550215 - protein, 29 aa, Mycobacterium tuberculosis
EVAAGIAGLIKTILCLKNKALPATLHYTS

SEQ ID NO: 1550216 - protein, 20 aa, Mycobacterium tuberculosis
EVGAELNCEMKIKDRTFNVN

SEQ ID NO: 1550217 - protein, 20 aa, Mycobacterium tuberculosis
EVIAAAATDLASLGSSISAA

SEQ ID NO: 1550218 - protein, 22 aa, Mycobacterium tuberculosis
EVLSFLSVSSVDYWAYRPALQQ

SEQ ID NO: 1550219 - protein, 19 aa, Mycobacterium tuberculosis
EVRDIRFEQMLLLDDETPI

SEQ ID NO: 1550220 - protein, 23 aa, Mycobacterium tuberculosis
EVSAAIASLFSGYARDYQALSAQ

SEQ ID NO: 1550221 - protein, 21 aa, Mycobacterium tuberculosis
EVSAGIAALFSAHAQEYQALS

SEQ ID NO: 1550222 - protein, 22 aa, Mycobacterium tuberculosis
EVTALNFMPGWLDMLLEVGGGR

SEQ ID NO: 1550223 - protein, 19 aa, Mycobacterium tuberculosis
EYELMWAADVAAMAGYHSG

SEQ ID NO: 1550224 - protein, 20 aa, Mycobacterium tuberculosis
EYELMWAADVAAMAGYHSGA

SEQ ID NO: 1550225 - protein, 23 aa, Mycobacterium tuberculosis
EYLDMFYNLGIAGRAMRRIGAVE

SEQ ID NO: 1550226 - protein, 18 aa, Mycobacterium tuberculosis
EYPMDFGALPPEINSARM

SEQ ID NO: 1550227 - protein, 18 aa, Mycobacterium tuberculosis
EYYQACHAARLWMDAQPG

SEQ ID NO: 1550228 - protein, 17 aa, Mycobacterium tuberculosis
FAALIVDPMLARSEAAI

SEQ ID NO: 1550229 - protein, 23 aa, Mycobacterium tuberculosis
FAALRAGQLVAAWTTTADPDIPA

SEQ ID NO: 1550230 - protein, 17 aa, Mycobacterium tuberculosis
FADELDVVLAAPSRILV

SEQ ID NO: 1550231 - protein, 25 aa, Mycobacterium tuberculosis
FADLTRPGLNVVVCQPSVPCGSATR

SEQ ID NO: 1550232 - protein, 24 aa, Mycobacterium tuberculosis
FAGGYAVAACKTVTLTVDGTAMRV

SEQ ID NO: 1550233 - protein, 18 aa, Mycobacterium tuberculosis
FAGLAGLANRIVDAVDSL

SEQ ID NO: 1550234 - protein, 24 aa, Mycobacterium tuberculosis
FAIAARFADHLNIVAAVDELPRKM

SEQ ID NO: 1550235 - protein, 21 aa, Mycobacterium tuberculosis
FAKLLFTNPVKAFQFLVDLIL

SEQ ID NO: 1550236 - protein, 22 aa, Mycobacterium tuberculosis
FAMKFSQPFSSYGTWDGYAVYP

SEQ ID NO: 1550237 - protein, 29 aa, Mycobacterium tuberculosis
FAQPYPAWRELFTDILPAHIVKDIPGGFA

SEQ ID NO: 1550238 - protein, 24 aa, Mycobacterium tuberculosis
FATELRNLLARCAERGLDPLELQQ

SEQ ID NO: 1550239 - protein, 23 aa, Mycobacterium tuberculosis
FAVWLVGWAGGFGTAIAASEPAY

SEQ ID NO: 1550240 - protein, 18 aa, Mycobacterium tuberculosis
FCSTCDRTRLTADGQIRS

SEQ ID NO: 1550241 - protein, 18 aa, Mycobacterium tuberculosis
FDAATLGSPGADGGMGGN

SEQ ID NO: 1550242 - protein, 17 aa, Mycobacterium tuberculosis
FDASGLIQYAYAGAGLK

SEQ ID NO: 1550243 - protein, 17 aa, Mycobacterium tuberculosis
FDPAEAITHGYIDSQKL

SEQ ID NO: 1550244 - protein, 17 aa, Mycobacterium tuberculosis
FDPEATLDLIDRHHATG

SEQ ID NO: 1550245 - protein, 29 aa, Mycobacterium tuberculosis
FDPKTAVLNWKGDQVIVFVELSGSGARYG

SEQ ID NO: 1550246 - protein, 24 aa, Mycobacterium tuberculosis
FEHRCPGCGEPVIWQLVDEDAPLR

SEQ ID NO: 1550247 - protein, 25 aa, Mycobacterium tuberculosis
FEPWSVADFSRYLSTLGLPAAGDAV

SEQ ID NO: 1550248 - protein, 17 aa, Mycobacterium tuberculosis
FERIFGRPLIGDGANGG

SEQ ID NO: 1550249 - protein, 17 aa, Mycobacterium tuberculosis
FFVKTLVAMLDWGLNPQ

SEQ ID NO: 1550250 - protein, 17 aa, Mycobacterium tuberculosis
FGAGRERGSGGSGNLTG

SEQ ID NO: 1550251 - protein, 18 aa, Mycobacterium tuberculosis
FGDPFPAPTQGITIHTGP

SEQ ID NO: 1550252 - protein, 41 aa, Mycobacterium tuberculosis; identical to SEQ ID NO: 210784

SEQ ID NO: 1550253 - protein, 23 aa, Mycobacterium tuberculosis
FGFAAAAHRVVRVWPLRPDDRRK

SEQ ID NO: 1550254 - protein, 24 aa, Mycobacterium tuberculosis
FGFEQVCATPAFPHDSRDWAVAGR

SEQ ID NO: 1550255 - protein, 23 aa, Mycobacterium tuberculosis
FGGPAVDSRWVWVLDPIDGTINY

SEQ ID NO: 1550256 - protein, 22 aa, Mycobacterium tuberculosis
FGGPKCLVKVIQKLSGLSINRF

SEQ ID NO: 1550257 - protein, 28 aa, Mycobacterium tuberculosis
FGITGDHQMGFGGFNSGSGNIGFGNSGT

SEQ ID NO: 1550258 - protein, 18 aa, Mycobacterium tuberculosis
FGLARARSAEGDRVGAVR

SEQ ID NO: 1550259 - protein, 23 aa, Mycobacterium tuberculosis
FGNFGGANSGFWNLASATSGASG

SEQ ID NO: 1550260 - protein, 24 aa, Mycobacterium tuberculosis
FGNFGGGASGFWNLASATSGLSGF

SEQ ID NO: 1550261 - protein, 17 aa, Mycobacterium tuberculosis
FGNGGFGGAGGLGAAGG

SEQ ID NO: 1550262 - protein, 25 aa, Mycobacterium tuberculosis
FGNGGVRRVRRGPALPAVSADPAGG

SEQ ID NO: 1550263 - protein, 17 aa, Mycobacterium tuberculosis
FGQMRFDRTNGYTAEFS

SEQ ID NO: 1550264 - protein, 26 aa, Mycobacterium tuberculosis
FGQVTSGLTAGVWPGAAAAAMAAAAA

SEQ ID NO: 1550265 - protein, 24 aa, Mycobacterium tuberculosis
FGQVTSGLTAGVWQGAAAAAMAPA

SEQ ID NO: 1550266 - protein, 32 aa, Mycobacterium tuberculosis
FGTHAQEYQALSARVATFHEQFVRSLTAAGSA

SEQ ID NO: 1550267 - protein, 18 aa, Mycobacterium tuberculosis
FGYPYAIAPPGIGFGSGM

SEQ ID NO: 1550268 - protein, 18 aa, Mycobacterium tuberculosis
FHDQFVRALAAGAGAYAG

SEQ ID NO: 1550269 - protein, 19 aa, Mycobacterium tuberculosis
FHEQFVHAMTAGAGAYAGA

SEQ ID NO: 1550270 - protein, 17 aa, Mycobacterium tuberculosis
FHPDRFGFAGSMSGFLY

SEQ ID NO: 1550271 - protein, 18 aa, Mycobacterium tuberculosis
FHTASSRLALWCVAVAGL

SEQ ID NO: 1550272 - protein, 23 aa, Mycobacterium tuberculosis
FIAPSRFHVVPVLAYSPDPGPVA

SEQ ID NO: 1550273 - protein, 17 aa, Mycobacterium tuberculosis
FIAYRYALATGIIDETG

SEQ ID NO: 1550274 - protein, 29 aa, Mycobacterium tuberculosis
FIPPPTVFRCGWCRWTRRGRSTTPAVTDR

SEQ ID NO: 1550275 - protein, 18 aa, Mycobacterium tuberculosis
FIRMWNQAALAMEVYQAE

SEQ ID NO: 1550276 - protein, 33 aa, Mycobacterium tuberculosis; identical to SEQ ID NO: 199186

SEQ ID NO: 1550277 - protein, 19 aa, Mycobacterium tuberculosis
FKAKPGQRIRIRIINSAAD

SEQ ID NO: 1550278 - protein, 18 aa, Mycobacterium tuberculosis
FKKRGISPEDFWRSAGLP

SEQ ID NO: 1550279 - protein, 23 aa, Mycobacterium tuberculosis
FKTLKYRPDFPKRFESIEAARVH

SEQ ID NO: 1550280 - protein, 19 aa, Mycobacterium tuberculosis
FLDRGLRDTGRCRVPLILR

SEQ ID NO: 1550281 - protein, 30 aa, Mycobacterium tuberculosis; identical to SEQ ID NO: 199219

SEQ ID NO: 1550282 - protein, 18 aa, Mycobacterium tuberculosis
FLFSREIGSESKVLIHRD

SEQ ID NO: 1550283 - protein, 25 aa, Mycobacterium tuberculosis
FLGRYCTGYERFERYLLGLDDGIPK

SEQ ID NO: 1550284 - protein, 17 aa, Mycobacterium tuberculosis
FLISACGILTVPKLPDI

SEQ ID NO: 1550285 - protein, 19 aa, Mycobacterium tuberculosis
FLLNQMLVWGFTGQVISAV

SEQ ID NO: 1550286 - protein, 17 aa, Mycobacterium tuberculosis
FLSGGFLAPPGRAPVLV

SEQ ID NO: 1550287 - protein, 28 aa, Mycobacterium tuberculosis
FNFTAWAVGWLPYIGILAPQINFFYYLG

SEQ ID NO: 1550288 - protein, 20 aa, Mycobacterium tuberculosis
FNGRHYAVPYARSTPLFYYN

SEQ ID NO: 1550289 - protein, 25 aa, Mycobacterium tuberculosis
FNQGTRVSAYFADAGGLRIGNTVEV

SEQ ID NO: 1550290 - protein, 23 aa, Mycobacterium tuberculosis
FNVNLKLQFLHDAFPNEFPDPTI

SEQ ID NO: 1550291 - protein, 22 aa, Mycobacterium tuberculosis
FNVRGARNIPCETVPGKRAPTV

SEQ ID NO: 1550292 - protein, 20 aa, Mycobacterium tuberculosis
FPELTAYQVINRIVQPATAF

SEQ ID NO: 1550293 - protein, 17 aa, Mycobacterium tuberculosis
FPVGPFFGLGVVNISGI

SEQ ID NO: 1550294 - protein, 23 aa, Mycobacterium tuberculosis
FQRPEILVRNWAASATHVRAVFR

SEQ ID NO: 1550295 - protein, 18 aa, Mycobacterium tuberculosis
FRAFSYGSLYPALRRMQA

SEQ ID NO: 1550296 - protein, 17 aa, Mycobacterium tuberculosis
FRGGEPTGLLADDPPPA

SEQ ID NO: 1550297 - protein, 18 aa, Mycobacterium tuberculosis
FRGNRVAVWGAWSGVSGG

SEQ ID NO: 1550298 - protein, 19 aa, Mycobacterium tuberculosis
FRGPPSWNVGYKSIRSHNV

SEQ ID NO: 1550299 - protein, 17 aa, Mycobacterium tuberculosis
FRLASAMVGYNREFLSA

SEQ ID NO: 1550300 - protein, 18 aa, Mycobacterium tuberculosis
FRPMHDRLASAVVAEAHR

SEQ ID NO: 1550301 - protein, 17 aa, Mycobacterium tuberculosis
FRTLPVVRYDNIDGQDV

SEQ ID NO: 1550302 - protein, 18 aa, Mycobacterium tuberculosis
FRVAVWAEDPHCPIDADV

SEQ ID NO: 1550303 - protein, 25 aa, Mycobacterium tuberculosis
FRYPRNGWPALFHVRSGASLAGNYA

SEQ ID NO: 1550304 - protein, 17 aa, Mycobacterium tuberculosis
FSAADKPVIFWTPDHGA

SEQ ID NO: 1550305 - protein, 17 aa, Mycobacterium tuberculosis
FSGYARDYQALSAQMAR

SEQ ID NO: 1550306 - protein, 24 aa, Mycobacterium tuberculosis
FSIPEQPLPLAINVIGHINALSTP

SEQ ID NO: 1550307 - protein, 19 aa, Mycobacterium tuberculosis
FSNVSGLRQGQFVRASGVE

SEQ ID NO: 1550308 - protein, 18 aa, Mycobacterium tuberculosis
FSPLRRRATAALAVAGER

SEQ ID NO: 1550309 - protein, 20 aa, Mycobacterium tuberculosis
FSRRGFLGAGIASGFALAAC

SEQ ID NO: 1550310 - protein, 28 aa, Mycobacterium tuberculosis
FTDGLPPRLWRNFLAKPPLPALFGKTTN

SEQ ID NO: 1550311 - protein, 23 aa, Mycobacterium tuberculosis
FTGAFGPVVVPPIPVLAINAHLT

SEQ ID NO: 1550312 - protein, 23 aa, Mycobacterium tuberculosis
FTGAFGPVVVPPIPVPAINAHLT

SEQ ID NO: 1550313 - protein, 17 aa, Mycobacterium tuberculosis
FTGVPGYNHIKIKEAYG

SEQ ID NO: 1550314 - protein, 19 aa, Mycobacterium tuberculosis
FTIPAQTPVTVGMEVANDG

SEQ ID NO: 1550315 - protein, 21 aa, Mycobacterium tuberculosis
FTIPIIGFESFAFSFHIHTEP

SEQ ID NO: 1550316 - protein, 17 aa, Mycobacterium tuberculosis
FTKRGISPEDFWRSAGL

SEQ ID NO: 1550317 - protein, 19 aa, Mycobacterium tuberculosis
FTSHGLRLGVEASLRSLAR

SEQ ID NO: 1550318 - protein, 22 aa, Mycobacterium tuberculosis
FTVITGIVYPLAVTGVGQLFFG

SEQ ID NO: 1550319 - protein, 21 aa, Mycobacterium tuberculosis
FVIAANRSRLVSLALSNLFGQ

SEQ ID NO: 1550320 - protein, 19 aa, Mycobacterium tuberculosis
FVIVDECHYYRGVFGSNVA

SEQ ID NO: 1550321 - protein, 23 aa, Mycobacterium tuberculosis
FVQALNMGAVCYAAAETANATPL

SEQ ID NO: 1550322 - protein, 24 aa, Mycobacterium tuberculosis
FVQALTAAAGRYASTEAAVERSLL

SEQ ID NO: 1550323 - protein, 18 aa, Mycobacterium tuberculosis
FYAQCAIDAGVAFVNALP

SEQ ID NO: 1550324 - protein, 30 aa, Mycobacterium tuberculosis
GAAGGFGGNGGWLYGNWGSDGILGAGLLNR

SEQ ID NO: 1550325 - protein, 17 aa, Mycobacterium tuberculosis
GAAGKAGGGGNGGRGGD

SEQ ID NO: 1550326 - protein, 17 aa, Mycobacterium tuberculosis
GAAGLWGSGGSGGQGGN

SEQ ID NO: 1550327 - protein, 22 aa, Mycobacterium tuberculosis
GAAGQLFSAGGAAGAVGVGGTG

SEQ ID NO: 1550328 - protein, 23 aa, Mycobacterium tuberculosis
GAAGQLFSAGGAAGAVGVGGTGG

SEQ ID NO: 1550329 - protein, 22 aa, Mycobacterium tuberculosis
GAAQLPLAPAINYPPPCLTGFL

SEQ ID NO: 1550330 - protein, 17 aa, Mycobacterium tuberculosis
GAAVCQSAPCGRVGEIF

SEQ ID NO: 1550331 - protein, 17 aa, Mycobacterium tuberculosis
GAAVGLFGHGGAGGAGG

SEQ ID NO: 1550332 - protein, 18 aa, Mycobacterium tuberculosis
GAAWLIVDVRDVVALHAA

SEQ ID NO: 1550333 - protein, 19 aa, Mycobacterium tuberculosis
GACPDVEVVFARGTGEPPG

SEQ ID NO: 1550334 - protein, 17 aa, Mycobacterium tuberculosis
GADESLRCETPEYDRGV

SEQ ID NO: 1550335 - protein, 25 aa, Mycobacterium tuberculosis
GADEVSAAIAALFGAHGQAYQTVSA

SEQ ID NO: 1550336 - protein, 28 aa, Mycobacterium tuberculosis
GADEVSAALASLFSGHAVSYQQVAAQAT

SEQ ID NO: 1550337 - protein, 29 aa, Mycobacterium tuberculosis
GADEVSAALASLFSGHAVSYQQVAAQATA

SEQ ID NO: 1550338 - protein, 24 aa, Mycobacterium tuberculosis
GADEVSAAVAAVFSSYAQQYQALS

SEQ ID NO: 1550339 - protein, 29 aa, Mycobacterium tuberculosis
GADEVSARIAALFGGFGLEYQAISAQVAA

SEQ ID NO: 1550340 - protein, 25 aa, Mycobacterium tuberculosis
GADEVSTAVAALFGAHGQAYQALSA

SEQ ID NO: 1550341 - protein, 26 aa, Mycobacterium tuberculosis
GADEVSTAVAALFGAHGQAYQALSAQ

SEQ ID NO: 1550342 - protein, 25 aa, Mycobacterium tuberculosis
GADEVSVLIAALFEAYAQEYQALSA

SEQ ID NO: 1550343 - protein, 26 aa, Mycobacterium tuberculosis
GADEVSVLIAALFEAYAQEYQALSAQ

SEQ ID NO: 1550344 - protein, 19 aa, Mycobacterium tuberculosis
GAFEAARAAMVDPVVVAAN

SEQ ID NO: 1550345 - protein, 19 aa, Mycobacterium tuberculosis
GAFRPGGRPAHPGSGDQRA

SEQ ID NO: 1550346 - protein, 23 aa, Mycobacterium tuberculosis
GAGAAAFLMDWAAPVIEKAYGAG

SEQ ID NO: 1550347 - protein, 18 aa, Mycobacterium tuberculosis
GAGADAPASTGLTGGTGF

SEQ ID NO: 1550348 - protein, 25 aa, Mycobacterium tuberculosis
GAGAGMPAGMMGRGGANPHVVQARP

SEQ ID NO: 1550349 - protein, 17 aa, Mycobacterium tuberculosis
GAGCVDRSAADVAAVAA

SEQ ID NO: 1550350 - protein, 17 aa, Mycobacterium tuberculosis
GAGDFASGVGGVGGAGG

SEQ ID NO: 1550351 - protein, 18 aa, Mycobacterium tuberculosis
GAGDPSFAVNNGAGGNGG

SEQ ID NO: 1550352 - protein, 18 aa, Mycobacterium tuberculosis
GAGEMRPTEAAFWGRPVD

SEQ ID NO: 1550353 - protein, 19 aa, Mycobacterium tuberculosis
GAGGAAFSINFTAGDGGAG

SEQ ID NO: 1550354 - protein, 23 aa, Mycobacterium tuberculosis
GAGGAGGFGAVLFGNGGAGGSGA

SEQ ID NO: 1550355 - protein, 25 aa, Mycobacterium tuberculosis
GAGGAGGRGGWLVGNGGNGGNGAAG

SEQ ID NO: 1550356 - protein, 25 aa, Mycobacterium tuberculosis
GAGGAGGRGGWLVGNGGNGGNGGNG

SEQ ID NO: 1550357 - protein, 21 aa, Mycobacterium tuberculosis
GAGGAGGWLYGDGGDGGAGGI

SEQ ID NO: 1550358 - protein, 24 aa, Mycobacterium tuberculosis
GAGGDGGGALGVLGGMGGDGGDGG

SEQ ID NO: 1550359 - protein, 37 aa, Mycobacterium tuberculosis
GAGGLIWGTAGDRWQRRGSPPFLMPLGGAGGGGDRRV

SEQ ID NO: 1550360 - protein, 20 aa, Mycobacterium tuberculosis
GAGGNGFDAATLGSPGADGG

SEQ ID NO: 1550361 - protein, 25 aa, Mycobacterium tuberculosis
GAGGNGGRGGMLIGNGGAGGAGGTG

SEQ ID NO: 1550362 - protein, 25 aa, Mycobacterium tuberculosis
GAGGNGGTGDGFIGGSGGTGGTGGD

SEQ ID NO: 1550363 - protein, 23 aa, Mycobacterium tuberculosis
GAGGNGGWLYCIGGIGGAGLSLR

SEQ ID NO: 1550364 - protein, 17 aa, Mycobacterium tuberculosis
GAGGRAWLWGTGGAGGA

SEQ ID NO: 1550365 - protein, 18 aa, Mycobacterium tuberculosis
GAGGWLSGNGGAGGNGGT

SEQ ID NO: 1550366 - protein, 18 aa, Mycobacterium tuberculosis
GAGGYPQMLLRVGWAPIN

SEQ ID NO: 1550367 - protein, 20 aa, Mycobacterium tuberculosis
GAGLFYGFGGAGGNGGMGGV

SEQ ID NO: 1550368 - protein, 36 aa, Mycobacterium tuberculosis
GAGLSLRQDFAFRFHWLLRVGFADCVDSRQSANRRP

SEQ ID NO: 1550369 - protein, 25 aa, Mycobacterium tuberculosis
GAGPAPMLAAAAGWQTLSAALDAQA

SEQ ID NO: 1550370 - protein, 18 aa, Mycobacterium tuberculosis
GAGPIIVPSIQFPAIPLD

SEQ ID NO: 1550371 - protein, 25 aa, Mycobacterium tuberculosis
GAGQITGLRSGFGGAGGAGGASDTG

SEQ ID NO: 1550372 - protein, 29 aa, Mycobacterium tuberculosis
GAGRSAHGWANADLISWTFQGPNWAFGGA

SEQ ID NO: 1550373 - protein, 30 aa, Mycobacterium tuberculosis
GAGTVGFDCSGLVLSLVCWGGHQAAALLGF

SEQ ID NO: 1550374 - protein, 25 aa, Mycobacterium tuberculosis
GAIGAGRTLHGWNGALAAGPTLAGN

SEQ ID NO: 1550375 - protein, 17 aa, Mycobacterium tuberculosis
GALLAGWAALAAGESGA

SEQ ID NO: 1550376 - protein, 19 aa, Mycobacterium tuberculosis
GALLKRGYTAGQVRDRESG

SEQ ID NO: 1550377 - protein, 22 aa, Mycobacterium tuberculosis
GANGAPGGWLLGNGGAGGSAAA

SEQ ID NO: 1550378 - protein, 25 aa, Mycobacterium tuberculosis
GANGGAGGNAWLFGAGGSGGAGTNG

SEQ ID NO: 1550379 - protein, 22 aa, Mycobacterium tuberculosis
GANGGPGGWLIGNGGAGGSGAP

SEQ ID NO: 1550380 - protein, 17 aa, Mycobacterium tuberculosis
GAPPWYADVLLPDLGAA

SEQ ID NO: 1550381 - protein, 26 aa, Mycobacterium tuberculosis
GAPVPMLPGSWGPDLVGVAGDGGLVS

SEQ ID NO: 1550382 - protein, 17 aa, Mycobacterium tuberculosis
GARAALFHEQFVQALTG

SEQ ID NO: 1550383 - protein, 24 aa, Mycobacterium tuberculosis
GARSPRLRSPLALMGGDPRRPVPA

SEQ ID NO: 1550384 - protein, 24 aa, Mycobacterium tuberculosis
GARSPRLRSPLGLAGDREPLSGRV

SEQ ID NO: 1550385 - protein, 20 aa, Mycobacterium tuberculosis
GATPSFLGYHGYPASICASI

SEQ ID NO: 1550386 - protein, 18 aa, Mycobacterium tuberculosis
GAVGRALCLAIDPRSTHH

SEQ ID NO: 1550387 - protein, 22 aa, Mycobacterium tuberculosis
GAVSAWVELHARFGRLPFETLF

SEQ ID NO: 1550388 - protein, 18 aa, Mycobacterium tuberculosis
GAYPKRWPAVSQSQWPQC

SEQ ID NO: 1550389 - protein, 20 aa, Mycobacterium tuberculosis
GCSGGTRLATGFGNGNSVHT

SEQ ID NO: 1550390 - protein, 18 aa, Mycobacterium tuberculosis
GCYSVMAATVAPVARVVS

SEQ ID NO: 1550391 - protein, 24 aa, Mycobacterium tuberculosis
GDEVSAAIAALFGAHARAYQALSA

SEQ ID NO: 1550392 - protein, 28 aa, Mycobacterium tuberculosis
GDEVSAAIAALFGAHARAYQALSAQAAM

SEQ ID NO: 1550393 - protein, 24 aa, Mycobacterium tuberculosis
GDEVSAAIAALFGTHAQEYQALSA

SEQ ID NO: 1550394 - protein, 20 aa, Mycobacterium tuberculosis
GDGFALDFAGGKMFFTPATG

SEQ ID NO: 1550395 - protein, 22 aa, Mycobacterium tuberculosis
GDGGAGPLLIGNGGVGGLGGAG

SEQ ID NO: 1550396 - protein, 29 aa, Mycobacterium tuberculosis
GDGGNGANGNFAFGDGNGGHGGNGGNPGA

SEQ ID NO: 1550397 - protein, 28 aa, Mycobacterium tuberculosis
GDKEGGGGEGPPAPPPAPPPPTPNPPAP

SEQ ID NO: 1550398 - protein, 24 aa, Mycobacterium tuberculosis
GDLARYWHDGTLEFVGRADHRVKI

SEQ ID NO: 1550399 - protein, 18 aa, Mycobacterium tuberculosis
GDLYAAGAAVDFAVLYPT

SEQ ID NO: 1550400 - protein, 19 aa, Mycobacterium tuberculosis
GDNQIGFGALNSGSGNLGF

SEQ ID NO: 1550401 - protein, 25 aa, Mycobacterium tuberculosis
GDPDAAPGDSRRSRGPGGTAGPVDP

SEQ ID NO: 1550402 - protein, 30 aa, Mycobacterium tuberculosis
GDPSRRTSCLSGLGYPASTPVLGAQPIDID

SEQ ID NO: 1550403 - protein, 18 aa, Mycobacterium tuberculosis
GDRAEVLASLNKLGYTPG

SEQ ID NO: 1550404 - protein, 18 aa, Mycobacterium tuberculosis
GDRLYAFNTNDYRPTVIS

SEQ ID NO: 1550405 - protein, 17 aa, Mycobacterium tuberculosis
GDRVRIAGLGVGTVEGL

SEQ ID NO: 1550406 - protein, 22 aa, Mycobacterium tuberculosis
GDSRVLAGMNVNVWDVVDDVKG

SEQ ID NO: 1550407 - protein, 23 aa, Mycobacterium tuberculosis
GDSSSWKGWGHVRWFIEEVPAGA

SEQ ID NO: 1550408 - protein, 19 aa, Mycobacterium tuberculosis
GDTLKSYFDYQAGKYGTTV

SEQ ID NO: 1550409 - protein, 17 aa, Mycobacterium tuberculosis
GDTRTGPGGDRGAGLRS

SEQ ID NO: 1550410 - protein, 25 aa, Mycobacterium tuberculosis
GEAAAAAAFVHARASAAAAADPGPG

SEQ ID NO: 1550411 - protein, 23 aa, Mycobacterium tuberculosis
GEDLSWLWDVRFEHFEKTRVVAA

SEQ ID NO: 1550412 - protein, 17 aa, Mycobacterium tuberculosis
GEFRCRRSTGRWCGWRP

SEQ ID NO: 1550413 - protein, 22 aa, Mycobacterium tuberculosis
GEGGGAGFGSGVAGAAGAGGNG

SEQ ID NO: 1550414 - protein, 24 aa, Mycobacterium tuberculosis
GEKGSRWLCRNGGTGGPGERTPAH

SEQ ID NO: 1550415 - protein, 24 aa, Mycobacterium tuberculosis
GELKISIPGFEIPQIATTRFLLDV

SEQ ID NO: 1550416 - protein, 19 aa, Mycobacterium tuberculosis
GELRRPVVHADDLVAVSAK

SEQ ID NO: 1550417 - protein, 27 aa, Mycobacterium tuberculosis
GEPGLDWRWLVLWWKSHAPHIANNLMN

SEQ ID NO: 1550418 - protein, 25 aa, Mycobacterium tuberculosis
GEPGRPKTAALLFGNGGNGFTQTTA

SEQ ID NO: 1550419 - protein, 17 aa, Mycobacterium tuberculosis
GEQRWLADHVIAGVVLL

SEQ ID NO: 1550420 - protein, 19 aa, Mycobacterium tuberculosis
GERRAWIEVRGLRSGGDDE

SEQ ID NO: 1550421 - protein, 18 aa, Mycobacterium tuberculosis
GEYAELPYLFTDQYDLGM

SEQ ID NO: 1550422 - protein, 29 aa, Mycobacterium tuberculosis
GFDAFVGLVSRCLRFGSAVAGSYTVRILE

SEQ ID NO: 1550423 - protein, 26 aa, Mycobacterium tuberculosis
GFGLTSGLFPFHFTLNGGIGPISIPT

SEQ ID NO: 1550424 - protein, 42 aa, Mycobacterium tuberculosis; identical to SEQ ID NO: 233495

SEQ ID NO: 1550425 - protein, 18 aa, Mycobacterium tuberculosis
GFHPRKALARVDEAARTM

SEQ ID NO: 1550426 - protein, 26 aa, Mycobacterium tuberculosis
GFLVSGDYQGLIGLPLLGIPVTPGYF

SEQ ID NO: 1550427 - protein, 19 aa, Mycobacterium tuberculosis
GFNPGGINTGWFNTGHANT

SEQ ID NO: 1550428 - protein, 25 aa, Mycobacterium tuberculosis
GFPGFPEFPAIPGFPALPGLPSIPN

SEQ ID NO: 1550429 - protein, 18 aa, Mycobacterium tuberculosis
GFTVFPQGFTVDRIPVDL

SEQ ID NO: 1550430 - protein, 23 aa, Mycobacterium tuberculosis
GGAAGLLGVGGHGGAGGHGAEGV

SEQ ID NO: 1550431 - protein, 19 aa, Mycobacterium tuberculosis
GGAAGLWGTGGAGGAGGSS

SEQ ID NO: 1550432 - protein, 24 aa, Mycobacterium tuberculosis
GGAAGQLFSAGGAAGAVGVGGTGG

SEQ ID NO: 1550433 - protein, 17 aa, Mycobacterium tuberculosis
GGAAVQAKAVAGAFEAA

SEQ ID NO: 1550434 - protein, 24 aa, Mycobacterium tuberculosis
GGADALRYPARYLFVFLDHHGMLS

SEQ ID NO: 1550435 - protein, 27 aa, Mycobacterium tuberculosis
GGAGAGIANFLGFSVLHGGAGGAGGTA

SEQ ID NO: 1550436 - protein, 25 aa, Mycobacterium tuberculosis
GGAGGAGGLLFGNGGAGAAGAPGQA

SEQ ID NO: 1550437 - protein, 23 aa, Mycobacterium tuberculosis
GGAGGAGGWIHGHGGSGGVGGAG

SEQ ID NO: 1550438 - protein, 24 aa, Mycobacterium tuberculosis
GGAGGAGGWLFGVGGAGGVGGAGG

SEQ ID NO: 1550439 - protein, 23 aa, Mycobacterium tuberculosis
GGAGGAGGWLLGNGGAGGPGGPT

SEQ ID NO: 1550440 - protein, 23 aa, Mycobacterium tuberculosis
GGAGGAGGWLYGDAGAGGDGGVG

SEQ ID NO: 1550441 - protein, 18 aa, Mycobacterium tuberculosis
GGAGGFALATTASGGAGG

SEQ ID NO: 1550442 - protein, 21 aa, Mycobacterium tuberculosis
GGAGGKAGLLIGNGGAGGAGG

SEQ ID NO: 1550443 - protein, 19 aa, Mycobacterium tuberculosis
GGAGGLFGAGRERGSGGSG

SEQ ID NO: 1550444 - protein, 20 aa, Mycobacterium tuberculosis
GGAGGLIWGTAGTGATRLGI

SEQ ID NO: 1550445 - protein, 23 aa, Mycobacterium tuberculosis
GGAGGNAGMLFGAAGVGGVGGFS

SEQ ID NO: 1550446 - protein, 27 aa, Mycobacterium tuberculosis
GGAGGNARLWGVGGAGGAGGDGGAGGA

SEQ ID NO: 1550447 - protein, 22 aa, Mycobacterium tuberculosis
GGAGGNGGWLWGNGGNGGVGGT

SEQ ID NO: 1550448 - protein, 24 aa, Mycobacterium tuberculosis
GGAGGRAELLFGAGGAGGAGTDGG

SEQ ID NO: 1550449 - protein, 21 aa, Mycobacterium tuberculosis
GGAGGRGGWLVGNGGNGGNGG

SEQ ID NO: 1550450 - protein, 24 aa, Mycobacterium tuberculosis
GGAGGSGGWLLGNGGVGGAGGQSL

SEQ ID NO: 1550451 - protein, 21 aa, Mycobacterium tuberculosis
GGAGGSGGWLYGNGGNGGIGG

SEQ ID NO: 1550452 - protein, 22 aa, Mycobacterium tuberculosis
GGAGGSGGWLYGNGGNGGIGGN

SEQ ID NO: 1550453 - protein, 22 aa, Mycobacterium tuberculosis
GGAGGTGGRGFLNDGGVGGAGG

SEQ ID NO: 1550454 - protein, 22 aa, Mycobacterium tuberculosis
GGAGLFYGFGGAGGNGGMGGVA

SEQ ID NO: 1550455 - protein, 23 aa, Mycobacterium tuberculosis
GGASGAGGWLLGTGGAGGAGGNG

SEQ ID NO: 1550456 - protein, 18 aa, Mycobacterium tuberculosis
GGAVIIAGFPFLDLGNVT

SEQ ID NO: 1550457 - protein, 18 aa, Mycobacterium tuberculosis
GGDAGWLGSGGVGGAGGF

SEQ ID NO: 1550458 - protein, 31 aa, Mycobacterium tuberculosis
GGDAPALECLDCPGCQPRGPDGLAWCPDTAY

SEQ ID NO: 1550459 - protein, 21 aa, Mycobacterium tuberculosis
GGDAVAACKTVTLTVDGTAMR

SEQ ID NO: 1550460 - protein, 26 aa, Mycobacterium tuberculosis
GGDEVSAAIAALFGAHARAYQALSAQ

SEQ ID NO: 1550461 - protein, 29 aa, Mycobacterium tuberculosis
GGDEVSAAIAALFGAHARAYQALSAQAAM

SEQ ID NO: 1550462 - protein, 39 aa, Mycobacterium tuberculosis
GGDGGAVRRARPGVPEAQRPGGGVSCQFVQALNAGVNSY

SEQ ID NO: 1550463 - protein, 24 aa, Mycobacterium tuberculosis
GGDPRRPVPALAIATGPDGGDPRR

SEQ ID NO: 1550464 - protein, 21 aa, Mycobacterium tuberculosis
GGEITARFLISACGILTVPKL

SEQ ID NO: 1550465 - protein, 22 aa, Mycobacterium tuberculosis
GGEITARFLISACGILTVPKLP

SEQ ID NO: 1550466 - protein, 19 aa, Mycobacterium tuberculosis
GGEMGRLWYENGKLLDKKN

SEQ ID NO: 1550467 - protein, 20 aa, Mycobacterium tuberculosis
GGEYEWTRAKAAYFMIVFSG

SEQ ID NO: 1550468 - protein, 29 aa, Mycobacterium tuberculosis
GGFTIPPGPFPRSRFASTQSSTSAPSPSR

SEQ ID NO: 1550469 - protein, 29 aa, Mycobacterium tuberculosis
GGGAIRIPLISIPAAPGFGNSTTNPSSGF

SEQ ID NO: 1550470 - protein, 22 aa, Mycobacterium tuberculosis
GGGALNQAGFFGTGGKGGNGGN

SEQ ID NO: 1550471 - protein, 41 aa, Mycobacterium tuberculosis
GGGGEESLQVVAPVRRRGLFRLDAGVVAAIEQQRPRLDRRD

SEQ ID NO: 1550472 - protein, 24 aa, Mycobacterium tuberculosis
GGGGEGGGGGGGKKKKKKKKKKKK

SEQ ID NO: 1550473 - protein, 26 aa, Mycobacterium tuberculosis
GGGGGGGGGGRGGKKKKKKKKKKKKR

SEQ ID NO: 1550474 - protein, 20 aa, Mycobacterium tuberculosis
GGGGLPPVPASPGGNGGGGG

SEQ ID NO: 1550475 - protein, 18 aa, Mycobacterium tuberculosis
GGGLPPVPASPGGNGGGG

SEQ ID NO: 1550476 - protein, 24 aa, Mycobacterium tuberculosis
GGGLSSPVILGIGIGGAGGDGGGA

SEQ ID NO: 1550477 - protein, 19 aa, Mycobacterium tuberculosis
GGGNGRFMGNGGVGGAGGY

SEQ ID NO: 1550478 - protein, 19 aa, Mycobacterium tuberculosis
GGGNGRSWATVGPAVPAAT

SEQ ID NO: 1550479 - protein, 28 aa, Mycobacterium tuberculosis
GGGVGVFFLFFCVSARPTRSARPARPRL

SEQ ID NO: 1550480 - protein, 17 aa, Mycobacterium tuberculosis
GGGWSLGGLDTHDPVAR

SEQ ID NO: 1550481 - protein, 19 aa, Mycobacterium tuberculosis
GGHGAEGVAGAAGEDLSPH

SEQ ID NO: 1550482 - protein, 32 aa, Mycobacterium tuberculosis
GGHRPAVWHGVAWGGSGRWYRAPGPPTVVPPR

SEQ ID NO: 1550483 - protein, 17 aa, Mycobacterium tuberculosis
GGHSGRRSIAPTPPAPR

SEQ ID NO: 1550484 - protein, 18 aa, Mycobacterium tuberculosis
GGIAQLFGTGGMGGSGGG

SEQ ID NO: 1550485 - protein, 17 aa, Mycobacterium tuberculosis
GGIEVVDVPHIDGTQTL

SEQ ID NO: 1550486 - protein, 22 aa, Mycobacterium tuberculosis
GGKGGLNTDGLSSATSGTGGTG

SEQ ID NO: 1550487 - protein, 24 aa, Mycobacterium tuberculosis
GGLAGIGGNAGFVRNGGAGGNGQL

SEQ ID NO: 1550488 - protein, 22 aa, Mycobacterium tuberculosis
GGLPAVRASLYSDPQFQAKYPM

SEQ ID NO: 1550489 - protein, 22 aa, Mycobacterium tuberculosis
GGLPAVRASLYSNPQFQAKYPM

SEQ ID NO: 1550490 - protein, 17 aa, Mycobacterium tuberculosis
GGLPPVPASPGCKGGGG

SEQ ID NO: 1550491 - protein, 18 aa, Mycobacterium tuberculosis
GGLSHSISVASLVDRWRA

SEQ ID NO: 1550492 - protein, 19 aa, Mycobacterium tuberculosis
GGLTFPKASAGVINLSGGT

SEQ ID NO: 1550493 - protein, 21 aa, Mycobacterium tuberculosis
GGLTFPKASAGVINLSGGTDP

SEQ ID NO: 1550494 - protein, 23 aa, Mycobacterium tuberculosis
GGMGGNGGLVFGNGGPGGLGGPG

SEQ ID NO: 1550495 - protein, 21 aa, Mycobacterium tuberculosis
GGMPMMLMPMSISGAGAGMPG

SEQ ID NO: 1550496 - protein, 18 aa, Mycobacterium tuberculosis
GGNARLWGVGGAGGAGGD

SEQ ID NO: 1550497 - protein, 24 aa, Mycobacterium tuberculosis
GGNDPFTFFPGGLTFPKASAGVIN

SEQ ID NO: 1550498 - protein, 31 aa, Mycobacterium tuberculosis
GGNDPFTFFPGGLTFPKASAGVINLSGGTDP

SEQ ID NO: 1550499 - protein, 19 aa, Mycobacterium tuberculosis
GGNGAHFSSGGKAGGNGGA

SEQ ID NO: 1550500 - protein, 22 aa, Mycobacterium tuberculosis
GGNGGAGGMLLGDGGAGGQGGP

SEQ ID NO: 1550501 - protein, 22 aa, Mycobacterium tuberculosis
GGNGGAGGWLYGNGGAGGAGGT

SEQ ID NO: 1550502 - protein, 23 aa, Mycobacterium tuberculosis
GGNGGRGGLLVGNGGAGGAGGVG

SEQ ID NO: 1550503 - protein, 24 aa, Mycobacterium tuberculosis
GGNGGTGGQLWGSGGAGGEGGAAL

SEQ ID NO: 1550504 - protein, 19 aa, Mycobacterium tuberculosis
GGNTSGLWNLASAASGVSG

SEQ ID NO: 1550505 - protein, 18 aa, Mycobacterium tuberculosis
GGNWSINTGNGYLGGLQF

SEQ ID NO: 1550506 - protein, 18 aa, Mycobacterium tuberculosis
GGPACRPAELFATDNTTD

SEQ ID NO: 1550507 - protein, 19 aa, Mycobacterium tuberculosis
GGPACRPAELFATDNTTDG

SEQ ID NO: 1550508 - protein, 19 aa, Mycobacterium tuberculosis
GGPAGLWGNGGPGGAGGSG

SEQ ID NO: 1550509 - protein, 19 aa, Mycobacterium tuberculosis
GGPDFPAPLDVATSPPNPD

SEQ ID NO: 1550510 - protein, 20 aa, Mycobacterium tuberculosis
GGPDFPAPLDVATSPPNPEG

SEQ ID NO: 1550511 - protein, 27 aa, Mycobacterium tuberculosis
GGPGGLAGNLFGQNGIQGVGGSGGKGG

SEQ ID NO: 1550512 - protein, 21 aa, Mycobacterium tuberculosis
GGPKCLVKVIQKLSGLSINRF

SEQ ID NO: 1550513 - protein, 29 aa, Mycobacterium tuberculosis
GGQGGGGGFSILLGLGGLGGLGSPGSIAT

SEQ ID NO: 1550514 - protein, 22 aa, Mycobacterium tuberculosis
GGQHRVGQCRQRQRRLRQHGCG

SEQ ID NO: 1550515 - protein, 26 aa, Mycobacterium tuberculosis
GGRGGDGGSAGWLSGNGGDAGTGGGG

SEQ ID NO: 1550516 - protein, 28 aa, Mycobacterium tuberculosis
GGRTGKFNRPYLCRSRCVHTSSSHHDVV

SEQ ID NO: 1550517 - protein, 17 aa, Mycobacterium tuberculosis
GGSAARWSRRRAVRPWR

SEQ ID NO: 1550518 - protein, 22 aa, Mycobacterium tuberculosis
GGSGGAGGFGFADGGQGGPGGN

SEQ ID NO: 1550519 - protein, 18 aa, Mycobacterium tuberculosis
GGSGGWLNGNGGAGGAGG

SEQ ID NO: 1550520 - protein, 27 aa, Mycobacterium tuberculosis
GGTGGERWRRRGRAASATAVRVATRHC

SEQ ID NO: 1550521 - protein, 26 aa, Mycobacterium tuberculosis
GGTGGFPGNGNAGGNGGPGGASEDGD

SEQ ID NO: 1550522 - protein, 26 aa, Mycobacterium tuberculosis
GGTGGKGGDGFGVFGKGGAGGTGGRG

SEQ ID NO: 1550523 - protein, 22 aa, Mycobacterium tuberculosis
GGTGGLGGWLWGNNGAAGTGDP

SEQ ID NO: 1550524 - protein, 19 aa, Mycobacterium tuberculosis
GGTPGDWGTGGTGGTGGTG

SEQ ID NO: 1550525 - protein, 28 aa, Mycobacterium tuberculosis
GGTRRSCVSGRCGWSQRSAVSTIRSGQR

SEQ ID NO: 1550526 - protein, 19 aa, Mycobacterium tuberculosis
GGVAHLASRCRYRTVGYHQ

SEQ ID NO: 1550527 - protein, 23 aa, Mycobacterium tuberculosis
GGVGGCLFGNGGHVAAGGRRLGP

SEQ ID NO: 1550528 - protein, 23 aa, Mycobacterium tuberculosis
GGVGGSGGFVYGNGGAGGIGGIG

SEQ ID NO: 1550529 - protein, 22 aa, Mycobacterium tuberculosis
GGVGGSGGWLNGNGGAGGAGGT

SEQ ID NO: 1550530 - protein, 18 aa, Mycobacterium tuberculosis
GGWLPSILVRRIERLELA

SEQ ID NO: 1550531 - protein, 22 aa, Mycobacterium tuberculosis
GGWMLSRASAMELLHAAETGIG

SEQ ID NO: 1550532 - protein, 17 aa, Mycobacterium tuberculosis
GHDQLRAAHALAAAVPR

SEQ ID NO: 1550533 - protein, 22 aa, Mycobacterium tuberculosis
GHFGQSGGFIWVDPKADLALVV

SEQ ID NO: 1550534 - protein, 31 aa, Mycobacterium tuberculosis
GHHPGDVISVTWKPVGRHAYRNVTLAEGPPG

SEQ ID NO: 1550535 - protein, 36 aa, Mycobacterium tuberculosis
GHSWRKRPATGWGMGSLRPKIDVVRVVAEGVANNDI

SEQ ID NO: 1550536 - protein, 28 aa, Mycobacterium tuberculosis
GHVALPTARRPWRFGRHDQRVAHRAAVR

SEQ ID NO: 1550537 - protein, 24 aa, Mycobacterium tuberculosis
GIQFSDDFIEWSVSFSQKPFPLPC

SEQ ID NO: 1550538 - protein, 24 aa, Mycobacterium tuberculosis
GIQFSDDFIEWSVSFSQKPFPPPC

SEQ ID NO: 1550539 - protein, 20 aa, Mycobacterium tuberculosis
GKGGDGMAGVAGSSPTTAGE

SEQ ID NO: 1550540 - protein, 21 aa, Mycobacterium tuberculosis
GKGGLNTDGLSSATSGTGGTG

SEQ ID NO: 1550541 - protein, 19 aa, Mycobacterium tuberculosis
GKGGMGGIAGDGGPGGDGG

SEQ ID NO: 1550542 - protein, 26 aa, Mycobacterium tuberculosis
GKGGNGGDGDGFIGGSGGTGGTGGDA

SEQ ID NO: 1550543 - protein, 25 aa, Mycobacterium tuberculosis
GKLSFPTSAAPGWSAFSDDQNPNLI

SEQ ID NO: 1550544 - protein, 33 aa, Mycobacterium tuberculosis; identical to SEQ ID NO: 1381675

SEQ ID NO: 1550545 - protein, 21 aa, Mycobacterium tuberculosis
GLACWPTGVNGGGWAVSVQIG

SEQ ID NO: 1550546 - protein, 36 aa, Mycobacterium tuberculosis
GLAHRVRCRSLRQWREHRLRRRSPRRSISVAAPLPH

SEQ ID NO: 1550547 - protein, 22 aa, Mycobacterium tuberculosis
GLALPMRLALPGSVNRGNAAQA

SEQ ID NO: 1550548 - protein, 18 aa, Mycobacterium tuberculosis
GLAMMLAPMVAAPGLAAA

SEQ ID NO: 1550549 - protein, 28 aa, Mycobacterium tuberculosis
GLDARAYRLAWPVGSIVYEVDMPEVIEF

SEQ ID NO: 1550550 - protein, 22 aa, Mycobacterium tuberculosis
GLETHLSYRMCLKTWSASESRN

SEQ ID NO: 1550551 - protein, 27 aa, Mycobacterium tuberculosis
GLFLSGDYQGLVGLNLVIDMPLPISLG

SEQ ID NO: 1550552 - protein, 25 aa, Mycobacterium tuberculosis
GLGGGSFGLPGLNGSGGDGGDGGNG

SEQ ID NO: 1550553 - protein, 26 aa, Mycobacterium tuberculosis
GLGGGSFGLPGLNGSGGDGGDGGNGA

SEQ ID NO: 1550554 - protein, 18 aa, Mycobacterium tuberculosis
GLGLRLELRLHDARDSNV

SEQ ID NO: 1550555 - protein, 22 aa, Mycobacterium tuberculosis
GLHKGDRVRIAGLGVGTVEGLK

SEQ ID NO: 1550556 - protein, 25 aa, Mycobacterium tuberculosis
GLHLPGVAFGHDWLTGTSRYSGLLE

SEQ ID NO: 1550557 - protein, 17 aa, Mycobacterium tuberculosis
GLLAARHGLLGAVVEQP

SEQ ID NO: 1550558 - protein, 19 aa, Mycobacterium tuberculosis
GLLACNCYVLAERPGTDAV

SEQ ID NO: 1550559 - protein, 17 aa, Mycobacterium tuberculosis
GLLSIPNFANPVQFICG

SEQ ID NO: 1550560 - protein, 18 aa, Mycobacterium tuberculosis
GLNSLPLPGTQGNGPGSF

SEQ ID NO: 1550561 - protein, 25 aa, Mycobacterium tuberculosis
GLSNATPREVLPASAAMDAPLDAAA

SEQ ID NO: 1550562 - protein, 17 aa, Mycobacterium tuberculosis
GLTAGVWQGAAAAAMAA

SEQ ID NO: 1550563 - protein, 19 aa, Mycobacterium tuberculosis
GLVGHGFGGSAAVFAAAGL

SEQ ID NO: 1550564 - protein, 19 aa, Mycobacterium tuberculosis
GLVGVRVGPTISQFPVTVH

SEQ ID NO: 1550565 - protein, 18 aa, Mycobacterium tuberculosis
GLVRVLPPFLSRKHLPSR

SEQ ID NO: 1550566 - protein, 19 aa, Mycobacterium tuberculosis
GLWPLLMEQFSVRPNAADV

SEQ ID NO: 1550567 - protein, 24 aa, Mycobacterium tuberculosis
GMAAVQLARLWGLEVFATASRGKW

SEQ ID NO: 1550568 - protein, 18 aa, Mycobacterium tuberculosis
GMHVRLAVTGDVPNLRVT

SEQ ID NO: 1550569 - protein, 18 aa, Mycobacterium tuberculosis
GMPGLPFVQPDGAGGDRT

SEQ ID NO: 1550570 - protein, 24 aa, Mycobacterium tuberculosis
GMSSPIDCRDHFDRDEMRDQAQFQ

SEQ ID NO: 1550571 - protein, 18 aa, Mycobacterium tuberculosis
GMTPRAALTKHLLDGDDS

SEQ ID NO: 1550572 - protein, 26 aa, Mycobacterium tuberculosis
GMYGDFFAFYLCDVVLKVNGKGGQPV

SEQ ID NO: 1550573 - protein, 17 aa, Mycobacterium tuberculosis
GNAGMLAGPGGAGGAGG

SEQ ID NO: 1550574 - protein, 22 aa, Mycobacterium tuberculosis
GNDPFTFFPGGLTFPKASAGVI

SEQ ID NO: 1550575 - protein, 23 aa, Mycobacterium tuberculosis
GNDPFTFFPGGLTFPKASAGVIN

SEQ ID NO: 1550576 - protein, 17 aa, Mycobacterium tuberculosis
GNGGDAGLFGNGGAGGA

SEQ ID NO: 1550577 - protein, 23 aa, Mycobacterium tuberculosis
GNGGHGGNGGWLLGNGGNGGLGG

SEQ ID NO: 1550578 - protein, 17 aa, Mycobacterium tuberculosis
GNGGKGGAGLIAGLDGA

SEQ ID NO: 1550579 - protein, 20 aa, Mycobacterium tuberculosis
GNGGSRGIGGAGGIGGAGST

SEQ ID NO: 1550580 - protein, 19 aa, Mycobacterium tuberculosis
GNGYMLLGLEVDAVPDRYR

SEQ ID NO: 1550581 - protein, 18 aa, Mycobacterium tuberculosis
GNIGFGLTGNNQVGIGGL

SEQ ID NO: 1550582 - protein, 30 aa, Mycobacterium tuberculosis
GNIVGAPMGWEAVFTRPFQAFWVELPACNN

SEQ ID NO: 1550583 - protein, 25 aa, Mycobacterium tuberculosis
GNTAGRRADAIAGTGGDGGNGGNGG

SEQ ID NO: 1550584 - protein, 19 aa, Mycobacterium tuberculosis
GNYSNGLFLSGDYQGLVGL

SEQ ID NO: 1550585 - protein, 31 aa, Mycobacterium tuberculosis; identical to SEQ ID NO: 1465739

SEQ ID NO: 1550586 - protein, 20 aa, Mycobacterium tuberculosis
GPAASAFNLVHQGVTAAKVG

SEQ ID NO: 1550587 - protein, 22 aa, Mycobacterium tuberculosis
GPAATPGCGCFGQRPDPGGEPA

SEQ ID NO: 1550588 - protein, 19 aa, Mycobacterium tuberculosis
GPAATRPAAQQTPAVPAAA

SEQ ID NO: 1550589 - protein, 25 aa, Mycobacterium tuberculosis
GPAMLPGFNSGFANIGSFNAGIANS

SEQ ID NO: 1550590 - protein, 18 aa, Mycobacterium tuberculosis
GPAPMLAAAAGWQTLSAA

SEQ ID NO: 1550591 - protein, 17 aa, Mycobacterium tuberculosis
GPEHLVVRAVRHGLQAA

SEQ ID NO: 1550592 - protein, 27 aa, Mycobacterium tuberculosis
GPFTIPEIHIPKIPIDVLGSVGLGQTT

SEQ ID NO: 1550593 - protein, 22 aa, Mycobacterium tuberculosis
  misc_feature (19)..(19): Xaa can be any naturally occurring amino acid
GPGGAAVGLFGHGGAGGAXGLG

SEQ ID NO: 1550594 - protein, 17 aa, Mycobacterium tuberculosis
GPGGLLFGNGGNGGSGG

SEQ ID NO: 1550595 - protein, 23 aa, Mycobacterium tuberculosis
GPGRLRQRCAGLARTAVRHRLTG

SEQ ID NO: 1550596 - protein, 18 aa, Mycobacterium tuberculosis
GPGSIVVEGRDIGTVVFP

SEQ ID NO: 1550597 - protein, 23 aa, Mycobacterium tuberculosis
GPGTIPGPFGATFNLSTSSLALF

SEQ ID NO: 1550598 - protein, 24 aa, Mycobacterium tuberculosis
GPLAHPGLVCDVAIGQSTLATQRV

SEQ ID NO: 1550599 - protein, 17 aa, Mycobacterium tuberculosis
GPLRPWPDDVRRAIREG

SEQ ID NO: 1550600 - protein, 21 aa, Mycobacterium tuberculosis
GPMGMMPMPMGMGGAGAGMPA

SEQ ID NO: 1550601 - protein, 22 aa, Mycobacterium tuberculosis
GPNGRPRYVTAIDADTATVHVG

SEQ ID NO: 1550602 - protein, 19 aa, Mycobacterium tuberculosis
GPQRFRYSLTTTISAEPAD

SEQ ID NO: 1550603 - protein, 20 aa, Mycobacterium tuberculosis
GPRAPQLWLPPLDETIPLSA

SEQ ID NO: 1550604 - protein, 23 aa, Mycobacterium tuberculosis
GPTQPRSITLTFIRNAQSQANAD

SEQ ID NO: 1550605 - protein, 17 aa, Mycobacterium tuberculosis
GPTVPILLDTGSSSLVI

SEQ ID NO: 1550606 - protein, 21 aa, Mycobacterium tuberculosis
GPVCGVVGFGGGAGRGGGRAG

SEQ ID NO: 1550607 - protein, 17 aa, Mycobacterium tuberculosis
GPVGLILTRQGVPVLDG

SEQ ID NO: 1550608 - protein, 18 aa, Mycobacterium tuberculosis
GPYFKVLLANLVPGQILQ

SEQ ID NO: 1550609 - protein, 23 aa, Mycobacterium tuberculosis
GQAGGKGWDGGPIGNGQVGEQHG

SEQ ID NO: 1550610 - protein, 17 aa, Mycobacterium tuberculosis
GQDGGLLFGNGGAGYNS

SEQ ID NO: 1550611 - protein, 17 aa, Mycobacterium tuberculosis
GQFELNRPATLIAALPA

SEQ ID NO: 1550612 - protein, 20 aa, Mycobacterium tuberculosis
GQGAGAFAGGGGGRGGDGGN

SEQ ID NO: 1550613 - protein, 17 aa, Mycobacterium tuberculosis
GQHGVNIIEFCKAYNAA

SEQ ID NO: 1550614 - protein, 17 aa, Mycobacterium tuberculosis
GQINLGFGNTGSGNIGN

SEQ ID NO: 1550615 - protein, 21 aa, Mycobacterium tuberculosis
GQKKARVSFIPDRSVVDHSQL

SEQ ID NO: 1550616 - protein, 18 aa, Mycobacterium tuberculosis
GQLSTGWFNSATTSTGWF

SEQ ID NO: 1550617 - protein, 18 aa, Mycobacterium tuberculosis
GQLTLLVPFIDRVRARVD

SEQ ID NO: 1550618 - protein, 18 aa, Mycobacterium tuberculosis
GQLVSFIGPIVIDTTIPG

SEQ ID NO: 1550619 - protein, 20 aa, Mycobacterium tuberculosis
GQNAPALMDVEAAYEQMWAL

SEQ ID NO: 1550620 - protein, 17 aa, Mycobacterium tuberculosis
GQNGGAGGILWGNGGNG

SEQ ID NO: 1550621 - protein, 23 aa, Mycobacterium tuberculosis
GQPSKFSMPGPWVGIAAPGENIA

SEQ ID NO: 1550622 - protein, 20 aa, Mycobacterium tuberculosis
GQPVKGRLTVPPSVPVKSAD

SEQ ID NO: 1550623 - protein, 20 aa, Mycobacterium tuberculosis
GQRLAAFVVLKPGVSATPET

SEQ ID NO: 1550624 - protein, 19 aa, Mycobacterium tuberculosis
GQTQFAAPVWMPRAKRTSI

SEQ ID NO: 1550625 - protein, 19 aa, Mycobacterium tuberculosis
GQVTSGLTAGVWQGAAAAA

SEQ ID NO: 1550626 - protein, 23 aa, Mycobacterium tuberculosis
GQVTSGLTAGVWQGAAAAAMAAA

SEQ ID NO: 1550627 - protein, 38 aa, Mycobacterium tuberculosis
GRAGHGGLRQCRRRRRRARGGAGGTVFGSGGAGGAGGV

SEQ ID NO: 1550628 - protein, 23 aa, Mycobacterium tuberculosis
GRAPKPGELFTFPDHAATLEKIA

SEQ ID NO: 1550629 - protein, 18 aa, Mycobacterium tuberculosis
GRCRTVRCHRLWGDEEQA

SEQ ID NO: 1550630 - protein, 18 aa, Mycobacterium tuberculosis
GRDIPVAFLAGGPHAVYL

SEQ ID NO: 1550631 - protein, 20 aa, Mycobacterium tuberculosis
GRDVQRLTAWASTTVSGDRD

SEQ ID NO: 1550632 - protein, 18 aa, Mycobacterium tuberculosis
GRFALKIGDGRARCTPTD

SEQ ID NO: 1550633 - protein, 19 aa, Mycobacterium tuberculosis
GRFALKIGDGRARCTPTDA

SEQ ID NO: 1550634 - protein, 25 aa, Mycobacterium tuberculosis
GRGGDGGSAGWLSGNGGDAGTGGGG

SEQ ID NO: 1550635 - protein, 20 aa, Mycobacterium tuberculosis
GRGGFSGMLLGSVSSAVAHS

SEQ ID NO: 1550636 - protein, 24 aa, Mycobacterium tuberculosis
GRGRPGRPPLMFRAVRRTDSTGTR

SEQ ID NO: 1550637 - protein, 25 aa, Mycobacterium tuberculosis
GRGTRLPVWLTQWGYRRPAEDTVDI

SEQ ID NO: 1550638 - protein, 22 aa, Mycobacterium tuberculosis
GRIGFPAIVGIIADVLHAADQW

SEQ ID NO: 1550639 - protein, 29 aa, Mycobacterium tuberculosis
GRLRRLALSAAINRPQICQQIFAGTHSPA

SEQ ID NO: 1550640 - protein, 25 aa, Mycobacterium tuberculosis
GRLSPDGLRWSTTEQLGYNRRYTLN

SEQ ID NO: 1550641 - protein, 18 aa, Mycobacterium tuberculosis
GRNRRGPVEPIGLVETAA

SEQ ID NO: 1550642 - protein, 26 aa, Mycobacterium tuberculosis
GRPEWRPRPRRQPARRSRPSPRPRRC

SEQ ID NO: 1550643 - protein, 21 aa, Mycobacterium tuberculosis
GRPPVIQLWARPRGVAPDALF

SEQ ID NO: 1550644 - protein, 44 aa, Mycobacterium tuberculosis
GRPSPPLPLPPPPLPPFFFFFFFFIFFFFFLKKKKRKKKKKKKK

SEQ ID NO: 1550645 - protein, 21 aa, Mycobacterium tuberculosis
GRRLGCGGGSWGDDCRPAGIG

SEQ ID NO: 1550646 - protein, 23 aa, Mycobacterium tuberculosis
GRRPARRGFSESARCVADRPDGD

SEQ ID NO: 1550647 - protein, 28 aa, Mycobacterium tuberculosis
GRRPGRRRRHRCGGRADVGHSARPCFGA

SEQ ID NO: 1550648 - protein, 32 aa, Mycobacterium tuberculosis
GRRVVINLWAHWCAPCMTELPVMSEYQRRVGP

SEQ ID NO: 1550649 - protein, 19 aa, Mycobacterium tuberculosis
GRSGLSVHGHARLLSEEDR

SEQ ID NO: 1550650 - protein, 23 aa, Mycobacterium tuberculosis
GRSLPAVGIDGVYAACDADGRVI

SEQ ID NO: 1550651 - protein, 18 aa, Mycobacterium tuberculosis
GRSPSAWTPEYFGGNAVP

SEQ ID NO: 1550652 - protein, 28 aa, Mycobacterium tuberculosis
GRSVLRPDVDLRRTVGWFTTYYPVPLAC

SEQ ID NO: 1550653 - protein, 23 aa, Mycobacterium tuberculosis
GRTTGNSCGVTWGPGESPGTLVM

SEQ ID NO: 1550654 - protein, 24 aa, Mycobacterium tuberculosis
GSAPMLAASVAWDGLAAELAVAAS

SEQ ID NO: 1550655 - protein, 17 aa, Mycobacterium tuberculosis
GSARLAFEQGKAALEVN

SEQ ID NO: 1550656 - protein, 21 aa, Mycobacterium tuberculosis
GSFNNGALWTGDHHGLVGFSY

SEQ ID NO: 1550657 - protein, 18 aa, Mycobacterium tuberculosis
GSGGAGGSRGVLFGTPGA

SEQ ID NO: 1550658 - protein, 18 aa, Mycobacterium tuberculosis
GSGGFVYGNGGAGGIGGI

SEQ ID NO: 1550659 - protein, 35 aa, Mycobacterium tuberculosis
GSGGIRGPIGLGFRVPCLVISPYSRGPLMVHDTFD

SEQ ID NO: 1550660 - protein, 17 aa, Mycobacterium tuberculosis
GSGPVGLILTRQGVPVL

SEQ ID NO: 1550661 - protein, 27 aa, Mycobacterium tuberculosis
GSHGLRLRLSLDLTNLIERYLANDVTT

SEQ ID NO: 1550662 - protein, 18 aa, Mycobacterium tuberculosis
GSIGLFLEPFRLSDPFIT

SEQ ID NO: 1550663 - protein, 21 aa, Mycobacterium tuberculosis
GSMVFPGYGAELLRWLDRAPQ

SEQ ID NO: 1550664 - protein, 27 aa, Mycobacterium tuberculosis
GSPCRKRWPRFGTRSAMHLDSLVAPLV

SEQ ID NO: 1550665 - protein, 19 aa, Mycobacterium tuberculosis
GSPCSYTPPADGLPRPWDP

SEQ ID NO: 1550666 - protein, 23 aa, Mycobacterium tuberculosis
GSQMGGALFVGWWLASGPQQGRG

SEQ ID NO: 1550667 - protein, 22 aa, Mycobacterium tuberculosis
GSRWEMDPTLLVSADVTNNHPF

SEQ ID NO: 1550668 - protein, 26 aa, Mycobacterium tuberculosis
GSSIPAIPIGLVLNGDIGPITIQPIP

SEQ ID NO: 1550669 - protein, 18 aa, Mycobacterium tuberculosis
GSSNWGFGNNGIGNIGFG

SEQ ID NO: 1550670 - protein, 20 aa, Mycobacterium tuberculosis
GSSSDLRVGQPVLAIGSPLG

SEQ ID NO: 1550671 - protein, 21 aa, Mycobacterium tuberculosis
GSSVLDSWGPTIFAGPRASPS

SEQ ID NO: 1550672 - protein, 25 aa, Mycobacterium tuberculosis
GSTPGAKGAHGFTPTSGGDGGDGGN

SEQ ID NO: 1550673 - protein, 21 aa, Mycobacterium tuberculosis
GSVCWLVGCSSGASSTTASTG

SEQ ID NO: 1550674 - protein, 59 aa, Mycobacterium tuberculosis; identical to SEQ ID NO: 1469298

SEQ ID NO: 1550675 - protein, 59 aa, Mycobacterium tuberculosis
GTALTRASSTWADSPRAWPIRAPSRLQVWRTRATTARECSIRVIISRVSSTGAPPPKKV

SEQ ID NO: 1550676 - protein, 20 aa, Mycobacterium tuberculosis
GTAVQFHFIARLVLVLLDET

SEQ ID NO: 1550677 - protein, 24 aa, Mycobacterium tuberculosis
GTCSAGQQCDRLAAVLMPDTATPS

SEQ ID NO: 1550678 - protein, 21 aa, Mycobacterium tuberculosis
GTDAVVLPGGFPEQFTAELSA

SEQ ID NO: 1550679 - protein, 25 aa, Mycobacterium tuberculosis
GTGADGAPGGWLIGNGGAGGSGAAN

SEQ ID NO: 1550680 - protein, 26 aa, Mycobacterium tuberculosis
GTGADGGAGGWLFGNGGNGGSGATGT

SEQ ID NO: 1550681 - protein, 25 aa, Mycobacterium tuberculosis
GTGANGGPGGWLIGNGGAGGSGAPG

SEQ ID NO: 1550682 - protein, 19 aa, Mycobacterium tuberculosis
GTGGLLFGNGGAGGHGAAA

SEQ ID NO: 1550683 - protein, 26 aa, Mycobacterium tuberculosis
GTGGNGALLFGFRGAGGAGGHGGAAL

SEQ ID NO: 1550684 - protein, 19 aa, Mycobacterium tuberculosis
GTGGVLLGLDGFTAPASTS

SEQ ID NO: 1550685 - protein, 25 aa, Mycobacterium tuberculosis
GTGQPGGPGGLLWGNGGNGGSGVAG

SEQ ID NO: 1550686 - protein, 18 aa, Mycobacterium tuberculosis
GTHAQEYQALSARVATFH

SEQ ID NO: 1550687 - protein, 17 aa, Mycobacterium tuberculosis
GTIPYQRFRGAEIAGLT

SEQ ID NO: 1550688 - protein, 17 aa, Mycobacterium tuberculosis
GTLNTGFFSAMTQAGPN

SEQ ID NO: 1550689 - protein, 17 aa, Mycobacterium tuberculosis
GTYKMAKSVLLAMSHSL

SEQ ID NO: 1550690 - protein, 17 aa, Mycobacterium tuberculosis
GVAFAFGPGVTVEGMLF

SEQ ID NO: 1550691 - protein, 28 aa, Mycobacterium tuberculosis
GVAVMPVCCWMFGIGGPRRPPGGDRRGA

SEQ ID NO: 1550692 - protein, 22 aa, Mycobacterium tuberculosis
GVGALSGMWGIPAVVAVATVGV

SEQ ID NO: 1550693 - protein, 24 aa, Mycobacterium tuberculosis
GVGGHGSALFGHGGINGDGGTGGM

SEQ ID NO: 1550694 - protein, 25 aa, Mycobacterium tuberculosis
GVIANGSFAPSFVGFGGNGGNGVNG

SEQ ID NO: 1550695 - protein, 26 aa, Mycobacterium tuberculosis
GVLDEATGRWGLRVARVELRSIDPPP

SEQ ID NO: 1550696 - protein, 22 aa, Mycobacterium tuberculosis
GVLLKTEQQVLGVINAPTQTLV

SEQ ID NO: 1550697 - protein, 23 aa, Mycobacterium tuberculosis
GVPGRSVSRWGAFLDDVGGFDCD

SEQ ID NO: 1550698 - protein, 31 aa, Mycobacterium tuberculosis
GVPSPVRRVCVTVGALVALACMVLAGCTVSP

SEQ ID NO: 1550699 - protein, 20 aa, Mycobacterium tuberculosis
GVRLGLALRRAVVWNSGNEN

SEQ ID NO: 1550700 - protein, 28 aa, Mycobacterium tuberculosis
GVTSCLGCADLHRSDRDAAWPAIAAQLR

SEQ ID NO: 1550701 - protein, 29 aa, Mycobacterium tuberculosis
GWGAGARRGKAAVRRVVSVGADGGNGGAG

SEQ ID NO: 1550702 - protein, 20 aa, Mycobacterium tuberculosis
GWKVSDLKSSTAVIPGYPVA

SEQ ID NO: 1550703 - protein, 24 aa, Mycobacterium tuberculosis
GWMTWSRRGMMRWARGEGDAPERS

SEQ ID NO: 1550704 - protein, 25 aa, Mycobacterium tuberculosis
GWQEGRRGWRGHGRPAPVTPADRQW

SEQ ID NO: 1550705 - protein, 26 aa, Mycobacterium tuberculosis
GYRLAISELTGAYWAGPAAASMVAAV

SEQ ID NO: 1550706 - protein, 22 aa, Mycobacterium tuberculosis
HAGGAAAAYRWLAKSLVANDVD

SEQ ID NO: 1550707 - protein, 25 aa, Mycobacterium tuberculosis
HAGTGGRGGLLAGQHANSGNGGGGG

SEQ ID NO: 1550708 - protein, 17 aa, Mycobacterium tuberculosis
HALGLGLLVGALERGMA

SEQ ID NO: 1550709 - protein, 19 aa, Mycobacterium tuberculosis
HARFGRLPFETLFEPAISY

SEQ ID NO: 1550710 - protein, 21 aa, Mycobacterium tuberculosis
HASGPKYMLDMTFPVDYSDQQ

SEQ ID NO: 1550711 - protein, 32 aa, Mycobacterium tuberculosis; identical to SEQ ID NO: 211033

SEQ ID NO: 1550712 - protein, 18 aa, Mycobacterium tuberculosis
HDRFRLLTGGSRSAPPAD

SEQ ID NO: 1550713 - protein, 17 aa, Mycobacterium tuberculosis
HEARFVLIGTMNPEEGE

SEQ ID NO: 1550714 - protein, 18 aa, Mycobacterium tuberculosis
HGENRFLYDIEFIIRGGI

SEQ ID NO: 1550715 - protein, 32 aa, Mycobacterium tuberculosis; identical to SEQ ID NO: 1381859

SEQ ID NO: 1550716 - protein, 25 aa, Mycobacterium tuberculosis
HGVALPEAIPVPHVPPLGAEPGVQA

SEQ ID NO: 1550717 - protein, 17 aa, Mycobacterium tuberculosis
HGVNIIEFCKAYNAATE

SEQ ID NO: 1550718 - protein, 18 aa, Mycobacterium tuberculosis
HIVAPVVVGWPVGQLYAN

SEQ ID NO: 1550719 - protein, 23 aa, Mycobacterium tuberculosis
HKANSLQGLAFALAYQGELSAAR

SEQ ID NO: 1550720 - protein, 25 aa, Mycobacterium tuberculosis
HLDIPRVPVTLNYLFGSQPGGPLKI

SEQ ID NO: 1550721 - protein, 19 aa, Mycobacterium tuberculosis
HLRGLPTAVGHRLRRCGDR

SEQ ID NO: 1550722 - protein, 21 aa, Mycobacterium tuberculosis
HLRLLWMCRERLLAELGDISY

SEQ ID NO: 1550723 - protein, 22 aa, Mycobacterium tuberculosis
HMRADVTVGAFLSGGIDSTGHR

SEQ ID NO: 1550724 - protein, 25 aa, Mycobacterium tuberculosis
HNATERYPMFTARIRALAGMSLLAS

SEQ ID NO: 1550725 - protein, 18 aa, Mycobacterium tuberculosis
HPGQPWARPGGLACWPTG

SEQ ID NO: 1550726 - protein, 31 aa, Mycobacterium tuberculosis
HPTTTYKAFDWDQAYRKPITYDTLWQADTDP

SEQ ID NO: 1550727 - protein, 21 aa, Mycobacterium tuberculosis
HRLLLEVSWEAIEHAGVDPAT

SEQ ID NO: 1550728 - protein, 18 aa, Mycobacterium tuberculosis
HRRARGDRALSVVPAGRR

SEQ ID NO: 1550729 - protein, 21 aa, Mycobacterium tuberculosis
HRRYRRSRRLWSVAVRQRRGR

SEQ ID NO: 1550730 - protein, 18 aa, Mycobacterium tuberculosis
HRSLVCDKPARWLLEHSE

SEQ ID NO: 1550731 - protein, 22 aa, Mycobacterium tuberculosis
HRWPRWRRRHGARRWRHRRRRR

SEQ ID NO: 1550732 - protein, 24 aa, Mycobacterium tuberculosis
HSAERLIVIYADFKGEAGADSFRD

SEQ ID NO: 1550733 - protein, 25 aa, Mycobacterium tuberculosis
HSARWDHTVPLLGRRIAVIGIGSTG

SEQ ID NO: 1550734 - protein, 32 aa, Mycobacterium tuberculosis; identical to SEQ ID NO: 200848

SEQ ID NO: 1550735 - protein, 24 aa, Mycobacterium tuberculosis
HSSAPAAATAVVWAAAAELAALII

SEQ ID NO: 1550736 - protein, 21 aa, Mycobacterium tuberculosis
HSTCMPAAFGGHLGLGDRSRS

SEQ ID NO: 1550737 - protein, 29 aa, Mycobacterium tuberculosis
HSYVGRPRPTAPWCSTYVSYLGTSTTTPP

SEQ ID NO: 1550738 - protein, 19 aa, Mycobacterium tuberculosis
HTAGRAGAVAAVAAQAAEA

SEQ ID NO: 1550739 - protein, 28 aa, Mycobacterium tuberculosis
HTGGFNRNTWGVAMIGNFDDVAPTPIQI

SEQ ID NO: 1550740 - protein, 23 aa, Mycobacterium tuberculosis
HTSGTLACLVRLANPPPRPETAY

SEQ ID NO: 1550741 - protein, 19 aa, Mycobacterium tuberculosis
HTVEQMVLNAINAPTQTLF

SEQ ID NO: 1550742 - protein, 18 aa, Mycobacterium tuberculosis
HVTAARLADWVDQNGNAG

SEQ ID NO: 1550743 - protein, 18 aa, Mycobacterium tuberculosis
HYDAEWIIILDDWTDGIG

SEQ ID NO: 1550744 - protein, 19 aa, Mycobacterium tuberculosis
HYNPWDQRLCLVPNGDLFR

SEQ ID NO: 1550745 - protein, 19 aa, Mycobacterium tuberculosis
IAAAEAMYEQMWAADVAAM

SEQ ID NO: 1550746 - protein, 19 aa, Mycobacterium tuberculosis
IAAARRGAGSASVLDAATI

SEQ ID NO: 1550747 - protein, 25 aa, Mycobacterium tuberculosis
IAAIADIPAAAALAAVTAVAARDGG

SEQ ID NO: 1550748 - protein, 29 aa, Mycobacterium tuberculosis
IAAQVVPWASLLQRFPGLGAGATGATGGE

SEQ ID NO: 1550749 - protein, 22 aa, Mycobacterium tuberculosis
IADACAPAGITVSDVDGGHTRT

SEQ ID NO: 1550750 - protein, 25 aa, Mycobacterium tuberculosis
IAGFYASICNAVWDGNVSLAGKDEL

SEQ ID NO: 1550751 - protein, 31 aa, Mycobacterium tuberculosis; identical to SEQ ID NO: 1467440

SEQ ID NO: 1550752 - protein, 32 aa, Mycobacterium tuberculosis; identical to SEQ ID NO: 157338

SEQ ID NO: 1550753 - protein, 21 aa, Mycobacterium tuberculosis
IANAAAMRVVLGAVNAPTQTL

SEQ ID NO: 1550754 - protein, 24 aa, Mycobacterium tuberculosis
IARSFAAALGLDFTRVQFTPDLLP

SEQ ID NO: 1550755 - protein, 26 aa, Mycobacterium tuberculosis
IARVIMRSAIGFFASFTVSSGVLAAN

SEQ ID NO: 1550756 - protein, 17 aa, Mycobacterium tuberculosis
IASLCAMSGERFVLGVG

SEQ ID NO: 1550757 - protein, 18 aa, Mycobacterium tuberculosis
IATRLFVSPLQWQTHLTH

SEQ ID NO: 1550758 - protein, 23 aa, Mycobacterium tuberculosis
IAVTRLGVTSVRFTGGEPLLAHH

SEQ ID NO: 1550759 - protein, 20 aa, Mycobacterium tuberculosis
ICDARGGSMSPAITGHYRSG

SEQ ID NO: 1550760 - protein, 17 aa, Mycobacterium tuberculosis
IDASGALDPITIFPGGY

SEQ ID NO: 1550761 - protein, 18 aa, Mycobacterium tuberculosis
IDGLLAMLTSGGSGGSGQ

SEQ ID NO: 1550762 - protein, 23 aa, Mycobacterium tuberculosis
IDIDARPAVLLVIPADTPDKLAV

SEQ ID NO: 1550763 - protein, 21 aa, Mycobacterium tuberculosis
IDIPITGSFTDLVVDNFTIPI

SEQ ID NO: 1550764 - protein, 25 aa, Mycobacterium tuberculosis
IDIPPMDFTLGLPVLGPITGQLGPI

SEQ ID NO: 1550765 - protein, 22 aa, Mycobacterium tuberculosis
IDNGGHTWAGWQAISAQGGHRG

SEQ ID NO: 1550766 - protein, 18 aa, Mycobacterium tuberculosis
IDRIPLNLGASVTVGPIL

SEQ ID NO: 1550767 - protein, 18 aa, Mycobacterium tuberculosis
IDTIYVWTHDSIGLGEDG

SEQ ID NO: 1550768 - protein, 22 aa, Mycobacterium tuberculosis
IECLRSIFTGARVEYSGRHVNS

SEQ ID NO: 1550769 - protein, 18 aa, Mycobacterium tuberculosis
IECRKAKERLSSSTVTTL

SEQ ID NO: 1550770 - protein, 29 aa, Mycobacterium tuberculosis
IELRVYRFGGSLHLDWWYDTRRIPAATAE

SEQ ID NO: 1550771 - protein, 19 aa, Mycobacterium tuberculosis
IEPRRARFPAAPDTNSVFA

SEQ ID NO: 1550772 - protein, 24 aa, Mycobacterium tuberculosis
IEQMPLDAGHSWRRNIALSADDVL

SEQ ID NO: 1550773 - protein, 19 aa, Mycobacterium tuberculosis
IERDGRPAAKLVLDVNPRY

SEQ ID NO: 1550774 - protein, 18 aa, Mycobacterium tuberculosis
IERRCMLYAGTTVVSGTA

SEQ ID NO: 1550775 - protein, 18 aa, Mycobacterium tuberculosis
IFATFCAAVASISGAAVT

SEQ ID NO: 1550776 - protein, 23 aa, Mycobacterium tuberculosis
IFLRQVQDVWIWVRPYFDDRATA

SEQ ID NO: 1550777 - protein, 23 aa, Mycobacterium tuberculosis
IFPGGLTIPAMNPLSINLSGGTG

SEQ ID NO: 1550778 - protein, 17 aa, Mycobacterium tuberculosis
IGAKAGGLPGDLTFSWY

SEQ ID NO: 1550779 - protein, 22 aa, Mycobacterium tuberculosis
IGATDLCEFVEFPSQLLQVCGD

SEQ ID NO: 1550780 - protein, 21 aa, Mycobacterium tuberculosis
IGDGFALDFAGGKMFFTPATG

SEQ ID NO: 1550781 - protein, 30 aa, Mycobacterium tuberculosis
IGGAGANAGFGAGVPGDGGIGGTGGAGGAG

SEQ ID NO: 1550782 - protein, 17 aa, Mycobacterium tuberculosis
IGGEGRTGGNGGSGGDG

SEQ ID NO: 1550783 - protein, 19 aa, Mycobacterium tuberculosis
IGGEGRTGGNGGSGGDGGG

SEQ ID NO: 1550784 - protein, 20 aa, Mycobacterium tuberculosis
IGGGFGNKVPIYPGYVCAIV

SEQ ID NO: 1550785 - protein, 21 aa, Mycobacterium tuberculosis
IGGNGGDAGLFGNGGAGGAGA

SEQ ID NO: 1550786 - protein, 24 aa, Mycobacterium tuberculosis
IGKLSLPPNWAGASPSLAPTVGSA

SEQ ID NO: 1550787 - protein, 17 aa, Mycobacterium tuberculosis
IGLRGADVTKTFTNIQK

SEQ ID NO: 1550788 - protein, 23 aa, Mycobacterium tuberculosis
IGNGGDGGPGMFGGPGGAGGSGG

SEQ ID NO: 1550789 - protein, 19 aa, Mycobacterium tuberculosis
IGNSGRFNTGIGNSGTAST

SEQ ID NO: 1550790 - protein, 17 aa, Mycobacterium tuberculosis
IGNWFNRTVFATKVAQH

SEQ ID NO: 1550791 - protein, 25 aa, Mycobacterium tuberculosis
IGPIKINPITLWPAQNFNQTITLAW

SEQ ID NO: 1550792 - protein, 33 aa, Mycobacterium tuberculosis
IGSGAGGAGVQCGAGGAGISFSNVSNGGTGGTG

SEQ ID NO: 1550793 - protein, 18 aa, Mycobacterium tuberculosis
IGSPIPLSLALGTTTWTL

SEQ ID NO: 1550794 - protein, 19 aa, Mycobacterium tuberculosis
IGWAEPGLAHRVRCRSLRQ

SEQ ID NO: 1550795 - protein, 19 aa, Mycobacterium tuberculosis
IHGVQICQHHCPVSHVAEE

SEQ ID NO: 1550796 - protein, 17 aa, Mycobacterium tuberculosis
IIAGFPFLDLGNVTIGG

SEQ ID NO: 1550797 - protein, 18 aa, Mycobacterium tuberculosis
IIAGRPAPTDGFVGVAPD

SEQ ID NO: 1550798 - protein, 22 aa, Mycobacterium tuberculosis
IIDRLFAGLMSYDAVGKPSLEV

SEQ ID NO: 1550799 - protein, 17 aa, Mycobacterium tuberculosis
IINSAVNTAAWYVNAAI

SEQ ID NO: 1550800 - protein, 26 aa, Mycobacterium tuberculosis
IKAMPPSSVVGLWTFDGREGRTEVPA

SEQ ID NO: 1550801 - protein, 17 aa, Mycobacterium tuberculosis
IKEAYGLTKQYVAEQLA

SEQ ID NO: 1550802 - protein, 23 aa, Mycobacterium tuberculosis
ILDIDRYRIDGELQDYIVGVREL

SEQ ID NO: 1550803 - protein, 23 aa, Mycobacterium tuberculosis
INAPTEFMFGRSLIGDGADGTAA

SEQ ID NO: 1550804 - protein, 29 aa, Mycobacterium tuberculosis
INAPTQLWLGRPLIGDGVHGAPGTGQPGG

SEQ ID NO: 1550805 - protein, 18 aa, Mycobacterium tuberculosis
INIDAGVVTLQGFSIVAA

SEQ ID NO: 1550806 - protein, 19 aa, Mycobacterium tuberculosis
ININETLYLGPLVVPPINV

SEQ ID NO: 1550807 - protein, 17 aa, Mycobacterium tuberculosis
INQSFPVTVNWSTPAVT

SEQ ID NO: 1550808 - protein, 18 aa, Mycobacterium tuberculosis
INTGNGYLGGLQFTQSTW

SEQ ID NO: 1550809 - protein, 18 aa, Mycobacterium tuberculosis
INTGNGYYGGLRFTAGTW

SEQ ID NO: 1550810 - protein, 25 aa, Mycobacterium tuberculosis
INYPPPCLTGFLPASEWRSPADTSP

SEQ ID NO: 1550811 - protein, 24 aa, Mycobacterium tuberculosis
IPAIPIGLELNGGVGPITVLPIQI

SEQ ID NO: 1550812 - protein, 27 aa, Mycobacterium tuberculosis
IPASRERVVAVSFPRDLAITPIQCEAW

SEQ ID NO: 1550813 - protein, 24 aa, Mycobacterium tuberculosis
IPDDLLNALIDFLAAVRNGLVPII

SEQ ID NO: 1550814 - protein, 18 aa, Mycobacterium tuberculosis
IPDRSDVVWLEHEDNHES

SEQ ID NO: 1550815 - protein, 18 aa, Mycobacterium tuberculosis
IPIIDVPAVPGFGNTTTA

SEQ ID NO: 1550816 - protein, 17 aa, Mycobacterium tuberculosis
IPIIHIPATPGFGNSTG

SEQ ID NO: 1550817 - protein, 20 aa, Mycobacterium tuberculosis
IPKTPEWAAALSGLAAGDLR

SEQ ID NO: 1550818 - protein, 21 aa, Mycobacterium tuberculosis
IPLNIHQTFSLGPLVVPDIVI

SEQ ID NO: 1550819 - protein, 17 aa, Mycobacterium tuberculosis
IPPRGTQAVVLKVYQNA

SEQ ID NO: 1550820 - protein, 20 aa, Mycobacterium tuberculosis
IPQFPIRITTTGGIGPIVIP

SEQ ID NO: 1550821 - protein, 20 aa, Mycobacterium tuberculosis
IPRGRGGATDGPNHRAGRLS

SEQ ID NO: 1550822 - protein, 19 aa, Mycobacterium tuberculosis
IPTDQRAGGRVSRAVCRGP

SEQ ID NO: 1550823 - protein, 22 aa, Mycobacterium tuberculosis
IPVRRVRATHAFHTSAMDPMLG

SEQ ID NO: 1550824 - protein, 17 aa, Mycobacterium tuberculosis
IPVTPGYFNLTGGPSSG

SEQ ID NO: 1550825 - protein, 18 aa, Mycobacterium tuberculosis
IQGLRAAFEVSQTSRSAP

SEQ ID NO: 1550826 - protein, 27 aa, Mycobacterium tuberculosis
IQILPTIPLNIHQTFSLGPLVVPDIVI

SEQ ID NO: 1550827 - protein, 17 aa, Mycobacterium tuberculosis
IQITGGFIGIREFTLPE

SEQ ID NO: 1550828 - protein, 26 aa, Mycobacterium tuberculosis
IQSTFVGAICRWHAANPAGLIDITRF

SEQ ID NO: 1550829 - protein, 21 aa, Mycobacterium tuberculosis
IRAAAELALPHRRRRDPFDDH

SEQ ID NO: 1550830 - protein, 18 aa, Mycobacterium tuberculosis
IRAEVAAAFGSAPPTSQT

SEQ ID NO: 1550831 - protein, 17 aa, Mycobacterium tuberculosis
IRCLKRARRTGATRIEV

SEQ ID NO: 1550832 - protein, 49 aa, Mycobacterium tuberculosis
IREDSCPNHATYRTWLTRLLRDGKKNKKIFFFFFFFFLKKKKKKKKKKK

SEQ ID NO: 1550833 - protein, 19 aa, Mycobacterium tuberculosis
IRPILTILRSCSPRLVAAT

SEQ ID NO: 1550834 - protein, 18 aa, Mycobacterium tuberculosis
IRTAELVAIVSVGGGANI

SEQ ID NO: 1550835 - protein, 19 aa, Mycobacterium tuberculosis
ISDTNLLAWYQRSHRDLPW

SEQ ID NO: 1550836 - protein, 22 aa, Mycobacterium tuberculosis
ISGNFNNGVLWVGDYQGLFGVS

SEQ ID NO: 1550837 - protein, 32 aa, Mycobacterium tuberculosis
ISGNFSNGVLWRGDYEGLWGLSGGSTIPAIPI

SEQ ID NO: 1550838 - protein, 33 aa, Mycobacterium tuberculosis; identical to SEQ ID NO: 201428

SEQ ID NO: 1550839 - protein, 32 aa, Mycobacterium tuberculosis; identical to SEQ ID NO: 1466979

SEQ ID NO: 1550840 - protein, 31 aa, Mycobacterium tuberculosis
ISPEDFWRSAGLPAYRWPDPNGSRFPNGAPP

SEQ ID NO: 1550841 - protein, 25 aa, Mycobacterium tuberculosis
ISSIPPVPGKFYWMSPTQVRWRPFE

SEQ ID NO: 1550842 - protein, 32 aa, Mycobacterium tuberculosis
ITATPLRPGIWPAYADHRMAMAGAIIGLRVAG

SEQ ID NO: 1550843 - protein, 27 aa, Mycobacterium tuberculosis
ITFLHFVRLPAMLFGVGRYTVTMELVE

SEQ ID NO: 1550844 - protein, 26 aa, Mycobacterium tuberculosis
ITIGEIPFDLVAHSTLGPVHILIDLP

SEQ ID NO: 1550845 - protein, 21 aa, Mycobacterium tuberculosis
ITLRPEMWVRKIAGADVVSEL

SEQ ID NO: 1550846 - protein, 17 aa, Mycobacterium tuberculosis
ITLRRRFAVAVAGVATA

SEQ ID NO: 1550847 - protein, 17 aa, Mycobacterium tuberculosis
ITVILALHDLINGGYVG

SEQ ID NO: 1550848 - protein, 18 aa, Mycobacterium tuberculosis
ITVYGWDETVFFRNGDPF

SEQ ID NO: 1550849 - protein, 23 aa, Mycobacterium tuberculosis
IVCAGRPLLEWCVRRRLDDEPRI

SEQ ID NO: 1550850 - protein, 23 aa, Mycobacterium tuberculosis
IVDRPNLFIKIPATKAGLPAISA

SEQ ID NO: 1550851 - protein, 18 aa, Mycobacterium tuberculosis
IVEIGPFTIPQVDVPAIP

SEQ ID NO: 1550852 - protein, 37 aa, Mycobacterium tuberculosis
IVNAIPFPSIVGDEFCLLDGLLAWYATIGSINNINSI

SEQ ID NO: 1550853 - protein, 17 aa, Mycobacterium tuberculosis
IWCMDWPAVATAAAAGL

SEQ ID NO: 1550854 - protein, 20 aa, Mycobacterium tuberculosis
IWRAHCRVLAAPSVTTPKPG

SEQ ID NO: 1550855 - protein, 18 aa, Mycobacterium tuberculosis
IYAGLATDTGSFRWASVR

SEQ ID NO: 1550856 - protein, 18 aa, Mycobacterium tuberculosis
IYGLGPRIAQLVAGAFFR

SEQ ID NO: 1550857 - protein, 30 aa, Mycobacterium tuberculosis
IYLNTFRHLYGLDCSHIAPANVYGPRQDPH

SEQ ID NO: 1550858 - protein, 24 aa, Mycobacterium tuberculosis
KAALEVNWPFVFASMLENAVKGGV

SEQ ID NO: 1550859 - protein, 25 aa, Mycobacterium tuberculosis
KAGGLPGDLTFSWYAVDKTGQPWVV

SEQ ID NO: 1550860 - protein, 21 aa, Mycobacterium tuberculosis
KARFVPGNENFQMGAYLKSND

SEQ ID NO: 1550861 - protein, 17 aa, Mycobacterium tuberculosis
KASAGVINLSGGTDPFT

SEQ ID NO: 1550862 - protein, 18 aa, Mycobacterium tuberculosis
KASAGVINLSGGTDPFTL

SEQ ID NO: 1550863 - protein, 18 aa, Mycobacterium tuberculosis
KAVASAFEAARAATVHPL

SEQ ID NO: 1550864 - protein, 20 aa, Mycobacterium tuberculosis
KAVDVLARIMGSSYQRLVAA

SEQ ID NO: 1550865 - protein, 21 aa, Mycobacterium tuberculosis
KAVIVSEPFLVAIPILEQKGM

SEQ ID NO: 1550866 - protein, 21 aa, Mycobacterium tuberculosis
KAWFPLTKRWLGFEDAHITFE

SEQ ID NO: 1550867 - protein, 19 aa, Mycobacterium tuberculosis
KAYGAGPCSGHLTDIEHIV

SEQ ID NO: 1550868 - protein, 20 aa, Mycobacterium tuberculosis
KCPAAPFEAAFLIAAQLGDR

SEQ ID NO: 1550869 - protein, 17 aa, Mycobacterium tuberculosis
KDDAIDWQAYFHLRNRL

SEQ ID NO: 1550870 - protein, 19 aa, Mycobacterium tuberculosis
KDVGFPYRSALVPRRNAEL

SEQ ID NO: 1550871 - protein, 17 aa, Mycobacterium tuberculosis
KEVREMQALLAKYGAGH

SEQ ID NO: 1550872 - protein, 26 aa, Mycobacterium tuberculosis
KFDVPLPTAVRWAMRIPGGKAVHRLL

SEQ ID NO: 1550873 - protein, 20 aa, Mycobacterium tuberculosis
KFRTGGYMIDFWGVGYQVAK

SEQ ID NO: 1550874 - protein, 17 aa, Mycobacterium tuberculosis
KGDLIFYGPEGTQSVAL

SEQ ID NO: 1550875 - protein, 19 aa, Mycobacterium tuberculosis
KGDSGGPVYLAPDGGPAQI

SEQ ID NO: 1550876 - protein, 21 aa, Mycobacterium tuberculosis
KGGAGDPSFAVNNGAGGNGGH

SEQ ID NO: 1550877 - protein, 21 aa, Mycobacterium tuberculosis
KGRLAALAIAAMASASLVTVA

SEQ ID NO: 1550878 - protein, 18 aa, Mycobacterium tuberculosis
KHKIRVISPDIGGGFGNK

SEQ ID NO: 1550879 - protein, 18 aa, Mycobacterium tuberculosis
KKDCKQNPIFDPLQPDDP

SEQ ID NO: 1550880 - protein, 22 aa, Mycobacterium tuberculosis
KKKIRGVLFLIMISLPPLPPLP

SEQ ID NO: 1550881 - protein, 27 aa, Mycobacterium tuberculosis
KKKKKKKGGGGRGGGAGGGGGGGGGGG

SEQ ID NO: 1550882 - protein, 28 aa, Mycobacterium tuberculosis
KKKKKKKRGREGGGGGGGGGGGGGGGGG

SEQ ID NO: 1550883 - protein, 25 aa, Mycobacterium tuberculosis
KKNKTKKKKKKRVVLSAARTCGSPR

SEQ ID NO: 1550884 - protein, 31 aa, Mycobacterium tuberculosis
KKQKKKKGKGGGWGGGGGGGGGGGGGGGEGG

SEQ ID NO: 1550885 - protein, 19 aa, Mycobacterium tuberculosis
KLLPARFTAALAQAQPDRL

SEQ ID NO: 1550886 - protein, 18 aa, Mycobacterium tuberculosis
KNIGFGLTGDNLVGIGAL

SEQ ID NO: 1550887 - protein, 27 aa, Mycobacterium tuberculosis
KPGCGLRRMHCRGAPSRPWCGGQSGDR

SEQ ID NO: 1550888 - protein, 25 aa, Mycobacterium tuberculosis
KPLQNLAGLPAWLASGAPAAAMTAA

SEQ ID NO: 1550889 - protein, 20 aa, Mycobacterium tuberculosis
KPQTVHWNLRLDVSDVDGKL

SEQ ID NO: 1550890 - protein, 32 aa, Mycobacterium tuberculosis
KPRARDCTPTRRLGRTTARARAQRAESSSSSF

SEQ ID NO: 1550891 - protein, 18 aa, Mycobacterium tuberculosis
KPVIFWTPDHGAFVVRGA

SEQ ID NO: 1550892 - protein, 19 aa, Mycobacterium tuberculosis
KPVPVGVVGDVYYGGGPAV

SEQ ID NO: 1550893 - protein, 20 aa, Mycobacterium tuberculosis
KQGWMCCIGSSWMHLSTGVI

SEQ ID NO: 1550894 - protein, 18 aa, Mycobacterium tuberculosis
KQTAIEPLPPMPGPSPTR

SEQ ID NO: 1550895 - protein, 23 aa, Mycobacterium tuberculosis
KSMILHEILPIDVSINLEDAVFI

SEQ ID NO: 1550896 - protein, 20 aa, Mycobacterium tuberculosis
KTGTMGPRLVYTETKLNSAF

SEQ ID NO: 1550897 - protein, 21 aa, Mycobacterium tuberculosis
KTGTMGPRLVYTETKLNSAFS

SEQ ID NO: 1550898 - protein, 19 aa, Mycobacterium tuberculosis
KTIQQAIELWKIVDRPNLF

SEQ ID NO: 1550899 - protein, 20 aa, Mycobacterium tuberculosis
KTVDDYRLAHKIGLDAVLVD

SEQ ID NO: 1550900 - protein, 21 aa, Mycobacterium tuberculosis
KVAEVKSGFGPEYTVTDVTPR

SEQ ID NO: 1550901 - protein, 17 aa, Mycobacterium tuberculosis
KVDNGRCDPVAGTNTGE

SEQ ID NO: 1550902 - protein, 18 aa, Mycobacterium tuberculosis
KVDNGRCDPVAGTNTGES

SEQ ID NO: 1550903 - protein, 23 aa, Mycobacterium tuberculosis
KVHRHWGFGGGPHRCLGSHLARL

SEQ ID NO: 1550904 - protein, 28 aa, Mycobacterium tuberculosis
KVIQKLSGLSINRFIAIDFVGFARMVEA

SEQ ID NO: 1550905 - protein, 29 aa, Mycobacterium tuberculosis
KVIQKLSGLSINRFIAIDFVGFARMVEAL

SEQ ID NO: 1550906 - protein, 18 aa, Mycobacterium tuberculosis
KVKADLGVDVFRRMVGDD

SEQ ID NO: 1550907 - protein, 30 aa, Mycobacterium tuberculosis
KVPIYPGYVCAIVASLLLDKPVKWMEDRSE

SEQ ID NO: 1550908 - protein, 20 aa, Mycobacterium tuberculosis
KVYLRKRCREHGSFEALVYG

SEQ ID NO: 1550909 - protein, 22 aa, Mycobacterium tuberculosis
KYNPECTCFLQGAKWYLDNGGY

SEQ ID NO: 1550910 - protein, 21 aa, Mycobacterium tuberculosis
LAAAAARAGGAAVQAKAVAGA

SEQ ID NO: 1550911 - protein, 19 aa, Mycobacterium tuberculosis
LAAAAAWDGLAAELGQAAN

SEQ ID NO: 1550912 - protein, 17 aa, Mycobacterium tuberculosis
LAAAASDVANIGSALSA

SEQ ID NO: 1550913 - protein, 18 aa, Mycobacterium tuberculosis
LAAAFANVLARWSASSRF

SEQ ID NO: 1550914 - protein, 19 aa, Mycobacterium tuberculosis
LAAGGYRLAISELTGAYWA

SEQ ID NO: 1550915 - protein, 18 aa, Mycobacterium tuberculosis
LAAIQARAAATAFEAALA

SEQ ID NO: 1550916 - protein, 27 aa, Mycobacterium tuberculosis
LAALIRARFPTLTARQVMQRIESTAHH

SEQ ID NO: 1550917 - protein, 17 aa, Mycobacterium tuberculosis
LAASVAWDGLAAELAVA

SEQ ID NO: 1550918 - protein, 18 aa, Mycobacterium tuberculosis
LAASVAWDGLAAELAVAA

SEQ ID NO: 1550919 - protein, 23 aa, Mycobacterium tuberculosis
LAEGPPGLISSRIPPAGRPIGLA

SEQ ID NO: 1550920 - protein, 20 aa, Mycobacterium tuberculosis
LAELDRVWGHLPFGAQWYSA

SEQ ID NO: 1550921 - protein, 19 aa, Mycobacterium tuberculosis
LAGPGGSRRRVRWGGVATR

SEQ ID NO: 1550922 - protein, 21 aa, Mycobacterium tuberculosis
LAGRYGDGWIAQARDINDAKL

SEQ ID NO: 1550923 - protein, 24 aa, Mycobacterium tuberculosis
LAGTGLAGLAARGGSAPTPAAAAP

SEQ ID NO: 1550924 - protein, 29 aa, Mycobacterium tuberculosis
LAITFLHFVRLPAMLFGVGRYTVTMELVE

SEQ ID NO: 1550925 - protein, 29 aa, Mycobacterium tuberculosis
LALGGRALRWPRFPLVIEAAVAAVDHQPL

SEQ ID NO: 1550926 - protein, 21 aa, Mycobacterium tuberculosis
LALLGRPLIGDGTDAAPGSGG

SEQ ID NO: 1550927 - protein, 22 aa, Mycobacterium tuberculosis
LALLGRPLIGNGADGAAGTGQA

SEQ ID NO: 1550928 - protein, 17 aa, Mycobacterium tuberculosis
LALTGKRKPYIYTSTIA

SEQ ID NO: 1550929 - protein, 22 aa, Mycobacterium tuberculosis
LANRPGTAIAAIAVKDPPRPRP

SEQ ID NO: 1550930 - protein, 21 aa, Mycobacterium tuberculosis
LANTGRPLIGNGANGAPGTGA

SEQ ID NO: 1550931 - protein, 21 aa, Mycobacterium tuberculosis
LANTGRPLIGNGTNGAPGTGA

SEQ ID NO: 1550932 - protein, 19 aa, Mycobacterium tuberculosis
LAPSALYRMFYKARKAAGR

SEQ ID NO: 1550933 - protein, 22 aa, Mycobacterium tuberculosis
LAQLRPQPILQLPDTNSGWRLV

SEQ ID NO: 1550934 - protein, 18 aa, Mycobacterium tuberculosis
LARYGPRAPQLWLPPLDE

SEQ ID NO: 1550935 - protein, 27 aa, Mycobacterium tuberculosis
LASGGVGLLGWAWVVAGAVDLLTTGDI

SEQ ID NO: 1550936 - protein, 23 aa, Mycobacterium tuberculosis
LASRCRYRTVGYHQRGGPRWLDR

SEQ ID NO: 1550937 - protein, 26 aa, Mycobacterium tuberculosis
LATLLASRYGCPALQATTVPAANAPT

SEQ ID NO: 1550938 - protein, 20 aa, Mycobacterium tuberculosis
LATLLQHWGISPDFLIGHSV

SEQ ID NO: 1550939 - protein, 21 aa, Mycobacterium tuberculosis
LATRARYGVISVLDRAHPAGV

SEQ ID NO: 1550940 - protein, 17 aa, Mycobacterium tuberculosis
LAVQRPPAALVLRSPFT

SEQ ID NO: 1550941 - protein, 17 aa, Mycobacterium tuberculosis
LAVSFSECNAGLVVDEV

SEQ ID NO: 1550942 - protein, 18 aa, Mycobacterium tuberculosis
LAVSHAFHSLLMEPMLAE

SEQ ID NO: 1550943 - protein, 20 aa, Mycobacterium tuberculosis
LCAAFRRGRHAGRSGSGPDR

SEQ ID NO: 1550944 - protein, 21 aa, Mycobacterium tuberculosis
LCASGCAWKPPTTRPSPPNTC

SEQ ID NO: 1550945 - protein, 19 aa, Mycobacterium tuberculosis
LCASRVPMSIAAIAGKLGV

SEQ ID NO: 1550946 - protein, 20 aa, Mycobacterium tuberculosis
LCGATLLIAACTRVVGGTAS

SEQ ID NO: 1550947 - protein, 18 aa, Mycobacterium tuberculosis
LCGPVAMVDAARTWLDHN

SEQ ID NO: 1550948 - protein, 20 aa, Mycobacterium tuberculosis
LCRGRRLRPGCGSHRGNPLM

SEQ ID NO: 1550949 - protein, 18 aa, Mycobacterium tuberculosis
LDALIGGFKPVFRALDPA

SEQ ID NO: 1550950 - protein, 18 aa, Mycobacterium tuberculosis
LDAVAAFVESGRTVVLGL

SEQ ID NO: 1550951 - protein, 17 aa, Mycobacterium tuberculosis
LDDLVCDDLVPYRTLVT

SEQ ID NO: 1550952 - protein, 18 aa, Mycobacterium tuberculosis
LDDRCRWLAPVPGTDVAI

SEQ ID NO: 1550953 - protein, 21 aa, Mycobacterium tuberculosis
LDFYRCAMLPASPDWKPGAVP

SEQ ID NO: 1550954 - protein, 17 aa, Mycobacterium tuberculosis
LDLPPNTAVTVIFFGPV

SEQ ID NO: 1550955 - protein, 17 aa, Mycobacterium tuberculosis
LDNLMAVAHKDVVLSAG

SEQ ID NO: 1550956 - protein, 19 aa, Mycobacterium tuberculosis
LDNTGNLTLNFGVANQGGL

SEQ ID NO: 1550957 - protein, 22 aa, Mycobacterium tuberculosis
LDRHLRLPLRNVLWEGDEALLT

SEQ ID NO: 1550958 - protein, 18 aa, Mycobacterium tuberculosis
LDRLRTLVHRTCVTPLPF

SEQ ID NO: 1550959 - protein, 20 aa, Mycobacterium tuberculosis
LDSITLFPGGLAFPENPVVS

SEQ ID NO: 1550960 - protein, 17 aa, Mycobacterium tuberculosis
LDSLVLIASGGAFGPNG

SEQ ID NO: 1550961 - protein, 31 aa, Mycobacterium tuberculosis
LDSVRLGVPLGPAVRAGGCTAMAAPAASAVS

SEQ ID NO: 1550962 - protein, 20 aa, Mycobacterium tuberculosis
LDVADGARLVDSIEGEPGLG

SEQ ID NO: 1550963 - protein, 17 aa, Mycobacterium tuberculosis
LDVARIGSSIGAANAAA

SEQ ID NO: 1550964 - protein, 18 aa, Mycobacterium tuberculosis
LDVARIGSSIGVANSASR

SEQ ID NO: 1550965 - protein, 21 aa, Mycobacterium tuberculosis
LDVIRCDRPNVVLGRQNLQRR

SEQ ID NO: 1550966 - protein, 19 aa, Mycobacterium tuberculosis
LDVNPRYISLIPVNVVADI

SEQ ID NO: 1550967 - protein, 21 aa, Mycobacterium tuberculosis
LDVNPRYISLIPVNVVADIEA

SEQ ID NO: 1550968 - protein, 24 aa, Mycobacterium tuberculosis
LDWPAKLRLLDGFRQRENLSWSAP

SEQ ID NO: 1550969 - protein, 18 aa, Mycobacterium tuberculosis
LEAQRPHGFKALDITLPM

SEQ ID NO: 1550970 - protein, 20 aa, Mycobacterium tuberculosis
LEARIVLRLLLDRTSVIEAA

SEQ ID NO: 1550971 - protein, 25 aa, Mycobacterium tuberculosis
LELPDIKCVYWAGGNPFHHHQNLPR

SEQ ID NO: 1550972 - protein, 17 aa, Mycobacterium tuberculosis
LELRLHDARDSNVRVVG

SEQ ID NO: 1550973 - protein, 20 aa, Mycobacterium tuberculosis
LEQRGSCAVRSSHRAALTTP

SEQ ID NO: 1550974 - protein, 19 aa, Mycobacterium tuberculosis
LERTFPLALSALIQEAIAA

SEQ ID NO: 1550975 - protein, 18 aa, Mycobacterium tuberculosis
LESGCFARIRADQLAPVI

SEQ ID NO: 1550976 - protein, 18 aa, Mycobacterium tuberculosis
LFASEVAMEIALNAVRIH

SEQ ID NO: 1550977 - protein, 19 aa, Mycobacterium tuberculosis
LFDVHEIVEIGPFTIPQVD

SEQ ID NO: 1550978 - protein, 29 aa, Mycobacterium tuberculosis
LFKGIARGVKEFAPLIGVRKAGLFTSSSF

SEQ ID NO: 1550979 - protein, 22 aa, Mycobacterium tuberculosis
LFPGGEGRLRLTEPDDMLTTGI

SEQ ID NO: 1550980 - protein, 21 aa, Mycobacterium tuberculosis
LFRHRRRVRRFAPAAPAPPTP

SEQ ID NO: 1550981 - protein, 19 aa, Mycobacterium tuberculosis
LGALLMLPGVRGLGPGPVT

SEQ ID NO: 1550982 - protein, 19 aa, Mycobacterium tuberculosis
LGARAALFHEQFVQALTGA

SEQ ID NO: 1550983 - protein, 19 aa, Mycobacterium tuberculosis
LGASPVWHTFCIDQCSIAF

SEQ ID NO: 1550984 - protein, 20 aa, Mycobacterium tuberculosis
LGESRTALAAALETQDGPRL

SEQ ID NO: 1550985 - protein, 28 aa, Mycobacterium tuberculosis
LGGAGGAAGQLFSASGAAGNAGVGGAGG

SEQ ID NO: 1550986 - protein, 23 aa, Mycobacterium tuberculosis
LGGAHPSTWYKAFNYNLATSQPI

SEQ ID NO: 1550987 - protein, 24 aa, Mycobacterium tuberculosis
LGGARMPGIPWYEYTNQAGSQYFP

SEQ ID NO: 1550988 - protein, 22 aa, Mycobacterium tuberculosis
LGGLKAALAIAGREAAADLARM

SEQ ID NO: 1550989 - protein, 18 aa, Mycobacterium tuberculosis
LGGNGGWLYGNGGAGGIG

SEQ ID NO: 1550990 - protein, 17 aa, Mycobacterium tuberculosis
LGGVFGDGGAGGTGGLG

SEQ ID NO: 1550991 - protein, 18 aa, Mycobacterium tuberculosis
LGIDAAGLLARWQRWLMG

SEQ ID NO: 1550992 - protein, 21 aa, Mycobacterium tuberculosis
LGIDIGKNGQINLGFGNTGSG

SEQ ID NO: 1550993 - protein, 25 aa, Mycobacterium tuberculosis
LGLSLLWVLRGWRRPDDVRVRPTAA

SEQ ID NO: 1550994 - protein, 23 aa, Mycobacterium tuberculosis
LGPCPQHRYSFINVRRVASGSNT

SEQ ID NO: 1550995 - protein, 30 aa, Mycobacterium tuberculosis
LGPFTIPEIHIPKIPIDVLGSVGLGQTTIS

SEQ ID NO: 1550996 - protein, 24 aa, Mycobacterium tuberculosis
LGQHGVNIMEFCKAYNAATENQRG

SEQ ID NO: 1550997 - protein, 17 aa, Mycobacterium tuberculosis
LGSAATDLAALGSVLGA

SEQ ID NO: 1550998 - protein, 30 aa, Mycobacterium tuberculosis; identical to SEQ ID NO: 1473333

SEQ ID NO: 1550999 - protein, 25 aa, Mycobacterium tuberculosis
LGSPGGSMIIQFFVKTLVAMLDWGL

SEQ ID NO: 1551000 - protein, 19 aa, Mycobacterium tuberculosis
LGVEASLRSLARVAPTQRH

SEQ ID NO: 1551001 - protein, 17 aa, Mycobacterium tuberculosis
LGVHRIFLITVALALLT

SEQ ID NO: 1551002 - protein, 18 aa, Mycobacterium tuberculosis
LGVHRIFLITVALALLTA

SEQ ID NO: 1551003 - protein, 19 aa, Mycobacterium tuberculosis
LHAPTRLALLTGLAPHQVT

SEQ ID NO: 1551004 - protein, 17 aa, Mycobacterium tuberculosis
LHFCRLPDQLAEIDTEL

SEQ ID NO: 1551005 - protein, 21 aa, Mycobacterium tuberculosis
LIGGFKPVFRALDPAKVNNIV

SEQ ID NO: 1551006 - protein, 25 aa, Mycobacterium tuberculosis
LIGNGGDGGPGMFGGPGGAGGSGGT

SEQ ID NO: 1551007 - protein, 19 aa, Mycobacterium tuberculosis
LINNAFRVPSMKPLAGTTF

SEQ ID NO: 1551008 - protein, 23 aa, Mycobacterium tuberculosis
LINQWYYNPEFFAIMSDCANTQI

SEQ ID NO: 1551009 - protein, 20 aa, Mycobacterium tuberculosis
LIVWPPSRWGVVRSVNPQQG

SEQ ID NO: 1551010 - protein, 18 aa, Mycobacterium tuberculosis
LKAWQRMGRPTIAVNANF

SEQ ID NO: 1551011 - protein, 17 aa, Mycobacterium tuberculosis
LKLAWVMVVTAPAAPPP

SEQ ID NO: 1551012 - protein, 28 aa, Mycobacterium tuberculosis
LKMARCRPWLWRQLELAGRDWAHRVDAR

SEQ ID NO: 1551013 - protein, 19 aa, Mycobacterium tuberculosis
LKNFFSFAEILDIDRYRID

SEQ ID NO: 1551014 - protein, 18 aa, Mycobacterium tuberculosis
LLAGCQFGGLNSLPLPGT

SEQ ID NO: 1551015 - protein, 18 aa, Mycobacterium tuberculosis
LLALGALLHDIGKGRGTD

SEQ ID NO: 1551016 - protein, 17 aa, Mycobacterium tuberculosis
LLATDAIVVLVSAQQKA

SEQ ID NO: 1551017 - protein, 18 aa, Mycobacterium tuberculosis
LLDKPVKWMEDRSENLTS

SEQ ID NO: 1551018 - protein, 17 aa, Mycobacterium tuberculosis
LLGRPLIGNGADGLPGQ

SEQ ID NO: 1551019 - protein, 22 aa, Mycobacterium tuberculosis
LLGVDHGRGWPPADVQTAQHAS

SEQ ID NO: 1551020 - protein, 27 aa, Mycobacterium tuberculosis
LLHSQAAGSRACRWMRRNIRVTLGAAT

SEQ ID NO: 1551021 - protein, 18 aa, Mycobacterium tuberculosis
LLLGRPLIGNGANGAPGT

SEQ ID NO: 1551022 - protein, 23 aa, Mycobacterium tuberculosis
LLLQAAKSLGWRAAPIPRNAPGC

SEQ ID NO: 1551023 - protein, 17 aa, Mycobacterium tuberculosis
LLLVLAFAGGDAVAACK

SEQ ID NO: 1551024 - protein, 17 aa, Mycobacterium tuberculosis
LLPSRKEGWGLAVIEAA

SEQ ID NO: 1551025 - protein, 17 aa, Mycobacterium tuberculosis
LLSGDRVIPQWVKVRNV

SEQ ID NO: 1551026 - protein, 17 aa, Mycobacterium tuberculosis
LLSGLGITGSIDISGIQ

SEQ ID NO: 1551027 - protein, 17 aa, Mycobacterium tuberculosis
LLVAAALSLGCGVAAAD

SEQ ID NO: 1551028 - protein, 18 aa, Mycobacterium tuberculosis
LLVVSALATLSGLGTPVA

SEQ ID NO: 1551029 - protein, 19 aa, Mycobacterium tuberculosis
LMAELPAGGVMVVVAASEE

SEQ ID NO: 1551030 - protein, 18 aa, Mycobacterium tuberculosis
LMAGAGPAPMLAAAAGWQ

SEQ ID NO: 1551031 - protein, 29 aa, Mycobacterium tuberculosis
LMAGAGPAPMLAAAVGWQTLSAALDAQAV

SEQ ID NO: 1551032 - protein, 20 aa, Mycobacterium tuberculosis
LMGAFPMRLILATMLVAGRL

SEQ ID NO: 1551033 - protein, 22 aa, Mycobacterium tuberculosis
LMPASSAARCAARIVGGPRLYG

SEQ ID NO: 1551034 - protein, 23 aa, Mycobacterium tuberculosis
LMPASSAARCAARIVGGRCLMPA

SEQ ID NO: 1551035 - protein, 26 aa, Mycobacterium tuberculosis
LMRPRIASRVLGKWARTRLSGQKTLI

SEQ ID NO: 1551036 - protein, 24 aa, Mycobacterium tuberculosis
LMSRAGYPTACFVSINRHKSVANY

SEQ ID NO: 1551037 - protein, 20 aa, Mycobacterium tuberculosis
LMTGAGYWVAHGALGGITIS

SEQ ID NO: 1551038 - protein, 22 aa, Mycobacterium tuberculosis
LMTVKAISLLPVCGVTLDRGSP

SEQ ID NO: 1551039 - protein, 20 aa, Mycobacterium tuberculosis
LMVSTSLAWTGRVAPPGTFG

SEQ ID NO: 1551040 - protein, 19 aa, Mycobacterium tuberculosis
LNASALDLATPGFLSGIGN

SEQ ID NO: 1551041 - protein, 18 aa, Mycobacterium tuberculosis
LNDYVGVYANDYWGPATV

SEQ ID NO: 1551042 - protein, 20 aa, Mycobacterium tuberculosis
LNLHAIGGVGPVDIVGGNVP

SEQ ID NO: 1551043 - protein, 26 aa, Mycobacterium tuberculosis
LNLLLVDFKGGATFLDLAGAPHVAAV

SEQ ID NO: 1551044 - protein, 17 aa, Mycobacterium tuberculosis
LNQNYLRDIRLIRRGKI

SEQ ID NO: 1551045 - protein, 17 aa, Mycobacterium tuberculosis
LNVGFASLGGFNFGGAT

SEQ ID NO: 1551046 - protein, 18 aa, Mycobacterium tuberculosis
LPADIIITATGLNLQLFG

SEQ ID NO: 1551047 - protein, 19 aa, Mycobacterium tuberculosis
LPAGSPVRLCMAAVNRDGS

SEQ ID NO: 1551048 - protein, 19 aa, Mycobacterium tuberculosis
LPAKFLEGFVRTSNIKFQD

SEQ ID NO: 1551049 - protein, 19 aa, Mycobacterium tuberculosis
LPCFHDMGMVGFLTIPMFF

SEQ ID NO: 1551050 - protein, 21 aa, Mycobacterium tuberculosis
LPDMFTRLMLSLAATGIAPGS

SEQ ID NO: 1551051 - protein, 17 aa, Mycobacterium tuberculosis
LPDRQRHASLLPLLHNY

SEQ ID NO: 1551052 - protein, 20 aa, Mycobacterium tuberculosis
LPFETLFEPAISYGRNGFLV

SEQ ID NO: 1551053 - protein, 17 aa, Mycobacterium tuberculosis
LPIGQGLSMTLLQMTGM

SEQ ID NO: 1551054 - protein, 20 aa, Mycobacterium tuberculosis
LPKLPQCIPNVVLGTTDGAL

SEQ ID NO: 1551055 - protein, 17 aa, Mycobacterium tuberculosis
LPLHLALNLTVPDSSIP

SEQ ID NO: 1551056 - protein, 24 aa, Mycobacterium tuberculosis
LPMPEFKPPIPVRWSPTSPIPMLP

SEQ ID NO: 1551057 - protein, 18 aa, Mycobacterium tuberculosis
LPPGLPPGVVANLAATLA

SEQ ID NO: 1551058 - protein, 19 aa, Mycobacterium tuberculosis
LPPPAALTGEWFGALAVIA

SEQ ID NO: 1551059 - protein, 18 aa, Mycobacterium tuberculosis
LPQAVPHSGAVVLNADDP

SEQ ID NO: 1551060 - protein, 27 aa, Mycobacterium tuberculosis
LPSSTQLPVWLAHAGIDVLRSHPIVAV

SEQ ID NO: 1551061 - protein, 21 aa, Mycobacterium tuberculosis
LPSWGSGAIWCRRPHRLPVMT

SEQ ID NO: 1551062 - protein, 21 aa, Mycobacterium tuberculosis
LPTAVGHRLRRCGDRGRAGCH

SEQ ID NO: 1551063 - protein, 17 aa, Mycobacterium tuberculosis
LPVMGQKYISQGAISKG

SEQ ID NO: 1551064 - protein, 20 aa, Mycobacterium tuberculosis
LPVTVFRCDMILADTSYTGQ

SEQ ID NO: 1551065 - protein, 19 aa, Mycobacterium tuberculosis
LQALQLELLNAINAPTLAL

SEQ ID NO: 1551066 - protein, 24 aa, Mycobacterium tuberculosis
LQHASMLFLPVRILTSPITTLASM

SEQ ID NO: 1551067 - protein, 18 aa, Mycobacterium tuberculosis
LQHYSWRIMPENLEDAGV

SEQ ID NO: 1551068 - protein, 27 aa, Mycobacterium tuberculosis
LQNFSGRARMSSMLWTFQVNQADGVAC

SEQ ID NO: 1551069 - protein, 23 aa, Mycobacterium tuberculosis
LQPEIPYYSATSFDPREEPYCDA

SEQ ID NO: 1551070 - protein, 25 aa, Mycobacterium tuberculosis
LQPGPCATSGWPTPAPATSGSGWWG

SEQ ID NO: 1551071 - protein, 17 aa, Mycobacterium tuberculosis
LQQALANQNWAALPGLQ

SEQ ID NO: 1551072 - protein, 18 aa, Mycobacterium tuberculosis
LQQFSWRIMPENLEDAGV

SEQ ID NO: 1551073 - protein, 22 aa, Mycobacterium tuberculosis
LQRARLAPIRLRIGVHTGEVAL

SEQ ID NO: 1551074 - protein, 17 aa, Mycobacterium tuberculosis
LQTLGLRVDGVGSELTV

SEQ ID NO: 1551075 - protein, 17 aa, Mycobacterium tuberculosis
LQVILDRQIMRKLAGHG

SEQ ID NO: 1551076 - protein, 17 aa, Mycobacterium tuberculosis
LQWVSIPAWALCVAFCD

SEQ ID NO: 1551077 - protein, 19 aa, Mycobacterium tuberculosis
LRAASLLDKIGEDHIFMTL

SEQ ID NO: 1551078 - protein, 37 aa, Mycobacterium tuberculosis; identical to SEQ ID NO: 202853

SEQ ID NO: 1551079 - protein, 18 aa, Mycobacterium tuberculosis
LRGLPGLGQVASAISGGA

SEQ ID NO: 1551080 - protein, 19 aa, Mycobacterium tuberculosis
LRKRLTGLLGAFRAFSYGS

SEQ ID NO: 1551081 - protein, 17 aa, Mycobacterium tuberculosis
LRLADGHPTEHSLRVYT

SEQ ID NO: 1551082 - protein, 17 aa, Mycobacterium tuberculosis
LRLALTGKRKPYIYTST

SEQ ID NO: 1551083 - protein, 17 aa, Mycobacterium tuberculosis
LRLIVWELVARHSASRP

SEQ ID NO: 1551084 - protein, 17 aa, Mycobacterium tuberculosis
LRMRPTVLEVRHDLPTS

SEQ ID NO: 1551085 - protein, 24 aa, Mycobacterium tuberculosis
LRNHARWAVLLRNLRFVIVDECHY

SEQ ID NO: 1551086 - protein, 17 aa, Mycobacterium tuberculosis
LRPRTVITGQRRWTLPA

SEQ ID NO: 1551087 - protein, 17 aa, Mycobacterium tuberculosis
LRQRISQQLFSFGDPTV

SEQ ID NO: 1551088 - protein, 18 aa, Mycobacterium tuberculosis
LRRIAALCAAFDVDGMRA

SEQ ID NO: 1551089 - protein, 20 aa, Mycobacterium tuberculosis
LRRIAALCAAFRRGRHAGRS

SEQ ID NO: 1551090 - protein, 25 aa, Mycobacterium tuberculosis
LRRLDLKRGEPVLITAHTNLEFLSC

SEQ ID NO: 1551091 - protein, 18 aa, Mycobacterium tuberculosis
LRRLLSLFEQLREQSQII

SEQ ID NO: 1551092 - protein, 20 aa, Mycobacterium tuberculosis
LRSLPGCHLLVRPEVMRRDV

SEQ ID NO: 1551093 - protein, 19 aa, Mycobacterium tuberculosis
LRSPFGPGPTRTCARSCRR

SEQ ID NO: 1551094 - protein, 17 aa, Mycobacterium tuberculosis
LRSTVPVTLTADRSGLV

SEQ ID NO: 1551095 - protein, 17 aa, Mycobacterium tuberculosis
LRTADRGSWALADATVD

SEQ ID NO: 1551096 - protein, 25 aa, Mycobacterium tuberculosis
LRTELLRRGIVFAMARVKQDLRESL

SEQ ID NO: 1551097 - protein, 18 aa, Mycobacterium tuberculosis
LRVADLFDSQGIWLVSSM

SEQ ID NO: 1551098 - protein, 17 aa, Mycobacterium tuberculosis
LRVAGAYASAEAAAAAP

SEQ ID NO: 1551099 - protein, 20 aa, Mycobacterium tuberculosis
LSAAAARAAGAAAQAKAVAS

SEQ ID NO: 1551100 - protein, 19 aa, Mycobacterium tuberculosis
LSAHVAAFHDQFVHTLTAG

SEQ ID NO: 1551101 - protein, 23 aa, Mycobacterium tuberculosis
LSAIRAIGGRGEVLAVGSGAPVA

SEQ ID NO: 1551102 - protein, 19 aa, Mycobacterium tuberculosis
LSAKGAKTFAVDAASAYCP

SEQ ID NO: 1551103 - protein, 18 aa, Mycobacterium tuberculosis
LSERGEGVTTLAADAAVA

SEQ ID NO: 1551104 - protein, 20 aa, Mycobacterium tuberculosis
LSGAVPVGIVGDAGQWVKTG

SEQ ID NO: 1551105 - protein, 20 aa, Mycobacterium tuberculosis
LSGLDLPAWGSLRLAMPSSG

SEQ ID NO: 1551106 - protein, 22 aa, Mycobacterium tuberculosis
LSGSGARYGRQGIEYWEHQGEV

SEQ ID NO: 1551107 - protein, 21 aa, Mycobacterium tuberculosis
LSKLTPWKAPPPIAHSTVLVA

SEQ ID NO: 1551108 - protein, 17 aa, Mycobacterium tuberculosis
LSKLVRHHLLLPITATR

SEQ ID NO: 1551109 - protein, 24 aa, Mycobacterium tuberculosis
LSLDEACLLMFARRDLTAAEASAA

SEQ ID NO: 1551110 - protein, 25 aa, Mycobacterium tuberculosis
LSLPADLPALASGVIPAAPIAPTPP

SEQ ID NO: 1551111 - protein, 20 aa, Mycobacterium tuberculosis
LSQRDIVLWAAHVVDRVAAG

SEQ ID NO: 1551112 - protein, 18 aa, Mycobacterium tuberculosis
LSRQTAEMLLAMGNSPDS

SEQ ID NO: 1551113 - protein, 22 aa, Mycobacterium tuberculosis
LSRRLRIPAALAGVGAGLAIAD

SEQ ID NO: 1551114 - protein, 25 aa, Mycobacterium tuberculosis
LSSLRAVAVGGDWVRPDLARRLQVQ

SEQ ID NO: 1551115 - protein, 32 aa, Mycobacterium tuberculosis; identical to SEQ ID NO: 1474863

SEQ ID NO: 1551116 - protein, 23 aa, Mycobacterium tuberculosis
LSTLRFALSGAEPVEPADVEDLL

SEQ ID NO: 1551117 - protein, 18 aa, Mycobacterium tuberculosis
LSVPDAWAAAKHVLSPEI

SEQ ID NO: 1551118 - protein, 19 aa, Mycobacterium tuberculosis
LSVPPDWAARARWANPAAW

SEQ ID NO: 1551119 - protein, 18 aa, Mycobacterium tuberculosis
LTAAARWYTATEIANAAA

SEQ ID NO: 1551120 - protein, 18 aa, Mycobacterium tuberculosis
LTALVAGGLPMLAAAGLP

SEQ ID NO: 1551121 - protein, 24 aa, Mycobacterium tuberculosis
LTDRCHPTRHGVGLTAADKIDHLP

SEQ ID NO: 1551122 - protein, 24 aa, Mycobacterium tuberculosis
LTESGLRPGWHRVPGVSASGSDSA

SEQ ID NO: 1551123 - protein, 28 aa, Mycobacterium tuberculosis
LTIPEIPAHLDVNIPIDIPITGSFTDLV

SEQ ID NO: 1551124 - protein, 22 aa, Mycobacterium tuberculosis
LTIPMFFGAELVKVTPMDFLRD

SEQ ID NO: 1551125 - protein, 17 aa, Mycobacterium tuberculosis
LTLNFGVANQGGLNAGI

SEQ ID NO: 1551126 - protein, 17 aa, Mycobacterium tuberculosis
LTLNLGVGNIGSLNLGS

SEQ ID NO: 1551127 - protein, 27 aa, Mycobacterium tuberculosis
LTMTGPRPGGFGALDGRTNEICAQGDL

SEQ ID NO: 1551128 - protein, 17 aa, Mycobacterium tuberculosis
LTNAVAFLSAAVVSGGT

SEQ ID NO: 1551129 - protein, 24 aa, Mycobacterium tuberculosis
LTRSLSLLATFPFPNETFQNFQRG

SEQ ID NO: 1551130 - protein, 19 aa, Mycobacterium tuberculosis
LTSVLSHRSAEIALHRANA

SEQ ID NO: 1551131 - protein, 19 aa, Mycobacterium tuberculosis
LTSVLSHRSAEMALHRANA

SEQ ID NO: 1551132 - protein, 17 aa, Mycobacterium tuberculosis
LTVDLPPIVDLRTRLLP

SEQ ID NO: 1551133 - protein, 17 aa, Mycobacterium tuberculosis
LTWVPAGGGAPVGNPAD

SEQ ID NO: 1551134 - protein, 22 aa, Mycobacterium tuberculosis
LTWVPAGGGAPVGNPADLQSLL

SEQ ID NO: 1551135 - protein, 19 aa, Mycobacterium tuberculosis
LTYHAVGGIGPLHVAPVPI

SEQ ID NO: 1551136 - protein, 18 aa, Mycobacterium tuberculosis
LTYNFTFKFEKAGQGSVM

SEQ ID NO: 1551137 - protein, 18 aa, Mycobacterium tuberculosis
LVAANRADLVSLVMSNLF

SEQ ID NO: 1551138 - protein, 27 aa, Mycobacterium tuberculosis
LVARRLCPRILLACLFVAELIGAAALS

SEQ ID NO: 1551139 - protein, 26 aa, Mycobacterium tuberculosis
LVCGHGPAKWAFRSWCTSRSCDTLPV

SEQ ID NO: 1551140 - protein, 28 aa, Mycobacterium tuberculosis
LVDLILFDWPTHMLQLATWLAENPQLLV

SEQ ID NO: 1551141 - protein, 18 aa, Mycobacterium tuberculosis
LVIATLFLVRSMNQQLKK

SEQ ID NO: 1551142 - protein, 19 aa, Mycobacterium tuberculosis
LVIGYRLARGIMHNLTAAN

SEQ ID NO: 1551143 - protein, 17 aa, Mycobacterium tuberculosis
LVISPVLLAVRPELQQA

SEQ ID NO: 1551144 - protein, 20 aa, Mycobacterium tuberculosis
LVKPPSALMRPRIASRVLGK

SEQ ID NO: 1551145 - protein, 17 aa, Mycobacterium tuberculosis
LVLASSMVVYGQGRYDC

SEQ ID NO: 1551146 - protein, 20 aa, Mycobacterium tuberculosis
LVMGGRRGGGAASIKVATGG

SEQ ID NO: 1551147 - protein, 24 aa, Mycobacterium tuberculosis
LVNWDVREGVFAPGVIDAMFTHQV

SEQ ID NO: 1551148 - protein, 23 aa, Mycobacterium tuberculosis
LVPRTPAALYWGARLTLVSRVDE

SEQ ID NO: 1551149 - protein, 24 aa, Mycobacterium tuberculosis
LVPVLRPRGLFAHDVDLAGEATPT

SEQ ID NO: 1551150 - protein, 19 aa, Mycobacterium tuberculosis
LVRHHLLLPITATRRDLND

SEQ ID NO: 1551151 - protein, 27 aa, Mycobacterium tuberculosis
LVSSWQMPGGIYAPMMHPWSTGKDVYF

SEQ ID NO: 1551152 - protein, 17 aa, Mycobacterium tuberculosis
LVTRVPQGWSFAQAAAV

SEQ ID NO: 1551153 - protein, 17 aa, Mycobacterium tuberculosis
LVVIAGLQDGLWPNTVP

SEQ ID NO: 1551154 - protein, 18 aa, Mycobacterium tuberculosis
LVVSFLVPQCVWYARADP

SEQ ID NO: 1551155 - protein, 24 aa, Mycobacterium tuberculosis
LVYVRLARPFIAFYNICANAILQA

SEQ ID NO: 1551156 - protein, 24 aa, Mycobacterium tuberculosis
LWAHWCAPCMTELPVMAEYQRRVG

SEQ ID NO: 1551157 - protein, 26 aa, Mycobacterium tuberculosis
LYNAVEPWVQYGFNFTAWAVGWLPYI

SEQ ID NO: 1551158 - protein, 18 aa, Mycobacterium tuberculosis
LYSRLARHRIALKLVDRC

SEQ ID NO: 1551159 - protein, 20 aa, Mycobacterium tuberculosis
MAATVVIVAWIANRPPASSH

SEQ ID NO: 1551160 - protein, 19 aa, Mycobacterium tuberculosis
MAFSRHCWCATARACLVEA

SEQ ID NO: 1551161 - protein, 17 aa, Mycobacterium tuberculosis
MAKSVLLAMSHSLATEL

SEQ ID NO: 1551162 - protein, 23 aa, Mycobacterium tuberculosis
MAPAAAPYAGWLGSVAAQAVAVA

SEQ ID NO: 1551163 - protein, 20 aa, Mycobacterium tuberculosis
MAVEPIIWRTYAQTLPPDAI

SEQ ID NO: 1551164 - protein, 17 aa, Mycobacterium tuberculosis
MDLPAEIRNRYDGRSLR

SEQ ID NO: 1551165 - protein, 23 aa, Mycobacterium tuberculosis
MELFKTALRLARHRELVDGADAT

SEQ ID NO: 1551166 - protein, 26 aa, Mycobacterium tuberculosis
MFATRPRWHPPVTIPPLPHHSHTASP

SEQ ID NO: 1551167 - protein, 22 aa, Mycobacterium tuberculosis
MFEVIKHPSLESVKVMRGCLVQ

SEQ ID NO: 1551168 - protein, 24 aa, Mycobacterium tuberculosis
MFRGQRTRRGCVGKPIGQHHRQGR

SEQ ID NO: 1551169 - protein, 23 aa, Mycobacterium tuberculosis
MGLVEIRPELRAVTVDGDLVGAG

SEQ ID NO: 1551170 - protein, 25 aa, Mycobacterium tuberculosis
MGRGRRMRMSWLRSAAPCRPVTDGI

SEQ ID NO: 1551171 - protein, 20 aa, Mycobacterium tuberculosis
MGVVLGSGFFSDTLLSSLRS

SEQ ID NO: 1551172 - protein, 27 aa, Mycobacterium tuberculosis
MIAAVVASCGWRGLNSLPLPGTQGNGP

SEQ ID NO: 1551173 - protein, 19 aa, Mycobacterium tuberculosis
MLTAAEWTAVLINMNADNI

SEQ ID NO: 1551174 - protein, 21 aa, Mycobacterium tuberculosis
MLTTLPKFPGLPGLPSLPDII

SEQ ID NO: 1551175 - protein, 20 aa, Mycobacterium tuberculosis
MMAAGAAWNGLAAELGTTAA

SEQ ID NO: 1551176 - protein, 23 aa, Mycobacterium tuberculosis
MNNRCPLTSYVLIGFSQGAVIAG

SEQ ID NO: 1551177 - protein, 28 aa, Mycobacterium tuberculosis
MPDPYQAFVLMAAWLAMRYGELTELRRK

SEQ ID NO: 1551178 - protein, 25 aa, Mycobacterium tuberculosis
MPGAGGNGGNANWFGSGGAGGQGGT

SEQ ID NO: 1551179 - protein, 25 aa, Mycobacterium tuberculosis
MQFISETWRLYGVAARNDGIANVDN

SEQ ID NO: 1551180 - protein, 21 aa, Mycobacterium tuberculosis
MQPYAAIYLHLMRAAVLRRGR

SEQ ID NO: 1551181 - protein, 19 aa, Mycobacterium tuberculosis
MRFDRTNGYTAEFSNVSGL

SEQ ID NO: 1551182 - protein, 19 aa, Mycobacterium tuberculosis
MRVTLHYSNKYQVPATATA

SEQ ID NO: 1551183 - protein, 28 aa, Mycobacterium tuberculosis
MSAELGKARLVGAMSVPPTWEGSVPARM

SEQ ID NO: 1551184 - protein, 18 aa, Mycobacterium tuberculosis
MSDEEWDAVIAVHLRGHF

SEQ ID NO: 1551185 - protein, 19 aa, Mycobacterium tuberculosis
MSDEEWDAVIAVHLRGHFL

SEQ ID NO: 1551186 - protein, 18 aa, Mycobacterium tuberculosis
MSFVIAAPEVIAAAATDL

SEQ ID NO: 1551187 - protein, 19 aa, Mycobacterium tuberculosis
MSGLRVVNDLEFTVRLKAP

SEQ ID NO: 1551188 - protein, 21 aa, Mycobacterium tuberculosis
MSIARCVGNTLLLNGRTYSPP

SEQ ID NO: 1551189 - protein, 30 aa, Mycobacterium tuberculosis; identical to SEQ ID NO: 1472049

SEQ ID NO: 1551190 - protein, 24 aa, Mycobacterium tuberculosis
MTGVAASYARWLTTAAAQAEQAAG

SEQ ID NO: 1551191 - protein, 20 aa, Mycobacterium tuberculosis
MVELFPGIVERIDTQLPNWW

SEQ ID NO: 1551192 - protein, 24 aa, Mycobacterium tuberculosis
MVGIPGCQPGNGGMMIGTGIGTGA

SEQ ID NO: 1551193 - protein, 26 aa, Mycobacterium tuberculosis
MVGIPGCQPGNGGMMIGTGIGTGAGT

SEQ ID NO: 1551194 - protein, 17 aa, Mycobacterium tuberculosis
MWALDVAAMAGYHFDAS

SEQ ID NO: 1551195 - protein, 25 aa, Mycobacterium tuberculosis
MWGPRTGPHIRTCRSRVTYGVISDF

SEQ ID NO: 1551196 - protein, 17 aa, Mycobacterium tuberculosis
MYSNYGFTVLAESVQRE

SEQ ID NO: 1551197 - protein, 36 aa, Mycobacterium tuberculosis
NAGLLFGAGGHRWIRRKPGLGWGTVGPVGPAATPGC

SEQ ID NO: 1551198 - protein, 26 aa, Mycobacterium tuberculosis
NAGMFGDGGNGGFSFFDGNGGDGGTG

SEQ ID NO: 1551199 - protein, 18 aa, Mycobacterium tuberculosis
NAGSGSWGLANVGVGNIG

SEQ ID NO: 1551200 - protein, 19 aa, Mycobacterium tuberculosis
NAGSNNWGLANLGVGNIGL

SEQ ID NO: 1551201 - protein, 24 aa, Mycobacterium tuberculosis
NAGWLGFGGAGGIGGIGGNANGGA

SEQ ID NO: 1551202 - protein, 21 aa, Mycobacterium tuberculosis
NAGWLGFGGAGGVGGSAGLIG

SEQ ID NO: 1551203 - protein, 17 aa, Mycobacterium tuberculosis
NAMAAVRTTALAPAAAD

SEQ ID NO: 1551204 - protein, 23 aa, Mycobacterium tuberculosis
NAPGCRGCCQCAIGCPATPSSAC

SEQ ID NO: 1551205 - protein, 27 aa, Mycobacterium tuberculosis
NAPTQLWLGRPLIGDGVHGAPGTGQPG

SEQ ID NO: 1551206 - protein, 26 aa, Mycobacterium tuberculosis
NCTGCRAADATTCWPSSPTRSAPRWV

SEQ ID NO: 1551207 - protein, 19 aa, Mycobacterium tuberculosis
NDLRGNPTLREVLQRTRQM

SEQ ID NO: 1551208 - protein, 21 aa, Mycobacterium tuberculosis
NDRGACLAGVVIDDGLRPKVV

SEQ ID NO: 1551209 - protein, 27 aa, Mycobacterium tuberculosis
NDSNGILWRGNFEGLFSAYLGFTIEQF

SEQ ID NO: 1551210 - protein, 28 aa, Mycobacterium tuberculosis
NDSNGILWRGNFEGLFSAYLGFTIEQFP

SEQ ID NO: 1551211 - protein, 20 aa, Mycobacterium tuberculosis
NETDGGFGPSSRIVRFSAAD

SEQ ID NO: 1551212 - protein, 20 aa, Mycobacterium tuberculosis
NETKQFVGRCVDKMGKNFLA

SEQ ID NO: 1551213 - protein, 23 aa, Mycobacterium tuberculosis
NFGNPNPPAIGFFISNLSITGPQ

SEQ ID NO: 1551214 - protein, 23 aa, Mycobacterium tuberculosis
NFGSGNGRAGLPGSGNVGNGNLG

SEQ ID NO: 1551215 - protein, 22 aa, Mycobacterium tuberculosis
NFRDVLVALGIYPGAAELGAEG

SEQ ID NO: 1551216 - protein, 22 aa, Mycobacterium tuberculosis
NFRDVVAALGMYPGQAPPLGAE

SEQ ID NO: 1551217 - protein, 17 aa, Mycobacterium tuberculosis
NGFDVGRRLGIGSRETY

SEQ ID NO: 1551218 - protein, 32 aa, Mycobacterium tuberculosis; identical to SEQ ID NO: 233926

SEQ ID NO: 1551219 - protein, 24 aa, Mycobacterium tuberculosis
NGGAGGNGGWLYGSGGNGGAGGAG

SEQ ID NO: 1551220 - protein, 18 aa, Mycobacterium tuberculosis
NGGLAGIGGNAGFVGNGG

SEQ ID NO: 1551221 - protein, 26 aa, Mycobacterium tuberculosis
NGMWGAPQLGRWKWHDPSVHASLLAQ

SEQ ID NO: 1551222 - protein, 31 aa, Mycobacterium tuberculosis; identical to SEQ ID NO: 1477458

SEQ ID NO: 1551223 - protein, 19 aa, Mycobacterium tuberculosis
NGQIGFGSFNSGSGNIGLF

SEQ ID NO: 1551224 - protein, 34 aa, Mycobacterium tuberculosis
NGSGGAGGTCGQVVAGGAGISFSNGSNGGTGGTG

SEQ ID NO: 1551225 - protein, 17 aa, Mycobacterium tuberculosis
NHIKIKEAYGLTKQYVA

SEQ ID NO: 1551226 - protein, 21 aa, Mycobacterium tuberculosis
NHLPLTLPLRYLGMSDAEVDQ

SEQ ID NO: 1551227 - protein, 18 aa, Mycobacterium tuberculosis
NHRAGRLSPGSAENAPAA

SEQ ID NO: 1551228 - protein, 19 aa, Mycobacterium tuberculosis
NHRPEVRGGVLARECAAPL

SEQ ID NO: 1551229 - protein, 25 aa, Mycobacterium tuberculosis
NHSNGLLWRGDNQGLIDLAIGVDIP

SEQ ID NO: 1551230 - protein, 24 aa, Mycobacterium tuberculosis
NIAYKKKLWQAIRAQDVCGNDALD

SEQ ID NO: 1551231 - protein, 24 aa, Mycobacterium tuberculosis
NIPIIDIPAAPGFGNSTQMPSSGF

SEQ ID NO: 1551232 - protein, 19 aa, Mycobacterium tuberculosis
NIQPLQHYSWRIMPENLED

SEQ ID NO: 1551233 - protein, 25 aa, Mycobacterium tuberculosis
NLDPAVVLAGWPAVERAARAVVDDG

SEQ ID NO: 1551234 - protein, 17 aa, Mycobacterium tuberculosis
NLEDAGVSWKVYQNKLL

SEQ ID NO: 1551235 - protein, 19 aa, Mycobacterium tuberculosis
NLFIKIRDPDHLAGHRQPD

SEQ ID NO: 1551236 - protein, 19 aa, Mycobacterium tuberculosis
NLLEEIGILLLPIAPELTP

SEQ ID NO: 1551237 - protein, 22 aa, Mycobacterium tuberculosis
NLPRVNAHGGPGGRPGCWQTIT

SEQ ID NO: 1551238 - protein, 19 aa, Mycobacterium tuberculosis
NLRRLLSLFEQLREQSQII

SEQ ID NO: 1551239 - protein, 28 aa, Mycobacterium tuberculosis
NLVIDMPLPISLGVNIPIDIPITASAGN

SEQ ID NO: 1551240 - protein, 22 aa, Mycobacterium tuberculosis
NMSVSNLRWSGDYVLIDVDASP

SEQ ID NO: 1551241 - protein, 25 aa, Mycobacterium tuberculosis
NNGMNFPGWAFWCPLPVLRPRSVGW

SEQ ID NO: 1551242 - protein, 18 aa, Mycobacterium tuberculosis
NNIGFGLTGDNLVVIGAL

SEQ ID NO: 1551243 - protein, 17 aa, Mycobacterium tuberculosis
NNIGFGLTGDNQIGFGA

SEQ ID NO: 1551244 - protein, 17 aa, Mycobacterium tuberculosis
NNLPAKFLEGFVRTSNI

SEQ ID NO: 1551245 - protein, 21 aa, Mycobacterium tuberculosis
NPGAVPGRAGGAGGLGGSGSD

SEQ ID NO: 1551246 - protein, 23 aa, Mycobacterium tuberculosis
NPGLPLWPYLVCGALAASAAATS

SEQ ID NO: 1551247 - protein, 20 aa, Mycobacterium tuberculosis
NPRKSCLRNVDRFRPGLLDL

SEQ ID NO: 1551248 - protein, 23 aa, Mycobacterium tuberculosis
NPSVHRFDLFVPVFRNHLVELSA

SEQ ID NO: 1551249 - protein, 18 aa, Mycobacterium tuberculosis
NPTGIGGTGGDGGTGGSA

SEQ ID NO: 1551250 - protein, 23 aa, Mycobacterium tuberculosis
NRFPDPKDRCHLATIGVQPLVPD

SEQ ID NO: 1551251 - protein, 24 aa, Mycobacterium tuberculosis
NRLPKVSWVLPGFLLSEHPAFPVN

SEQ ID NO: 1551252 - protein, 30 aa, Mycobacterium tuberculosis; identical to SEQ ID NO: 211416

SEQ ID NO: 1551253 - protein, 20 aa, Mycobacterium tuberculosis
NRNAFVQLVLSNLFGQNAPA

SEQ ID NO: 1551254 - protein, 29 aa, Mycobacterium tuberculosis
NRPTPDRVRELVVAWGKLYPQFGAVAALN

SEQ ID NO: 1551255 - protein, 33 aa, Mycobacterium tuberculosis; identical to SEQ ID NO: 1487777

SEQ ID NO: 1551256 - protein, 20 aa, Mycobacterium tuberculosis
NSGHGNTGFFNAGSFNTGML

SEQ ID NO: 1551257 - protein, 25 aa, Mycobacterium tuberculosis
NSGTCFRPSLAVQRRWRDEFGLGLA

SEQ ID NO: 1551258 - protein, 17 aa, Mycobacterium tuberculosis
NTISGWLNASALDLATP

SEQ ID NO: 1551259 - protein, 19 aa, Mycobacterium tuberculosis
NTPRGRFGVIASVSHAFCS

SEQ ID NO: 1551260 - protein, 24 aa, Mycobacterium tuberculosis
NTRVPEFLERLGVGAPEAEQDIIN

SEQ ID NO: 1551261 - protein, 22 aa, Mycobacterium tuberculosis
NTTFPVGPFFGLGVVNISGIEI

SEQ ID NO: 1551262 - protein, 18 aa, Mycobacterium tuberculosis
NTVPRGGVLGTQRLLDEL

SEQ ID NO: 1551263 - protein, 17 aa, Mycobacterium tuberculosis
NVADGDAALALLRAELR

SEQ ID NO: 1551264 - protein, 23 aa, Mycobacterium tuberculosis
NVAVRWVQNALSFIGFVPPDEND

SEQ ID NO: 1551265 - protein, 17 aa, Mycobacterium tuberculosis
NVLARWSASSRFLLNLP

SEQ ID NO: 1551266 - protein, 18 aa, Mycobacterium tuberculosis
NYGSLNWGSGNTGTGNAG

SEQ ID NO: 1551267 - protein, 22 aa, Mycobacterium tuberculosis
NYRNNWKRLGFTDDEVSRPGSD

SEQ ID NO: 1551268 - protein, 18 aa, Mycobacterium tuberculosis
NYSVGFANSGNYHIGIAN

SEQ ID NO: 1551269 - protein, 21 aa, Mycobacterium tuberculosis
PAAAEVPGFEGSAGQGGAAIL

SEQ ID NO: 1551270 - protein, 26 aa, Mycobacterium tuberculosis
PAAERAAPVATPRGCSAVVVPAAPAE

SEQ ID NO: 1551271 - protein, 22 aa, Mycobacterium tuberculosis
PAASARFCLATAGLAGAVPPVA

SEQ ID NO: 1551272 - protein, 22 aa, Mycobacterium tuberculosis
PACGKAGCQTYKWETFLTSELP

SEQ ID NO: 1551273 - protein, 26 aa, Mycobacterium tuberculosis
PADSACAPAAAGVPVVIPVVNDWPND

SEQ ID NO: 1551274 - protein, 25 aa, Mycobacterium tuberculosis
PAFALGDYEWILAFEAPELDRIVDL

SEQ ID NO: 1551275 - protein, 18 aa, Mycobacterium tuberculosis
PAFEWYYQSGLSIVMPVG

SEQ ID NO: 1551276 - protein, 19 aa, Mycobacterium tuberculosis
PAFEWYYQSGLSIVMPVGG

SEQ ID NO: 1551277 - protein, 24 aa, Mycobacterium tuberculosis
PAFPRDLPCVSPVRLGTFQPGSAR

SEQ ID NO: 1551278 - protein, 26 aa, Mycobacterium tuberculosis
PAGCSARAGGFGRRPVASATPVGPAA

SEQ ID NO: 1551279 - protein, 18 aa, Mycobacterium tuberculosis
PAKGFSRVGRPHRRRRNR

SEQ ID NO: 1551280 - protein, 18 aa, Mycobacterium tuberculosis
PAKIRRYAAVGGDHNPIH

SEQ ID NO: 1551281 - protein, 19 aa, Mycobacterium tuberculosis
PAKPIAVNIIDFGADPDRA

SEQ ID NO: 1551282 - protein, 22 aa, Mycobacterium tuberculosis
PALQRRWWAARGRGAFASVDGA

SEQ ID NO: 1551283 - protein, 17 aa, Mycobacterium tuberculosis
PANRYSRPQSERHRKRR

SEQ ID NO: 1551284 - protein, 18 aa, Mycobacterium tuberculosis
PAPARPAATAAEAATAAK

SEQ ID NO: 1551285 - protein, 25 aa, Mycobacterium tuberculosis
PAPDGVKLAAGWLVERAGFGKGYPD

SEQ ID NO: 1551286 - protein, 20 aa, Mycobacterium tuberculosis
PARARTPLPVPTPRGERPDD

SEQ ID NO: 1551287 - protein, 18 aa, Mycobacterium tuberculosis
PARLAAVGRRCRGDVAGC

SEQ ID NO: 1551288 - protein, 23 aa, Mycobacterium tuberculosis
PARLDNARFLLPVVGVPPDQATD

SEQ ID NO: 1551289 - protein, 18 aa, Mycobacterium tuberculosis
PARPAATAGCSTATAASA

SEQ ID NO: 1551290 - protein, 26 aa, Mycobacterium tuberculosis
PASAAEWLPRVIIPEATISALPPASP

SEQ ID NO: 1551291 - protein, 23 aa, Mycobacterium tuberculosis
PASIAALRRGRGALVTQQRGAGR

SEQ ID NO: 1551292 - protein, 26 aa, Mycobacterium tuberculosis
PASLELNSRPALPLAPPASPVPVVAA

SEQ ID NO: 1551293 - protein, 25 aa, Mycobacterium tuberculosis
PASLPPIGVFTLFRHRRRVRRFAPA

SEQ ID NO: 1551294 - protein, 18 aa, Mycobacterium tuberculosis
PASMLIGPMMQLAQMGTT

SEQ ID NO: 1551295 - protein, 26 aa, Mycobacterium tuberculosis
PASRERVVAVSFPRDLAITPIQCEAW

SEQ ID NO: 1551296 - protein, 25 aa, Mycobacterium tuberculosis
PAVAPVRAGPVVPRASSSAPAERPV

SEQ ID NO: 1551297 - protein, 19 aa, Mycobacterium tuberculosis
PAVEELRSPFGPGPTRTCA

SEQ ID NO: 1551298 - protein, 18 aa, Mycobacterium tuberculosis
PAVEELRSPLDQARHDGA

SEQ ID NO: 1551299 - protein, 17 aa, Mycobacterium tuberculosis
PAVTSFIAPLVAMVGGG

SEQ ID NO: 1551300 - protein, 17 aa, Mycobacterium tuberculosis
PCDASDWLDAALGNAPQ

SEQ ID NO: 1551301 - protein, 23 aa, Mycobacterium tuberculosis
PCGAMVMVLLFLGVVFLLLGWQA

SEQ ID NO: 1551302 - protein, 18 aa, Mycobacterium tuberculosis
PCRLSTKHALALTNRGGA

SEQ ID NO: 1551303 - protein, 27 aa, Mycobacterium tuberculosis
PCRSPKPRVGRKRTRGQGVGHCFGPSQ

SEQ ID NO: 1551304 - protein, 19 aa, Mycobacterium tuberculosis
PDAEVVFARGRFEPPGIGT

SEQ ID NO: 1551305 - protein, 19 aa, Mycobacterium tuberculosis
PDDGKWWLRLPDEVSGGDC

SEQ ID NO: 1551306 - protein, 17 aa, Mycobacterium tuberculosis
PDEIDVFAARVDAPIVV

SEQ ID NO: 1551307 - protein, 21 aa, Mycobacterium tuberculosis
PDGAAVRYDKLLLATGSAPRR

SEQ ID NO: 1551308 - protein, 17 aa, Mycobacterium tuberculosis
PDIPININETLYLGPLV

SEQ ID NO: 1551309 - protein, 20 aa, Mycobacterium tuberculosis
PDPRAADIVETWAHVLDQLE

SEQ ID NO: 1551310 - protein, 22 aa, Mycobacterium tuberculosis
PDPRAADIVETWAHVLDQLERD

SEQ ID NO: 1551311 - protein, 18 aa, Mycobacterium tuberculosis
PDPSCVVRATAINGNGSR

SEQ ID NO: 1551312 - protein, 18 aa, Mycobacterium tuberculosis
PDSGPVFQVAGAVTAVAA

SEQ ID NO: 1551313 - protein, 24 aa, Mycobacterium tuberculosis
PDSILRVLAMHRFAKAPMLVGGQM

SEQ ID NO: 1551314 - protein, 25 aa, Mycobacterium tuberculosis
PDSILRVLAMHRFAKAPMLVGGQML

SEQ ID NO: 1551315 - protein, 20 aa, Mycobacterium tuberculosis
PEALAAAASDVANIGSALSA

SEQ ID NO: 1551316 - protein, 20 aa, Mycobacterium tuberculosis
PEDLFEVQRSLLAKYHVDEP

SEQ ID NO: 1551317 - protein, 20 aa, Mycobacterium tuberculosis
PEGTQSVALYLGKGQMLEVG

SEQ ID NO: 1551318 - protein, 19 aa, Mycobacterium tuberculosis
PEHHEFKQAAVLTDLPGEL

SEQ ID NO: 1551319 - protein, 20 aa, Mycobacterium tuberculosis
PELAMPVLVLPVFSQPVLTL

SEQ ID NO: 1551320 - protein, 19 aa, Mycobacterium tuberculosis
PELDRGQEAGFTLSAPLRS

SEQ ID NO: 1551321 - protein, 19 aa, Mycobacterium tuberculosis
PELEVPAMGVLPTVDPKVA

SEQ ID NO: 1551322 - protein, 18 aa, Mycobacterium tuberculosis
PELFLRRRGSVVASSPIK

SEQ ID NO: 1551323 - protein, 25 aa, Mycobacterium tuberculosis
PELGLRPRLAIGIHQPGGRCAAATG

SEQ ID NO: 1551324 - protein, 19 aa, Mycobacterium tuberculosis
PELRIDFPPLRVANDDVAH

SEQ ID NO: 1551325 - protein, 29 aa, Mycobacterium tuberculosis
PELTLFRRLAVFVGCFFVDDAQAVACSGD

SEQ ID NO: 1551326 - protein, 18 aa, Mycobacterium tuberculosis
PELVAAAAADLTGIGQAI

SEQ ID NO: 1551327 - protein, 21 aa, Mycobacterium tuberculosis
PEPDLPRWRRAVEVATQRWVA

SEQ ID NO: 1551328 - protein, 22 aa, Mycobacterium tuberculosis
PEPWRVEALVLLAFSAYARGDG

SEQ ID NO: 1551329 - protein, 25 aa, Mycobacterium tuberculosis
PESGVRRLRCRPVHPQPSLRRRARI

SEQ ID NO: 1551330 - protein, 19 aa, Mycobacterium tuberculosis
PESLRRLDRVDAIVIDPRV

SEQ ID NO: 1551331 - protein, 20 aa, Mycobacterium tuberculosis
PESLRRLDRVDAIVIDPRVL

SEQ ID NO: 1551332 - protein, 27 aa, Mycobacterium tuberculosis
PESVTCPSDLPAEVGAELNCEMKIKDR

SEQ ID NO: 1551333 - protein, 20 aa, Mycobacterium tuberculosis
PETVAAAALDVARIGSSIGA

SEQ ID NO: 1551334 - protein, 21 aa, Mycobacterium tuberculosis
PETVAAAALDVARIGSSIGAA

SEQ ID NO: 1551335 - protein, 31 aa, Mycobacterium tuberculosis
PETVAAAALDVARIGSSIGAANAAAAGSTTS

SEQ ID NO: 1551336 - protein, 17 aa, Mycobacterium tuberculosis
PEVGEALVSMLKDHGVG

SEQ ID NO: 1551337 - protein, 20 aa, Mycobacterium tuberculosis
PEVNSALMFAGAGSGPTLAA

SEQ ID NO: 1551338 - protein, 29 aa, Mycobacterium tuberculosis
PFDPCRDIPFDVIQRLGLAYTPPEAEEGL

SEQ ID NO: 1551339 - protein, 28 aa, Mycobacterium tuberculosis
PFDPCRDIPLDVIQRLGLAYTPPEAEEG

SEQ ID NO: 1551340 - protein, 19 aa, Mycobacterium tuberculosis
PFEDGGWVWFDITTDTAVT

SEQ ID NO: 1551341 - protein, 25 aa, Mycobacterium tuberculosis
PFEPWSVADFSRYLSTLGLPAAGDA

SEQ ID NO: 1551342 - protein, 21 aa, Mycobacterium tuberculosis
PFMEFTPGYVLRSLDELPKQG

SEQ ID NO: 1551343 - protein, 28 aa, Mycobacterium tuberculosis
PFPTMYELLSVGWGKPDLRDQWKHATQQ

SEQ ID NO: 1551344 - protein, 24 aa, Mycobacterium tuberculosis
PFSMPVPPAPPARAVTAVLAGPVR

SEQ ID NO: 1551345 - protein, 26 aa, Mycobacterium tuberculosis
PFTQQLKKLAGLSERLTSAAAAAAGP

SEQ ID NO: 1551346 - protein, 18 aa, Mycobacterium tuberculosis
PFWGGPLLGALAAAVVPG

SEQ ID NO: 1551347 - protein, 21 aa, Mycobacterium tuberculosis
PGAADFCRIRVGVGSAPLATR

SEQ ID NO: 1551348 - protein, 19 aa, Mycobacterium tuberculosis
PGAAPAVRAEWAAPGNQAL

SEQ ID NO: 1551349 - protein, 18 aa, Mycobacterium tuberculosis
PGAAQGWHLHHLLTAGQI

SEQ ID NO: 1551350 - protein, 37 aa, Mycobacterium tuberculosis
PGAPVPGWPLAPLPISGRPVAAWMGALNTSIRLSRRC

SEQ ID NO: 1551351 - protein, 22 aa, Mycobacterium tuberculosis
PGCLVPMCRVWIAGSPRMAPRR

SEQ ID NO: 1551352 - protein, 17 aa, Mycobacterium tuberculosis
PGCPMPLPMRGQRYRSP

SEQ ID NO: 1551353 - protein, 21 aa, Mycobacterium tuberculosis
PGCQAAALSALGGRCGARLRA

SEQ ID NO: 1551354 - protein, 33 aa, Mycobacterium tuberculosis
PGECVNIGNALWARLQPCVNWISQHWTVQPDGL

SEQ ID NO: 1551355 - protein, 26 aa, Mycobacterium tuberculosis
PGEVPGRGTTFCTAGMVPPWNPAVGS

SEQ ID NO: 1551356 - protein, 23 aa, Mycobacterium tuberculosis
PGFGVPWLYNYIGQPWKTQRDGR

SEQ ID NO: 1551357 - protein, 22 aa, Mycobacterium tuberculosis
PGFRPDWTPHRCHGAGLRRIGR

SEQ ID NO: 1551358 - protein, 21 aa, Mycobacterium tuberculosis
PGGAAVGLFGHGGAGGAGGLG

SEQ ID NO: 1551359 - protein, 24 aa, Mycobacterium tuberculosis
PGGAGGLISLLGGQGAGGAGGTGG

SEQ ID NO: 1551360 - protein, 23 aa, Mycobacterium tuberculosis
PGGAGGTGGRGFLNNGGVGGAGG

SEQ ID NO: 1551361 - protein, 25 aa, Mycobacterium tuberculosis
PGGDRGAGLRSRRAVGEGRPTQLPY

SEQ ID NO: 1551362 - protein, 20 aa, Mycobacterium tuberculosis
PGGEGRLRLTEPDDMLTTGI

SEQ ID NO: 1551363 - protein, 19 aa, Mycobacterium tuberculosis
PGGIGVNTGTGWAYGGNGG

SEQ ID NO: 1551364 - protein, 22 aa, Mycobacterium tuberculosis
PGGLTFPKASAGVINLSGGTDP

SEQ ID NO: 1551365 - protein, 21 aa, Mycobacterium tuberculosis
PGGPLKIGPITGLFNTPIGLT

SEQ ID NO: 1551366 - protein, 18 aa, Mycobacterium tuberculosis
PGGSHSWFAGYRGDLAFA

SEQ ID NO: 1551367 - protein, 22 aa, Mycobacterium tuberculosis
PGHTRGSVVFRVLQATHNDKDI

SEQ ID NO: 1551368 - protein, 19 aa, Mycobacterium tuberculosis
PGLLDLPAPAPVDLRRLLP

SEQ ID NO: 1551369 - protein, 21 aa, Mycobacterium tuberculosis
PGLMHVRFGPYHVRDVKFVAA

SEQ ID NO: 1551370 - protein, 31 aa, Mycobacterium tuberculosis; identical to SEQ ID NO: 1376437

SEQ ID NO: 1551371 - protein, 19 aa, Mycobacterium tuberculosis
PGMGHAIELRVYRFGGSLH

SEQ ID NO: 1551372 - protein, 19 aa, Mycobacterium tuberculosis
PGPGGFRGGLPVAGGRQDH

SEQ ID NO: 1551373 - protein, 18 aa, Mycobacterium tuberculosis
PGQPRRARRVAVRQRRQR

SEQ ID NO: 1551374 - protein, 21 aa, Mycobacterium tuberculosis
PGRAPSAAPRQQWCDVSKDSP

SEQ ID NO: 1551375 - protein, 36 aa, Mycobacterium tuberculosis; identical to SEQ ID NO: 1473517

SEQ ID NO: 1551376 - protein, 23 aa, Mycobacterium tuberculosis
PGSPCSYTPPADGLPRPWDPLPC

SEQ ID NO: 1551377 - protein, 24 aa, Mycobacterium tuberculosis
PGSPCSYTPPADGLPRPWDPLPSA

SEQ ID NO: 1551378 - protein, 19 aa, Mycobacterium tuberculosis
PGTALLLCYRQRRWYLEGS

SEQ ID NO: 1551379 - protein, 27 aa, Mycobacterium tuberculosis
PGTGADGGAGGWLFGNGGNGGQGTIGG

SEQ ID NO: 1551380 - protein, 27 aa, Mycobacterium tuberculosis
PGTGADGGAGGWLFGNGGNGGSGATGT

SEQ ID NO: 1551381 - protein, 23 aa, Mycobacterium tuberculosis
PGTGQAAASSWLDRLRTLVHRTC

SEQ ID NO: 1551382 - protein, 19 aa, Mycobacterium tuberculosis
PGTLNTGFFSAMTQAGPNS

SEQ ID NO: 1551383 - protein, 27 aa, Mycobacterium tuberculosis
PGVPGRSVSRWGAFLDDVGGFDCDFFG

SEQ ID NO: 1551384 - protein, 23 aa, Mycobacterium tuberculosis
PGYGEMFSALGFDGLVRSARSRA

SEQ ID NO: 1551385 - protein, 21 aa, Mycobacterium tuberculosis
PHPRLPRLIPGGDYVMAGGDG

SEQ ID NO: 1551386 - protein, 21 aa, Mycobacterium tuberculosis
PHYRPSAKLAEFVRMRDLTCR

SEQ ID NO: 1551387 - protein, 23 aa, Mycobacterium tuberculosis
PIALSPWPARAFVMLLVALAVAV

SEQ ID NO: 1551388 - protein, 18 aa, Mycobacterium tuberculosis
PIMFHPLNTITAYKGQII

SEQ ID NO: 1551389 - protein, 24 aa, Mycobacterium tuberculosis
PIRIDRFELLAARRRDQLIDIDVE

SEQ ID NO: 1551390 - protein, 22 aa, Mycobacterium tuberculosis
PIRRYDVDAAILFSDIVVPLRA

SEQ ID NO: 1551391 - protein, 23 aa, Mycobacterium tuberculosis
PIRRYDVDAAILFSDIVVPLRAA

SEQ ID NO: 1551392 - protein, 30 aa, Mycobacterium tuberculosis
PITAKARYTLVRGRLRAWIPRSMPGVYGRG

SEQ ID NO: 1551393 - protein, 18 aa, Mycobacterium tuberculosis
PIVWAFNCALNVVSTTPQ

SEQ ID NO: 1551394 - protein, 23 aa, Mycobacterium tuberculosis
PKERVQRVAPWLTTDDNPYPVVV

SEQ ID NO: 1551395 - protein, 27 aa, Mycobacterium tuberculosis
PKFDVPLPTAVRWAMRIPGGKAVHRVL

SEQ ID NO: 1551396 - protein, 26 aa, Mycobacterium tuberculosis
PKNIRDWDDLLLPGIEVITPSPLSSG

SEQ ID NO: 1551397 - protein, 17 aa, Mycobacterium tuberculosis
PKTELTMVASRAGLVME

SEQ ID NO: 1551398 - protein, 18 aa, Mycobacterium tuberculosis
PKVAAALKDPPYRLKTTT

SEQ ID NO: 1551399 - protein, 23 aa, Mycobacterium tuberculosis
PLAAPKNDLSWHDCTSRVYSNAG

SEQ ID NO: 1551400 - protein, 17 aa, Mycobacterium tuberculosis
PLACGLPALPQGNNPVS

SEQ ID NO: 1551401 - protein, 18 aa, Mycobacterium tuberculosis
PLADRPRLAPGAPGGTVP

SEQ ID NO: 1551402 - protein, 42 aa, Mycobacterium tuberculosis; identical to SEQ ID NO: 235292

SEQ ID NO: 1551403 - protein, 23 aa, Mycobacterium tuberculosis
PLATLEHNVLNALNAPTQALLGR

SEQ ID NO: 1551404 - protein, 18 aa, Mycobacterium tuberculosis
PLGFDIRTSAGPLNIPII

SEQ ID NO: 1551405 - protein, 25 aa, Mycobacterium tuberculosis
PLGRGLLEVAVARRAARPGRPAVTA

SEQ ID NO: 1551406 - protein, 18 aa, Mycobacterium tuberculosis
PLHTLKQQALAAINAPTQ

SEQ ID NO: 1551407 - protein, 19 aa, Mycobacterium tuberculosis
PLPSWTHHTLMLSREDSHR

SEQ ID NO: 1551408 - protein, 20 aa, Mycobacterium tuberculosis
PLQQFSWRIMPENLEDAGVS

SEQ ID NO: 1551409 - protein, 22 aa, Mycobacterium tuberculosis
PLRRASPSAVHPVAPPSVRPFT

SEQ ID NO: 1551410 - protein, 20 aa, Mycobacterium tuberculosis
PLTYHAVGGIGPLHVAPVPI

SEQ ID NO: 1551411 - protein, 23 aa, Mycobacterium tuberculosis
PLVIPGRPVARVDTQRARDLLVQ

SEQ ID NO: 1551412 - protein, 17 aa, Mycobacterium tuberculosis
PMGNLHINWPGRQQTAH

SEQ ID NO: 1551413 - protein, 22 aa, Mycobacterium tuberculosis
PMLAAAAAWDGLAAELGLAAES

SEQ ID NO: 1551414 - protein, 20 aa, Mycobacterium tuberculosis
PNFFTVFGPYGYVGSSYFAL

SEQ ID NO: 1551415 - protein, 24 aa, Mycobacterium tuberculosis
PNGGNGGDAGMFGNGGAGGAGYSP

SEQ ID NO: 1551416 - protein, 17 aa, Mycobacterium tuberculosis
PNGRPRYVTAIDADTAT

SEQ ID NO: 1551417 - protein, 18 aa, Mycobacterium tuberculosis
PNGRPRYVTAIDADTATV

SEQ ID NO: 1551418 - protein, 17 aa, Mycobacterium tuberculosis
PNGSCDFVAGANLRTPD

SEQ ID NO: 1551419 - protein, 21 aa, Mycobacterium tuberculosis
PNHRSRRRRRLPPFAAPGRPC

SEQ ID NO: 1551420 - protein, 19 aa, Mycobacterium tuberculosis
PNLFIKIPATKAGLPAISA

SEQ ID NO: 1551421 - protein, 22 aa, Mycobacterium tuberculosis
PNPTMTWPTRWNGSTTFSAPSE

SEQ ID NO: 1551422 - protein, 26 aa, Mycobacterium tuberculosis
PNSFTIPGFQIRVLLGPAAVLVNEMI

SEQ ID NO: 1551423 - protein, 18 aa, Mycobacterium tuberculosis
PNTIPAWCSEWPAASADT

SEQ ID NO: 1551424 - protein, 18 aa, Mycobacterium tuberculosis
PNWGRVLAAVGMAPITLD

SEQ ID NO: 1551425 - protein, 30 aa, Mycobacterium tuberculosis
PPAPAPPPFRLPLLFVNALGDNWIVGASNS

SEQ ID NO: 1551426 - protein, 20 aa, Mycobacterium tuberculosis
PPAPCLPISGRPGDVPPNVP

SEQ ID NO: 1551427 - protein, 20 aa, Mycobacterium tuberculosis
PPCPERLATAVLPRSATPVL

SEQ ID NO: 1551428 - protein, 17 aa, Mycobacterium tuberculosis
PPEINSARMFAGAGSGP

SEQ ID NO: 1551429 - protein, 23 aa, Mycobacterium tuberculosis
PPEPNSRPALPPAPPAPPELPVS

SEQ ID NO: 1551430 - protein, 24 aa, Mycobacterium tuberculosis
PPEPNSRPALPPAPPAPPELPVSP

SEQ ID NO: 1551431 - protein, 25 aa, Mycobacterium tuberculosis
PPGAKFPSGSFYLSISDLQINGPII

SEQ ID NO: 1551432 - protein, 18 aa, Mycobacterium tuberculosis
PPGHARCPSGRRLVRLRP

SEQ ID NO: 1551433 - protein, 20 aa, Mycobacterium tuberculosis
PPGPAARPTPIKALVRTVSP

SEQ ID NO: 1551434 - protein, 17 aa, Mycobacterium tuberculosis
PPGVGGIGEDFIDALRS

SEQ ID NO: 1551435 - protein, 19 aa, Mycobacterium tuberculosis
PPHAWYIAFAPAQAPKVAV

SEQ ID NO: 1551436 - protein, 21 aa, Mycobacterium tuberculosis
PPPIDERWLPESALPAPPRPT

SEQ ID NO: 1551437 - protein, 20 aa, Mycobacterium tuberculosis
PPPKTTVTFSDGRTAPFTVV

SEQ ID NO: 1551438 - protein, 24 aa, Mycobacterium tuberculosis
PPPTAPRRPSDPGALVKAPSNLTG

SEQ ID NO: 1551439 - protein, 32 aa, Mycobacterium tuberculosis
PPPTPPPPARVQVRGWRSPDDGAAPVPEHAAF

SEQ ID NO: 1551440 - protein, 27 aa, Mycobacterium tuberculosis
PPRRPTQIIMGIDWIGPGFNPHLLSDL

SEQ ID NO: 1551441 - protein, 19 aa, Mycobacterium tuberculosis
PPTPSRVGISSVLKIGRDL

SEQ ID NO: 1551442 - protein, 17 aa, Mycobacterium tuberculosis
PPWDPVIAVGNTARQPA

SEQ ID NO: 1551443 - protein, 24 aa, Mycobacterium tuberculosis
PQAKRVPGLVVYRYDAPLCFANAE

SEQ ID NO: 1551444 - protein, 37 aa, Mycobacterium tuberculosis; identical to SEQ ID NO: 1463420

SEQ ID NO: 1551445 - protein, 20 aa, Mycobacterium tuberculosis
PQLLIDRLSVQRVMAHQMST

SEQ ID NO: 1551446 - protein, 22 aa, Mycobacterium tuberculosis
PQLLIDRLSVQRVMAHQMSTQM

SEQ ID NO: 1551447 - protein, 25 aa, Mycobacterium tuberculosis
PQLLSESGWYSALFGMQHETSYLKR

SEQ ID NO: 1551448 - protein, 28 aa, Mycobacterium tuberculosis
PQPLRAKISFWFDRKYRVPADAAAAILS

SEQ ID NO: 1551449 - protein, 27 aa, Mycobacterium tuberculosis
PQRSLAYDRAWWFARFVAAAYGTAKLR

SEQ ID NO: 1551450 - protein, 17 aa, Mycobacterium tuberculosis
PQTFKIENPLAVVATST

SEQ ID NO: 1551451 - protein, 17 aa, Mycobacterium tuberculosis
PQTSVLIGTQGGDGTPG

SEQ ID NO: 1551452 - protein, 18 aa, Mycobacterium tuberculosis
PQTSVLIGTQGGDGTPGG

SEQ ID NO: 1551453 - protein, 18 aa, Mycobacterium tuberculosis
PRASPPAGRACRPGHHAG

SEQ ID NO: 1551454 - protein, 20 aa, Mycobacterium tuberculosis
PRATWPWLATTYALELGVDI

SEQ ID NO: 1551455 - protein, 21 aa, Mycobacterium tuberculosis
PREEPYCDAYYWVDNLRHTVR

SEQ ID NO: 1551456 - protein, 18 aa, Mycobacterium tuberculosis
PRGLSAVPLEPGQQTVGF

SEQ ID NO: 1551457 - protein, 42 aa, Mycobacterium tuberculosis
PRGRQRRVRHLGHGMSGSATRAWGRCRGSATSGWATPAATTS

SEQ ID NO: 1551458 - protein, 19 aa, Mycobacterium tuberculosis
PRIAQLVAGAFFREPKQVV

SEQ ID NO: 1551459 - protein, 18 aa, Mycobacterium tuberculosis
PRLIPRGPRGDLASGTLL

SEQ ID NO: 1551460 - protein, 21 aa, Mycobacterium tuberculosis
PRPAIDGRFSAAGCGRHAEPA

SEQ ID NO: 1551461 - protein, 25 aa, Mycobacterium tuberculosis
PRPQLTAAFGGALWAARRPGDTSAT

SEQ ID NO: 1551462 - protein, 18 aa, Mycobacterium tuberculosis
PRRLSPRVVAAPFDPAVG

SEQ ID NO: 1551463 - protein, 20 aa, Mycobacterium tuberculosis
PRSGRPSFRQFIAPADQQEH

SEQ ID NO: 1551464 - protein, 21 aa, Mycobacterium tuberculosis
PRSTPPPPRRPTQIIMGIDWI

SEQ ID NO: 1551465 - protein, 21 aa, Mycobacterium tuberculosis
PRTMPAALHCDRILFCAKEAT

SEQ ID NO: 1551466 - protein, 18 aa, Mycobacterium tuberculosis
PRVHPAPMETCGAVADLD

SEQ ID NO: 1551467 - protein, 29 aa, Mycobacterium tuberculosis
PRVLCTDDLRVARIRGCGADELSTAWNRA

SEQ ID NO: 1551468 - protein, 25 aa, Mycobacterium tuberculosis
PRVLQIRALVLGGALDWLKDNKAST

SEQ ID NO: 1551469 - protein, 17 aa, Mycobacterium tuberculosis
PRVPAEPGGDFVDQAGN

SEQ ID NO: 1551470 - protein, 17 aa, Mycobacterium tuberculosis
PSAPARLVVLASGTVSL

SEQ ID NO: 1551471 - protein, 33 aa, Mycobacterium tuberculosis; identical to SEQ ID NO: 204387

SEQ ID NO: 1551472 - protein, 17 aa, Mycobacterium tuberculosis
PSFRLASAMVGYNREFL

SEQ ID NO: 1551473 - protein, 22 aa, Mycobacterium tuberculosis
PSHDWPDRVLRVTAIDIATGEL

SEQ ID NO: 1551474 - protein, 17 aa, Mycobacterium tuberculosis
PSIGPNCVADGSNSIAT

SEQ ID NO: 1551475 - protein, 19 aa, Mycobacterium tuberculosis
PSLERPSPHPSRESEWPRP

SEQ ID NO: 1551476 - protein, 37 aa, Mycobacterium tuberculosis
PSPRASRPALPPAPPCPPVWLPCPPSPPAPPAPNSPP

SEQ ID NO: 1551477 - protein, 25 aa, Mycobacterium tuberculosis
PSPSRTSRFPPWDSTPQPVSPWARY

SEQ ID NO: 1551478 - protein, 18 aa, Mycobacterium tuberculosis
PTELGGQPGLWIPSSSIS

SEQ ID NO: 1551479 - protein, 19 aa, Mycobacterium tuberculosis
PTELHPFVELTGPRHTAPA

SEQ ID NO: 1551480 - protein, 18 aa, Mycobacterium tuberculosis
PTFELPRFALPRFALPRF

SEQ ID NO: 1551481 - protein, 23 aa, Mycobacterium tuberculosis
PTIPLNIHQTFSLGPLVVPDIVI

SEQ ID NO: 1551482 - protein, 23 aa, Mycobacterium tuberculosis
PTQALWGRPLIGNGADGTAANPN

SEQ ID NO: 1551483 - protein, 23 aa, Mycobacterium tuberculosis
PTRYGWCPATSTPHCRGSPGCWA

SEQ ID NO: 1551484 - protein, 22 aa, Mycobacterium tuberculosis
PTSRRELLAALTKRGRDVVRQV

SEQ ID NO: 1551485 - protein, 27 aa, Mycobacterium tuberculosis
PTVGCGVSLALACDLVLASDNAFFMLA

SEQ ID NO: 1551486 - protein, 28 aa, Mycobacterium tuberculosis
PVAALAAVPARAGRRSAVAADAAVAAVA

SEQ ID NO: 1551487 - protein, 21 aa, Mycobacterium tuberculosis
PVAPRRAGGAVAEVYAEARRE

SEQ ID NO: 1551488 - protein, 19 aa, Mycobacterium tuberculosis
PVCGRGLSNATPREVLPAS

SEQ ID NO: 1551489 - protein, 20 aa, Mycobacterium tuberculosis
PVCGVVGFGGGAGRGGGRAG

SEQ ID NO: 1551490 - protein, 21 aa, Mycobacterium tuberculosis
PVEAFQFYFELLLFDYPTHIV

SEQ ID NO: 1551491 - protein, 18 aa, Mycobacterium tuberculosis
PVGVPAIVVPPVAAPNVL

SEQ ID NO: 1551492 - protein, 23 aa, Mycobacterium tuberculosis
PVHAECAGLLYLVSELDGHPMCV

SEQ ID NO: 1551493 - protein, 31 aa, Mycobacterium tuberculosis
PVLRYPRPRLGAGFDRPVQRWQAGHQYRTRS

SEQ ID NO: 1551494 - protein, 20 aa, Mycobacterium tuberculosis
PVMFDRIMDLPAEIRNRYDG

SEQ ID NO: 1551495 - protein, 27 aa, Mycobacterium tuberculosis
PVPDYYWCPGQPFDPAWGPNWDPYTCH

SEQ ID NO: 1551496 - protein, 27 aa, Mycobacterium tuberculosis
PVPRSCAEPAGIPALLSPRDKLAQLLV

SEQ ID NO: 1551497 - protein, 21 aa, Mycobacterium tuberculosis
PVQFICGGSFDTAAGPSAPDY

SEQ ID NO: 1551498 - protein, 25 aa, Mycobacterium tuberculosis
PVQRSVARFALIQALSAVLVGAGTR

SEQ ID NO: 1551499 - protein, 17 aa, Mycobacterium tuberculosis
PVTMGFYTRRDLPIHYL

SEQ ID NO: 1551500 - protein, 20 aa, Mycobacterium tuberculosis
PVTVHAIGGVGPLHVAPVPV

SEQ ID NO: 1551501 - protein, 19 aa, Mycobacterium tuberculosis
PVTVNWSTPAVTIFPNGIS

SEQ ID NO: 1551502 - protein, 18 aa, Mycobacterium tuberculosis
PVVNDWPNDCGDNGAVAA

SEQ ID NO: 1551503 - protein, 18 aa, Mycobacterium tuberculosis
PWDGDQLLRALGLRPPGH

SEQ ID NO: 1551504 - protein, 23 aa, Mycobacterium tuberculosis
PWQQVLRNLGIDIGKNGQINLGF

SEQ ID NO: 1551505 - protein, 19 aa, Mycobacterium tuberculosis
PYLDTVLFLLGVTRGEIEA

SEQ ID NO: 1551506 - protein, 25 aa, Mycobacterium tuberculosis
PYPAWRELFTDILPAHIVKDIPGGF

SEQ ID NO: 1551507 - protein, 17 aa, Mycobacterium tuberculosis
PYQELKIATAERGGQVN

SEQ ID NO: 1551508 - protein, 18 aa, Mycobacterium tuberculosis
PYRPEPPAPPPGGPPPGP

SEQ ID NO: 1551509 - protein, 29 aa, Mycobacterium tuberculosis
PYTLTGPIVIGSFFLPAFNIPGIDVPAIN

SEQ ID NO: 1551510 - protein, 21 aa, Mycobacterium tuberculosis
QAAAVPVVFLTAWYGLADLAE

SEQ ID NO: 1551511 - protein, 25 aa, Mycobacterium tuberculosis
QAAEQRASALWSHPDPTALASVPGS

SEQ ID NO: 1551512 - protein, 19 aa, Mycobacterium tuberculosis
QAALFHEQFVHAMTAGAGA

SEQ ID NO: 1551513 - protein, 17 aa, Mycobacterium tuberculosis
QAALRIEQLEQMVLEQF

SEQ ID NO: 1551514 - protein, 19 aa, Mycobacterium tuberculosis
QAFPCIPNGGSVFAANPVV

SEQ ID NO: 1551515 - protein, 28 aa, Mycobacterium tuberculosis
QAGCCTGIPPSACRVRPGKPAGPAAPPG

SEQ ID NO: 1551516 - protein, 17 aa, Mycobacterium tuberculosis
QAIARQMAAFHDQFTLA

SEQ ID NO: 1551517 - protein, 21 aa, Mycobacterium tuberculosis
QAIELWKIVDRPNLFIKIPAT

SEQ ID NO: 1551518 - protein, 27 aa, Mycobacterium tuberculosis
QAIELWKIVDRPNLFIKIRDPDHLAGH

SEQ ID NO: 1551519 - protein, 20 aa, Mycobacterium tuberculosis
QALLGRPIIGNGANGLPNTG

SEQ ID NO: 1551520 - protein, 22 aa, Mycobacterium tuberculosis
QALLGRPIIGNGANGLPNTGQD

SEQ ID NO: 1551521 - protein, 21 aa, Mycobacterium tuberculosis
QALLGRPLIGDGANGGPGQDG

SEQ ID NO: 1551522 - protein, 20 aa, Mycobacterium tuberculosis
QALLGRPLIGDGAVGTASSP

SEQ ID NO: 1551523 - protein, 22 aa, Mycobacterium tuberculosis
QALLGRPLIGDGAVGTASSPDG

SEQ ID NO: 1551524 - protein, 24 aa, Mycobacterium tuberculosis
QALNDCPLRWLAERHGGTNTRELP

SEQ ID NO: 1551525 - protein, 20 aa, Mycobacterium tuberculosis
QALWGRPLIGNGADGTAANP

SEQ ID NO: 1551526 - protein, 17 aa, Mycobacterium tuberculosis
QCIPNVVLGTTDGALPS

SEQ ID NO: 1551527 - protein, 24 aa, Mycobacterium tuberculosis
QDEVSAAIAALFSAHGRAYQVASA

SEQ ID NO: 1551528 - protein, 17 aa, Mycobacterium tuberculosis
QDIRAAAELALPHRRRR

SEQ ID NO: 1551529 - protein, 23 aa, Mycobacterium tuberculosis
QDIRAAAELALPHRRRRDPFDDH

SEQ ID NO: 1551530 - protein, 25 aa, Mycobacterium tuberculosis
QDNEGHSMFPWLTLALVGNSTSSIL

SEQ ID NO: 1551531 - protein, 24 aa, Mycobacterium tuberculosis
QFISETWRLYGVAARNDGIANVDN

SEQ ID NO: 1551532 - protein, 22 aa, Mycobacterium tuberculosis
QFSRGEGQLVAIIDTGVQPGPR

SEQ ID NO: 1551533 - protein, 36 aa, Mycobacterium tuberculosis
QFVQALTAAAGRYASTEAAVERSLLGAVNAPTEALL

SEQ ID NO: 1551534 - protein, 21 aa, Mycobacterium tuberculosis
QFWSQIHGFVMLELAGFYGDR

SEQ ID NO: 1551535 - protein, 27 aa, Mycobacterium tuberculosis
QGDSGSGLGGQPGFAGGAGGKGGAGGN

SEQ ID NO: 1551536 - protein, 28 aa, Mycobacterium tuberculosis
QGDSGSGLGGQPGFAGGAGGKGGAGGSS

SEQ ID NO: 1551537 - protein, 31 aa, Mycobacterium tuberculosis
QGDSGSGLGGQPGFAGGPGGKGGAGGNAGTG

SEQ ID NO: 1551538 - protein, 32 aa, Mycobacterium tuberculosis
QGDSGSGLGGQPGFAGGPGGKGGAGGNAGTGG

SEQ ID NO: 1551539 - protein, 22 aa, Mycobacterium tuberculosis
QGGEPRLTLPDAITGNPGDPRY

SEQ ID NO: 1551540 - protein, 19 aa, Mycobacterium tuberculosis
QGLTAMWRRESELFADVAV

SEQ ID NO: 1551541 - protein, 21 aa, Mycobacterium tuberculosis
QGTRVSAYFADAGGLRTGNTV

SEQ ID NO: 1551542 - protein, 17 aa, Mycobacterium tuberculosis
QGTYLAWLDCRELGFDD

SEQ ID NO: 1551543 - protein, 18 aa, Mycobacterium tuberculosis
QIDIPGMSLFDVHEIVEI

SEQ ID NO: 1551544 - protein, 24 aa, Mycobacterium tuberculosis
QLAKLARAGFRVSDVKPPSSPVTS

SEQ ID NO: 1551545 - protein, 21 aa, Mycobacterium tuberculosis
QLLATAALDLASIGSQVSAAN

SEQ ID NO: 1551546 - protein, 17 aa, Mycobacterium tuberculosis
QLLDGLLLVSGNDAANT

SEQ ID NO: 1551547 - protein, 18 aa, Mycobacterium tuberculosis
QLLIDRLSVQRVMAHQMS

SEQ ID NO: 1551548 - protein, 19 aa, Mycobacterium tuberculosis
QLLWYRPDLVNSPPTDWNA

SEQ ID NO: 1551549 - protein, 23 aa, Mycobacterium tuberculosis
QLMRRAGGLVFARKVRAEHRPGR

SEQ ID NO: 1551550 - protein, 27 aa, Mycobacterium tuberculosis
QLPYLPLQVPQQLSLPADLPALASGVI

SEQ ID NO: 1551551 - protein, 23 aa, Mycobacterium tuberculosis
QLSRARALLLGRDYVIPEDVKEL

SEQ ID NO: 1551552 - protein, 21 aa, Mycobacterium tuberculosis
QMAVEPIIWRTYAQTLPPDAI

SEQ ID NO: 1551553 - protein, 18 aa, Mycobacterium tuberculosis
QMLVWGFTGQVISAVLDV

SEQ ID NO: 1551554 - protein, 24 aa, Mycobacterium tuberculosis
QNAYCTEVGVLPGTDFQLQPKYME

SEQ ID NO: 1551555 - protein, 17 aa, Mycobacterium tuberculosis
QNGWPFVARLLYGRRSL

SEQ ID NO: 1551556 - protein, 23 aa, Mycobacterium tuberculosis
QNLPRLRRALSRVDTIVVHEQYW

SEQ ID NO: 1551557 - protein, 31 aa, Mycobacterium tuberculosis
QPQPRRWQPRRAEPGVGQPRGRQRRVRHLGH

SEQ ID NO: 1551558 - protein, 18 aa, Mycobacterium tuberculosis
QPQSLWPRPARSTQPVQR

SEQ ID NO: 1551559 - protein, 26 aa, Mycobacterium tuberculosis
QPVQDPFGGIVFRLPGGHRNRQAAGQ

SEQ ID NO: 1551560 - protein, 19 aa, Mycobacterium tuberculosis
QPYAAIYLHLMRAAVLRRA

SEQ ID NO: 1551561 - protein, 18 aa, Mycobacterium tuberculosis
QQALRGLPGLGQVASAIS

SEQ ID NO: 1551562 - protein, 22 aa, Mycobacterium tuberculosis
QQLGARAALFHEQFVQALTGAA

SEQ ID NO: 1551563 - protein, 23 aa, Mycobacterium tuberculosis
QQLGARAALFHEQFVQALTGAAS

SEQ ID NO: 1551564 - protein, 17 aa, Mycobacterium tuberculosis
QQRPSFFPHFTPLRSAF

SEQ ID NO: 1551565 - protein, 31 aa, Mycobacterium tuberculosis
QQTPAARVLAIWPDWVRRWPTPSATATASTA

SEQ ID NO: 1551566 - protein, 27 aa, Mycobacterium tuberculosis
QRDGLTLGEALALWLSGQEQLMPRDHE

SEQ ID NO: 1551567 - protein, 24 aa, Mycobacterium tuberculosis
QRDRLGAADGRWALQTWRRLAVTR

SEQ ID NO: 1551568 - protein, 19 aa, Mycobacterium tuberculosis
QRGACSVSGVIPGTDPGVP

SEQ ID NO: 1551569 - protein, 19 aa, Mycobacterium tuberculosis
QRLRIDLSALRIIGDGLAW

SEQ ID NO: 1551570 - protein, 32 aa, Mycobacterium tuberculosis
QRRGRWYRRGRRCRWERGVVVGQRRQRRCRRH

SEQ ID NO: 1551571 - protein, 27 aa, Mycobacterium tuberculosis
QRVKANLFYRGLRFHRFPAVGDTLYTR

SEQ ID NO: 1551572 - protein, 18 aa, Mycobacterium tuberculosis
QRVLCASPTTLPGPGSRS

SEQ ID NO: 1551573 - protein, 25 aa, Mycobacterium tuberculosis
QSCGNPAPAAPRDKPPPFSRTDAGP

SEQ ID NO: 1551574 - protein, 18 aa, Mycobacterium tuberculosis
QSDETFVYLARAVDPAVA

SEQ ID NO: 1551575 - protein, 90 aa, Mycobacterium tuberculosis
QSGGPRRQRWCRWQRRRWLGRQRRRRWCRWQRRCRRQRWRWRCRQRRLRRQWRQGRRRCRPWLHRRRGRQGRRWRQRRFQQRQRSRWQRR

SEQ ID NO: 1551576 - protein, 26 aa, Mycobacterium tuberculosis
QSGRFEFRAGPIFTNLLLADEINRTP

SEQ ID NO: 1551577 - protein, 25 aa, Mycobacterium tuberculosis
QSQWPQCRKGCRWWPHWPSRHPRDG

SEQ ID NO: 1551578 - protein, 20 aa, Mycobacterium tuberculosis
QSTDQRLLDLINGPTQALLG

SEQ ID NO: 1551579 - protein, 17 aa, Mycobacterium tuberculosis
QSVTFSSSLSGLSGGDG

SEQ ID NO: 1551580 - protein, 24 aa, Mycobacterium tuberculosis
QTAPGHMLGGLPLGQLTNSGGGFG

SEQ ID NO: 1551581 - protein, 24 aa, Mycobacterium tuberculosis
QTGMPSSFSMHGPWVDVAAPAENI

SEQ ID NO: 1551582 - protein, 21 aa, Mycobacterium tuberculosis
QTLFFPFVLLLAATALYRGND

SEQ ID NO: 1551583 - protein, 22 aa, Mycobacterium tuberculosis
QTLTGRPLIGNGANGTPGTGAD

SEQ ID NO: 1551584 - protein, 21 aa, Mycobacterium tuberculosis
QTLVGRPLIGDGTHGAPGTGQ

SEQ ID NO: 1551585 - protein, 33 aa, Mycobacterium tuberculosis; identical to SEQ ID NO: 1379257

SEQ ID NO: 1551586 - protein, 43 aa, Mycobacterium tuberculosis
QVAAFHEQFVQALTAAAGRYASTEVAVERSLLGAVNAPTEALL

SEQ ID NO: 1551587 - protein, 17 aa, Mycobacterium tuberculosis
QVGALAVVLGVGAAVTT

SEQ ID NO: 1551588 - protein, 19 aa, Mycobacterium tuberculosis
QVVLGWKVSDLKSSTAVIP

SEQ ID NO: 1551589 - protein, 27 aa, Mycobacterium tuberculosis
QYQQLGARAALFHEQFVQALTGAASAY

SEQ ID NO: 1551590 - protein, 20 aa, Mycobacterium tuberculosis
RAAACIPPLRCLDLKRGEPV

SEQ ID NO: 1551591 - protein, 23 aa, Mycobacterium tuberculosis
RAAGLRVGDTVAVLGPKTGEKVA

SEQ ID NO: 1551592 - protein, 19 aa, Mycobacterium tuberculosis
RAALRPVDRIRAAAQTLTT

SEQ ID NO: 1551593 - protein, 19 aa, Mycobacterium tuberculosis
RACTPVWSGVGLHRPAEFN

SEQ ID NO: 1551594 - protein, 17 aa, Mycobacterium tuberculosis
RAEAGAVLTEISDTASR

SEQ ID NO: 1551595 - protein, 17 aa, Mycobacterium tuberculosis
RAGAWSGSAPGGARPAG

SEQ ID NO: 1551596 - protein, 19 aa, Mycobacterium tuberculosis
RAGGCFFAAAAADVDSQPG

SEQ ID NO: 1551597 - protein, 28 aa, Mycobacterium tuberculosis
RAGLLLPLGWDPRLPVMGQKYISQGAIS

SEQ ID NO: 1551598 - protein, 17 aa, Mycobacterium tuberculosis
RAIDPGFFSARKLPDGL

SEQ ID NO: 1551599 - protein, 26 aa, Mycobacterium tuberculosis
RALESRPGVVLHPGQAVCHFGVSTGE

SEQ ID NO: 1551600 - protein, 22 aa, Mycobacterium tuberculosis
RALRAAAPWGGRAAACRSRCAG

SEQ ID NO: 1551601 - protein, 20 aa, Mycobacterium tuberculosis
RALRVIPAILGRPADTVVRR

SEQ ID NO: 1551602 - protein, 22 aa, Mycobacterium tuberculosis
RALRVIPAILGRPADTVVRRSA

SEQ ID NO: 1551603 - protein, 22 aa, Mycobacterium tuberculosis
RALTPRLNPQRGVKGAPVGASP

SEQ ID NO: 1551604 - protein, 28 aa, Mycobacterium tuberculosis
RAMGPMQFLPGTWARYATDGDDDGVADP

SEQ ID NO: 1551605 - protein, 31 aa, Mycobacterium tuberculosis
RAPSRPRSWLLRPIGSLGCCALRVSAPRPTC

SEQ ID NO: 1551606 - protein, 18 aa, Mycobacterium tuberculosis
RAPTTRATLTPAPSTSGF

SEQ ID NO: 1551607 - protein, 24 aa, Mycobacterium tuberculosis
RAQQRRWCHRRHRRYRRSRRLWSV

SEQ ID NO: 1551608 - protein, 18 aa, Mycobacterium tuberculosis
RARLRRRGPVTVYGVDKF

SEQ ID NO: 1551609 - protein, 32 aa, Mycobacterium tuberculosis
RARRHRAATAAACRAAAGPRGHGGQTGVGGKV

SEQ ID NO: 1551610 - protein, 18 aa, Mycobacterium tuberculosis
RAVDAGAAGHIFNLGHGV

SEQ ID NO: 1551611 - protein, 25 aa, Mycobacterium tuberculosis
RAVDGGLQMGGWGAGARRGKAAVRR

SEQ ID NO: 1551612 - protein, 19 aa, Mycobacterium tuberculosis
RAVGEGRPTQLPYLPLQVP

SEQ ID NO: 1551613 - protein, 17 aa, Mycobacterium tuberculosis
RAVRWDDIDGLRFHRGS

SEQ ID NO: 1551614 - protein, 17 aa, Mycobacterium tuberculosis
RAYGDFLSYCLVAEGAV

SEQ ID NO: 1551615 - protein, 19 aa, Mycobacterium tuberculosis
RAYGGTFLQFSDYMRPAVR

SEQ ID NO: 1551616 - protein, 17 aa, Mycobacterium tuberculosis
RAYQALSAQAAMFHEQF

SEQ ID NO: 1551617 - protein, 33 aa, Mycobacterium tuberculosis; identical to SEQ ID NO: 1489703

SEQ ID NO: 1551618 - protein, 19 aa, Mycobacterium tuberculosis
RCLTPSLGFGFWIGARVRC

SEQ ID NO: 1551619 - protein, 25 aa, Mycobacterium tuberculosis
RCNLRCSYCMPERGLRWLPGEQLLR

SEQ ID NO: 1551620 - protein, 26 aa, Mycobacterium tuberculosis
RCPHPAEVTWHWWWLGAADLGGLLVV

SEQ ID NO: 1551621 - protein, 20 aa, Mycobacterium tuberculosis
RCPSGRRLVRLRPRRRQARR

SEQ ID NO: 1551622 - protein, 17 aa, Mycobacterium tuberculosis
RCRRHQRGRSFVGRPER

SEQ ID NO: 1551623 - protein, 17 aa, Mycobacterium tuberculosis
RCRVSYVSVLPATLATA

SEQ ID NO: 1551624 - protein, 23 aa, Mycobacterium tuberculosis
RDAHKALACAAASGAHLDLPDVL

SEQ ID NO: 1551625 - protein, 17 aa, Mycobacterium tuberculosis
RDDGACYAELLTAAGVS

SEQ ID NO: 1551626 - protein, 18 aa, Mycobacterium tuberculosis
RDDWVPFTGVPGYNHIKI

SEQ ID NO: 1551627 - protein, 52 aa, Mycobacterium tuberculosis
RDGAGVGPRAPGPFDGHPSPARRCRAGPGGFRRGRSALAFGSGGVGGAGGLG

SEQ ID NO: 1551628 - protein, 19 aa, Mycobacterium tuberculosis
RDHADVLALLPHRETAPEF

SEQ ID NO: 1551629 - protein, 20 aa, Mycobacterium tuberculosis
RDPDAWARLIDTYEVTALNF

SEQ ID NO: 1551630 - protein, 18 aa, Mycobacterium tuberculosis
RDPRLRRALTPDYEPMCK

SEQ ID NO: 1551631 - protein, 22 aa, Mycobacterium tuberculosis
RDRAKMFALLWQSLRRQRQLLK

SEQ ID NO: 1551632 - protein, 20 aa, Mycobacterium tuberculosis
RDSLVKTALFGSDPNWGRVL

SEQ ID NO: 1551633 - protein, 20 aa, Mycobacterium tuberculosis
RDTLLWAKLIDKYQGTMTAA

SEQ ID NO: 1551634 - protein, 17 aa, Mycobacterium tuberculosis
RDVACRRDFEDVALTLV

SEQ ID NO: 1551635 - protein, 20 aa, Mycobacterium tuberculosis
RDWNWLKWLPHVDIPGRLDA

SEQ ID NO: 1551636 - protein, 38 aa, Mycobacterium tuberculosis
RECQGGYNPMKRSMKSGSFAIGLAMMLAPMVAAPGLAA

SEQ ID NO: 1551637 - protein, 18 aa, Mycobacterium tuberculosis
REDGRRQRCWQRVSRHSA

SEQ ID NO: 1551638 - protein, 18 aa, Mycobacterium tuberculosis
REELRLIVWELVARHSAS

SEQ ID NO: 1551639 - protein, 25 aa, Mycobacterium tuberculosis
REFHLCVVEAPTLHNAAEALHRQFN

SEQ ID NO: 1551640 - protein, 25 aa, Mycobacterium tuberculosis
RELFCARDPFGIKPLFIATGAGGTA

SEQ ID NO: 1551641 - protein, 18 aa, Mycobacterium tuberculosis
RELLVAMAMLVSVTGCAR

SEQ ID NO: 1551642 - protein, 19 aa, Mycobacterium tuberculosis
REPIAVAGEQIWRVPPLGH

SEQ ID NO: 1551643 - protein, 17 aa, Mycobacterium tuberculosis
RERYSMLAACFEPDVAC

SEQ ID NO: 1551644 - protein, 18 aa, Mycobacterium tuberculosis
REVLPASAAMDAPLDAAA

SEQ ID NO: 1551645 - protein, 17 aa, Mycobacterium tuberculosis
REYPPVRGVIHAAGVLD

SEQ ID NO: 1551646 - protein, 20 aa, Mycobacterium tuberculosis
REYPPVRGVIHAAGVLDDAV

SEQ ID NO: 1551647 - protein, 17 aa, Mycobacterium tuberculosis
RFARPALKVDPFGPRST

SEQ ID NO: 1551648 - protein, 20 aa, Mycobacterium tuberculosis
RFLYDIEFIIRGGISSSTGP

SEQ ID NO: 1551649 - protein, 19 aa, Mycobacterium tuberculosis
RFRAVSHLRGLPTAVGHRL

SEQ ID NO: 1551650 - protein, 21 aa, Mycobacterium tuberculosis
RFSGWQSTRQRVWGQMDSARC

SEQ ID NO: 1551651 - protein, 20 aa, Mycobacterium tuberculosis
RFSGWQSTRQRVWGQMDSTR

SEQ ID NO: 1551652 - protein, 20 aa, Mycobacterium tuberculosis
RFTLYHLPVALQLPPGATGV

SEQ ID NO: 1551653 - protein, 17 aa, Mycobacterium tuberculosis
RGACSVSGVIPGTDPGV

SEQ ID NO: 1551654 - protein, 17 aa, Mycobacterium tuberculosis
RGAGSASVLDAATIAAV

SEQ ID NO: 1551655 - protein, 19 aa, Mycobacterium tuberculosis
RGAQALPPGGVLPVGQSTT

SEQ ID NO: 1551656 - protein, 23 aa, Mycobacterium tuberculosis
RGARKRPTSGWGALTPTELEVAL

SEQ ID NO: 1551657 - protein, 51 aa, Mycobacterium tuberculosis
RGASPTAPGPLAFPAPKAWPARPASAGRRRACRSRGAGLKPRARDCTPTRR

SEQ ID NO: 1551658 - protein, 19 aa, Mycobacterium tuberculosis
RGDASRLAVSWFGHSTALL

SEQ ID NO: 1551659 - protein, 17 aa, Mycobacterium tuberculosis
RGGPVCGVVGFGGGAGR

SEQ ID NO: 1551660 - protein, 19 aa, Mycobacterium tuberculosis
RGHTRNCRLHWVQIIPTIA

SEQ ID NO: 1551661 - protein, 22 aa, Mycobacterium tuberculosis
RGLMQLLAATNWFGQNAPALMD

SEQ ID NO: 1551662 - protein, 21 aa, Mycobacterium tuberculosis
RGRQGRVGRRGRQRRRRRCHD

SEQ ID NO: 1551663 - protein, 25 aa, Mycobacterium tuberculosis
RGRVGCRRAVQSAGRHGGANLSGSL

SEQ ID NO: 1551664 - protein, 18 aa, Mycobacterium tuberculosis
RGRWPWRRRRRRMGRPAT

SEQ ID NO: 1551665 - protein, 29 aa, Mycobacterium tuberculosis
RGVLDEATGRWGLRVARVELRSIDPPPSI

SEQ ID NO: 1551666 - protein, 23 aa, Mycobacterium tuberculosis
RGVRRLESGCFARIRADQLAPVI

SEQ ID NO: 1551667 - protein, 18 aa, Mycobacterium tuberculosis
RHASLLPLLHNYREPAKP

SEQ ID NO: 1551668 - protein, 17 aa, Mycobacterium tuberculosis
RHISDTNLLAWYQRSHR

SEQ ID NO: 1551669 - protein, 18 aa, Mycobacterium tuberculosis
RHQLVSLVLSNLFGQNAP

SEQ ID NO: 1551670 - protein, 18 aa, Mycobacterium tuberculosis
RHQRGRSFVGRPERRNAG

SEQ ID NO: 1551671 - protein, 24 aa, Mycobacterium tuberculosis
RHRAMIQAFVQWRAQSRSELTEVG

SEQ ID NO: 1551672 - protein, 25 aa, Mycobacterium tuberculosis
RHRGARRNAPSLEHRLYEEAVAGDS

SEQ ID NO: 1551673 - protein, 30 aa, Mycobacterium tuberculosis
RHRRAAGLPRSLRPPLPPLPNAELPAPPSP

SEQ ID NO: 1551674 - protein, 17 aa, Mycobacterium tuberculosis
RHRRYRWCRRRPRQPGR

SEQ ID NO: 1551675 - protein, 25 aa, Mycobacterium tuberculosis
RHSSRRPGWPCPPIWNSPSPDPPTS

SEQ ID NO: 1551676 - protein, 18 aa, Mycobacterium tuberculosis
RHSTRASSSISGWPMWAA

SEQ ID NO: 1551677 - protein, 19 aa, Mycobacterium tuberculosis
RIAGASVTLEWSVDDFAIS

SEQ ID NO: 1551678 - protein, 22 aa, Mycobacterium tuberculosis
RIGRLAVRLDVSRLVVVGTGRS

SEQ ID NO: 1551679 - protein, 20 aa, Mycobacterium tuberculosis
RILVCARSATSRRAQRLPGR

SEQ ID NO: 1551680 - protein, 17 aa, Mycobacterium tuberculosis
RIMPENLEDAGVSWKVY

SEQ ID NO: 1551681 - protein, 19 aa, Mycobacterium tuberculosis
RINQSFPVTVNWSTPAVTI

SEQ ID NO: 1551682 - protein, 18 aa, Mycobacterium tuberculosis
RIPVDLHTTLSIGPFPFR

SEQ ID NO: 1551683 - protein, 18 aa, Mycobacterium tuberculosis
RITTTGGIGPIVIPDTTI

SEQ ID NO: 1551684 - protein, 27 aa, Mycobacterium tuberculosis
RITVPAFGIPFTLQFQTNVPALQPPGG

SEQ ID NO: 1551685 - protein, 34 aa, Mycobacterium tuberculosis
RKKKKKGEGGGGGGGGEGGGGPPKKKNKRKKKKK

SEQ ID NO: 1551686 - protein, 26 aa, Mycobacterium tuberculosis
RKKKKKKGGGRGGGGGGGGGGGKKKQ

SEQ ID NO: 1551687 - protein, 18 aa, Mycobacterium tuberculosis
RKRGRRISVADVELTQGG

SEQ ID NO: 1551688 - protein, 17 aa, Mycobacterium tuberculosis
RKRGTLLEWLWRRVLLK

SEQ ID NO: 1551689 - protein, 24 aa, Mycobacterium tuberculosis
RLAARVLVALAALFAMIALTGSAC

SEQ ID NO: 1551690 - protein, 19 aa, Mycobacterium tuberculosis
RLAGMTTWVASIALLAAAL

SEQ ID NO: 1551691 - protein, 17 aa, Mycobacterium tuberculosis
RLARPSETATRFVADPF

SEQ ID NO: 1551692 - protein, 19 aa, Mycobacterium tuberculosis
RLFGRRLADFFTGRDPRGG

SEQ ID NO: 1551693 - protein, 18 aa, Mycobacterium tuberculosis
RLGGTWKKPGTSDIEIVC

SEQ ID NO: 1551694 - protein, 18 aa, Mycobacterium tuberculosis
RLGHNLALHPATMLAGLF

SEQ ID NO: 1551695 - protein, 18 aa, Mycobacterium tuberculosis
RLLPEWEPIRDLPPRDVA

SEQ ID NO: 1551696 - protein, 22 aa, Mycobacterium tuberculosis
RLPRWRAMAAHALCKRDDLARQ

SEQ ID NO: 1551697 - protein, 19 aa, Mycobacterium tuberculosis
RLPSGLWRSCARATLVLRA

SEQ ID NO: 1551698 - protein, 17 aa, Mycobacterium tuberculosis
RLRCQVVAATGLQLDEL

SEQ ID NO: 1551699 - protein, 23 aa, Mycobacterium tuberculosis
RLRKLWDVPALAFVGIGNGTQVA

SEQ ID NO: 1551700 - protein, 38 aa, Mycobacterium tuberculosis
RLRKQILRLDQRWLIARVIMRSAIGFFASFTVSSGVLA

SEQ ID NO: 1551701 - protein, 31 aa, Mycobacterium tuberculosis
RLSGVSTPFGWTFPYAGPRMHILATNVVCTS

SEQ ID NO: 1551702 - protein, 18 aa, Mycobacterium tuberculosis
RLTLRVYAYSSCCKASYP

SEQ ID NO: 1551703 - protein, 19 aa, Mycobacterium tuberculosis
RLVAHPTESFGLRITDPSG

SEQ ID NO: 1551704 - protein, 19 aa, Mycobacterium tuberculosis
RLYPVRLTTTMTRFIIAAV

SEQ ID NO: 1551705 - protein, 24 aa, Mycobacterium tuberculosis
RNAESDSGWVLHARGVLGAKAVAP

SEQ ID NO: 1551706 - protein, 33 aa, Mycobacterium tuberculosis
RNAFAQLVMSNWFGLNAPLIAAVEGAYEQMWAA

SEQ ID NO: 1551707 - protein, 23 aa, Mycobacterium tuberculosis
RNAPGCRGCCQCAIGCPSNAKFG

SEQ ID NO: 1551708 - protein, 34 aa, Mycobacterium tuberculosis
RNPRWRRRIRFCRRRRYRPAPPLAADAAVDGAWA

SEQ ID NO: 1551709 - protein, 20 aa, Mycobacterium tuberculosis
RNVTHGCINLSPANAKCSPP

SEQ ID NO: 1551710 - protein, 19 aa, Mycobacterium tuberculosis
RPAAPIPLASPNIYRGDAS

SEQ ID NO: 1551711 - protein, 20 aa, Mycobacterium tuberculosis
RPALGLSIGVTNLAAVAADH

SEQ ID NO: 1551712 - protein, 19 aa, Mycobacterium tuberculosis
RPAPAHEWHAMSVEQVRKA

SEQ ID NO: 1551713 - protein, 19 aa, Mycobacterium tuberculosis
RPAPTDGFVGVAPDARLLS

SEQ ID NO: 1551714 - protein, 24 aa, Mycobacterium tuberculosis
RPARRRRWGCRVDRQRRQRWHRRA

SEQ ID NO: 1551715 - protein, 23 aa, Mycobacterium tuberculosis
RPDPDWDGRTGLVTDLLDERMLA

SEQ ID NO: 1551716 - protein, 19 aa, Mycobacterium tuberculosis
RPFYFGVLTWYMDRVLELV

SEQ ID NO: 1551717 - protein, 20 aa, Mycobacterium tuberculosis
RPGSHAGVGCLRAGRHGGRR

SEQ ID NO: 1551718 - protein, 18 aa, Mycobacterium tuberculosis
RPHRGPLGHHSRPDRRTS

SEQ ID NO: 1551719 - protein, 18 aa, Mycobacterium tuberculosis
RPIVVVLFLSAEIAAFEN

SEQ ID NO: 1551720 - protein, 28 aa, Mycobacterium tuberculosis
RPKLGFPVPIRHWLRAGELLEWAYATVG

SEQ ID NO: 1551721 - protein, 17 aa, Mycobacterium tuberculosis
RPMHDRLASAVVAEAHR

SEQ ID NO: 1551722 - protein, 19 aa, Mycobacterium tuberculosis
RPPNWKRPSTPGSIATIPG

SEQ ID NO: 1551723 - protein, 27 aa, Mycobacterium tuberculosis
RPPSRLTGCYWWNWPPTTIRPTGSPTC

SEQ ID NO: 1551724 - protein, 19 aa, Mycobacterium tuberculosis
RPPVIQLWARPRGVAPAAL

SEQ ID NO: 1551725 - protein, 25 aa, Mycobacterium tuberculosis
RPQSAPFDLCIEAMGAIDTQQRLGV

SEQ ID NO: 1551726 - protein, 22 aa, Mycobacterium tuberculosis
RPRRRPRRVLLLCDVSRSMQPY

SEQ ID NO: 1551727 - protein, 23 aa, Mycobacterium tuberculosis
RPRRRPRRVLLLCDVSRSMQPYA

SEQ ID NO: 1551728 - protein, 19 aa, Mycobacterium tuberculosis
RPRWRWVKPRRRLPAVPDR

SEQ ID NO: 1551729 - protein, 18 aa, Mycobacterium tuberculosis
RPVTAWMGALTAANACCC

SEQ ID NO: 1551730 - protein, 23 aa, Mycobacterium tuberculosis
RPYQQRGLAWLAFLSSLGLGSCL

SEQ ID NO: 1551731 - protein, 47 aa, Mycobacterium tuberculosis
RQPGCGQYRRLERGFGQCRRRQRRVRQYRRCQLRVGQCGSGGGPGRG

SEQ ID NO: 1551732 - protein, 22 aa, Mycobacterium tuberculosis
RQQTLWASVDWSYTLLTEPELT

SEQ ID NO: 1551733 - protein, 19 aa, Mycobacterium tuberculosis
RQRAPVAIFVKHPSDSVVA

SEQ ID NO: 1551734 - protein, 24 aa, Mycobacterium tuberculosis
RQRLNAAQALAFVRQRHGLDNGDL

SEQ ID NO: 1551735 - protein, 23 aa, Mycobacterium tuberculosis
RQRRCRRHQRGRSIGGAGGNGGN

SEQ ID NO: 1551736 - protein, 19 aa, Mycobacterium tuberculosis
RRARQEWLAERLATLNRSE

SEQ ID NO: 1551737 - protein, 17 aa, Mycobacterium tuberculosis
RRCRRSRHCRWPRWSRR

SEQ ID NO: 1551738 - protein, 28 aa, Mycobacterium tuberculosis
RRELSALVARSPFGQGAAWPVVQTVQRD

SEQ ID NO: 1551739 - protein, 46 aa, Mycobacterium tuberculosis
RRELSALVARSPFGQVRRGRWSRRCNVTARVCWRNAPAPAPAPTDL

SEQ ID NO: 1551740 - protein, 21 aa, Mycobacterium tuberculosis
RRFARERSRWLFSNPEMTHLS

SEQ ID NO: 1551741 - protein, 17 aa, Mycobacterium tuberculosis
RRFSRRGFLGAGIASGF

SEQ ID NO: 1551742 - protein, 19 aa, Mycobacterium tuberculosis
RRGRPEWIAAGQFAQRYEQ

SEQ ID NO: 1551743 - protein, 19 aa, Mycobacterium tuberculosis
RRGRRGGRVALRQRRRRRC

SEQ ID NO: 1551744 - protein, 19 aa, Mycobacterium tuberculosis
RRHRWCPPRPRAEPDRRSH

SEQ ID NO: 1551745 - protein, 21 aa, Mycobacterium tuberculosis
RRHVLRFRRRRRRRRGERQRR

SEQ ID NO: 1551746 - protein, 17 aa, Mycobacterium tuberculosis
RRIGTWIGAAAEGQVSR

SEQ ID NO: 1551747 - protein, 20 aa, Mycobacterium tuberculosis
RRLPAHPARRRRVGTYGRLR

SEQ ID NO: 1551748 - protein, 19 aa, Mycobacterium tuberculosis
RRLPPFAAPGRPCFTNARP

SEQ ID NO: 1551749 - protein, 18 aa, Mycobacterium tuberculosis
RRLRLTRQALLAAAVVPL

SEQ ID NO: 1551750 - protein, 19 aa, Mycobacterium tuberculosis
RRLTKVLGLPGPHRRTQRS

SEQ ID NO: 1551751 - protein, 30 aa, Mycobacterium tuberculosis; identical to SEQ ID NO: 205878

SEQ ID NO: 1551752 - protein, 21 aa, Mycobacterium tuberculosis
RRPSWEEITEVLEWLSPLPGG

SEQ ID NO: 1551753 - protein, 18 aa, Mycobacterium tuberculosis
RRPTQIIMGIDWIGPGFN

SEQ ID NO: 1551754 - protein, 19 aa, Mycobacterium tuberculosis
RRQRCWQRVSRHSAMQSGW

SEQ ID NO: 1551755 - protein, 21 aa, Mycobacterium tuberculosis
RRRGDLPTTLRVDASGNPETG

SEQ ID NO: 1551756 - protein, 28 aa, Mycobacterium tuberculosis
RRRGQRGQRPSVKRWQRDRRKRWRRVSG

SEQ ID NO: 1551757 - protein, 33 aa, Mycobacterium tuberculosis
RRRPGKLAWPTAAGWTSSCRRPSSPPTGEVDPD

SEQ ID NO: 1551758 - protein, 17 aa, Mycobacterium tuberculosis
RRRRAQQRRWCHRRHRR

SEQ ID NO: 1551759 - protein, 17 aa, Mycobacterium tuberculosis
RRRRPATNLVVAAAAAL

SEQ ID NO: 1551760 - protein, 18 aa, Mycobacterium tuberculosis
RRRRSLRAADGFRAAIAA

SEQ ID NO: 1551761 - protein, 24 aa, Mycobacterium tuberculosis
RRRRWYWRHSWHRRRQLNDRRQRR

SEQ ID NO: 1551762 - protein, 18 aa, Mycobacterium tuberculosis
RRRVTRRGYGDEFMDMNI

SEQ ID NO: 1551763 - protein, 31 aa, Mycobacterium tuberculosis; identical to SEQ ID NO: 235330

SEQ ID NO: 1551764 - protein, 24 aa, Mycobacterium tuberculosis
RRSCVSGRCGWSQRSAVSTIRSGQ

SEQ ID NO: 1551765 - protein, 17 aa, Mycobacterium tuberculosis
RRSLVLVHHCHREQWPV

SEQ ID NO: 1551766 - protein, 19 aa, Mycobacterium tuberculosis
RRSPAPGQLETGWVGHGTL

SEQ ID NO: 1551767 - protein, 27 aa, Mycobacterium tuberculosis
RRTFPARRCRFHRRLPPGHARCPSGRR

SEQ ID NO: 1551768 - protein, 19 aa, Mycobacterium tuberculosis
RRTIPADARSVRWSARGAR

SEQ ID NO: 1551769 - protein, 27 aa, Mycobacterium tuberculosis
RRVSISCRVREGFVMRLAIVGTAAAAA

SEQ ID NO: 1551770 - protein, 20 aa, Mycobacterium tuberculosis
RRVVINLWAHWCAPCMTELP

SEQ ID NO: 1551771 - protein, 21 aa, Mycobacterium tuberculosis
RRYLVAAGCDQCRGRCRRGRV

SEQ ID NO: 1551772 - protein, 21 aa, Mycobacterium tuberculosis
RSALGRPLIGNGANGKPGTGQ

SEQ ID NO: 1551773 - protein, 17 aa, Mycobacterium tuberculosis
RSALWMHVIPGRGAAWL

SEQ ID NO: 1551774 - protein, 25 aa, Mycobacterium tuberculosis
RSAREWLEHMYDKWSAELDFPVPSF

SEQ ID NO: 1551775 - protein, 20 aa, Mycobacterium tuberculosis
RSEAAAKYAALGYLKYPKAV

SEQ ID NO: 1551776 - protein, 25 aa, Mycobacterium tuberculosis
RSEANLDQLIGFFINIVVLRNDLRG

SEQ ID NO: 1551777 - protein, 21 aa, Mycobacterium tuberculosis
RSGKTTLLRHIIRTVREHSTA

SEQ ID NO: 1551778 - protein, 17 aa, Mycobacterium tuberculosis
RSGRFRAVSHLRGLPTA

SEQ ID NO: 1551779 - protein, 19 aa, Mycobacterium tuberculosis
RSHRDLPWREPGVSPWQIL

SEQ ID NO: 1551780 - protein, 17 aa, Mycobacterium tuberculosis
RSLARAVVHAANLGVGV

SEQ ID NO: 1551781 - protein, 19 aa, Mycobacterium tuberculosis
RSNLARFGISPTYPLDFAA

SEQ ID NO: 1551782 - protein, 23 aa, Mycobacterium tuberculosis
RSRLAGPPRRCWPTNTCRRCRRW

SEQ ID NO: 1551783 - protein, 19 aa, Mycobacterium tuberculosis
RSRLVSLALSNLFGQNTPA

SEQ ID NO: 1551784 - protein, 21 aa, Mycobacterium tuberculosis
RTALDAARARLATFQTAVNKV

SEQ ID NO: 1551785 - protein, 18 aa, Mycobacterium tuberculosis
RTAVTASHACADTRPAGS

SEQ ID NO: 1551786 - protein, 22 aa, Mycobacterium tuberculosis
RTGESLAVLGWNMSVSNLRWSG

SEQ ID NO: 1551787 - protein, 23 aa, Mycobacterium tuberculosis
RTGESLAVLGWNMSVSNLRWSGD

SEQ ID NO: 1551788 - protein, 24 aa, Mycobacterium tuberculosis
RTLQAGADIALWVTTKEVPAVLDR

SEQ ID NO: 1551789 - protein, 19 aa, Mycobacterium tuberculosis
RTLSTSADNVWAIGDATVL

SEQ ID NO: 1551790 - protein, 17 aa, Mycobacterium tuberculosis
RTPWRLNQNYLRDIRLI

SEQ ID NO: 1551791 - protein, 20 aa, Mycobacterium tuberculosis
RVCVTVGALVALACMVLVGC

SEQ ID NO: 1551792 - protein, 24 aa, Mycobacterium tuberculosis
RVFRPRWLLSAAMTKRAATAAMVM

SEQ ID NO: 1551793 - protein, 19 aa, Mycobacterium tuberculosis
RVGQCGSGGGPGRGGQHRV

SEQ ID NO: 1551794 - protein, 17 aa, Mycobacterium tuberculosis
RVHPAPMETCGAVADLD

SEQ ID NO: 1551795 - protein, 17 aa, Mycobacterium tuberculosis
RVLCASPTTLPGSGFHD

SEQ ID NO: 1551796 - protein, 28 aa, Mycobacterium tuberculosis
RVLCTDDLRVARIRGCGADELSTAWNRA

SEQ ID NO: 1551797 - protein, 24 aa, Mycobacterium tuberculosis
RVNDPRLSAIATISPADIVDRILD

SEQ ID NO: 1551798 - protein, 17 aa, Mycobacterium tuberculosis
RVNSVAPGYIWGDTLKS

SEQ ID NO: 1551799 - protein, 22 aa, Mycobacterium tuberculosis
RVNSVAPGYIWGDTLKSYFDYQ

SEQ ID NO: 1551800 - protein, 24 aa, Mycobacterium tuberculosis
RVSISCRVREGFVMRLAIVGTAAA

SEQ ID NO: 1551801 - protein, 27 aa, Mycobacterium tuberculosis
RVSRAVCRGPNLGWRVVRGRRDRQRHV

SEQ ID NO: 1551802 - protein, 20 aa, Mycobacterium tuberculosis
RWDDPFRALDMLASLWSSTG

SEQ ID NO: 1551803 - protein, 22 aa, Mycobacterium tuberculosis
RWLADHVIAGVVLLAGAAFVEL

SEQ ID NO: 1551804 - protein, 20 aa, Mycobacterium tuberculosis
RWLAEGVADFVARPKTPPPA

SEQ ID NO: 1551805 - protein, 19 aa, Mycobacterium tuberculosis
RWRVGTPTRYGWCPATSTP

SEQ ID NO: 1551806 - protein, 17 aa, Mycobacterium tuberculosis
RWTIAILAVVAALMAAL

SEQ ID NO: 1551807 - protein, 25 aa, Mycobacterium tuberculosis
RYASTEAAVERSLLGAVNAPTEALL

SEQ ID NO: 1551808 - protein, 17 aa, Mycobacterium tuberculosis
RYFVPRFAASPITNDND

SEQ ID NO: 1551809 - protein, 22 aa, Mycobacterium tuberculosis
RYRDRIPILIGGGGEKKTFAIA

SEQ ID NO: 1551810 - protein, 24 aa, Mycobacterium tuberculosis
SAAEARIAAVAAMAAVGTGCDGVA

SEQ ID NO: 1551811 - protein, 19 aa, Mycobacterium tuberculosis
SAAIASLFSGYARDYQALS

SEQ ID NO: 1551812 - protein, 18 aa, Mycobacterium tuberculosis
SAAVAALFSAHAGQYQQL

SEQ ID NO: 1551813 - protein, 22 aa, Mycobacterium tuberculosis
SADSRAHCPLLCTDDPLPGTVP

SEQ ID NO: 1551814 - protein, 18 aa, Mycobacterium tuberculosis
SAFEAARAATVHPLLVAA

SEQ ID NO: 1551815 - protein, 21 aa, Mycobacterium tuberculosis
SAFGGGNAFGGRGGDGGDGGD

SEQ ID NO: 1551816 - protein, 26 aa, Mycobacterium tuberculosis
SAFHAPVCAGVDWRRRGVCGCRGRQR

SEQ ID NO: 1551817 - protein, 18 aa, Mycobacterium tuberculosis
SAFHAQFVQALTGGGGAY

SEQ ID NO: 1551818 - protein, 17 aa, Mycobacterium tuberculosis
SAGCPDAEVVFARGTGE

SEQ ID NO: 1551819 - protein, 21 aa, Mycobacterium tuberculosis
SAGGTGRQSGTGGAGGAGADN

SEQ ID NO: 1551820 - protein, 20 aa, Mycobacterium tuberculosis
SAGKWPDKFLAGAAGVAHGV

SEQ ID NO: 1551821 - protein, 17 aa, Mycobacterium tuberculosis
SAGLFYGSGGAGGNGGY

SEQ ID NO: 1551822 - protein, 27 aa, Mycobacterium tuberculosis
SAGWDGRQRGLGVRQRRPRRSRRGRAR

SEQ ID NO: 1551823 - protein, 18 aa, Mycobacterium tuberculosis
SAHGRDFQALSARAAAFH

SEQ ID NO: 1551824 - protein, 22 aa, Mycobacterium tuberculosis
SAISKRGAASMFAAPAAARAAV

SEQ ID NO: 1551825 - protein, 23 aa, Mycobacterium tuberculosis
SALDRMKAIVAQAVLDHVTDEEY

SEQ ID NO: 1551826 - protein, 18 aa, Mycobacterium tuberculosis
SALGRPLIGNGANGKPGT

SEQ ID NO: 1551827 - protein, 19 aa, Mycobacterium tuberculosis
SALGRPLIGNGANGKPGTG

SEQ ID NO: 1551828 - protein, 41 aa, Mycobacterium tuberculosis
SAPDYYRRAEICRERLGPVLRRLTVNYPPIMFHPLNTITAY

SEQ ID NO: 1551829 - protein, 21 aa, Mycobacterium tuberculosis
SAPLRYGELIAALNATSGERA

SEQ ID NO: 1551830 - protein, 19 aa, Mycobacterium tuberculosis
SAPPSKIFRTRALRVPGVG

SEQ ID NO: 1551831 - protein, 23 aa, Mycobacterium tuberculosis
SAPVGLPGAGAWVSARGHPDTVP

SEQ ID NO: 1551832 - protein, 22 aa, Mycobacterium tuberculosis
SAQAAAFHARFVQALAGAMGAY

SEQ ID NO: 1551833 - protein, 22 aa, Mycobacterium tuberculosis
SARRLRLRSRRAGDIGLCHLTP

SEQ ID NO: 1551834 - protein, 18 aa, Mycobacterium tuberculosis
SATAVSAERAEPAAERAA

SEQ ID NO: 1551835 - protein, 34 aa, Mycobacterium tuberculosis
SATWRARPRLAITPAGLAIRGWFRTQLLRHSNIK

SEQ ID NO: 1551836 - protein, 23 aa, Mycobacterium tuberculosis
SAVAGCSRGGSSKAGRSSSVAGT

SEQ ID NO: 1551837 - protein, 30 aa, Mycobacterium tuberculosis
SAVAPETTAPVWITMLWPLADRPPVGPRGH

SEQ ID NO: 1551838 - protein, 30 aa, Mycobacterium tuberculosis
SAVAPETTAPVWITMLWPLADRPRLAPGAP

SEQ ID NO: 1551839 - protein, 25 aa, Mycobacterium tuberculosis
SAVTAAVAACWPATAAPAVPVATAV

SEQ ID NO: 1551840 - protein, 20 aa, Mycobacterium tuberculosis
SAYAEEFPQRVRAMILDGAV

SEQ ID NO: 1551841 - protein, 34 aa, Mycobacterium tuberculosis; identical to SEQ ID NO: 206263

SEQ ID NO: 1551842 - protein, 23 aa, Mycobacterium tuberculosis
SCGWRGLNSLPLPGTQGNGPGSF

SEQ ID NO: 1551843 - protein, 21 aa, Mycobacterium tuberculosis
SCQAIWRLDDGYLAASDPRRD

SEQ ID NO: 1551844 - protein, 20 aa, Mycobacterium tuberculosis
SDAWDRLFAGPRPTELHPFV

SEQ ID NO: 1551845 - protein, 19 aa, Mycobacterium tuberculosis
SDFPDRPDNLLAVANAAIG

SEQ ID NO: 1551846 - protein, 24 aa, Mycobacterium tuberculosis
SDGEPATEWTLNWAHQLIENAPHP

SEQ ID NO: 1551847 - protein, 30 aa, Mycobacterium tuberculosis
SDPFVAILRFPFIPQAMREHYAELEIKAFA

SEQ ID NO: 1551848 - protein, 34 aa, Mycobacterium tuberculosis
SDRRRGRPGQHGLRQCRQRQLWCLQPGPCATSGW

SEQ ID NO: 1551849 - protein, 25 aa, Mycobacterium tuberculosis
SDTVDAFALPDCAGHPTWYEPSEWL

SEQ ID NO: 1551850 - protein, 24 aa, Mycobacterium tuberculosis
SDYSPVFGCLFKGIARGVKEFAPL

SEQ ID NO: 1551851 - protein, 19 aa, Mycobacterium tuberculosis
SELPGWLQANRHVKPTGSA

SEQ ID NO: 1551852 - protein, 19 aa, Mycobacterium tuberculosis
SEVAMEIALNAVRIHGGYG

SEQ ID NO: 1551853 - protein, 32 aa, Mycobacterium tuberculosis; identical to SEQ ID NO: 1475249

SEQ ID NO: 1551854 - protein, 17 aa, Mycobacterium tuberculosis
SFSTGIANTGDYNTGSF

SEQ ID NO: 1551855 - protein, 20 aa, Mycobacterium tuberculosis
SFTTLRLIYQEMLANYRVGQ

SEQ ID NO: 1551856 - protein, 17 aa, Mycobacterium tuberculosis
SFVIAAPEVIAAAATDL

SEQ ID NO: 1551857 - protein, 28 aa, Mycobacterium tuberculosis
SGAAGGVGGRGGWLLGNGGTGGAGGAAG

SEQ ID NO: 1551858 - protein, 17 aa, Mycobacterium tuberculosis
SGADNASGIGADGGAGG

SEQ ID NO: 1551859 - protein, 20 aa, Mycobacterium tuberculosis
SGADPLWFTSLFSQHTLDLL

SEQ ID NO: 1551860 - protein, 18 aa, Mycobacterium tuberculosis
SGAGRAGVVPRYGVRLTV

SEQ ID NO: 1551861 - protein, 20 aa, Mycobacterium tuberculosis
SGALLKRGYTAGQVRNRESG

SEQ ID NO: 1551862 - protein, 20 aa, Mycobacterium tuberculosis
SGAYPRWALANSATGMMSGD

SEQ ID NO: 1551863 - protein, 26 aa, Mycobacterium tuberculosis
SGDDCPDWVAGELWVSGRGIARGYRG

SEQ ID NO: 1551864 - protein, 20 aa, Mycobacterium tuberculosis
SGDHPGIDWAKYALKAPVMM

SEQ ID NO: 1551865 - protein, 19 aa, Mycobacterium tuberculosis
SGDRVIPQWVKIRNVDGFN

SEQ ID NO: 1551866 - protein, 20 aa, Mycobacterium tuberculosis
SGDRVIPQWVKIRNVDRFNG

SEQ ID NO: 1551867 - protein, 24 aa, Mycobacterium tuberculosis
SGERFVLGVGFGWNVEELADHGVP

SEQ ID NO: 1551868 - protein, 19 aa, Mycobacterium tuberculosis
SGGALRFLQHHAPQQRPSF

SEQ ID NO: 1551869 - protein, 21 aa, Mycobacterium tuberculosis
SGGANLYGGTGGTGGTGGTSG

SEQ ID NO: 1551870 - protein, 23 aa, Mycobacterium tuberculosis
SGGSGGAGGFGFADGGQGGPGGN

SEQ ID NO: 1551871 - protein, 21 aa, Mycobacterium tuberculosis
SGGVGGVFGNGGFGGAGGLGA

SEQ ID NO: 1551872 - protein, 20 aa, Mycobacterium tuberculosis
SGKLKRRAVAQAYRDGTLPR

SEQ ID NO: 1551873 - protein, 17 aa, Mycobacterium tuberculosis
SGLAALIRARFPTLTAR

SEQ ID NO: 1551874 - protein, 27 aa, Mycobacterium tuberculosis
SGLPLRAMVMVLLFLGVVFLLLGWQAL

SEQ ID NO: 1551875 - protein, 29 aa, Mycobacterium tuberculosis
SGLPLRAMVMVLLFLGVVFLLLVWQALGS

SEQ ID NO: 1551876 - protein, 17 aa, Mycobacterium tuberculosis
SGLTAVHQACRSLDDGE

SEQ ID NO: 1551877 - protein, 19 aa, Mycobacterium tuberculosis
SGMYFWLDYADAFEPYFSV

SEQ ID NO: 1551878 - protein, 25 aa, Mycobacterium tuberculosis
SGNQARLKLAIDSGEMGFIPSNATV

SEQ ID NO: 1551879 - protein, 36 aa, Mycobacterium tuberculosis; identical to SEQ ID NO: 1473735

SEQ ID NO: 1551880 - protein, 31 aa, Mycobacterium tuberculosis; identical to SEQ ID NO: 206407

SEQ ID NO: 1551881 - protein, 18 aa, Mycobacterium tuberculosis
SGPARWFLDHARVALSSG

SEQ ID NO: 1551882 - protein, 19 aa, Mycobacterium tuberculosis
SGPYFKVLLANLVPGQILQ

SEQ ID NO: 1551883 - protein, 18 aa, Mycobacterium tuberculosis
SGQIGFGSLNSGSHNIGL

SEQ ID NO: 1551884 - protein, 33 aa, Mycobacterium tuberculosis; identical to SEQ ID NO: 206423

SEQ ID NO: 1551885 - protein, 17 aa, Mycobacterium tuberculosis
SGSGRPWDGDQLLRALG

SEQ ID NO: 1551886 - protein, 19 aa, Mycobacterium tuberculosis
SGSGRPWDRDQLLRALGLR

SEQ ID NO: 1551887 - protein, 22 aa, Mycobacterium tuberculosis
SGSRMRPDVVIAFMDQFGDVIY

SEQ ID NO: 1551888 - protein, 23 aa, Mycobacterium tuberculosis
SGTEFNSQFSAAVRKIYDSGHNT

SEQ ID NO: 1551889 - protein, 24 aa, Mycobacterium tuberculosis
SGTIAGGVYKFFIARRDPVTMSGM

SEQ ID NO: 1551890 - protein, 19 aa, Mycobacterium tuberculosis
SGTQLRGGIEVVDVPHIDG

SEQ ID NO: 1551891 - protein, 22 aa, Mycobacterium tuberculosis
SGVSIDGLIAILTFPPAESVFD

SEQ ID NO: 1551892 - protein, 18 aa, Mycobacterium tuberculosis
SHEARFVLIGTMNPEEGE

SEQ ID NO: 1551893 - protein, 20 aa, Mycobacterium tuberculosis
SHEARFVLIGTMNPEEGELR

SEQ ID NO: 1551894 - protein, 24 aa, Mycobacterium tuberculosis
SHPTTLGGYPWPVGSTGWRWPSDR

SEQ ID NO: 1551895 - protein, 26 aa, Mycobacterium tuberculosis
SHSWFAGYRGDLAFASLIVGGGSSEY

SEQ ID NO: 1551896 - protein, 26 aa, Mycobacterium tuberculosis
SIAGQRAHFGPITIPNITVVGPTTTV

SEQ ID NO: 1551897 - protein, 20 aa, Mycobacterium tuberculosis
SIGSPIPLSLALGTTTWTLF

SEQ ID NO: 1551898 - protein, 17 aa, Mycobacterium tuberculosis
SIPYRVPYPQVMPTQET

SEQ ID NO: 1551899 - protein, 17 aa, Mycobacterium tuberculosis
SIYAEYRLSTTVRKAAT

SEQ ID NO: 1551900 - protein, 26 aa, Mycobacterium tuberculosis
SKARAGGLVEGRRLTKVLGLPGPHRR

SEQ ID NO: 1551901 - protein, 17 aa, Mycobacterium tuberculosis
SKIRGREPIRIHPDDAA

SEQ ID NO: 1551902 - protein, 42 aa, Mycobacterium tuberculosis
SKKQIRKKQGGQWGGLCVWPRPLEPGVLGGGGEESLQVVAPV

SEQ ID NO: 1551903 - protein, 17 aa, Mycobacterium tuberculosis
SKMTTPLISSAPRPPLS

SEQ ID NO: 1551904 - protein, 17 aa, Mycobacterium tuberculosis
SKRVMWQGIGHGASIYS

SEQ ID NO: 1551905 - protein, 23 aa, Mycobacterium tuberculosis
SKTPGATVALTFQDPSGGSRTVQ

SEQ ID NO: 1551906 - protein, 18 aa, Mycobacterium tuberculosis
SLAISALFGQHAQAYQAL

SEQ ID NO: 1551907 - protein, 19 aa, Mycobacterium tuberculosis
SLAISALFGQHAQAYQALS

SEQ ID NO: 1551908 - protein, 23 aa, Mycobacterium tuberculosis
SLESVKVMRGCLVQSRKTTSVLA

SEQ ID NO: 1551909 - protein, 20 aa, Mycobacterium tuberculosis
SLMDAWAGPVVMQLMEAAKP

SEQ ID NO: 1551910 - protein, 24 aa, Mycobacterium tuberculosis
SLPADLPALASGGHSGRRSIAPTP

SEQ ID NO: 1551911 - protein, 24 aa, Mycobacterium tuberculosis
SLPADLPALASGVIPAAPIAPTPP

SEQ ID NO: 1551912 - protein, 18 aa, Mycobacterium tuberculosis
SLPLTVTEWDEWGNPLND

SEQ ID NO: 1551913 - protein, 24 aa, Mycobacterium tuberculosis
SLSESIPIRIPVDIPASVIDGISM

SEQ ID NO: 1551914 - protein, 17 aa, Mycobacterium tuberculosis
SLTRLTSVLSHRSAEIA

SEQ ID NO: 1551915 - protein, 21 aa, Mycobacterium tuberculosis
SLYAAFWPPCALIFFSNLRCV

SEQ ID NO: 1551916 - protein, 47 aa, Mycobacterium tuberculosis
SMNCRNGFQWSAHFDPRYGSASKDVQQQLPAGSPVKKKKKKKKKKKK

SEQ ID NO: 1551917 - protein, 30 aa, Mycobacterium tuberculosis; identical to SEQ ID NO: 206547

SEQ ID NO: 1551918 - protein, 18 aa, Mycobacterium tuberculosis
SNALCANEILSLLDGETT

SEQ ID NO: 1551919 - protein, 17 aa, Mycobacterium tuberculosis
SNATPREVLPASAAMDA

SEQ ID NO: 1551920 - protein, 26 aa, Mycobacterium tuberculosis
SNGMLWRGDHEGLFGLSYGITIPQFP

SEQ ID NO: 1551921 - protein, 22 aa, Mycobacterium tuberculosis
SNIEPQTSVLIGTQGGDGTPGG

SEQ ID NO: 1551922 - protein, 22 aa, Mycobacterium tuberculosis
SNPRWTCDYGLAVVPHAVLVLS

SEQ ID NO: 1551923 - protein, 22 aa, Mycobacterium tuberculosis
SPDGQDGGLLFGNGGAGYNSAA

SEQ ID NO: 1551924 - protein, 30 aa, Mycobacterium tuberculosis
SPEDFWRSAGLPAYRWPDPNGTRFPNGAPP

SEQ ID NO: 1551925 - protein, 28 aa, Mycobacterium tuberculosis
SPGATAFPWRRQSALVQWYVETSGSPPE

SEQ ID NO: 1551926 - protein, 18 aa, Mycobacterium tuberculosis
SPGLLSYAVLGKGSVGNI

SEQ ID NO: 1551927 - protein, 25 aa, Mycobacterium tuberculosis
SPGSTMTLPLISMRFEGEDWILGST

SEQ ID NO: 1551928 - protein, 19 aa, Mycobacterium tuberculosis
SPIPTTLIGPIHINTGFSI

SEQ ID NO: 1551929 - protein, 26 aa, Mycobacterium tuberculosis
SPLFPDLPSFPGFPGFPEFPAIPGFP

SEQ ID NO: 1551930 - protein, 18 aa, Mycobacterium tuberculosis
SPLIRWIINVPREFINDY

SEQ ID NO: 1551931 - protein, 23 aa, Mycobacterium tuberculosis
SPPSPPRPSLPPSPASLPPIGVF

SEQ ID NO: 1551932 - protein, 28 aa, Mycobacterium tuberculosis
SPRPRRCHRRTQSPCRSPKPRVGRKRTR

SEQ ID NO: 1551933 - protein, 18 aa, Mycobacterium tuberculosis
SPRSVWMPLRSNGCGAPV

SEQ ID NO: 1551934 - protein, 17 aa, Mycobacterium tuberculosis
SPRVVAAPFDPAVGAAL

SEQ ID NO: 1551935 - protein, 20 aa, Mycobacterium tuberculosis
SPVDACSPLGGSASSLAAIP

SEQ ID NO: 1551936 - protein, 17 aa, Mycobacterium tuberculosis
SQGDFGVAGTWTYLPPW

SEQ ID NO: 1551937 - protein, 27 aa, Mycobacterium tuberculosis
SQMSFVIAVPEALTMAASDLANIGSTI

SEQ ID NO: 1551938 - protein, 20 aa, Mycobacterium tuberculosis
SQVPWLWAKFIGHAQAIAPA

SEQ ID NO: 1551939 - protein, 28 aa, Mycobacterium tuberculosis
SRAAGLPRLSWFAGLTWFAGGSTGAGCA

SEQ ID NO: 1551940 - protein, 27 aa, Mycobacterium tuberculosis
SRATLPRTIWLCISETSSLLLTRCECR

SEQ ID NO: 1551941 - protein, 19 aa, Mycobacterium tuberculosis
SRAVRWDDIDGLRFHRGSW

SEQ ID NO: 1551942 - protein, 20 aa, Mycobacterium tuberculosis
SRDRLRSGNLQELIDTKSVV

SEQ ID NO: 1551943 - protein, 19 aa, Mycobacterium tuberculosis
SRGAGCCRARRFTSFTNPT

SEQ ID NO: 1551944 - protein, 18 aa, Mycobacterium tuberculosis
SRLAIRTDTILGRKVLEI

SEQ ID NO: 1551945 - protein, 18 aa, Mycobacterium tuberculosis
SRLAVSWFGHSTALLEID

SEQ ID NO: 1551946 - protein, 20 aa, Mycobacterium tuberculosis
SRLDVPALWAPRRRDEELRV

SEQ ID NO: 1551947 - protein, 18 aa, Mycobacterium tuberculosis
SRLVGAVLIGRDRAAVAE

SEQ ID NO: 1551948 - protein, 21 aa, Mycobacterium tuberculosis
SRPLPACGFLERDEVPIRTRI

SEQ ID NO: 1551949 - protein, 23 aa, Mycobacterium tuberculosis
SRPSRYTNIVGCVSDRALLRDVM

SEQ ID NO: 1551950 - protein, 25 aa, Mycobacterium tuberculosis
SRRGRRPGVDRGRPAAGTRNRKNDP

SEQ ID NO: 1551951 - protein, 18 aa, Mycobacterium tuberculosis
SRSRLQLASAGARRNLIA

SEQ ID NO: 1551952 - protein, 18 aa, Mycobacterium tuberculosis
SRSWCGRAGTATIAAVLL

SEQ ID NO: 1551953 - protein, 18 aa, Mycobacterium tuberculosis
SRYRPRRETCVVRPAREM

SEQ ID NO: 1551954 - protein, 19 aa, Mycobacterium tuberculosis
SSALIGYAQGGSGGLGGFG

SEQ ID NO: 1551955 - protein, 19 aa, Mycobacterium tuberculosis
SSCMVTFKTSYGVIQQALF

SEQ ID NO: 1551956 - protein, 20 aa, Mycobacterium tuberculosis
SSGVAAYFYVRVIVSMFFTE

SEQ ID NO: 1551957 - protein, 24 aa, Mycobacterium tuberculosis
SSICPPRRCPPAVADHVAAVALFG

SEQ ID NO: 1551958 - protein, 22 aa, Mycobacterium tuberculosis
SSKIRCALVPLIPKEDTAARRG

SEQ ID NO: 1551959 - protein, 27 aa, Mycobacterium tuberculosis
SSLRLWPDRRLSRRGVEIISRRAPRGD

SEQ ID NO: 1551960 - protein, 18 aa, Mycobacterium tuberculosis
SSNPLANFAPGYLPTIEP

SEQ ID NO: 1551961 - protein, 24 aa, Mycobacterium tuberculosis
SSPDGQDGGLLFGNGGAGYNSAAT

SEQ ID NO: 1551962 - protein, 30 aa, Mycobacterium tuberculosis
SSRPRWHRPHCARRCGCFARGPASATGSEQ

SEQ ID NO: 1551963 - protein, 21 aa, Mycobacterium tuberculosis
STAIAALFCAQDLAYQEASAL

SEQ ID NO: 1551964 - protein, 18 aa, Mycobacterium tuberculosis
STAISALFGAHAQAYQAL

SEQ ID NO: 1551965 - protein, 18 aa, Mycobacterium tuberculosis
STEARCLSGVCWGAGEMR

SEQ ID NO: 1551966 - protein, 26 aa, Mycobacterium tuberculosis
STPQPVSPWARYSAQLHHRSIQPYAA

SEQ ID NO: 1551967 - protein, 19 aa, Mycobacterium tuberculosis
STQMARFKAARLTGRQGRA

SEQ ID NO: 1551968 - protein, 25 aa, Mycobacterium tuberculosis
STTIGAFAIPGGPGYFNSSTAPSSG

SEQ ID NO: 1551969 - protein, 18 aa, Mycobacterium tuberculosis
STTMAWRTWVWAILGLPT

SEQ ID NO: 1551970 - protein, 20 aa, Mycobacterium tuberculosis
STVARHRPTGATGSARTARA

SEQ ID NO: 1551971 - protein, 21 aa, Mycobacterium tuberculosis
STVARHRPTGATGSARTARAA

SEQ ID NO: 1551972 - protein, 23 aa, Mycobacterium tuberculosis
SVDCFRSQSGMKVMGFAVKTVDD

SEQ ID NO: 1551973 - protein, 26 aa, Mycobacterium tuberculosis
SVLAYPRVVWIAGGLLKGASLHAEVA

SEQ ID NO: 1551974 - protein, 31 aa, Mycobacterium tuberculosis; identical to SEQ ID NO: 206766

SEQ ID NO: 1551975 - protein, 23 aa, Mycobacterium tuberculosis
SVPHYGIGYGLLRYVYAPTGRVL

SEQ ID NO: 1551976 - protein, 22 aa, Mycobacterium tuberculosis
SVPMLFAKPSYYGQFTDSGGLH

SEQ ID NO: 1551977 - protein, 24 aa, Mycobacterium tuberculosis
SVQRESGIEFGRYLTEAVCEHLGM

SEQ ID NO: 1551978 - protein, 18 aa, Mycobacterium tuberculosis
SVSLAWAAAIGLMVPIGL

SEQ ID NO: 1551979 - protein, 17 aa, Mycobacterium tuberculosis
SVTSGLAGQSWQGAAAA

SEQ ID NO: 1551980 - protein, 25 aa, Mycobacterium tuberculosis
SWQQALRGLPGLGQVASAISGGAAR

SEQ ID NO: 1551981 - protein, 18 aa, Mycobacterium tuberculosis
SYTPPADGLPRPWDPLPC

SEQ ID NO: 1551982 - protein, 23 aa, Mycobacterium tuberculosis
SYYLASAFGEVWMQPSGSVGAGR

SEQ ID NO: 1551983 - protein, 25 aa, Mycobacterium tuberculosis
TAAPRPAAPAAKGRPASPTQARSQG

SEQ ID NO: 1551984 - protein, 23 aa, Mycobacterium tuberculosis
TAAQAAAMIAEFEAVKTAVVQPM

SEQ ID NO: 1551985 - protein, 25 aa, Mycobacterium tuberculosis
TAARPPCLPSRWSRCCCASPVRVHI

SEQ ID NO: 1551986 - protein, 17 aa, Mycobacterium tuberculosis
TACSFSIGTSHSHSVSK

SEQ ID NO: 1551987 - protein, 19 aa, Mycobacterium tuberculosis
TAELLRLALTGKRKPYIYT

SEQ ID NO: 1551988 - protein, 22 aa, Mycobacterium tuberculosis
TAGAFSRPGLPVEYLQVPSPSM

SEQ ID NO: 1551989 - protein, 18 aa, Mycobacterium tuberculosis
TAIVARVPVRAFINPANR

SEQ ID NO: 1551990 - protein, 19 aa, Mycobacterium tuberculosis
TANATPLQALQTVQQNVLT

SEQ ID NO: 1551991 - protein, 24 aa, Mycobacterium tuberculosis
TAPGHMLGGLPLGHSVNAGSGINN

SEQ ID NO: 1551992 - protein, 24 aa, Mycobacterium tuberculosis
TAPSRSAFVAGPWGAVASLSPELF

SEQ ID NO: 1551993 - protein, 22 aa, Mycobacterium tuberculosis
TAQKYPAILAMTSLNDTRVYYV

SEQ ID NO: 1551994 - protein, 28 aa, Mycobacterium tuberculosis
TARPGRCRQCPPGLCHLPGGLRRQRSLS

SEQ ID NO: 1551995 - protein, 27 aa, Mycobacterium tuberculosis
TATPLRPGIWRAYADHRMAMAGAIIGL

SEQ ID NO: 1551996 - protein, 22 aa, Mycobacterium tuberculosis
TATPRAYPFTNLIGPASTNDIV

SEQ ID NO: 1551997 - protein, 22 aa, Mycobacterium tuberculosis
TAVLAGPVRPAGKAGPAVAAAS

SEQ ID NO: 1551998 - protein, 21 aa, Mycobacterium tuberculosis
TAVRWKNVLRQAAVYSACQKW

SEQ ID NO: 1551999 - protein, 17 aa, Mycobacterium tuberculosis
TDIPVRVYWPPVVRDNL

SEQ ID NO: 1552000 - protein, 20 aa, Mycobacterium tuberculosis
TDLAGIRSAISAATAAAAAP

SEQ ID NO: 1552001 - protein, 26 aa, Mycobacterium tuberculosis
TDLPGELMSALSQGLSQFGINIPPVP

SEQ ID NO: 1552002 - protein, 24 aa, Mycobacterium tuberculosis
TDPDELIALLGPVLADRPAFTGQP

SEQ ID NO: 1552003 - protein, 24 aa, Mycobacterium tuberculosis
TDSFAVLALLCHRLSHDEVKAVAN

SEQ ID NO: 1552004 - protein, 25 aa, Mycobacterium tuberculosis
TDSFAVLALLCRRLSHDEVKAVANE

SEQ ID NO: 1552005 - protein, 17 aa, Mycobacterium tuberculosis
TDVAIMLGLAYVLATES

SEQ ID NO: 1552006 - protein, 24 aa, Mycobacterium tuberculosis
TEFDYLEMWAQDVAAMVGYHAGAK

SEQ ID NO: 1552007 - protein, 26 aa, Mycobacterium tuberculosis
TEIAQTVARWLVLYLRRPGGQTQFAA

SEQ ID NO: 1552008 - protein, 23 aa, Mycobacterium tuberculosis
TEPDIGPIIVPSFVLSVPTFAIA

SEQ ID NO: 1552009 - protein, 23 aa, Mycobacterium tuberculosis
TESGLRPGWHRVPGVSASGSDSA

SEQ ID NO: 1552010 - protein, 21 aa, Mycobacterium tuberculosis
TESWMGPASMAMVAAAQPYLA

SEQ ID NO: 1552011 - protein, 23 aa, Mycobacterium tuberculosis
TEVARIGSALSLASAVAAAQTSA

SEQ ID NO: 1552012 - protein, 25 aa, Mycobacterium tuberculosis
TFHEDPVAGVWAVGGVGGDGGSGGS

SEQ ID NO: 1552013 - protein, 17 aa, Mycobacterium tuberculosis
TGAGYWVAHGALGGITI

SEQ ID NO: 1552014 - protein, 29 aa, Mycobacterium tuberculosis
TGATGLPELGAWLAGAARFTVVTHAALAR

SEQ ID NO: 1552015 - protein, 25 aa, Mycobacterium tuberculosis
TGATLGFARLRRVSAGAGGHRPAVW

SEQ ID NO: 1552016 - protein, 23 aa, Mycobacterium tuberculosis
TGFPEAVAAHWLTTEERHGLGND

SEQ ID NO: 1552017 - protein, 18 aa, Mycobacterium tuberculosis
TGGAGFAGGAGGEGGAGG

SEQ ID NO: 1552018 - protein, 27 aa, Mycobacterium tuberculosis
TGGAGGAGFSRALIVAGDNGGDGGNGG

SEQ ID NO: 1552019 - protein, 24 aa, Mycobacterium tuberculosis
TGGAGRHRRLRVAKAATGGVGCGV

SEQ ID NO: 1552020 - protein, 24 aa, Mycobacterium tuberculosis
TGGASRSGGFGGAGGAGGDAGMFF

SEQ ID NO: 1552021 - protein, 28 aa, Mycobacterium tuberculosis
TGGHGGVGGDGGWLAPGGAGGAGGQGGA

SEQ ID NO: 1552022 - protein, 18 aa, Mycobacterium tuberculosis
TGGLFFSPTIDFLDHPPP

SEQ ID NO: 1552023 - protein, 17 aa, Mycobacterium tuberculosis
TGGLLFGAGGNGGPGGS

SEQ ID NO: 1552024 - protein, 24 aa, Mycobacterium tuberculosis
TGGNGALLFGFGGAGGAGGHGGAA

SEQ ID NO: 1552025 - protein, 26 aa, Mycobacterium tuberculosis
TGGNGGRAGLLLGVGGTGGSGGAGGA

SEQ ID NO: 1552026 - protein, 19 aa, Mycobacterium tuberculosis
TGGRGFFQRTGGVGGAGGN

SEQ ID NO: 1552027 - protein, 27 aa, Mycobacterium tuberculosis
TGGVGGKVMLFGAERLLASSGSPTAAS

SEQ ID NO: 1552028 - protein, 19 aa, Mycobacterium tuberculosis
TGIRAGCYGASPDRRAGKY

SEQ ID NO: 1552029 - protein, 31 aa, Mycobacterium tuberculosis
TGLDIRPNPGIGHPCWANYFPVTRTVPEPPS

SEQ ID NO: 1552030 - protein, 32 aa, Mycobacterium tuberculosis
TGLPELGAWLAGGRPVHRCYPCCPGPPGRSGG

SEQ ID NO: 1552031 - protein, 19 aa, Mycobacterium tuberculosis
TGLYPPGSTFKMITAGAAV

SEQ ID NO: 1552032 - protein, 25 aa, Mycobacterium tuberculosis
TGQAGGAGGILWGNGGAGGSGAPGQ

SEQ ID NO: 1552033 - protein, 17 aa, Mycobacterium tuberculosis
TGQDLLTRFCLARPEGG

SEQ ID NO: 1552034 - protein, 24 aa, Mycobacterium tuberculosis
TGQPGGAGGLLWGNGGNGGSGAAG

SEQ ID NO: 1552035 - protein, 23 aa, Mycobacterium tuberculosis
TGSEADAAVHFVQRHCETGNSVV

SEQ ID NO: 1552036 - protein, 23 aa, Mycobacterium tuberculosis
TGVAGVCALAAVTGINTAVAVAA

SEQ ID NO: 1552037 - protein, 19 aa, Mycobacterium tuberculosis
TGWTGRFVSRILIDGSTLS

SEQ ID NO: 1552038 - protein, 17 aa, Mycobacterium tuberculosis
THHYRFTLYHLPVALQL

SEQ ID NO: 1552039 - protein, 23 aa, Mycobacterium tuberculosis
THSPDRFVTYHVMNPYDDGIGLD

SEQ ID NO: 1552040 - protein, 26 aa, Mycobacterium tuberculosis
THTFMPNFALEWLINAYHRRGADIEG

SEQ ID NO: 1552041 - protein, 26 aa, Mycobacterium tuberculosis
TICHVIPGLLCWVGEYAGQVREEYCA

SEQ ID NO: 1552042 - protein, 22 aa, Mycobacterium tuberculosis
TIDRIPLNLGASVTVGPILING

SEQ ID NO: 1552043 - protein, 17 aa, Mycobacterium tuberculosis
TIPAAPLPLTIDIDGQI

SEQ ID NO: 1552044 - protein, 25 aa, Mycobacterium tuberculosis
TIPAIPIGLELNGGVGPITVLPIQI

SEQ ID NO: 1552045 - protein, 25 aa, Mycobacterium tuberculosis
TISEIPIDLQVIGGIGPIHVQPIDI

SEQ ID NO: 1552046 - protein, 30 aa, Mycobacterium tuberculosis; identical to SEQ ID NO: 1473815

SEQ ID NO: 1552047 - protein, 23 aa, Mycobacterium tuberculosis
TKSICPVCKVVVDAQVNICHDKV

SEQ ID NO: 1552048 - protein, 17 aa, Mycobacterium tuberculosis
TKSLTDFGLGLLLIAVL

SEQ ID NO: 1552049 - protein, 18 aa, Mycobacterium tuberculosis
TKSLTDFGLGLLLIAVLG

SEQ ID NO: 1552050 - protein, 23 aa, Mycobacterium tuberculosis
TLHEVPVLSGLGLTMTGPRPGGF

SEQ ID NO: 1552051 - protein, 19 aa, Mycobacterium tuberculosis
TLLGRPLIGNGADGAPGTG

SEQ ID NO: 1552052 - protein, 24 aa, Mycobacterium tuberculosis
TLLGRPLIGNGADGLPGQNGGAGG

SEQ ID NO: 1552053 - protein, 17 aa, Mycobacterium tuberculosis
TLLRGGGLVNLEGIQQE

SEQ ID NO: 1552054 - protein, 19 aa, Mycobacterium tuberculosis
TLLSALGITGQFRFGPITV

SEQ ID NO: 1552055 - protein, 18 aa, Mycobacterium tuberculosis
TLLSALKNNGSFISFGPI

SEQ ID NO: 1552056 - protein, 20 aa, Mycobacterium tuberculosis
TLNWPRFARPALKVDPFGPR

SEQ ID NO: 1552057 - protein, 17 aa, Mycobacterium tuberculosis
TLPGLKPPVLVLPALKL

SEQ ID NO: 1552058 - protein, 20 aa, Mycobacterium tuberculosis
TLPLLWRRLTTAGVKYADQG

SEQ ID NO: 1552059 - protein, 18 aa, Mycobacterium tuberculosis
TLRCTRQLCWPGSSTTTS

SEQ ID NO: 1552060 - protein, 28 aa, Mycobacterium tuberculosis
TLSGRFCVPVVRTPRPQLTAAFGGALWA

SEQ ID NO: 1552061 - protein, 28 aa, Mycobacterium tuberculosis
TLSRRFCVPVVRTPRPAIDGRFSAAGCG

SEQ ID NO: 1552062 - protein, 27 aa, Mycobacterium tuberculosis
TLTILGRFSASFGETFASGPYFKVLLA

SEQ ID NO: 1552063 - protein, 28 aa, Mycobacterium tuberculosis
TLTILGRFSASFGETFASGPYFKVLLAN

SEQ ID NO: 1552064 - protein, 25 aa, Mycobacterium tuberculosis
TLVHRTCVTPLPFAQADLDALQRVN

SEQ ID NO: 1552065 - protein, 18 aa, Mycobacterium tuberculosis
TMAKYDWTINGEPYSTTN

SEQ ID NO: 1552066 - protein, 24 aa, Mycobacterium tuberculosis
TMEALWWDRPFALAGVDIGASVAA

SEQ ID NO: 1552067 - protein, 23 aa, Mycobacterium tuberculosis
TMLNLPAAWQFSRGEGQLVAIID

SEQ ID NO: 1552068 - protein, 18 aa, Mycobacterium tuberculosis
TMLTRLQRALAHEQQFVA

SEQ ID NO: 1552069 - protein, 24 aa, Mycobacterium tuberculosis
TNALCAAAVALECGASVEQVAAAL

SEQ ID NO: 1552070 - protein, 23 aa, Mycobacterium tuberculosis
TNIAGLLRDGAGTAAINLGLANH

SEQ ID NO: 1552071 - protein, 25 aa, Mycobacterium tuberculosis
TNPQIDLTIRWDTPPITLFPNGISA

SEQ ID NO: 1552072 - protein, 19 aa, Mycobacterium tuberculosis
TPAAGISVSETRATTTSVS

SEQ ID NO: 1552073 - protein, 21 aa, Mycobacterium tuberculosis
TPAVRAVSACRWSRRVAGRLR

SEQ ID NO: 1552074 - protein, 29 aa, Mycobacterium tuberculosis
TPFPTMYELFSVGWGKPDLRDQWKHATQQ

SEQ ID NO: 1552075 - protein, 28 aa, Mycobacterium tuberculosis
TPGEVPGRGTTFCTAGMVPPWNPAVGSS

SEQ ID NO: 1552076 - protein, 20 aa, Mycobacterium tuberculosis
TPGMPTPGWPTRAPSAPAPS

SEQ ID NO: 1552077 - protein, 18 aa, Mycobacterium tuberculosis
TPLPAARIGPGTNNAPSA

SEQ ID NO: 1552078 - protein, 22 aa, Mycobacterium tuberculosis
TPPHAWYIAFAPAQAPKVAVAV

SEQ ID NO: 1552079 - protein, 21 aa, Mycobacterium tuberculosis
TPRCGGAFRRTCGLQYSTSVT

SEQ ID NO: 1552080 - protein, 22 aa, Mycobacterium tuberculosis
TPRCGGAFRRTCGLQYSTSVTA

SEQ ID NO: 1552081 - protein, 44 aa, Mycobacterium tuberculosis
TPRPLAHIALASGCCDLAGCVLAAWGWVVMSFVVAVPEALAAAA

SEQ ID NO: 1552082 - protein, 24 aa, Mycobacterium tuberculosis
TQALLGRPLIGDGAAGAPGTGQAG

SEQ ID NO: 1552083 - protein, 21 aa, Mycobacterium tuberculosis
TQALWGRPLIGNGADGTAANT

SEQ ID NO: 1552084 - protein, 21 aa, Mycobacterium tuberculosis
TQIIMGIDWIGPGFNPHLLSD

SEQ ID NO: 1552085 - protein, 22 aa, Mycobacterium tuberculosis
TRARLIDLGRPFIAETVFSHPS

SEQ ID NO: 1552086 - protein, 34 aa, Mycobacterium tuberculosis
TRGSAWLGSPRRWRRAGLARCLPAGTVRRTDPPP

SEQ ID NO: 1552087 - protein, 23 aa, Mycobacterium tuberculosis
TRMPVHLCRDGSLLALRSKAFHK

SEQ ID NO: 1552088 - protein, 25 aa, Mycobacterium tuberculosis
TRPWNIKPGDVMPATYVGIWQTFAD

SEQ ID NO: 1552089 - protein, 17 aa, Mycobacterium tuberculosis
TRQRVWGQMDSARCGPI

SEQ ID NO: 1552090 - protein, 23 aa, Mycobacterium tuberculosis
TRRKGRLAALAIAAMASASLVTV

SEQ ID NO: 1552091 - protein, 20 aa, Mycobacterium tuberculosis
TRVPQGWSFAQAAAVPVVFL

SEQ ID NO: 1552092 - protein, 17 aa, Mycobacterium tuberculosis
TSADNVWAIGDATVLTL

SEQ ID NO: 1552093 - protein, 25 aa, Mycobacterium tuberculosis
TSAHAGVVSPGFIGAPLALAALGQM

SEQ ID NO: 1552094 - protein, 23 aa, Mycobacterium tuberculosis
TSDADWKPVADILGRTGKLNDGS

SEQ ID NO: 1552095 - protein, 22 aa, Mycobacterium tuberculosis
TSGKGGMGGIAGDGGPGGDGGN

SEQ ID NO: 1552096 - protein, 18 aa, Mycobacterium tuberculosis
TSHRRLPAHPARRRRVGT

SEQ ID NO: 1552097 - protein, 19 aa, Mycobacterium tuberculosis
TSLIPWYSALQQWLAENLL

SEQ ID NO: 1552098 - protein, 17 aa, Mycobacterium tuberculosis
TSLRGLRHTLKKLSGLR

SEQ ID NO: 1552099 - protein, 20 aa, Mycobacterium tuberculosis
TSPLLAPINEFFLANTGRPL

SEQ ID NO: 1552100 - protein, 21 aa, Mycobacterium tuberculosis
TSPLLAPINEFFLANTGRPLI

SEQ ID NO: 1552101 - protein, 24 aa, Mycobacterium tuberculosis
TSRIAEIPLDIDATLISDGTGTAL

SEQ ID NO: 1552102 - protein, 23 aa, Mycobacterium tuberculosis
TSSEWNAALSRIAVAGRGPGDVD

SEQ ID NO: 1552103 - protein, 17 aa, Mycobacterium tuberculosis
TTCGRRDLADYVPTQDA

SEQ ID NO: 1552104 - protein, 18 aa, Mycobacterium tuberculosis
TTCGRRLGIGPKEAVVLA

SEQ ID NO: 1552105 - protein, 17 aa, Mycobacterium tuberculosis
TTFPVGPFFGLGVVNIS

SEQ ID NO: 1552106 - protein, 27 aa, Mycobacterium tuberculosis
TTIRTLRRLGFRCGVVSGGFRRIIEPL

SEQ ID NO: 1552107 - protein, 23 aa, Mycobacterium tuberculosis
TTKPDERPSRPAVAADTAAATHT

SEQ ID NO: 1552108 - protein, 32 aa, Mycobacterium tuberculosis
TTLIGPIHINTGFSIPVTFSYSTPALTLFPVG

SEQ ID NO: 1552109 - protein, 25 aa, Mycobacterium tuberculosis
TTPEFAIPPIGVGGFTLPQITTQEI

SEQ ID NO: 1552110 - protein, 24 aa, Mycobacterium tuberculosis
TTPNRLYWMSAWIDPDGTDGGPVL

SEQ ID NO: 1552111 - protein, 17 aa, Mycobacterium tuberculosis
TTRECQGGYNPMKRSMK

SEQ ID NO: 1552112 - protein, 23 aa, Mycobacterium tuberculosis
TTWPAHLRPALTTAGFATELRNL

SEQ ID NO: 1552113 - protein, 19 aa, Mycobacterium tuberculosis
TVADALPLLGKLPSANVVI

SEQ ID NO: 1552114 - protein, 21 aa, Mycobacterium tuberculosis
TVASCPNTRIVLGGYSQGATV

SEQ ID NO: 1552115 - protein, 24 aa, Mycobacterium tuberculosis
TVDPFVIAANRSRLVSLALSNLFG

SEQ ID NO: 1552116 - protein, 19 aa, Mycobacterium tuberculosis
TVGPVGPAATPGCGCFGQR

SEQ ID NO: 1552117 - protein, 19 aa, Mycobacterium tuberculosis
TVIRRYFRYHRRLRQRRRW

SEQ ID NO: 1552118 - protein, 31 aa, Mycobacterium tuberculosis; identical to SEQ ID NO: 1492699

SEQ ID NO: 1552119 - protein, 18 aa, Mycobacterium tuberculosis
TVQRDGTCVLVIAPAPAL

SEQ ID NO: 1552120 - protein, 23 aa, Mycobacterium tuberculosis
TVTMELVEAGGLYRTGNVTYRGF

SEQ ID NO: 1552121 - protein, 24 aa, Mycobacterium tuberculosis
TVTMELVEAGGLYRTGNVTYRGFE

SEQ ID NO: 1552122 - protein, 25 aa, Mycobacterium tuberculosis
TVVFPDAPVKIFLTASAETRARRRN

SEQ ID NO: 1552123 - protein, 17 aa, Mycobacterium tuberculosis
TVVHGWDLAVATGQAGE

SEQ ID NO: 1552124 - protein, 19 aa, Mycobacterium tuberculosis
TVWKWCLVAVNVLTASSKS

SEQ ID NO: 1552125 - protein, 17 aa, Mycobacterium tuberculosis
TWNPSGMYFWLDYADAF

SEQ ID NO: 1552126 - protein, 20 aa, Mycobacterium tuberculosis
TYLDAKRCWANQVIFGVTGP

SEQ ID NO: 1552127 - protein, 19 aa, Mycobacterium tuberculosis
TYLTRVMLTAAEWTAVLIN

SEQ ID NO: 1552128 - protein, 20 aa, Mycobacterium tuberculosis
TYPIAWEIEIERIGLPSRGR

SEQ ID NO: 1552129 - protein, 20 aa, Mycobacterium tuberculosis
TYWEGAVALDGRYQRMPISG

SEQ ID NO: 1552130 - protein, 20 aa, Mycobacterium tuberculosis
TYWEGAVALEGRYQGMPISG

SEQ ID NO: 1552131 - protein, 30 aa, Mycobacterium tuberculosis
VAAECRRVGVPDARCVLPLAHRVTQAARDA

SEQ ID NO: 1552132 - protein, 23 aa, Mycobacterium tuberculosis
VAAHAPYLAWLMRASETSAEAAA

SEQ ID NO: 1552133 - protein, 17 aa, Mycobacterium tuberculosis
VAANRNAFVQLVLSNLF

SEQ ID NO: 1552134 - protein, 23 aa, Mycobacterium tuberculosis
VAAQLAPWAQAVRALPNPTAPAL

SEQ ID NO: 1552135 - protein, 24 aa, Mycobacterium tuberculosis
VAASLRCPWCVDAHTTMLYAAGQT

SEQ ID NO: 1552136 - protein, 17 aa, Mycobacterium tuberculosis
VAATRRPLIGNGANGAP

SEQ ID NO: 1552137 - protein, 17 aa, Mycobacterium tuberculosis
VAAVGLCGHGGAGGAGG

SEQ ID NO: 1552138 - protein, 17 aa, Mycobacterium tuberculosis
VACGKVVPAGKPLPTGS

SEQ ID NO: 1552139 - protein, 18 aa, Mycobacterium tuberculosis
VACLRRPSLGPGAARTST

SEQ ID NO: 1552140 - protein, 24 aa, Mycobacterium tuberculosis
VADAHGVPFLGIRGMSDGPGDPLH

SEQ ID NO: 1552141 - protein, 22 aa, Mycobacterium tuberculosis
VAEYISALALLAKREQWAEFAR

SEQ ID NO: 1552142 - protein, 17 aa, Mycobacterium tuberculosis
VAFLAGGPHAVYLLDAF

SEQ ID NO: 1552143 - protein, 18 aa, Mycobacterium tuberculosis
VAFSIPRDDWVPFTGVPG

SEQ ID NO: 1552144 - protein, 18 aa, Mycobacterium tuberculosis
VAGEQIWRVPPLGHGEAI

SEQ ID NO: 1552145 - protein, 19 aa, Mycobacterium tuberculosis
VAGGGPLPLAVSVDEEGGR

SEQ ID NO: 1552146 - protein, 42 aa, Mycobacterium tuberculosis
VAGRGDPPGGRRRETAAAPGLFLRFSAAPGGNGRDGAGVGPR

SEQ ID NO: 1552147 - protein, 30 aa, Mycobacterium tuberculosis; identical to SEQ ID NO: 159323

SEQ ID NO: 1552148 - protein, 23 aa, Mycobacterium tuberculosis
VALAAKLVHDFDIAPGHVFATGM

SEQ ID NO: 1552149 - protein, 23 aa, Mycobacterium tuberculosis
VALAVLACPLAGPAGPAAPGGPA

SEQ ID NO: 1552150 - protein, 23 aa, Mycobacterium tuberculosis
VANDGFTFFPGGLTFPRASAGVT

SEQ ID NO: 1552151 - protein, 24 aa, Mycobacterium tuberculosis
VAPGSFDGPDDWSANSVFGLPALG

SEQ ID NO: 1552152 - protein, 25 aa, Mycobacterium tuberculosis
VAPPALSLGSWVAFARTPDGQTMLM

SEQ ID NO: 1552153 - protein, 20 aa, Mycobacterium tuberculosis
VAQHKFLFSREIGSESKVLI

SEQ ID NO: 1552154 - protein, 27 aa, Mycobacterium tuberculosis
VARHRPRRHRLRRHRRAAGLPRSLRPP

SEQ ID NO: 1552155 - protein, 24 aa, Mycobacterium tuberculosis
VARPAPACRIDWEPADRAAHRDGV

SEQ ID NO: 1552156 - protein, 27 aa, Mycobacterium tuberculosis
VARTIVELCALWAVHLHFDPSPEPWSI

SEQ ID NO: 1552157 - protein, 23 aa, Mycobacterium tuberculosis
VARVRRAVVRVGEGFKVTTPKSD

SEQ ID NO: 1552158 - protein, 23 aa, Mycobacterium tuberculosis
VASAARNSAGFCVHALRRQHIVM

SEQ ID NO: 1552159 - protein, 26 aa, Mycobacterium tuberculosis
VASCPNTRIVLGWLFAGCDGSSICPP

SEQ ID NO: 1552160 - protein, 20 aa, Mycobacterium tuberculosis
VAVGAPGQPGGAGGHGGAGG

SEQ ID NO: 1552161 - protein, 21 aa, Mycobacterium tuberculosis
VAVPEALAAAASDVANIGSAL

SEQ ID NO: 1552162 - protein, 23 aa, Mycobacterium tuberculosis
VAVPEALAAAASDVANIGSALSA

SEQ ID NO: 1552163 - protein, 22 aa, Mycobacterium tuberculosis
VAVRQRRGRRPGRHRRSRRSRR

SEQ ID NO: 1552164 - protein, 24 aa, Mycobacterium tuberculosis
VAVTRATPRFGFEQVCATPAFPHD

SEQ ID NO: 1552165 - protein, 33 aa, Mycobacterium tuberculosis
VAVTRATPRFGFEQVCATPAFPHDSRDWAVAGR

SEQ ID NO: 1552166 - protein, 25 aa, Mycobacterium tuberculosis
VCLLTAFLLIAVFGEVRFGDGKTYY

SEQ ID NO: 1552167 - protein, 30 aa, Mycobacterium tuberculosis
VCSRALGGRWVRWVNMVAFLPSIPVVEDLR

SEQ ID NO: 1552168 - protein, 26 aa, Mycobacterium tuberculosis
VDAFAALKRLTMVTSHVLAETKVDFG

SEQ ID NO: 1552169 - protein, 18 aa, Mycobacterium tuberculosis
VDAFPRGAGRMLAIMHAL

SEQ ID NO: 1552170 - protein, 23 aa, Mycobacterium tuberculosis
VDARTALDPSAPVIRTDLEGKSD

SEQ ID NO: 1552171 - protein, 24 aa, Mycobacterium tuberculosis
VDDRWRLAQILTFQAVDAVVAGDP

SEQ ID NO: 1552172 - protein, 25 aa, Mycobacterium tuberculosis
VDEPREFFTTNAFWSVPSDPTNDAN

SEQ ID NO: 1552173 - protein, 17 aa, Mycobacterium tuberculosis
VDFVGWYNAHPHFEQVS

SEQ ID NO: 1552174 - protein, 18 aa, Mycobacterium tuberculosis
VDGMRADLVVARTAAAHA

SEQ ID NO: 1552175 - protein, 32 aa, Mycobacterium tuberculosis; identical to SEQ ID NO: 1466123

SEQ ID NO: 1552176 - protein, 25 aa, Mycobacterium tuberculosis
VDLLRFCLERGYQLRVIEQMPLDAG

SEQ ID NO: 1552177 - protein, 25 aa, Mycobacterium tuberculosis
VDLSRLAEDIIVWSSTEFGYVTLHD

SEQ ID NO: 1552178 - protein, 17 aa, Mycobacterium tuberculosis
VDPDLGKLAGRITDALT

SEQ ID NO: 1552179 - protein, 17 aa, Mycobacterium tuberculosis
VDSLDFQDGIAFVHAED

SEQ ID NO: 1552180 - protein, 24 aa, Mycobacterium tuberculosis
VDTFYTCLYRSLLHPNTFNDVDGR

SEQ ID NO: 1552181 - protein, 18 aa, Mycobacterium tuberculosis
VDTGAFISGSYSNGFLWS

SEQ ID NO: 1552182 - protein, 17 aa, Mycobacterium tuberculosis
VDTGAFITGNYSNGLFL

SEQ ID NO: 1552183 - protein, 17 aa, Mycobacterium tuberculosis
VDTGAFITGSYSNGFLV

SEQ ID NO: 1552184 - protein, 19 aa, Mycobacterium tuberculosis
VDWKGTLTGLAGYASGDLD

SEQ ID NO: 1552185 - protein, 22 aa, Mycobacterium tuberculosis
VEGLKIDGDHIVVKFSIGTNTI

SEQ ID NO: 1552186 - protein, 25 aa, Mycobacterium tuberculosis
VEIGKVKALHLVDGGRRVRVEFNID

SEQ ID NO: 1552187 - protein, 26 aa, Mycobacterium tuberculosis
VEPLRPGPPPTVWSRRWRQRWAPPTS

SEQ ID NO: 1552188 - protein, 17 aa, Mycobacterium tuberculosis
VEQMVLNAINAPTQTLF

SEQ ID NO: 1552189 - protein, 19 aa, Mycobacterium tuberculosis
VEVEARLAVRTAEERANAV

SEQ ID NO: 1552190 - protein, 17 aa, Mycobacterium tuberculosis
VEVPELEVPAMGVLPTV

SEQ ID NO: 1552191 - protein, 17 aa, Mycobacterium tuberculosis
VFGPPGTVASINYLDAD

SEQ ID NO: 1552192 - protein, 18 aa, Mycobacterium tuberculosis
VFGSPTWRTVTGGSANYV

SEQ ID NO: 1552193 - protein, 31 aa, Mycobacterium tuberculosis
VGAPYAWGGAAPGGFDCSGLVMWAFQQAGIA

SEQ ID NO: 1552194 - protein, 21 aa, Mycobacterium tuberculosis
VGCGVAAELAGPGGSRRRVRW

SEQ ID NO: 1552195 - protein, 32 aa, Mycobacterium tuberculosis
VGEQVVPAAMVARWVVPAGRAVPAAPVAPAVA

SEQ ID NO: 1552196 - protein, 24 aa, Mycobacterium tuberculosis
VGGAGGAGWLVGNGGAGGFGGVGT

SEQ ID NO: 1552197 - protein, 20 aa, Mycobacterium tuberculosis
VGGFPVAARAALTACAAGAT

SEQ ID NO: 1552198 - protein, 17 aa, Mycobacterium tuberculosis
VGGPGGAAGLFGNGGSG

SEQ ID NO: 1552199 - protein, 20 aa, Mycobacterium tuberculosis
VGGSGGWLNGNGGAGGAGGT

SEQ ID NO: 1552200 - protein, 19 aa, Mycobacterium tuberculosis
VGGTWHWNTYPGIAVDIPS

SEQ ID NO: 1552201 - protein, 20 aa, Mycobacterium tuberculosis
VGGTWHWNTYPGIAVDIPSF

SEQ ID NO: 1552202 - protein, 33 aa, Mycobacterium tuberculosis
VGGVHDPWCMPACWRKTTLRVWVWSPTNPGASD

SEQ ID NO: 1552203 - protein, 21 aa, Mycobacterium tuberculosis
VGHGNYRFRQFGSDRRRGRPG

SEQ ID NO: 1552204 - protein, 33 aa, Mycobacterium tuberculosis; identical to SEQ ID NO: 207779

SEQ ID NO: 1552205 - protein, 18 aa, Mycobacterium tuberculosis
VGMCLFLLSDSASWITGQ

SEQ ID NO: 1552206 - protein, 31 aa, Mycobacterium tuberculosis
VGNNGMNFPGWAFWCPSTGFEAAVGRMVTAT

SEQ ID NO: 1552207 - protein, 17 aa, Mycobacterium tuberculosis
VGNTLLLNGRTYSPPYT

SEQ ID NO: 1552208 - protein, 17 aa, Mycobacterium tuberculosis
VGPFFGLGVVNISGIEI

SEQ ID NO: 1552209 - protein, 24 aa, Mycobacterium tuberculosis
VGQAGGKGWDGGPIGNGQVGEQHG

SEQ ID NO: 1552210 - protein, 30 aa, Mycobacterium tuberculosis; identical to SEQ ID NO: 1465465

SEQ ID NO: 1552211 - protein, 29 aa, Mycobacterium tuberculosis
VGRFRYPRNGWPALFHVRSGASLAGNYAA

SEQ ID NO: 1552212 - protein, 24 aa, Mycobacterium tuberculosis
VHAGVDGCRRGLCGCGGGQRLGGA

SEQ ID NO: 1552213 - protein, 25 aa, Mycobacterium tuberculosis
VHGENRFPYDIEFIIRGESEQHRTK

SEQ ID NO: 1552214 - protein, 18 aa, Mycobacterium tuberculosis
VHGLWRGGIGTTWEARIK

SEQ ID NO: 1552215 - protein, 23 aa, Mycobacterium tuberculosis
VHHCHREQWPVAGRMMGRLGWYV

SEQ ID NO: 1552216 - protein, 24 aa, Mycobacterium tuberculosis
VHILIDLPAVPGFGNTTGAPSSGF

SEQ ID NO: 1552217 - protein, 23 aa, Mycobacterium tuberculosis
VKAPSNLTGICDRSIQSNIDAAL

SEQ ID NO: 1552218 - protein, 17 aa, Mycobacterium tuberculosis
VKGDSVTIIAVDTKPVT

SEQ ID NO: 1552219 - protein, 23 aa, Mycobacterium tuberculosis
VKIPGGALCGKLAVPVDYDRPDG

SEQ ID NO: 1552220 - protein, 18 aa, Mycobacterium tuberculosis
VKLPNRWPLTDAAGVPVV

SEQ ID NO: 1552221 - protein, 17 aa, Mycobacterium tuberculosis
VKSVARVSWRHDGSSVK

SEQ ID NO: 1552222 - protein, 56 aa, Mycobacterium tuberculosis
VLAAGADEVSARIAALFGGFGLEYQAISAQVAAYHQRFVQALSTGAGAYASAEAAA

SEQ ID NO: 1552223 - protein, 55 aa, Mycobacterium tuberculosis
VLAAGADEVSARIAALFGGLGLEYQAISAQVAAYHQRFVQALSTGAGAYASAEAA

SEQ ID NO: 1552224 - protein, 24 aa, Mycobacterium tuberculosis
VLALVKACRGVRLLATCREPLRVE

SEQ ID NO: 1552225 - protein, 19 aa, Mycobacterium tuberculosis
VLARPPWDPGTAIIAVSDI

SEQ ID NO: 1552226 - protein, 20 aa, Mycobacterium tuberculosis
VLDWDLRRGGGFSYRIYLFA

SEQ ID NO: 1552227 - protein, 18 aa, Mycobacterium tuberculosis
VLHRPKLGFPVPIRHWLR

SEQ ID NO: 1552228 - protein, 17 aa, Mycobacterium tuberculosis
VLILCWSLLGAAPAHAD

SEQ ID NO: 1552229 - protein, 19 aa, Mycobacterium tuberculosis
VLILCWSLLGAAPAHADDS

SEQ ID NO: 1552230 - protein, 18 aa, Mycobacterium tuberculosis
VLRLARRSAASGAALADR

SEQ ID NO: 1552231 - protein, 25 aa, Mycobacterium tuberculosis
VLSPEIRAPTLLTLNTPRQFRVSLY

SEQ ID NO: 1552232 - protein, 17 aa, Mycobacterium tuberculosis
VLTDWAAPVIEKAYGAG

SEQ ID NO: 1552233 - protein, 19 aa, Mycobacterium tuberculosis
VLWVGDYQGLFGVSAGSSI

SEQ ID NO: 1552234 - protein, 19 aa, Mycobacterium tuberculosis
VLYEVFGPPGTVASINYLD

SEQ ID NO: 1552235 - protein, 27 aa, Mycobacterium tuberculosis
VMATIRNAVFLGHAFAALNPATVTAAA

SEQ ID NO: 1552236 - protein, 26 aa, Mycobacterium tuberculosis
VMRDYRLRVSDALSKLTPWKAPPPIA

SEQ ID NO: 1552237 - protein, 23 aa, Mycobacterium tuberculosis
VMRHRAWQGLVLLVLALLLSSCG

SEQ ID NO: 1552238 - protein, 36 aa, Mycobacterium tuberculosis
VNAIPFPSIVGDEFCLLDGLLAWYATIGSINNINSM

SEQ ID NO: 1552239 - protein, 28 aa, Mycobacterium tuberculosis
VNAPAQALLGRPLIGNGANGADGTGAPG

SEQ ID NO: 1552240 - protein, 19 aa, Mycobacterium tuberculosis
VNIIEFCKAYNAATENQRG

SEQ ID NO: 1552241 - protein, 17 aa, Mycobacterium tuberculosis
VNQGGWMLSRASAMELL

SEQ ID NO: 1552242 - protein, 17 aa, Mycobacterium tuberculosis
VNTGAFIAGNYSNGVLW

SEQ ID NO: 1552243 - protein, 19 aa, Mycobacterium tuberculosis
VNTGTGWAYGGNGGNGGDG

SEQ ID NO: 1552244 - protein, 18 aa, Mycobacterium tuberculosis
VNTTAWFVMATIRNAVFL

SEQ ID NO: 1552245 - protein, 17 aa, Mycobacterium tuberculosis
VPAEGRVRLLRKVLERA

SEQ ID NO: 1552246 - protein, 21 aa, Mycobacterium tuberculosis
VPATFDGTILIGDIPIPIIDV

SEQ ID NO: 1552247 - protein, 21 aa, Mycobacterium tuberculosis
VPDILECLASVMADAGSNREA

SEQ ID NO: 1552248 - protein, 22 aa, Mycobacterium tuberculosis
VPDIPIPAIHIDFDGAADAGFT

SEQ ID NO: 1552249 - protein, 21 aa, Mycobacterium tuberculosis
VPDIPIPAIHIGINGVVTVGF

SEQ ID NO: 1552250 - protein, 27 aa, Mycobacterium tuberculosis
VPDSPEALPLLFGHIGEGNLHLNVLRL

SEQ ID NO: 1552251 - protein, 18 aa, Mycobacterium tuberculosis
VPGAVRFSRDLGPHYDYQ

SEQ ID NO: 1552252 - protein, 17 aa, Mycobacterium tuberculosis
VPGRVVALGQTVQASDS

SEQ ID NO: 1552253 - protein, 29 aa, Mycobacterium tuberculosis
VPIYPGYVCAIVASLLLDKPVKWMEDRSE

SEQ ID NO: 1552254 - protein, 21 aa, Mycobacterium tuberculosis
VPMLFAKPSYYGQFTDSGGLH

SEQ ID NO: 1552255 - protein, 18 aa, Mycobacterium tuberculosis
VPNSGGRQGYFGPCPPAG

SEQ ID NO: 1552256 - protein, 18 aa, Mycobacterium tuberculosis
VPPAEAKRGDLIFYGPGG

SEQ ID NO: 1552257 - protein, 19 aa, Mycobacterium tuberculosis
VPPSWAWPKPAVAPPVLFG

SEQ ID NO: 1552258 - protein, 21 aa, Mycobacterium tuberculosis
VPRPLMGSLIQRVPLDGAALS

SEQ ID NO: 1552259 - protein, 31 aa, Mycobacterium tuberculosis
VPVARAGCYSAKMGCPGRERPNPGQPPMGNL

SEQ ID NO: 1552260 - protein, 23 aa, Mycobacterium tuberculosis
VQDAANLPPDWASVPYGVPFPNN

SEQ ID NO: 1552261 - protein, 25 aa, Mycobacterium tuberculosis
VQFSCKGANVAPPLTWSSPAGAAEL

SEQ ID NO: 1552262 - protein, 17 aa, Mycobacterium tuberculosis
VQRDGTCVLVIAPAPAL

SEQ ID NO: 1552263 - protein, 24 aa, Mycobacterium tuberculosis
VQRSVARFALIQALSAVLVGAGTR

SEQ ID NO: 1552264 - protein, 25 aa, Mycobacterium tuberculosis
VQTPQPYWYWALDRESIGGSVSAAL

SEQ ID NO: 1552265 - protein, 21 aa, Mycobacterium tuberculosis
VRAAARAGAYCARTRAAPAQA

SEQ ID NO: 1552266 - protein, 24 aa, Mycobacterium tuberculosis
VRARMKAWRPWAITASSVIRTSPP

SEQ ID NO: 1552267 - protein, 29 aa, Mycobacterium tuberculosis
VRDHPDFPAAAARLGSRLSIHDQPNLGGS

SEQ ID NO: 1552268 - protein, 17 aa, Mycobacterium tuberculosis
VRELAVFWTARSIGCSW

SEQ ID NO: 1552269 - protein, 18 aa, Mycobacterium tuberculosis
VREPIPGMGHAIELRVYR

SEQ ID NO: 1552270 - protein, 19 aa, Mycobacterium tuberculosis
VRGAMVAAWDKLRGPNGKL

SEQ ID NO: 1552271 - protein, 21 aa, Mycobacterium tuberculosis
VRGARNIPCVDVPGKRAATPK

SEQ ID NO: 1552272 - protein, 18 aa, Mycobacterium tuberculosis
VRGGVYWDAYRDPVSVVV

SEQ ID NO: 1552273 - protein, 21 aa, Mycobacterium tuberculosis
VRLTTTMTRFIIAAVEIYCPN

SEQ ID NO: 1552274 - protein, 19 aa, Mycobacterium tuberculosis
VRQAIPLINTYVMSLGESL

SEQ ID NO: 1552275 - protein, 29 aa, Mycobacterium tuberculosis
VRQRRPRRSRRGRARRPATAVWAATLSDC

SEQ ID NO: 1552276 - protein, 17 aa, Mycobacterium tuberculosis
VRRCRMVMAGESLPQAE

SEQ ID NO: 1552277 - protein, 24 aa, Mycobacterium tuberculosis
VRVICRRSALMTRIAGAGAMASVE

SEQ ID NO: 1552278 - protein, 19 aa, Mycobacterium tuberculosis
VRVPPRIIKATVAPDGSRT

SEQ ID NO: 1552279 - protein, 20 aa, Mycobacterium tuberculosis
VSAAIAALFGAHARAYQALS

SEQ ID NO: 1552280 - protein, 20 aa, Mycobacterium tuberculosis
VSAAIAALFSAHGRDFQALS

SEQ ID NO: 1552281 - protein, 19 aa, Mycobacterium tuberculosis
VSAAIAALFSSHGQQYQAM

SEQ ID NO: 1552282 - protein, 20 aa, Mycobacterium tuberculosis
VSAAIAALFSSYARDYQTLS

SEQ ID NO: 1552283 - protein, 22 aa, Mycobacterium tuberculosis
VSAAIASLFSGYARDYQALSAQ

SEQ ID NO: 1552284 - protein, 21 aa, Mycobacterium tuberculosis
VSAALASLFSGHAVSYQQVAA

SEQ ID NO: 1552285 - protein, 20 aa, Mycobacterium tuberculosis
VSAAVAALFSAHAGQYQQLG

SEQ ID NO: 1552286 - protein, 20 aa, Mycobacterium tuberculosis
VSAAVSALFSAHAGQYQQLG

SEQ ID NO: 1552287 - protein, 17 aa, Mycobacterium tuberculosis
VSALMPFTQQLKKLAGL

SEQ ID NO: 1552288 - protein, 25 aa, Mycobacterium tuberculosis
VSAQMSAFHAQFMQALTGAGGAYAA

SEQ ID NO: 1552289 - protein, 17 aa, Mycobacterium tuberculosis
VSASFLWAPDPGTMRLV

SEQ ID NO: 1552290 - protein, 24 aa, Mycobacterium tuberculosis
VSASPEPIVKVWAGEVGLDDQHVV

SEQ ID NO: 1552291 - protein, 17 aa, Mycobacterium tuberculosis
VSDRLVGITSDIGSVTV

SEQ ID NO: 1552292 - protein, 22 aa, Mycobacterium tuberculosis
VSESIPLNFSFGSPASTVKSMI

SEQ ID NO: 1552293 - protein, 21 aa, Mycobacterium tuberculosis
VSFSECNAGLVVDEVDADLLA

SEQ ID NO: 1552294 - protein, 25 aa, Mycobacterium tuberculosis
VSIPLIKIPAAPGFGNSTTSPSSGF

SEQ ID NO: 1552295 - protein, 20 aa, Mycobacterium tuberculosis
VSKPRIPLVSNVTGQMAGAG

SEQ ID NO: 1552296 - protein, 20 aa, Mycobacterium tuberculosis
VSLAAVFLALAMGVVLGSGF

SEQ ID NO: 1552297 - protein, 21 aa, Mycobacterium tuberculosis
VSLAISALFGQHAQAYQALSA

SEQ ID NO: 1552298 - protein, 24 aa, Mycobacterium tuberculosis
VSPLLDPINEFFLANTGRPLIGNG

SEQ ID NO: 1552299 - protein, 25 aa, Mycobacterium tuberculosis
VSRAVCRGPNLGWRVVRGRRDRQRH

SEQ ID NO: 1552300 - protein, 25 aa, Mycobacterium tuberculosis
VSRVLGCLVTAVTVATVVTLGPAAS

SEQ ID NO: 1552301 - protein, 18 aa, Mycobacterium tuberculosis
VSSVDYWAYRPALQQVAA

SEQ ID NO: 1552302 - protein, 24 aa, Mycobacterium tuberculosis
VSVARFAAALAPRGSGTLLAGRDG

SEQ ID NO: 1552303 - protein, 32 aa, Mycobacterium tuberculosis
VSVARFAAALAPRGVWHAACRPGTVRRTDPPP

SEQ ID NO: 1552304 - protein, 17 aa, Mycobacterium tuberculosis
VSVQPADHILAILRQLN

SEQ ID NO: 1552305 - protein, 17 aa, Mycobacterium tuberculosis
VSYARKPARPHDSHNGP

SEQ ID NO: 1552306 - protein, 26 aa, Mycobacterium tuberculosis
VTAAGLAANGAWLFGNGGAGGGGGKG

SEQ ID NO: 1552307 - protein, 25 aa, Mycobacterium tuberculosis
VTAAKVGCYTAMAATVVTPAAAEVP

SEQ ID NO: 1552308 - protein, 21 aa, Mycobacterium tuberculosis
VTALGTCWAVTVMGSSNTVVA

SEQ ID NO: 1552309 - protein, 22 aa, Mycobacterium tuberculosis
VTARPLPPLGLAGRQSSQSVPG

SEQ ID NO: 1552310 - protein, 22 aa, Mycobacterium tuberculosis
VTDDLRPGGPVIVETVSQAIAL

SEQ ID NO: 1552311 - protein, 18 aa, Mycobacterium tuberculosis
VTGIARRLPGRSVGRRIE

SEQ ID NO: 1552312 - protein, 24 aa, Mycobacterium tuberculosis
VTIPQLTIPAGITIGGFSLPAIHT

SEQ ID NO: 1552313 - protein, 22 aa, Mycobacterium tuberculosis
VTLPGAAIWHMAWSDKDDAIDW

SEQ ID NO: 1552314 - protein, 26 aa, Mycobacterium tuberculosis
VTQRFRRLRLPSVRRFTTPDRAALIA

SEQ ID NO: 1552315 - protein, 18 aa, Mycobacterium tuberculosis
VTRAELDVAWLTDTAQRD

SEQ ID NO: 1552316 - protein, 18 aa, Mycobacterium tuberculosis
VTVDGDLVGAGWVSGGSD

SEQ ID NO: 1552317 - protein, 18 aa, Mycobacterium tuberculosis
VTVNWSTPAVTIFPNGIS

SEQ ID NO: 1552318 - protein, 23 aa, Mycobacterium tuberculosis
VTVQCARPVWQAGNIGQQIGFTS

SEQ ID NO: 1552319 - protein, 21 aa, Mycobacterium tuberculosis
VTVTYPAHWGPAAVAALDSAL

SEQ ID NO: 1552320 - protein, 23 aa, Mycobacterium tuberculosis
VVAAAPYAGWLAAAAARAGGAAV

SEQ ID NO: 1552321 - protein, 19 aa, Mycobacterium tuberculosis
VVAAQPYLAWLTYTAESAA

SEQ ID NO: 1552322 - protein, 24 aa, Mycobacterium tuberculosis
VVDARTALDPSAPVIRTDLEGKSD

SEQ ID NO: 1552323 - protein, 21 aa, Mycobacterium tuberculosis
VVGGIDWDGHGLLGLEDSLDA

SEQ ID NO: 1552324 - protein, 17 aa, Mycobacterium tuberculosis
VVITGNPVTGWRLVEWD

SEQ ID NO: 1552325 - protein, 23 aa, Mycobacterium tuberculosis
VVITSAAAFALCPNAAADPATPQ

SEQ ID NO: 1552326 - protein, 18 aa, Mycobacterium tuberculosis
VVLGSGFFSDTLLSSLRS

SEQ ID NO: 1552327 - protein, 17 aa, Mycobacterium tuberculosis
VVLSAGWDEDLFRRMGD

SEQ ID NO: 1552328 - protein, 20 aa, Mycobacterium tuberculosis
VVLVGGCLVMGGRRGGGAAS

SEQ ID NO: 1552329 - protein, 25 aa, Mycobacterium tuberculosis
VVMVAGVILWRFFGDALSNRSHTAA

SEQ ID NO: 1552330 - protein, 38 aa, Mycobacterium tuberculosis
VVPPRRRPGWVAPGGQWRFAPGLLLGCGVAMGGNGRVP

SEQ ID NO: 1552331 - protein, 25 aa, Mycobacterium tuberculosis
VVSAMRRTGGLGGFAGLAGLANRIV

SEQ ID NO: 1552332 - protein, 19 aa, Mycobacterium tuberculosis
VVSGGFRRIIEPLARELML

SEQ ID NO: 1552333 - protein, 17 aa, Mycobacterium tuberculosis
VVTPAAAEVPGFEGSAG

SEQ ID NO: 1552334 - protein, 19 aa, Mycobacterium tuberculosis
VVTPAWYAPLVLSVGGIGQ

SEQ ID NO: 1552335 - protein, 18 aa, Mycobacterium tuberculosis
VVTYLKMGCPLSTEEVPL

SEQ ID NO: 1552336 - protein, 17 aa, Mycobacterium tuberculosis
VYAPVTGFYSLRYSSTA

SEQ ID NO: 1552337 - protein, 24 aa, Mycobacterium tuberculosis
VYFAMKFSQPFSSYGTWDGYAVYP

SEQ ID NO: 1552338 - protein, 25 aa, Mycobacterium tuberculosis
VYGAIAYSGNGSWGRSWDYPTRAAA

SEQ ID NO: 1552339 - protein, 21 aa, Mycobacterium tuberculosis
VYKQFRGEFTPKTELTMVASR

SEQ ID NO: 1552340 - protein, 24 aa, Mycobacterium tuberculosis
VYRRPHTRRWAGPAFLLNQMLVWG

SEQ ID NO: 1552341 - protein, 22 aa, Mycobacterium tuberculosis
VYYHGGGWSLGGLDTHDPVARA

SEQ ID NO: 1552342 - protein, 18 aa, Mycobacterium tuberculosis
WAAAIGLMVPIGLAPPAM

SEQ ID NO: 1552343 - protein, 19 aa, Mycobacterium tuberculosis
WAAWQRSGLQRRWLAASEH

SEQ ID NO: 1552344 - protein, 29 aa, Mycobacterium tuberculosis
WAGVTSVSIPSWWQPYVLSVASLTSAGQP

SEQ ID NO: 1552345 - protein, 18 aa, Mycobacterium tuberculosis
WAKYALKAPVMMVRSPDT

SEQ ID NO: 1552346 - protein, 17 aa, Mycobacterium tuberculosis
WAMRIPGGKAVHRVLSQ

SEQ ID NO: 1552347 - protein, 18 aa, Mycobacterium tuberculosis
WARERAQRAVSGMASVAI

SEQ ID NO: 1552348 - protein, 24 aa, Mycobacterium tuberculosis
WARPRGVAPAALFALLCGDLSAPV

SEQ ID NO: 1552349 - protein, 26 aa, Mycobacterium tuberculosis
WDEVKEGLTRLAADLSPAAGELQGPL

SEQ ID NO: 1552350 - protein, 17 aa, Mycobacterium tuberculosis
WDGHGLLGLEDSLDAVL

SEQ ID NO: 1552351 - protein, 21 aa, Mycobacterium tuberculosis
WDIEPDLTNAVAFLSAAVVSG

SEQ ID NO: 1552352 - protein, 24 aa, Mycobacterium tuberculosis
WDIEPDLTNAVAFPVSGRGQRRHR

SEQ ID NO: 1552353 - protein, 19 aa, Mycobacterium tuberculosis
WDQRLCLVPNGDLFRAIRH

SEQ ID NO: 1552354 - protein, 17 aa, Mycobacterium tuberculosis
WDTPPITLFPNGISAPD

SEQ ID NO: 1552355 - protein, 25 aa, Mycobacterium tuberculosis
WDVLARFGNMLSVSLIFVLETMVQQ

SEQ ID NO: 1552356 - protein, 28 aa, Mycobacterium tuberculosis
WGISAMATGAAWNVGSFNFGTANAGSFN

SEQ ID NO: 1552357 - protein, 18 aa, Mycobacterium tuberculosis
WGLVSAVYPAADFDAEVD

SEQ ID NO: 1552358 - protein, 35 aa, Mycobacterium tuberculosis; identical to SEQ ID NO: 212034

SEQ ID NO: 1552359 - protein, 17 aa, Mycobacterium tuberculosis
WHTFCIDQCSIAFTADI

SEQ ID NO: 1552360 - protein, 17 aa, Mycobacterium tuberculosis
WIPLLILVVVAIAGFTV

SEQ ID NO: 1552361 - protein, 17 aa, Mycobacterium tuberculosis
WIPLLILVVVAIPGFTV

SEQ ID NO: 1552362 - protein, 21 aa, Mycobacterium tuberculosis
WKAPAVTTVRAFDATPMTTLP

SEQ ID NO: 1552363 - protein, 22 aa, Mycobacterium tuberculosis
WKAPAVTTVRAFDATPMTTLPG

SEQ ID NO: 1552364 - protein, 19 aa, Mycobacterium tuberculosis
WKAPPPIAHSTVLVAPVSP

SEQ ID NO: 1552365 - protein, 17 aa, Mycobacterium tuberculosis
WLAEHRWDVEPPRASGS

SEQ ID NO: 1552366 - protein, 17 aa, Mycobacterium tuberculosis
WLPESALPAPPRPTVQR

SEQ ID NO: 1552367 - protein, 20 aa, Mycobacterium tuberculosis
WLPETMAYTAVRWKNVLRQA

SEQ ID NO: 1552368 - protein, 17 aa, Mycobacterium tuberculosis
WLSPLPGGSVVSVEPGG

SEQ ID NO: 1552369 - protein, 21 aa, Mycobacterium tuberculosis
WLVKDGQPFIPADCLAKGGNP

SEQ ID NO: 1552370 - protein, 29 aa, Mycobacterium tuberculosis
WMSPTQVRWRPFEFLAANGVRSRSDAAGT

SEQ ID NO: 1552371 - protein, 28 aa, Mycobacterium tuberculosis
WMSPTQVRWRPFEFWPANTAVNIDAAGT

SEQ ID NO: 1552372 - protein, 18 aa, Mycobacterium tuberculosis
WNAALSRIAVAGRGPGDV

SEQ ID NO: 1552373 - protein, 18 aa, Mycobacterium tuberculosis
WNPETGKYGPIYDEKTGT

SEQ ID NO: 1552374 - protein, 19 aa, Mycobacterium tuberculosis
WNPETGKYGPIYDEKTGTM

SEQ ID NO: 1552375 - protein, 25 aa, Mycobacterium tuberculosis
WPLTDAAGVPVVFLTAYYALRVLAQ

SEQ ID NO: 1552376 - protein, 20 aa, Mycobacterium tuberculosis
WPSSPTRSAPRWVSVTDSIW

SEQ ID NO: 1552377 - protein, 26 aa, Mycobacterium tuberculosis
WPVAGRMMGRLGWYVESMLSPRLHRR

SEQ ID NO: 1552378 - protein, 20 aa, Mycobacterium tuberculosis
WPVCGRGLSNATPREVLPAS

SEQ ID NO: 1552379 - protein, 24 aa, Mycobacterium tuberculosis
WQASEIYPPLKAWQRMGRPTIAVN

SEQ ID NO: 1552380 - protein, 21 aa, Mycobacterium tuberculosis
WREWSLRCAALATHPAALDTR

SEQ ID NO: 1552381 - protein, 18 aa, Mycobacterium tuberculosis
WRIMPENLEDAGVSWKVY

SEQ ID NO: 1552382 - protein, 17 aa, Mycobacterium tuberculosis
WRLPGDDVTALRGTAEN

SEQ ID NO: 1552383 - protein, 21 aa, Mycobacterium tuberculosis
WRQGYYPGIGAPSWTADYGSE

SEQ ID NO: 1552384 - protein, 19 aa, Mycobacterium tuberculosis
WRRESELFADVAVPDDVDV

SEQ ID NO: 1552385 - protein, 25 aa, Mycobacterium tuberculosis
WSFAQAAAVPVVFLTAWYGLADLAE

SEQ ID NO: 1552386 - protein, 20 aa, Mycobacterium tuberculosis
WSINTGNGYLGGLQFTQSTW

SEQ ID NO: 1552387 - protein, 20 aa, Mycobacterium tuberculosis
WSRRWRQRWAPPTSVAASAD

SEQ ID NO: 1552388 - protein, 20 aa, Mycobacterium tuberculosis
WVAAAGIVIAVIGYQRISTS

SEQ ID NO: 1552389 - protein, 24 aa, Mycobacterium tuberculosis
WVATEVRAALAAMVLPASVAGAGW

SEQ ID NO: 1552390 - protein, 24 aa, Mycobacterium tuberculosis
WVDNLRHTVRFAAAVQAALEDGYR

SEQ ID NO: 1552391 - protein, 19 aa, Mycobacterium tuberculosis
WVSIPAWALCVAFCDRPGG

SEQ ID NO: 1552392 - protein, 17 aa, Mycobacterium tuberculosis
WWAGPWPDDERWWDPDR

SEQ ID NO: 1552393 - protein, 18 aa, Mycobacterium tuberculosis
WYDTRRIPAATAEALERT

SEQ ID NO: 1552394 - protein, 18 aa, Mycobacterium tuberculosis
YAASRPDNVARLILDSPI

SEQ ID NO: 1552395 - protein, 31 aa, Mycobacterium tuberculosis; identical to SEQ ID NO: 1475547

SEQ ID NO: 1552396 - protein, 18 aa, Mycobacterium tuberculosis
YALATGIIDETGFPEAVA

SEQ ID NO: 1552397 - protein, 18 aa, Mycobacterium tuberculosis
YAMEANWALLLLDDDGAG

SEQ ID NO: 1552398 - protein, 17 aa, Mycobacterium tuberculosis
YANDSWGPATVTYHDGQ

SEQ ID NO: 1552399 - protein, 30 aa, Mycobacterium tuberculosis; identical to SEQ ID NO: 208728

SEQ ID NO: 1552400 - protein, 28 aa, Mycobacterium tuberculosis
YDRATLKLVFSMDLGMCLNRFTYDSKLA

SEQ ID NO: 1552401 - protein, 19 aa, Mycobacterium tuberculosis
YDYSARFGDYQVIVIANPL

SEQ ID NO: 1552402 - protein, 17 aa, Mycobacterium tuberculosis
YELMWAQDVAAMLGYHT

SEQ ID NO: 1552403 - protein, 24 aa, Mycobacterium tuberculosis
YEQMWAADVAAMVGYHGGASAAAA

SEQ ID NO: 1552404 - protein, 24 aa, Mycobacterium tuberculosis
YEQMWAADVAAMVGYHSGASAAAE

SEQ ID NO: 1552405 - protein, 18 aa, Mycobacterium tuberculosis
YEQMWALDVAAMAGYHFD

SEQ ID NO: 1552406 - protein, 31 aa, Mycobacterium tuberculosis
YERATAQRFADWLVRVVEAFADRPDQPLREV

SEQ ID NO: 1552407 - protein, 18 aa, Mycobacterium tuberculosis
YERMWAQDVAAMVGYHAG

SEQ ID NO: 1552408 - protein, 17 aa, Mycobacterium tuberculosis
YETAGMRTTCGRRDLAD

SEQ ID NO: 1552409 - protein, 17 aa, Mycobacterium tuberculosis
YEVFGPPGTVASINYLD

SEQ ID NO: 1552410 - protein, 28 aa, Mycobacterium tuberculosis
YFHLRNRLVVAAMHWDGPKAQVIGLVRS

SEQ ID NO: 1552411 - protein, 22 aa, Mycobacterium tuberculosis
YFYRPFRDLVIRAAERADAPLR

SEQ ID NO: 1552412 - protein, 24 aa, Mycobacterium tuberculosis
YGLAWRTKRLIVFDVDSTLVQGEV

SEQ ID NO: 1552413 - protein, 17 aa, Mycobacterium tuberculosis
YGPWECDGVRRAGVSSF

SEQ ID NO: 1552414 - protein, 18 aa, Mycobacterium tuberculosis
YGRRARLAVQAMTAVVAR

SEQ ID NO: 1552415 - protein, 24 aa, Mycobacterium tuberculosis
YGVPFPNNACRVVADSGDDCPDWV

SEQ ID NO: 1552416 - protein, 17 aa, Mycobacterium tuberculosis
YHGGGWSLGGLDTHDPV

SEQ ID NO: 1552417 - protein, 34 aa, Mycobacterium tuberculosis
YHRRLRQRRRWRRCRRCRRYLRSRRRTPSMPLPP

SEQ ID NO: 1552418 - protein, 17 aa, Mycobacterium tuberculosis
YKMAKSVLLAMSHSLAT

SEQ ID NO: 1552419 - protein, 18 aa, Mycobacterium tuberculosis
YLLSRAALRPVDRIRAAA

SEQ ID NO: 1552420 - protein, 17 aa, Mycobacterium tuberculosis
YLVCGALAASAAATSPP

SEQ ID NO: 1552421 - protein, 25 aa, Mycobacterium tuberculosis
YMEMLNLNEAWQFGRGDGVKVAVID

SEQ ID NO: 1552422 - protein, 17 aa, Mycobacterium tuberculosis
YMLDMTFPVDYSDQQAL

SEQ ID NO: 1552423 - protein, 17 aa, Mycobacterium tuberculosis
YNASALDLVTPAFASGL

SEQ ID NO: 1552424 - protein, 18 aa, Mycobacterium tuberculosis
YPAAFPVGMLPTNQNDAG

SEQ ID NO: 1552425 - protein, 18 aa, Mycobacterium tuberculosis
YPDIKVRSLLSGPGVMQQ

SEQ ID NO: 1552426 - protein, 18 aa, Mycobacterium tuberculosis
YPDVRVHRSLVCDKPARW

SEQ ID NO: 1552427 - protein, 34 aa, Mycobacterium tuberculosis
YPGRRPIPRPGWCRWCRISTIRPILTILRSCSPR

SEQ ID NO: 1552428 - protein, 18 aa, Mycobacterium tuberculosis
YPPVRGVIHAAGVLDDAV

SEQ ID NO: 1552429 - protein, 20 aa, Mycobacterium tuberculosis
YPQMLLRVGWAPINADPLPP

SEQ ID NO: 1552430 - protein, 28 aa, Mycobacterium tuberculosis
YQALSAQMARFHQQFVQALTASVGSYAA

SEQ ID NO: 1552431 - protein, 17 aa, Mycobacterium tuberculosis
YQALSARVATFHEQFVR

SEQ ID NO: 1552432 - protein, 19 aa, Mycobacterium tuberculosis
YRLAHKIGLDAVLVDSPLA

SEQ ID NO: 1552433 - protein, 18 aa, Mycobacterium tuberculosis
YRLSTTVRKAANLRSDPF

SEQ ID NO: 1552434 - protein, 17 aa, Mycobacterium tuberculosis
YRPEPPAPPPGGRRPAR

SEQ ID NO: 1552435 - protein, 21 aa, Mycobacterium tuberculosis
YRTPAGCTRAPTTRATLTPAP

SEQ ID NO: 1552436 - protein, 17 aa, Mycobacterium tuberculosis
YRTVRIGAHQARILLAK

SEQ ID NO: 1552437 - protein, 19 aa, Mycobacterium tuberculosis
YRVFTELTPHPLLTHAVDQ

SEQ ID NO: 1552438 - protein, 17 aa, Mycobacterium tuberculosis
YSCWPVPGGDIALMAAR

SEQ ID NO: 1552439 - protein, 23 aa, Mycobacterium tuberculosis
YSGLLEHLASWGIVAAAPDSERG

SEQ ID NO: 1552440 - protein, 26 aa, Mycobacterium tuberculosis
YSLDVPRITILDAHFTGAFRPGGRPA

SEQ ID NO: 1552441 - protein, 22 aa, Mycobacterium tuberculosis
YTARAVACFAYRQRVPVVDTNV

SEQ ID NO: 1552442 - protein, 24 aa, Mycobacterium tuberculosis
YTLKADLPASGGLYPTANVTYRGI

SEQ ID NO: 1552443 - protein, 24 aa, Mycobacterium tuberculosis
YVAAHAPYLAWLMRASETSAEAAA

SEQ ID NO: 1552444 - protein, 25 aa, Mycobacterium tuberculosis
YVAAHAPYLAWLMRASETSAEAAAR

SEQ ID NO: 1552445 - protein, 17 aa, Mycobacterium tuberculosis
YVDASPDLWSFLQNALT

SEQ ID NO: 1552446 - protein, 23 aa, Mycobacterium tuberculosis
YVPSRPHLEWQLRRRVLQLSNVQ

SEQ ID NO: 1552447 - protein, 18 aa, Mycobacterium tuberculosis
YYGGLRFTAGTWRANGGS

SEQ ID NO: 1552448 - protein, 19 aa, Mycobacterium tuberculosis
AANITRLPVRYTFDNRYFS

SEQ ID NO: 1552449 - protein, 23 aa, Mycobacterium tuberculosis
ALTYPRRLGFGLGSSVVSLSWRT

SEQ ID NO: 1552450 - protein, 19 aa, Mycobacterium tuberculosis
APDYLPVVLEFAATVDPEA

SEQ ID NO: 1552451 - protein, 24 aa, Mycobacterium tuberculosis
AVTAAEVPLAFALAAGSFRDATRV

SEQ ID NO: 1552452 - protein, 18 aa, Mycobacterium tuberculosis
DGLNRVSAILARDKDNLG

SEQ ID NO: 1552453 - protein, 18 aa, Mycobacterium tuberculosis
DKIARMLLIWAALAAVAL

SEQ ID NO: 1552454 - protein, 24 aa, Mycobacterium tuberculosis
DLKRSCLDIGLAERVLGWRPQIEL

SEQ ID NO: 1552455 - protein, 24 aa, Mycobacterium tuberculosis
FGFAVIVYLVWRFIVPLVGRLMSA

SEQ ID NO: 1552456 - protein, 18 aa, Mycobacterium tuberculosis
GPQALSFVRQRHDLPRGD

SEQ ID NO: 1552457 - protein, 23 aa, Mycobacterium tuberculosis
LLSTDFRAGCPIAAVSVEAGDEQ

SEQ ID NO: 1552458 - protein, 18 aa, Mycobacterium tuberculosis
LRVNPEFHCEIVVDGQVV

SEQ ID NO: 1552459 - protein, 19 aa, Mycobacterium tuberculosis
LSSCGWRGISNVAIPGGPG

SEQ ID NO: 1552460 - protein, 20 aa, Mycobacterium tuberculosis
NKNARFVAVAGIGLLSPGNT

SEQ ID NO: 1552461 - protein, 19 aa, Mycobacterium tuberculosis
NRVLIGFSLPGKTIGMQSR

SEQ ID NO: 1552462 - protein, 24 aa, Mycobacterium tuberculosis
NVNYRITVKPGWKFTDGSPVTAHS

SEQ ID NO: 1552463 - protein, 18 aa, Mycobacterium tuberculosis
PMGLGLVSQFFGKYFTPE

SEQ ID NO: 1552464 - protein, 17 aa, Mycobacterium tuberculosis
QVQDWVVGLLHEQDQGK

SEQ ID NO: 1552465 - protein, 23 aa, Mycobacterium tuberculosis
RAAELRYGRSFGIVAGYGGHGIG

SEQ ID NO: 1552466 - protein, 19 aa, Mycobacterium tuberculosis
RDALFHWGVAMLPAGPAGR

SEQ ID NO: 1552467 - protein, 21 aa, Mycobacterium tuberculosis
TRLTEVLSRIYGHPVTVQLHI

SEQ ID NO: 1552468 - protein, 17 aa, Mycobacterium tuberculosis
VNWPFVFASMLENAVKG

SEQ ID NO: 1552469 - protein, 17 aa, Mycobacterium tuberculosis
VPDPRYVAVSDRDQLAT

SEQ ID NO: 1552470 - protein, 19 aa, Mycobacterium tuberculosis
AAECRRVGVPDARCVLPLA

SEQ ID NO: 1552471 - protein, 18 aa, Mycobacterium tuberculosis
AAQALAFVRQRHGLDNGD

SEQ ID NO: 1552472 - protein, 20 aa, Mycobacterium tuberculosis
AEGRLGWRTLDFEVEVLPIG

SEQ ID NO: 1552473 - protein, 18 aa, Mycobacterium tuberculosis
ALLPEWRTELPLRYLESV

SEQ ID NO: 1552474 - protein, 21 aa, Mycobacterium tuberculosis
CWPTPRPPMRIWPRRFDAPPG

SEQ ID NO: 1552475 - protein, 24 aa, Mycobacterium tuberculosis
DGLTLGEALALWLSGQEQLMPRDL

SEQ ID NO: 1552476 - protein, 18 aa, Mycobacterium tuberculosis
ELPGRLHALFARGDGVTP

SEQ ID NO: 1552477 - protein, 19 aa, Mycobacterium tuberculosis
FEEGLRTTIDWYRDNESWW

SEQ ID NO: 1552478 - protein, 21 aa, Mycobacterium tuberculosis
FRNGDPFIWDRGRELGMVNRL

SEQ ID NO: 1552479 - protein, 19 aa, Mycobacterium tuberculosis
IPTLLAHYGVDAVITDEDH

SEQ ID NO: 1552480 - protein, 17 aa, Mycobacterium tuberculosis
IQTEFNVALPWRKEVSL

SEQ ID NO: 1552481 - protein, 27 aa, Mycobacterium tuberculosis
KVILSRCVEVPFAIDFPLTYRLGRRHN

SEQ ID NO: 1552482 - protein, 18 aa, Mycobacterium tuberculosis
LARADIRGPYVINADGAP

SEQ ID NO: 1552483 - protein, 18 aa, Mycobacterium tuberculosis
LRTTIDWYRDNESWWRPL

SEQ ID NO: 1552484 - protein, 20 aa, Mycobacterium tuberculosis
MKLDLLLTVPLDYYKKFMSV

SEQ ID NO: 1552485 - protein, 19 aa, Mycobacterium tuberculosis
NGAQCPRCNEEYRQLCAAL

SEQ ID NO: 1552486 - protein, 23 aa, Mycobacterium tuberculosis
NNVRRLAGPYAWSNALSAGYTAE

SEQ ID NO: 1552487 - protein, 23 aa, Mycobacterium tuberculosis
NRMLSQIWSHWSLLSAPSCAAQL

SEQ ID NO: 1552488 - protein, 17 aa, Mycobacterium tuberculosis
NTFRHLYGLDCSHIAPA

SEQ ID NO: 1552489 - protein, 17 aa, Mycobacterium tuberculosis
PADCVGVGYLTQRNVYR

SEQ ID NO: 1552490 - protein, 21 aa, Mycobacterium tuberculosis
QFAPGELKNLPGFQGSGDGSA

SEQ ID NO: 1552491 - protein, 25 aa, Mycobacterium tuberculosis
QPLPEFLSAEIFQPLGLAMVVDPVG

SEQ ID NO: 1552492 - protein, 20 aa, Mycobacterium tuberculosis
RAGSQMGVPYSWGGGSLQGP

SEQ ID NO: 1552493 - protein, 19 aa, Mycobacterium tuberculosis
RIAYDASQQVFGFAPYPAV

SEQ ID NO: 1552494 - protein, 21 aa, Mycobacterium tuberculosis
SAAVAALFARFGQEYQAVSAQ

SEQ ID NO: 1552495 - protein, 28 aa, Mycobacterium tuberculosis
SGLMNTGFLPFRFQPVYIDYSPSGIGTT

SEQ ID NO: 1552496 - protein, 18 aa, Mycobacterium tuberculosis
TRAVYKHMAKRGGGAIVN

SEQ ID NO: 1552497 - protein, 23 aa, Mycobacterium tuberculosis
VDMLEMLPTPWGLVRSGVAPDHP

SEQ ID NO: 1552498 - protein, 25 aa, Mycobacterium tuberculosis
VLDEATGRWGLRVARVELRSIDPPP

SEQ ID NO: 1552499 - protein, 19 aa, Mycobacterium tuberculosis
VPDDWRLLPESSRAPYGGI

SEQ ID NO: 1552500 - protein, 17 aa, Mycobacterium tuberculosis
VPPTWQGSIPISMASSA

SEQ ID NO: 1552501 - protein, 19 aa, Mycobacterium tuberculosis
VQPRLAILLGDCAVPAEGR

SEQ ID NO: 1552502 - protein, 18 aa, Mycobacterium tuberculosis
VSLAAVFLALAMGVVLGS

SEQ ID NO: 1552503 - protein, 19 aa, Mycobacterium tuberculosis
WRTELPLRYLESVITQLSQ

SEQ ID NO: 1552504 - protein, 19 aa, Mycobacterium tuberculosis
WSARGVDVTPFFAVLNGPR

SEQ ID NO: 1552505 - protein, 19 aa, Mycobacterium tuberculosis
WWWQRPRTNAVAADSLVGV

SEQ ID NO: 1552506 - protein, 21 aa, Mycobacterium tuberculosis
YPLFNLWGPAFHERYPNVTIT

SEQ ID NO: 1552507 - protein, 24 aa, Mycobacterium tuberculosis
AIDLLKGVLMPSIMQAVQNGGAAA

SEQ ID NO: 1552508 - protein, 17 aa, Mycobacterium tuberculosis
DKFPRMVDYVVPTGVRI

SEQ ID NO: 1552509 - protein, 24 aa, Mycobacterium tuberculosis
EFNVALPWRKEVSLSKSSLHPASV

SEQ ID NO: 1552510 - protein, 19 aa, Mycobacterium tuberculosis
GCGVSWNLLAGIGRIESMH

SEQ ID NO: 1552511 - protein, 18 aa, Mycobacterium tuberculosis
IIMGIDWIGPGFNPHLLS

SEQ ID NO: 1552512 - protein, 17 aa, Mycobacterium tuberculosis
LDPLCRVNSAMAGRQQG

SEQ ID NO: 1552513 - protein, 23 aa, Mycobacterium tuberculosis
MRPGNWAGIYACWGTENREAAVR

SEQ ID NO: 1552514 - protein, 17 aa, Mycobacterium tuberculosis
PPFRMWDPGSGPAGGRA

SEQ ID NO: 1552515 - protein, 18 aa, Mycobacterium tuberculosis
PTIDLPVPDDWRLLPESS

SEQ ID NO: 1552516 - protein, 24 aa, Mycobacterium tuberculosis
QSRTRRALALCVPRDAIARDAGVP

SEQ ID NO: 1552517 - protein, 20 aa, Mycobacterium tuberculosis
RADERFAFCSTFKAPLVAAV

SEQ ID NO: 1552518 - protein, 17 aa, Mycobacterium tuberculosis
RVFAGGMATGFIGVVLV

SEQ ID NO: 1552519 - protein, 20 aa, Mycobacterium tuberculosis
SGSIGLGFAIPVDQAKRIAD

SEQ ID NO: 1552520 - protein, 24 aa, Mycobacterium tuberculosis
SSTQLPVWLAHAGIDVLRSHPIVA

SEQ ID NO: 1552521 - protein, 22 aa, Mycobacterium tuberculosis
TDLSTRCSLPISGLQAIGLMQA

SEQ ID NO: 1552522 - protein, 24 aa, Mycobacterium tuberculosis
TITARLNFQLAFGARVGQRLADAR

SEQ ID NO: 1552523 - protein, 17 aa, Mycobacterium tuberculosis
WRAQLPIEDSGRVEQQL

SEQ ID NO: 1552524 - protein, 24 aa, Mycobacterium tuberculosis
YNAVEPWVQYGFNLTAWAVGWLPY

SEQ ID NO: 1552525 - protein, 19 aa, Mycobacterium tuberculosis
YRRAEICRERLGPVLRRLT

SEQ ID NO: 1552526 - protein, 18 aa, Mycobacterium tuberculosis
YYWCPGQPFDPAWGPNWD

SEQ ID NO: 1552527 - protein, 17 aa, Mycobacterium tuberculosis
AATGMVFAVFADDDSLA

SEQ ID NO: 1552528 - protein, 30 aa, Mycobacterium tuberculosis; identical to SEQ ID NO: 235490

SEQ ID NO: 1552529 - protein, 21 aa, Mycobacterium tuberculosis
EGHSMFPWLTLALVGNSTSSI

SEQ ID NO: 1552530 - protein, 19 aa, Mycobacterium tuberculosis
FRYVWASDHLQPWQDNEGH

SEQ ID NO: 1552531 - protein, 19 aa, Mycobacterium tuberculosis
FYTCLYRSLLHPNTFNDVD

SEQ ID NO: 1552532 - protein, 18 aa, Mycobacterium tuberculosis
IDRLPNGVFLDWQQFQET

SEQ ID NO: 1552533 - protein, 20 aa, Mycobacterium tuberculosis
ISVNVTLIFSVQRYREVMDA

SEQ ID NO: 1552534 - protein, 24 aa, Mycobacterium tuberculosis
KALDITLPMPPRWTQVPDPNVPDA

SEQ ID NO: 1552535 - protein, 19 aa, Mycobacterium tuberculosis
KLREIRMALTLDKTFTKSE

SEQ ID NO: 1552536 - protein, 17 aa, Mycobacterium tuberculosis
LFFGRPAPTPQQWLQIV

SEQ ID NO: 1552537 - protein, 18 aa, Mycobacterium tuberculosis
LKIVSCYQYGKGSTADWL

SEQ ID NO: 1552538 - protein, 20 aa, Mycobacterium tuberculosis
LPLDRAAVIIADLAQSTPTG

SEQ ID NO: 1552539 - protein, 17 aa, Mycobacterium tuberculosis
LPVWLTQWGYRRPAEDT

SEQ ID NO: 1552540 - protein, 23 aa, Mycobacterium tuberculosis
PGAKSARPATVWIAQDGSHHLVR

SEQ ID NO: 1552541 - protein, 18 aa, Mycobacterium tuberculosis
PKNDLSWHDCTSRVYSNA

SEQ ID NO: 1552542 - protein, 19 aa, Mycobacterium tuberculosis
PSAPMPGCTLICIGSHGPP

SEQ ID NO: 1552543 - protein, 21 aa, Mycobacterium tuberculosis
RDIPFDVIQRLGLAYTPPEAE

SEQ ID NO: 1552544 - protein, 19 aa, Mycobacterium tuberculosis
REVQDVWIWVRPYFDDRAT

SEQ ID NO: 1552545 - protein, 17 aa, Mycobacterium tuberculosis
RKVNALKFIAFVTNPTN

SEQ ID NO: 1552546 - protein, 22 aa, Mycobacterium tuberculosis
RRVGVPDARCVLPLAHRVTQAA

SEQ ID NO: 1552547 - protein, 20 aa, Mycobacterium tuberculosis
SCGYSDCKVLTSFTACGAVA

SEQ ID NO: 1552548 - protein, 19 aa, Mycobacterium tuberculosis
SEERLRPPPGYKDTTVPGI

SEQ ID NO: 1552549 - protein, 17 aa, Mycobacterium tuberculosis
SKMAFAMANFEPGSNEP

SEQ ID NO: 1552550 - protein, 25 aa, Mycobacterium tuberculosis
SNAVRFAFWGAEEFGLIGSRNYVES

SEQ ID NO: 1552551 - protein, 18 aa, Mycobacterium tuberculosis
SRGLRYATVIALVAALVG

SEQ ID NO: 1552552 - protein, 26 aa, Mycobacterium tuberculosis
TEVLQRLRGMFAFALWDTVTRELFCA

SEQ ID NO: 1552553 - protein, 18 aa, Mycobacterium tuberculosis
TTGCIRWSTQSRPVVNGP

SEQ ID NO: 1552554 - protein, 18 aa, Mycobacterium tuberculosis
VKLFDDWSNLGSISELST

SEQ ID NO: 1552555 - protein, 20 aa, Mycobacterium tuberculosis
WRELFTDILPAHIVKDIPGG

SEQ ID NO: 1552556 - protein, 19 aa, Mycobacterium tuberculosis
ACLALWLSGCSSPKPDAEE

SEQ ID NO: 1552557 - protein, 18 aa, Mycobacterium tuberculosis
ATDGRFRFLRVYPNPEVY

SEQ ID NO: 1552558 - protein, 17 aa, Mycobacterium tuberculosis
EHHEFKQAAVLTDLPGE

SEQ ID NO: 1552559 - protein, 20 aa, Mycobacterium tuberculosis
FAGGMATGFIGVVLVTAGKA

SEQ ID NO: 1552560 - protein, 22 aa, Mycobacterium tuberculosis
FNRNTWGVAMIGNFDDVAPTPI

SEQ ID NO: 1552561 - protein, 23 aa, Mycobacterium tuberculosis
GAIARLPAIFTHRDVGNTDCPGN

SEQ ID NO: 1552562 - protein, 19 aa, Mycobacterium tuberculosis
GAIYQRWQALGGMNSALGA

SEQ ID NO: 1552563 - protein, 18 aa, Mycobacterium tuberculosis
GRAAVPWWPWAPLVRLMW

SEQ ID NO: 1552564 - protein, 19 aa, Mycobacterium tuberculosis
GRLLGWRLGMDDVDPRSMV

SEQ ID NO: 1552565 - protein, 19 aa, Mycobacterium tuberculosis
LPSHCRGLLVGRVAGAHTP

SEQ ID NO: 1552566 - protein, 17 aa, Mycobacterium tuberculosis
LTSCTWRGIANVPLPVG

SEQ ID NO: 1552567 - protein, 20 aa, Mycobacterium tuberculosis
QLDAFLKWHHGVREFLQSAI

SEQ ID NO: 1552568 - protein, 21 aa, Mycobacterium tuberculosis
QLGAIGIDLTDVFAVLEEEGV

SEQ ID NO: 1552569 - protein, 17 aa, Mycobacterium tuberculosis
RDLRFGYRTSVLKHADG

SEQ ID NO: 1552570 - protein, 22 aa, Mycobacterium tuberculosis
RSWRPRVAVWGIHLLRRGGLTG

SEQ ID NO: 1552571 - protein, 18 aa, Mycobacterium tuberculosis
SCAPGWSAAVFDWSGVEL

SEQ ID NO: 1552572 - protein, 20 aa, Mycobacterium tuberculosis
SEEDRRFAVVFVHDQSDYAR

SEQ ID NO: 1552573 - protein, 18 aa, Mycobacterium tuberculosis
TMYELFSVGWGKPDLRDQ

SEQ ID NO: 1552574 - protein, 23 aa, Mycobacterium tuberculosis
DDYLRVIGVPAMFAAGDVAAARM

SEQ ID NO: 1552575 - protein, 22 aa, Mycobacterium tuberculosis
ELGLRPRLAIGIHQPGVGALRP

SEQ ID NO: 1552576 - protein, 19 aa, Mycobacterium tuberculosis
FAALSARAVALGFDTVATG

SEQ ID NO: 1552577 - protein, 17 aa, Mycobacterium tuberculosis
FSAWQLGGSYSKNGKLR

SEQ ID NO: 1552578 - protein, 17 aa, Mycobacterium tuberculosis
FSEEIGLCVPDGPRIDF

SEQ ID NO: 1552579 - protein, 18 aa, Mycobacterium tuberculosis
GRSVSRWGAFLDDVGGFD

SEQ ID NO: 1552580 - protein, 23 aa, Mycobacterium tuberculosis
GTAFLAARGGYFVADLSSGHTAR

SEQ ID NO: 1552581 - protein, 24 aa, Mycobacterium tuberculosis
HSNALWCRWCLGYAQLMRGELAAA

SEQ ID NO: 1552582 - protein, 19 aa, Mycobacterium tuberculosis
IAGRLGLRPDVRRMPLFGL

SEQ ID NO: 1552583 - protein, 20 aa, Mycobacterium tuberculosis
KGCPKETWCVVNAGNYRGSM

SEQ ID NO: 1552584 - protein, 18 aa, Mycobacterium tuberculosis
LAAATVVWCAGMRASRLT

SEQ ID NO: 1552585 - protein, 21 aa, Mycobacterium tuberculosis
LLALRIPWYVTVLDLGSAGAV

SEQ ID NO: 1552586 - protein, 18 aa, Mycobacterium tuberculosis
LYGLDCSHIAPANVYGPR

SEQ ID NO: 1552587 - protein, 24 aa, Mycobacterium tuberculosis
NREVRWRPEHFWKPGTAVDVAVNT

SEQ ID NO: 1552588 - protein, 20 aa, Mycobacterium tuberculosis
PQLGRWKWHDPWVHASLLAQ

SEQ ID NO: 1552589 - protein, 24 aa, Mycobacterium tuberculosis
QPLRAKISFWFDRKYRVPADAAAA

SEQ ID NO: 1552590 - protein, 19 aa, Mycobacterium tuberculosis
RAGKMTNWAIARPPGQTQA

SEQ ID NO: 1552591 - protein, 17 aa, Mycobacterium tuberculosis
RRARTWLGATAEAIEAC

SEQ ID NO: 1552592 - protein, 18 aa, Mycobacterium tuberculosis
RRLLRLCARYSAHPTVIF

SEQ ID NO: 1552593 - protein, 24 aa, Mycobacterium tuberculosis
SGIPKAAGVEAIFRLDECPRGLYS

SEQ ID NO: 1552594 - protein, 22 aa, Mycobacterium tuberculosis
SRRLWTMLIFMLWHAIFVEHSV

SEQ ID NO: 1552595 - protein, 20 aa, Mycobacterium tuberculosis
SVVLSSGWDIMDFVRQLQKL

SEQ ID NO: 1552596 - protein, 23 aa, Mycobacterium tuberculosis
TLFRRLAVFVGCFFVDDAQAVAC

SEQ ID NO: 1552597 - protein, 20 aa, Mycobacterium tuberculosis
TYKAFDWDQAYRKPITYDTL

SEQ ID NO: 1552598 - protein, 17 aa, Mycobacterium tuberculosis
VGVEGKVIWSGVRGIAD

SEQ ID NO: 1552599 - protein, 17 aa, Mycobacterium tuberculosis
WIPLLILVVVAIAGFTV

SEQ ID NO: 1552600 - protein, 19 aa, Mycobacterium tuberculosis
AGGKCPDVLMAWELTYAEL

SEQ ID NO: 1552601 - protein, 17 aa, Mycobacterium tuberculosis
ANLERWAPLLPEGATLV

SEQ ID NO: 1552602 - protein, 20 aa, Mycobacterium tuberculosis
CGFKPGFPMAEWASKRRAQL

SEQ ID NO: 1552603 - protein, 17 aa, Mycobacterium tuberculosis
DRWRLAQILTFQAVDAV

SEQ ID NO: 1552604 - protein, 17 aa, Mycobacterium tuberculosis
ECHLTQLELQWGRTIGQ

SEQ ID NO: 1552605 - protein, 18 aa, Mycobacterium tuberculosis
IDNLRAAFVWNRENSDTE

SEQ ID NO: 1552606 - protein, 17 aa, Mycobacterium tuberculosis
IFQPLGLAMVVDPVGKV

SEQ ID NO: 1552607 - protein, 21 aa, Mycobacterium tuberculosis
IPYYSATLWDPRERPSFTGEY

SEQ ID NO: 1552608 - protein, 19 aa, Mycobacterium tuberculosis
KLGFPVPIRHWLRAGELLE

SEQ ID NO: 1552609 - protein, 21 aa, Mycobacterium tuberculosis
KSTWRSVPLVGHIPSAPGNPG

SEQ ID NO: 1552610 - protein, 17 aa, Mycobacterium tuberculosis
LAQILTFQAVDAVVAGD

SEQ ID NO: 1552611 - protein, 31 aa, Mycobacterium tuberculosis
LFDLPPRWFAGWSRLGLRTSLRYKVPRMPFS

SEQ ID NO: 1552612 - protein, 21 aa, Mycobacterium tuberculosis
LKYLPLAPFRISYAYTNFGVT

SEQ ID NO: 1552613 - protein, 17 aa, Mycobacterium tuberculosis
LRAAFVWNRENSDTEGA

SEQ ID NO: 1552614 - protein, 19 aa, Mycobacterium tuberculosis
LRPRMRVVNEFQRRYPDIK

SEQ ID NO: 1552615 - protein, 20 aa, Mycobacterium tuberculosis
LSDLQPGDVLTFYSDASHAG

SEQ ID NO: 1552616 - protein, 19 aa, Mycobacterium tuberculosis
LVAFWWWQRPRTNAVAADS

SEQ ID NO: 1552617 - protein, 18 aa, Mycobacterium tuberculosis
LWRMGIRTIGQFAALSRT

SEQ ID NO: 1552618 - protein, 17 aa, Mycobacterium tuberculosis
MGVPYSWGGGSLQGPSK

SEQ ID NO: 1552619 - protein, 18 aa, Mycobacterium tuberculosis
MRDRWAGFFNEFDVLLLP

SEQ ID NO: 1552620 - protein, 17 aa, Mycobacterium tuberculosis
RGSVVFRVLQATNNDKD

SEQ ID NO: 1552621 - protein, 26 aa, Mycobacterium tuberculosis
RSDLARYGIAPAYPWDFIRDVINNTL

SEQ ID NO: 1552622 - protein, 22 aa, Mycobacterium tuberculosis
RYPRNGWPALFHVRSGASLAGN

SEQ ID NO: 1552623 - protein, 20 aa, Mycobacterium tuberculosis
VAAFKWRAQLPIEDSGRVEQ

SEQ ID NO: 1552624 - protein, 17 aa, Mycobacterium tuberculosis
VEGAFYWLNNREVRWRP

SEQ ID NO: 1552625 - protein, 18 aa, Mycobacterium tuberculosis
VEGKVIWSGVRGIADLAS

SEQ ID NO: 1552626 - protein, 20 aa, Mycobacterium tuberculosis
VGAPMGWEAVFTRPFQAFWV

SEQ ID NO: 1552627 - protein, 17 aa, Mycobacterium tuberculosis
VSLALACDLVLASDNAF

SEQ ID NO: 1552628 - protein, 24 aa, Mycobacterium tuberculosis
YREAALRLDHHFAISVIDCGSSME

SEQ ID NO: 1552629 - protein, 17 aa, Mycobacterium tuberculosis
AAIPAFKPLGGRELGAG

SEQ ID NO: 1552630 - protein, 23 aa, Mycobacterium tuberculosis
AARLRWARRPDWGGLEVDVDVAG

SEQ ID NO: 1552631 - protein, 17 aa, Mycobacterium tuberculosis
AKLCVQYLAPIVKNRQY

SEQ ID NO: 1552632 - protein, 18 aa, Mycobacterium tuberculosis
CLDIDWVIGGCMSVDPTH

SEQ ID NO: 1552633 - protein, 18 aa, Mycobacterium tuberculosis
CSVPGAWPPVTIAGRRYM

SEQ ID NO: 1552634 - protein, 17 aa, Mycobacterium tuberculosis
DNPDRWAPPYAEAGAYN

SEQ ID NO: 1552635 - protein, 25 aa, Mycobacterium tuberculosis
EDFWRSAGLPAYRWPDPNGTRFPNG

SEQ ID NO: 1552636 - protein, 18 aa, Mycobacterium tuberculosis
EWFCLFSSAAALVGSPGQ

SEQ ID NO: 1552637 - protein, 19 aa, Mycobacterium tuberculosis
GFDISARMGAAISDAAPQL

SEQ ID NO: 1552638 - protein, 19 aa, Mycobacterium tuberculosis
GGMLRRMRPLFSVGLGARL

SEQ ID NO: 1552639 - protein, 23 aa, Mycobacterium tuberculosis
GILCGSIVSGLRMRPGNWAGIYA

SEQ ID NO: 1552640 - protein, 18 aa, Mycobacterium tuberculosis
GSMIIQFVVKTLVAMLDW

SEQ ID NO: 1552641 - protein, 18 aa, Mycobacterium tuberculosis
KEGLTRLAADLSPAAGEL

SEQ ID NO: 1552642 - protein, 21 aa, Mycobacterium tuberculosis
LGAPCSSWERFIFGRGPSGQA

SEQ ID NO: 1552643 - protein, 17 aa, Mycobacterium tuberculosis
LGGSYSKNGKLRTVAQK

SEQ ID NO: 1552644 - protein, 24 aa, Mycobacterium tuberculosis
LLSFERWAPDMGWEIATGKSVLAG

SEQ ID NO: 1552645 - protein, 25 aa, Mycobacterium tuberculosis
NFWRSAGLPEFRWPDPNGTRFPNGA

SEQ ID NO: 1552646 - protein, 23 aa, Mycobacterium tuberculosis
PAIQPKLTFTWRIMPQNLSDAGI

SEQ ID NO: 1552647 - protein, 19 aa, Mycobacterium tuberculosis
PLKELRRAAPYLVGALKLI

SEQ ID NO: 1552648 - protein, 24 aa, Mycobacterium tuberculosis
PVGGFSFALPAGWVESDAAHLDYG

SEQ ID NO: 1552649 - protein, 17 aa, Mycobacterium tuberculosis
QGYYPGIGAPSWTADYG

SEQ ID NO: 1552650 - protein, 20 aa, Mycobacterium tuberculosis
RRPGGAWMLGKPIQLSEARD

SEQ ID NO: 1552651 - protein, 19 aa, Mycobacterium tuberculosis
TALPRRHKLVLSRGPYGYH

SEQ ID NO: 1552652 - protein, 17 aa, Mycobacterium tuberculosis
TLFPPVRPRQWLEIRYL

SEQ ID NO: 1552653 - protein, 19 aa, Mycobacterium tuberculosis
VASCGWRGLNSLPLPGTQG

SEQ ID NO: 1552654 - protein, 22 aa, Mycobacterium tuberculosis
VDIKPGLSLGGYAAFARYDNNE

SEQ ID NO: 1552655 - protein, 19 aa, Mycobacterium tuberculosis
VRCDARLAVTLPPELPVAA

SEQ ID NO: 1552656 - protein, 20 aa, Mycobacterium tuberculosis
WLDAFAHWRRAQGLPATSIA

SEQ ID NO: 1552657 - protein, 17 aa, Mycobacterium tuberculosis
YQILQPWVDAAFKKRGI

SEQ ID NO: 1552658 - protein, 21 aa, Mycobacterium tuberculosis
YRPTQPGSYPIVLATYEIVCS

SEQ ID NO: 1552659 - protein, 20 aa, Mycobacterium tuberculosis
AALNLVKCVHWPSSSPPQPP

SEQ ID NO: 1552660 - protein, 24 aa, Mycobacterium tuberculosis
ADEVSVLIAALFEAYAQEYQALSA

SEQ ID NO: 1552661 - protein, 17 aa, Mycobacterium tuberculosis
AHGWANADLISWTFQGP

SEQ ID NO: 1552662 - protein, 25 aa, Mycobacterium tuberculosis
AHQKLCEVYKLAARAVQIATNGDNP

SEQ ID NO: 1552663 - protein, 17 aa, Mycobacterium tuberculosis
DAEVVFARGRFEPPGIG

SEQ ID NO: 1552664 - protein, 18 aa, Mycobacterium tuberculosis
DGLPMLCLGARGWQPGWF

SEQ ID NO: 1552665 - protein, 23 aa, Mycobacterium tuberculosis
DLPGELMSALSQGLSQFGINIPP

SEQ ID NO: 1552666 - protein, 17 aa, Mycobacterium tuberculosis
EFAEAGWALPLSDDPAG

SEQ ID NO: 1552667 - protein, 24 aa, Mycobacterium tuberculosis
EGKYIPRLGGMAFRDPDWADEVYV

SEQ ID NO: 1552668 - protein, 20 aa, Mycobacterium tuberculosis
FLRRFSLLDSLYMVPSVPII

SEQ ID NO: 1552669 - protein, 21 aa, Mycobacterium tuberculosis
GLFPPELSGGIGNILNIGAGN

SEQ ID NO: 1552670 - protein, 25 aa, Mycobacterium tuberculosis
LANAKRWGVLHVIWRQGYYPGIGAP

SEQ ID NO: 1552671 - protein, 21 aa, Mycobacterium tuberculosis
LGALSSWYVWAALGLYPSTPG

SEQ ID NO: 1552672 - protein, 19 aa, Mycobacterium tuberculosis
LLFKRNICHQAIFYRRGLF

SEQ ID NO: 1552673 - protein, 21 aa, Mycobacterium tuberculosis
LRWSWLLSVLAAVGLGLATAP

SEQ ID NO: 1552674 - protein, 23 aa, Mycobacterium tuberculosis
PDPGKWAGFELHRDVTVTEEFTL

SEQ ID NO: 1552675 - protein, 20 aa, Mycobacterium tuberculosis
PEVNSALMFAGAGSGPTLAA

SEQ ID NO: 1552676 - protein, 19 aa, Mycobacterium tuberculosis
PGTEISIADVLRCIDGPLA

SEQ ID NO: 1552677 - protein, 19 aa, Mycobacterium tuberculosis
PRGWPEWAEPDVVDAFADR

SEQ ID NO: 1552678 - protein, 17 aa, Mycobacterium tuberculosis
RNICHQAIFYRRGLFGT

SEQ ID NO: 1552679 - protein, 19 aa, Mycobacterium tuberculosis
SAARNSAGFGAPRYGVKPI

SEQ ID NO: 1552680 - protein, 22 aa, Mycobacterium tuberculosis
TRRKGRLAALAIAAMASASLVT

SEQ ID NO: 1552681 - protein, 23 aa, Mycobacterium tuberculosis
TVAPALSLGSWVAFARTPDGQTM

SEQ ID NO: 1552682 - protein, 22 aa, Mycobacterium tuberculosis
VASPCAYFLVYESTETTERPEH

SEQ ID NO: 1552683 - protein, 23 aa, Mycobacterium tuberculosis
VLLDDRWWFHFALSGVLTALDDL

SEQ ID NO: 1552684 - protein, 17 aa, Mycobacterium tuberculosis
VPDEVWPAVVFTLVTLL

SEQ ID NO: 1552685 - protein, 17 aa, Mycobacterium tuberculosis
WRFPDRLDRVYVNSRAR

SEQ ID NO: 1552686 - protein, 17 aa, Mycobacterium tuberculosis
YELARPGTEISIADVLR

SEQ ID NO: 1552687 - protein, 19 aa, Mycobacterium tuberculosis
AIRGNRVLIGFSLPGKTIG

SEQ ID NO: 1552688 - protein, 18 aa, Mycobacterium tuberculosis
CVDRMGFSFLANIGTASV

SEQ ID NO: 1552689 - protein, 23 aa, Mycobacterium tuberculosis
DAGPPQRWFVVWLGTANNPVDKG

SEQ ID NO: 1552690 - protein, 17 aa, Mycobacterium tuberculosis
EGISVNVTLIFSVQRYR

SEQ ID NO: 1552691 - protein, 17 aa, Mycobacterium tuberculosis
GEMWAQDALAMYGYAAS

SEQ ID NO: 1552692 - protein, 17 aa, Mycobacterium tuberculosis
ILKGDKGEPCWPDGVVG

SEQ ID NO: 1552693 - protein, 27 aa, Mycobacterium tuberculosis
IVGDEFCLLDGLLAWYATIGSINNINS

SEQ ID NO: 1552694 - protein, 20 aa, Mycobacterium tuberculosis
KGDKGEPCWPDGVVGSLTHC

SEQ ID NO: 1552695 - protein, 20 aa, Mycobacterium tuberculosis
LACVVLRVARFFVEGDDMPD

SEQ ID NO: 1552696 - protein, 22 aa, Mycobacterium tuberculosis
LRWGEYRAGGLARARWGLLEPP

SEQ ID NO: 1552697 - protein, 24 aa, Mycobacterium tuberculosis
LTAWAVGWLPYIGILAPQINFFYY

SEQ ID NO: 1552698 - protein, 18 aa, Mycobacterium tuberculosis
LTMLLVFTVITGIVYPLA

SEQ ID NO: 1552699 - protein, 17 aa, Mycobacterium tuberculosis
MSSPIDCRDHFDRDEMR

SEQ ID NO: 1552700 - protein, 18 aa, Mycobacterium tuberculosis
NHEPGWVVAPGMQGMQVQ

SEQ ID NO: 1552701 - protein, 20 aa, Mycobacterium tuberculosis
NPDYLPGALLPPSIHATADA

SEQ ID NO: 1552702 - protein, 24 aa, Mycobacterium tuberculosis
NSGTCFRPSLAVQRRWRDEFGLGL

SEQ ID NO: 1552703 - protein, 20 aa, Mycobacterium tuberculosis
PEGLPSVFVYDGYPGGAGFA

SEQ ID NO: 1552704 - protein, 23 aa, Mycobacterium tuberculosis
PPEHLQWIGQWGIFDALRAGREV

SEQ ID NO: 1552705 - protein, 17 aa, Mycobacterium tuberculosis
REISWQWDCLLPDGTIE

SEQ ID NO: 1552706 - protein, 17 aa, Mycobacterium tuberculosis
RFACDYALLAVPYLTLR

SEQ ID NO: 1552707 - protein, 18 aa, Mycobacterium tuberculosis
SAELPDWLAANRGLAPGG

SEQ ID NO: 1552708 - protein, 18 aa, Mycobacterium tuberculosis
SVSNLRWSGDYVLIDVDA

SEQ ID NO: 1552709 - protein, 17 aa, Mycobacterium tuberculosis
TTSGYRAGLLASIAASC

SEQ ID NO: 1552710 - protein, 18 aa, Mycobacterium tuberculosis
VVHYGNGVSIVYADVPTT

SEQ ID NO: 1552711 - protein, 23 aa, Mycobacterium tuberculosis
ADVQRLPLNVTWVNLTTGKSGSA

SEQ ID NO: 1552712 - protein, 19 aa, Mycobacterium tuberculosis
AELLRPGLLVLPVRGPARF

SEQ ID NO: 1552713 - protein, 18 aa, Mycobacterium tuberculosis
ALPSRLCTPGFGPIGVCI

SEQ ID NO: 1552714 - protein, 18 aa, Mycobacterium tuberculosis
ALRDGGCNDVILVLGAVE

SEQ ID NO: 1552715 - protein, 21 aa, Mycobacterium tuberculosis
ARLGSDMGEFYMPYPGTRINQ

SEQ ID NO: 1552716 - protein, 17 aa, Mycobacterium tuberculosis
ASFGETFASGPYFKVLL

SEQ ID NO: 1552717 - protein, 19 aa, Mycobacterium tuberculosis
AYDRAWWFARFVAAAYGTA

SEQ ID NO: 1552718 - protein, 23 aa, Mycobacterium tuberculosis
DRNRAHWDWLKWLPHNQHPNACD

SEQ ID NO: 1552719 - protein, 25 aa, Mycobacterium tuberculosis
DTGSFRWASVRGYRLAARLVEIGVD

SEQ ID NO: 1552720 - protein, 19 aa, Mycobacterium tuberculosis
GAAPGGFDCSGLVMWAFQQ

SEQ ID NO: 1552721 - protein, 18 aa, Mycobacterium tuberculosis
GGLFGVLTNVVWTNHGPC

SEQ ID NO: 1552722 - protein, 21 aa, Mycobacterium tuberculosis
IRPNPGIGHPCWANYFPVTRA

SEQ ID NO: 1552723 - protein, 18 aa, Mycobacterium tuberculosis
KAAARLGSDMGEFYMPYP

SEQ ID NO: 1552724 - protein, 19 aa, Mycobacterium tuberculosis
LHHPCCGDLVYGADPKLAK

SEQ ID NO: 1552725 - protein, 23 aa, Mycobacterium tuberculosis
MEFVSFKGGWQLSRQTAEMLLAM

SEQ ID NO: 1552726 - protein, 17 aa, Mycobacterium tuberculosis
PGPICLSILRSPRQVCS

SEQ ID NO: 1552727 - protein, 18 aa, Mycobacterium tuberculosis
PIGLELNGGVGPITVLPI

SEQ ID NO: 1552728 - protein, 18 aa, Mycobacterium tuberculosis
RVAHCIYAGLATDTGSFR

SEQ ID NO: 1552729 - protein, 20 aa, Mycobacterium tuberculosis
SFAIGLAMMLAPMVAAPGLA

SEQ ID NO: 1552730 - protein, 20 aa, Mycobacterium tuberculosis
SVPLVCLLAGLLLAATHGVS

SEQ ID NO: 1552731 - protein, 24 aa, Mycobacterium tuberculosis
TGTVAYRFSWHLPKDRIWTYDGQL

SEQ ID NO: 1552732 - protein, 24 aa, Mycobacterium tuberculosis
AADPAGWPRLDWSMDAALLLAALA

SEQ ID NO: 1552733 - protein, 18 aa, Mycobacterium tuberculosis
ADYLRGFIQERWIIRPKS

SEQ ID NO: 1552734 - protein, 19 aa, Mycobacterium tuberculosis
DEVWPAVVFTLVTLLDDPV

SEQ ID NO: 1552735 - protein, 24 aa, Mycobacterium tuberculosis
GGIRGPIGLGFRVPCFVISPYSRG

SEQ ID NO: 1552736 - protein, 21 aa, Mycobacterium tuberculosis
GLPLRAMVMVLLFLGVVFLLL

SEQ ID NO: 1552737 - protein, 18 aa, Mycobacterium tuberculosis
GSWHIRWAALTPARQAAV

SEQ ID NO: 1552738 - protein, 21 aa, Mycobacterium tuberculosis
IVRLRRRVRFAGEVTKVTSER

SEQ ID NO: 1552739 - protein, 20 aa, Mycobacterium tuberculosis
LAGTVLRFVPPLAALGSVPV

SEQ ID NO: 1552740 - protein, 19 aa, Mycobacterium tuberculosis
LLSESGWYSALFGMQHETS

SEQ ID NO: 1552741 - protein, 24 aa, Mycobacterium tuberculosis
NAFFSSRCNLIAWDRGVFMAVAQE

SEQ ID NO: 1552742 - protein, 18 aa, Mycobacterium tuberculosis
RDEGRWHVRWTTSGLHPK

SEQ ID NO: 1552743 - protein, 25 aa, Mycobacterium tuberculosis
SGGIRGPLGLGFRVPCIVISPYSRG

SEQ ID NO: 1552744 - protein, 20 aa, Mycobacterium tuberculosis
SLRDLGCRALLMSGRPDEGA

SEQ ID NO: 1552745 - protein, 22 aa, Mycobacterium tuberculosis
SLRLHPDIRLFTAIPEQRSSTA

SEQ ID NO: 1552746 - protein, 17 aa, Mycobacterium tuberculosis
TADGINYRVLWQAAGPD

SEQ ID NO: 1552747 - protein, 18 aa, Mycobacterium tuberculosis
VQALNMGAVCYAAAETAN

SEQ ID NO: 1552748 - protein, 29 aa, Mycobacterium tuberculosis
AERCGSPAWDLPTVFGPIAITYNIKGVST

SEQ ID NO: 1552749 - protein, 18 aa, Mycobacterium tuberculosis
AGQQCDRLAAVLMPDTAT

SEQ ID NO: 1552750 - protein, 23 aa, Mycobacterium tuberculosis
AKLWTIADLGGWGSVDPQLFDKA

SEQ ID NO: 1552751 - protein, 18 aa, Mycobacterium tuberculosis
AQLAPWAQAVRALPNPTA

SEQ ID NO: 1552752 - protein, 17 aa, Mycobacterium tuberculosis
DGTYPCIIRVENLSAGY

SEQ ID NO: 1552753 - protein, 18 aa, Mycobacterium tuberculosis
EFLSCFLGLMLHGAVPVP

SEQ ID NO: 1552754 - protein, 21 aa, Mycobacterium tuberculosis
EVSAAIAALFGAHARAYQALS

SEQ ID NO: 1552755 - protein, 17 aa, Mycobacterium tuberculosis
GLGGWLWGNNGAAGTGD

SEQ ID NO: 1552756 - protein, 26 aa, Mycobacterium tuberculosis
GNFSNGVLWRGDYEGLWGLSGGSTIP

SEQ ID NO: 1552757 - protein, 17 aa, Mycobacterium tuberculosis
GPMQFLPGTWARYATDG

SEQ ID NO: 1552758 - protein, 18 aa, Mycobacterium tuberculosis
NDIAVVWSPTGVPYVVAV

SEQ ID NO: 1552759 - protein, 18 aa, Mycobacterium tuberculosis
NGRGRWLAIAASLVVSAA

SEQ ID NO: 1552760 - protein, 18 aa, Mycobacterium tuberculosis
PAVLAVAVVVAFLTTGCI

SEQ ID NO: 1552761 - protein, 19 aa, Mycobacterium tuberculosis
PEFPIHWTSTGGIGPIIIP

SEQ ID NO: 1552762 - protein, 20 aa, Mycobacterium tuberculosis
PSGLPGLRHKYSLDIAPGNF

SEQ ID NO: 1552763 - protein, 18 aa, Mycobacterium tuberculosis
RAGGCFFAAAAADVDSQP

SEQ ID NO: 1552764 - protein, 21 aa, Mycobacterium tuberculosis
TDMPGRFVVAAAMVRHLLTDP

SEQ ID NO: 1552765 - protein, 22 aa, Mycobacterium tuberculosis
TFMPNFALEWLINAYHRRGADI

SEQ ID NO: 1552766 - protein, 19 aa, Mycobacterium tuberculosis
VIMRSAIGFFASFTVSSGV

SEQ ID NO: 1552767 - protein, 18 aa, Mycobacterium tuberculosis
VQAQKLWAQAGFRPVDPA

SEQ ID NO: 1552768 - protein, 18 aa, Mycobacterium tuberculosis
AKMLRLNAGLGNVGNYNV

SEQ ID NO: 1552769 - protein, 17 aa, Mycobacterium tuberculosis
DGLRWSTTEQLGYNRRY

SEQ ID NO: 1552770 - protein, 22 aa, Mycobacterium tuberculosis
DPPVEGGWAWLPDEAQGARVHW

SEQ ID NO: 1552771 - protein, 20 aa, Mycobacterium tuberculosis
ELLPQVFRWARTVDPVQPLT

SEQ ID NO: 1552772 - protein, 20 aa, Mycobacterium tuberculosis
ELYKRLPGDLSILTPSPASD

SEQ ID NO: 1552773 - protein, 17 aa, Mycobacterium tuberculosis
FARERSRWLFSNPEMTH

SEQ ID NO: 1552774 - protein, 24 aa, Mycobacterium tuberculosis
GGNGGRAGLLLGVGGMGGNGGATS

SEQ ID NO: 1552775 - protein, 17 aa, Mycobacterium tuberculosis
LRLNAGLGNVGNYNVGL

SEQ ID NO: 1552776 - protein, 18 aa, Mycobacterium tuberculosis
LTGWQWLGPSSVRMGAAV

SEQ ID NO: 1552777 - protein, 25 aa, Mycobacterium tuberculosis
NAFFSSRCNLIAWDRGVFMAVAQEY

SEQ ID NO: 1552778 - protein, 26 aa, Mycobacterium tuberculosis
PPPRRPAHRVLVGWLSLAAGLLAIAA

SEQ ID NO: 1552779 - protein, 22 aa, Mycobacterium tuberculosis
QLSGLRLGKVISISEASGAAPT

SEQ ID NO: 1552780 - protein, 18 aa, Mycobacterium tuberculosis
RAGDCGRDYRVLSAALLE

SEQ ID NO: 1552781 - protein, 18 aa, Mycobacterium tuberculosis
RGHEWKFAITKNGRHSLT

SEQ ID NO: 1552782 - protein, 20 aa, Mycobacterium tuberculosis
SPAPRCWPSRCPIPRCVSRD

SEQ ID NO: 1552783 - protein, 17 aa, Mycobacterium tuberculosis
TPRFGFEQVCATPAFPH

SEQ ID NO: 1552784 - protein, 19 aa, Mycobacterium tuberculosis
WDWAVDWDTWVSMSALPPP

SEQ ID NO: 1552785 - protein, 19 aa, Mycobacterium tuberculosis
YGINWLPWILRGVYPPPAM

SEQ ID NO: 1552786 - protein, 18 aa, Mycobacterium tuberculosis
YRTDVDWATQISYSGVFV

SEQ ID NO: 1552787 - protein, 18 aa, Mycobacterium tuberculosis
AAGYLCWRGKDLATPRGW

SEQ ID NO: 1552788 - protein, 24 aa, Mycobacterium tuberculosis
ATPLRPGIWRAYADHRMAMAGAII

SEQ ID NO: 1552789 - protein, 18 aa, Mycobacterium tuberculosis
FARERSRWLFSNPEMTHL

SEQ ID NO: 1552790 - protein, 17 aa, Mycobacterium tuberculosis
FHLCVVDAPTLHNAAEA

SEQ ID NO: 1552791 - protein, 18 aa, Mycobacterium tuberculosis
IPNGGSVFGCQPCSAPDR

SEQ ID NO: 1552792 - protein, 18 aa, Mycobacterium tuberculosis
IRGNRVLIGFSLPGKTIG

SEQ ID NO: 1552793 - protein, 17 aa, Mycobacterium tuberculosis
LRLSPDLTNLIERYLAN

SEQ ID NO: 1552794 - protein, 17 aa, Mycobacterium tuberculosis
NDIAVVWSPTGVPYVVA

SEQ ID NO: 1552795 - protein, 17 aa, Mycobacterium tuberculosis
NRFPYDIEFIIRGESEQ

SEQ ID NO: 1552796 - protein, 25 aa, Mycobacterium tuberculosis
PAPPPFRLPLLFVNALGDNWIVGAS

SEQ ID NO: 1552797 - protein, 22 aa, Mycobacterium tuberculosis
RAAASLLSRSNWVLATALPASQ

SEQ ID NO: 1552798 - protein, 17 aa, Mycobacterium tuberculosis
RPPPAPRLTFRPADSAA

SEQ ID NO: 1552799 - protein, 20 aa, Mycobacterium tuberculosis
SGPRWLALLLQPLSGPPSTS

SEQ ID NO: 1552800 - protein, 19 aa, Mycobacterium tuberculosis
TADGINYRVLWQAAGPDTI

SEQ ID NO: 1552801 - protein, 19 aa, Mycobacterium tuberculosis
VICRRSRLMSRIAGSGAMA

SEQ ID NO: 1552802 - protein, 17 aa, Mycobacterium tuberculosis
YTARLRPGPLRPAERRT

SEQ ID NO: 1552803 - protein, 19 aa, Mycobacterium tuberculosis
AAGYLCWRGKDLATPRGWI

SEQ ID NO: 1552804 - protein, 17 aa, Mycobacterium tuberculosis
AAIAALFSAHGRDFQAL

SEQ ID NO: 1552805 - protein, 24 aa, Mycobacterium tuberculosis
AGGAGGRGALLLGAGGQGGLGGAG

SEQ ID NO: 1552806 - protein, 20 aa, Mycobacterium tuberculosis
ARIGSALSLASAVAAAQTSA

SEQ ID NO: 1552807 - protein, 21 aa, Mycobacterium tuberculosis
DAHGVPFLGIRGMSDGPGDPL

SEQ ID NO: 1552808 - protein, 18 aa, Mycobacterium tuberculosis
DPSRPVACIVRVRATNGS

SEQ ID NO: 1552809 - protein, 18 aa, Mycobacterium tuberculosis
EFAEAGWALPLSDDPAGL

SEQ ID NO: 1552810 - protein, 20 aa, Mycobacterium tuberculosis
ELGQPLPLFIKWDDADYGLR

SEQ ID NO: 1552811 - protein, 18 aa, Mycobacterium tuberculosis
ENRFPYDIEFIIRGESEQ

SEQ ID NO: 1552812 - protein, 17 aa, Mycobacterium tuberculosis
FEQVCATPAFPHDSRDW

SEQ ID NO: 1552813 - protein, 20 aa, Mycobacterium tuberculosis
FVGAICRWQAANPAGLIDIT

SEQ ID NO: 1552814 - protein, 25 aa, Mycobacterium tuberculosis
GGAGGPGGLIWGGGGAGGVGGAGGG

SEQ ID NO: 1552815 - protein, 25 aa, Mycobacterium tuberculosis
GGHGGVGGDGGWLAPGGAGGAGGQG

SEQ ID NO: 1552816 - protein, 25 aa, Mycobacterium tuberculosis
IDVSGGLPAFTLFPGGLNIPQNAIP

SEQ ID NO: 1552817 - protein, 18 aa, Mycobacterium tuberculosis
LHLPGFPVQFFVYKQIAA

SEQ ID NO: 1552818 - protein, 27 aa, Mycobacterium tuberculosis
LRNPERVWGWYLWRHYLVANVEPNDGH

SEQ ID NO: 1552819 - protein, 25 aa, Mycobacterium tuberculosis
LTAWAVGWLPYIGILAPQINFFYYL

SEQ ID NO: 1552820 - protein, 21 aa, Mycobacterium tuberculosis
MEFVSFKGGWQLSRQTAEMLL

SEQ ID NO: 1552821 - protein, 19 aa, Mycobacterium tuberculosis
PAAAARLGSRLSIHDQPNL

SEQ ID NO: 1552822 - protein, 18 aa, Mycobacterium tuberculosis
PDGLRWSTTEQLGYNRRY

SEQ ID NO: 1552823 - protein, 17 aa, Mycobacterium tuberculosis
PGDFFPVPCCFPSCRSI

SEQ ID NO: 1552824 - protein, 17 aa, Mycobacterium tuberculosis
RATVAAAVWLATVCLVA

SEQ ID NO: 1552825 - protein, 20 aa, Mycobacterium tuberculosis
RAYRLRWPAGTIVFEVDQPQ

SEQ ID NO: 1552826 - protein, 19 aa, Mycobacterium tuberculosis
THCNLDCPICFADSGHQPD

SEQ ID NO: 1552827 - protein, 19 aa, Mycobacterium tuberculosis
VGAICRWQAANPAGLIDIT

SEQ ID NO: 1552828 - protein, 19 aa, Mycobacterium tuberculosis
VPCCFPSCRSITYLLTDGE

SEQ ID NO: 1552829 - protein, 24 aa, Mycobacterium tuberculosis
VSLAGSGWCGWVLFEKHQTDVAAG

SEQ ID NO: 1552830 - protein, 19 aa, Mycobacterium tuberculosis
YRTDVDWATQISYSGVFVH

SEQ ID NO: 1552831 - protein, 23 aa, Mycobacterium tuberculosis
AADPAGWPRLDWSMDAALLLAAL

SEQ ID NO: 1552832 - protein, 24 aa, Mycobacterium tuberculosis
AGHYTLRAAIDWQQHKPNGSHVVN

SEQ ID NO: 1552833 - protein, 20 aa, Mycobacterium tuberculosis
ARTETWINLQVGDCLADLPP

SEQ ID NO: 1552834 - protein, 17 aa, Mycobacterium tuberculosis
DEGLGFDPIECFGVVGV

SEQ ID NO: 1552835 - protein, 21 aa, Mycobacterium tuberculosis
EFRCARCGVPYTDALPEMPEP

SEQ ID NO: 1552836 - protein, 17 aa, Mycobacterium tuberculosis
EVARIGSALSLASAVAA

SEQ ID NO: 1552837 - protein, 17 aa, Mycobacterium tuberculosis
FGGAPGFGNDTTAPSSG

SEQ ID NO: 1552838 - protein, 21 aa, Mycobacterium tuberculosis
FMPNFALEWLINAYHRRGADI

SEQ ID NO: 1552839 - protein, 25 aa, Mycobacterium tuberculosis
FSNGILWRGNYEGLFSYSYSLDVPR

SEQ ID NO: 1552840 - protein, 19 aa, Mycobacterium tuberculosis
GILNRGAGISGVYNTGTLG

SEQ ID NO: 1552841 - protein, 18 aa, Mycobacterium tuberculosis
GINWLPWILRGVYPPPAM

SEQ ID NO: 1552842 - protein, 21 aa, Mycobacterium tuberculosis
GNGGDGDGFIGGSGGTGGTGG

SEQ ID NO: 1552843 - protein, 27 aa, Mycobacterium tuberculosis
GTGGAGGRAELLFGAGGAGGAGTDGGP

SEQ ID NO: 1552844 - protein, 24 aa, Mycobacterium tuberculosis
HQKLCEVYKLAARAVQIATNGDNP

SEQ ID NO: 1552845 - protein, 24 aa, Mycobacterium tuberculosis
HSQAAGSRACRWMRRNIRVTLGAA

SEQ ID NO: 1552846 - protein, 26 aa, Mycobacterium tuberculosis
ILWRGNYEGLAGFSFGYPIPLFPAVG

SEQ ID NO: 1552847 - protein, 17 aa, Mycobacterium tuberculosis
LCVVDAPTLHNAAEALH

SEQ ID NO: 1552848 - protein, 20 aa, Mycobacterium tuberculosis
LEFLSCFLGLMLHGAVPVPI

SEQ ID NO: 1552849 - protein, 20 aa, Mycobacterium tuberculosis
LPIFGFGGAPGFGNDTTAPS

SEQ ID NO: 1552850 - protein, 18 aa, Mycobacterium tuberculosis
LPTAVRWAMRIPGGKAVH

SEQ ID NO: 1552851 - protein, 23 aa, Mycobacterium tuberculosis
PDSPEALPLLFGHIGEGNLHLNV

SEQ ID NO: 1552852 - protein, 17 aa, Mycobacterium tuberculosis
QVTSGLTAGVWQGAAAA

SEQ ID NO: 1552853 - protein, 24 aa, Mycobacterium tuberculosis
RHLFTVLMDREWKHGVAAAVDVTL

SEQ ID NO: 1552854 - protein, 19 aa, Mycobacterium tuberculosis
RRPGGAWMLGKPIQLSEAR

SEQ ID NO: 1552855 - protein, 20 aa, Mycobacterium tuberculosis
RVICRRSRLMSRIAGSGAMA

SEQ ID NO: 1552856 - protein, 19 aa, Mycobacterium tuberculosis
SFAIGLAMMLAPMVAAPGL

SEQ ID NO: 1552857 - protein, 25 aa, Mycobacterium tuberculosis
SLDVPRITILDAHFTGAFGPVVVPP

SEQ ID NO: 1552858 - protein, 25 aa, Mycobacterium tuberculosis
SSSGFKVRPSFSFFAVGPDGMPGGE

SEQ ID NO: 1552859 - protein, 27 aa, Mycobacterium tuberculosis
TGGAGGAGGWLFGVGGAGGVGGAGGGT

SEQ ID NO: 1552860 - protein, 19 aa, Mycobacterium tuberculosis
TILGRFSASFGETFASGPY

SEQ ID NO: 1552861 - protein, 17 aa, Mycobacterium tuberculosis
TVAAAVWLATVCLVASC

SEQ ID NO: 1552862 - protein, 18 aa, Mycobacterium tuberculosis
VAFWWWQRPRTNAVAADS

SEQ ID NO: 1552863 - protein, 23 aa, Mycobacterium tuberculosis
VGAAARGGRRLVIAMMYGLVKEG

SEQ ID NO: 1552864 - protein, 20 aa, Mycobacterium tuberculosis
VGLVSRCLRFGSAVAGSYTV

SEQ ID NO: 1552865 - protein, 19 aa, Mycobacterium tuberculosis
YFKYHVFDEGLGFDPIECF

SEQ ID NO: 1552866 - protein, 18 aa, Mycobacterium tuberculosis
YGEMWAQDALAMYGYAAS

SEQ ID NO: 1552867 - protein, 17 aa, Mycobacterium tuberculosis
YGNGVSIVYADVPTTVD

SEQ ID NO: 1552868 - protein, 35 aa, Mycobacterium tuberculosis; identical to SEQ ID NO: 235449

SEQ ID NO: 1552869 - protein, 17 aa, Mycobacterium tuberculosis
AAGGLLFGNGGNGAAGG

SEQ ID NO: 1552870 - protein, 24 aa, Mycobacterium tuberculosis
AARLRWARRPDWGGLEVDVDVAGT

SEQ ID NO: 1552871 - protein, 29 aa, Mycobacterium tuberculosis
ADEVSAAIAGLFGAHARQYQALSVQVAAF

SEQ ID NO: 1552872 - protein, 17 aa, Mycobacterium tuberculosis
AELPDWLAANRGLAPGG

SEQ ID NO: 1552873 - protein, 17 aa, Mycobacterium tuberculosis
AGDCGRDYRVLSAALLE

SEQ ID NO: 1552874 - protein, 19 aa, Mycobacterium tuberculosis
AGGLFGVLTNVVWTNHGPC

SEQ ID NO: 1552875 - protein, 17 aa, Mycobacterium tuberculosis
ARTETWINLQVGDCLAD

SEQ ID NO: 1552876 - protein, 17 aa, Mycobacterium tuberculosis
CGFKPGFPMAEWASKRR

SEQ ID NO: 1552877 - protein, 20 aa, Mycobacterium tuberculosis
DGASGLGLGLSGFDGGQGGQ

SEQ ID NO: 1552878 - protein, 17 aa, Mycobacterium tuberculosis
DGLPMLCLGARGWQPGW

SEQ ID NO: 1552879 - protein, 20 aa, Mycobacterium tuberculosis
EFLTAAAMDLASIGSTVSAA

SEQ ID NO: 1552880 - protein, 17 aa, Mycobacterium tuberculosis
FPIAAHYFAVFPLAKHM

SEQ ID NO: 1552881 - protein, 20 aa, Mycobacterium tuberculosis
GAPCSSWERFIFGRGPSGQA

SEQ ID NO: 1552882 - protein, 18 aa, Mycobacterium tuberculosis
GAPYAWGGAAPGGFDCSG

SEQ ID NO: 1552883 - protein, 20 aa, Mycobacterium tuberculosis
GGAAPGGFDCSGLVMWAFQQ

SEQ ID NO: 1552884 - protein, 17 aa, Mycobacterium tuberculosis
IARVIMRSAIGFFASFT

SEQ ID NO: 1552885 - protein, 18 aa, Mycobacterium tuberculosis
IARVIMRSAIGFFASFTV

SEQ ID NO: 1552886 - protein, 18 aa, Mycobacterium tuberculosis
LFPPELSGGIGNILNIGA

SEQ ID NO: 1552887 - protein, 22 aa, Mycobacterium tuberculosis
LLDDRWWFHFALSGVLTALDDL

SEQ ID NO: 1552888 - protein, 21 aa, Mycobacterium tuberculosis
LRLHPDIRLFTAIPEQRSSTA

SEQ ID NO: 1552889 - protein, 23 aa, Mycobacterium tuberculosis
LSFERWAPDMGWEIATGKSVLAG

SEQ ID NO: 1552890 - protein, 24 aa, Mycobacterium tuberculosis
NFWRSAGLPEFRWPDPNGTRFPNG

SEQ ID NO: 1552891 - protein, 18 aa, Mycobacterium tuberculosis
PDAEVVFARGRFEPPGIG

SEQ ID NO: 1552892 - protein, 18 aa, Mycobacterium tuberculosis
PIWCFPKFDVPLPTAVRW

SEQ ID NO: 1552893 - protein, 23 aa, Mycobacterium tuberculosis
QLSGLRLGKVISISEASGAAPTH

SEQ ID NO: 1552894 - protein, 20 aa, Mycobacterium tuberculosis
RGVKEFAPLIGVRKAGLFTS

SEQ ID NO: 1552895 - protein, 17 aa, Mycobacterium tuberculosis
SDGNRWRAHLGYVPGMT

SEQ ID NO: 1552896 - protein, 23 aa, Mycobacterium tuberculosis
SGTCFRPSLAVQRRWRDEFGLGL

SEQ ID NO: 1552897 - protein, 24 aa, Mycobacterium tuberculosis
SNGILWRGNFEGLFGLNVGITIPE

SEQ ID NO: 1552898 - protein, 19 aa, Mycobacterium tuberculosis
SPVFGCLFKGIARGVKEFA

SEQ ID NO: 1552899 - protein, 18 aa, Mycobacterium tuberculosis
SSIPPVPGKFYWMSPTQV

SEQ ID NO: 1552900 - protein, 21 aa, Mycobacterium tuberculosis
TEALLGRPLIGNGADGTAPGQ

SEQ ID NO: 1552901 - protein, 21 aa, Mycobacterium tuberculosis
VASPCAYFLVYESTETTERPE

SEQ ID NO: 1552902 - protein, 21 aa, Mycobacterium tuberculosis
VDIKPGLSLGGYAAFARYDNN

SEQ ID NO: 1552903 - protein, 17 aa, Mycobacterium tuberculosis
VEGKVIWSGVRGIADLA

SEQ ID NO: 1552904 - protein, 22 aa, Mycobacterium tuberculosis
VGAAARGGRRLVIAMMYGLVKE

SEQ ID NO: 1552905 - protein, 18 aa, Mycobacterium tuberculosis
VNLKLQFLHDAFPNEFPD

SEQ ID NO: 1552906 - protein, 17 aa, Mycobacterium tuberculosis
VSNLRWSGDYVLIDVDA

SEQ ID NO: 1552907 - protein, 31 aa, Mycobacterium tuberculosis
AAPARPARTADPWLAPIFARSTLRHSHHLGG

SEQ ID NO: 1552908 - protein, 24 aa, Mycobacterium tuberculosis
AGLFGFGGDGGWGGRGVDARFGAA

SEQ ID NO: 1552909 - protein, 24 aa, Mycobacterium tuberculosis
AGTGGRGGLLAGQHANSGNGGGGG

SEQ ID NO: 1552910 - protein, 19 aa, Mycobacterium tuberculosis
ALNLVKCVHWPSSSPPQPP

SEQ ID NO: 1552911 - protein, 17 aa, Mycobacterium tuberculosis
CSVPGAWPPVTIAGRRY

SEQ ID NO: 1552912 - protein, 19 aa, Mycobacterium tuberculosis
EGLPSVFVYDGYPGGAGFA

SEQ ID NO: 1552913 - protein, 21 aa, Mycobacterium tuberculosis
ETMVIPPIVFLPSMTIGGQTY

SEQ ID NO: 1552914 - protein, 24 aa, Mycobacterium tuberculosis
EVSIAVAALFGMHGQAYQALSVQA

SEQ ID NO: 1552915 - protein, 17 aa, Mycobacterium tuberculosis
FGDFRFGPTTVYHATFT

SEQ ID NO: 1552916 - protein, 19 aa, Mycobacterium tuberculosis
FLRRFSLLDSLYMVPSVPI

SEQ ID NO: 1552917 - protein, 25 aa, Mycobacterium tuberculosis
FSNGILWRGNFEGLFGLNVGITIPE

SEQ ID NO: 1552918 - protein, 18 aa, Mycobacterium tuberculosis
FSRWLSAKPDYLVTTEQS

SEQ ID NO: 1552919 - protein, 17 aa, Mycobacterium tuberculosis
FTLPGERIHVVFRSDES

SEQ ID NO: 1552920 - protein, 21 aa, Mycobacterium tuberculosis
GAGGNGGWLWGNGGNGGVGGT

SEQ ID NO: 1552921 - protein, 19 aa, Mycobacterium tuberculosis
GALSSWYVWAALGLYPSTP

SEQ ID NO: 1552922 - protein, 18 aa, Mycobacterium tuberculosis
GAPGGWLLGDGGAGGSGA

SEQ ID NO: 1552923 - protein, 18 aa, Mycobacterium tuberculosis
GAPGGWLLGNGGAGGSAA

SEQ ID NO: 1552924 - protein, 18 aa, Mycobacterium tuberculosis
GDFFAFYLCDVVLKVNGK

SEQ ID NO: 1552925 - protein, 24 aa, Mycobacterium tuberculosis
GEDYLRLSALGSYGAFFNIYFCSV

SEQ ID NO: 1552926 - protein, 21 aa, Mycobacterium tuberculosis
GGAGGFGFLGGDGGAGGNAGL

SEQ ID NO: 1552927 - protein, 18 aa, Mycobacterium tuberculosis
GGMLRRMRPLFSVGLGAR

SEQ ID NO: 1552928 - protein, 23 aa, Mycobacterium tuberculosis
GIPKAAGVEAIFRLDECPRGLYS

SEQ ID NO: 1552929 - protein, 23 aa, Mycobacterium tuberculosis
GKYIPRLGGMAFRDPDWADEVYV

SEQ ID NO: 1552930 - protein, 22 aa, Mycobacterium tuberculosis
GPFQALFGRPLIGDGANGAPGQ

SEQ ID NO: 1552931 - protein, 17 aa, Mycobacterium tuberculosis
GRGRWLAIAASLVVSAA

SEQ ID NO: 1552932 - protein, 17 aa, Mycobacterium tuberculosis
ILGRFSASFGETFASGP

SEQ ID NO: 1552933 - protein, 18 aa, Mycobacterium tuberculosis
ILGRFSASFGETFASGPY

SEQ ID NO: 1552934 - protein, 22 aa, Mycobacterium tuberculosis
IRGPIGLGFRVPCFVISPYSRG

SEQ ID NO: 1552935 - protein, 22 aa, Mycobacterium tuberculosis
LPGELMSALSQGLSQFGINIPP

SEQ ID NO: 1552936 - protein, 17 aa, Mycobacterium tuberculosis
LPSAIYHRFGRVHTYAK

SEQ ID NO: 1552937 - protein, 18 aa, Mycobacterium tuberculosis
LPSWWDRRRKLGLVLSAY

SEQ ID NO: 1552938 - protein, 17 aa, Mycobacterium tuberculosis
LVIVLVRRWPKVISRAM

SEQ ID NO: 1552939 - protein, 21 aa, Mycobacterium tuberculosis
LVPEYIGNLLLYFQPDATVTM

SEQ ID NO: 1552940 - protein, 25 aa, Mycobacterium tuberculosis
LVSHYDVYPAFGFRFDLKKSGVSVT

SEQ ID NO: 1552941 - protein, 17 aa, Mycobacterium tuberculosis
LYGLDCSHIAPANVYGP

SEQ ID NO: 1552942 - protein, 24 aa, Mycobacterium tuberculosis
PAGAAVPAVRCSAAPARPARTADP

SEQ ID NO: 1552943 - protein, 21 aa, Mycobacterium tuberculosis
PDGQDGGLLFGNGGAGYNSAA

SEQ ID NO: 1552944 - protein, 19 aa, Mycobacterium tuberculosis
PPGPARPAGAAVPAVRCSA

SEQ ID NO: 1552945 - protein, 26 aa, Mycobacterium tuberculosis
QAGGPGGPAGLWGNGGPGGAGGSGGG

SEQ ID NO: 1552946 - protein, 24 aa, Mycobacterium tuberculosis
QGILCGSIVFGLRMRPGNWAGIYA

SEQ ID NO: 1552947 - protein, 20 aa, Mycobacterium tuberculosis
QMPGGIYAPMMHPWSTGKDV

SEQ ID NO: 1552948 - protein, 18 aa, Mycobacterium tuberculosis
QRGWRFPDRLDRVYVNSR

SEQ ID NO: 1552949 - protein, 22 aa, Mycobacterium tuberculosis
QSARTETWINLQVGDCLADLPP

SEQ ID NO: 1552950 - protein, 25 aa, Mycobacterium tuberculosis
RCGSPAWNLPVVFGPIAVTYNLNSV

SEQ ID NO: 1552951 - protein, 23 aa, Mycobacterium tuberculosis
REAALRLDHHFAISVIDCGSSME

SEQ ID NO: 1552952 - protein, 22 aa, Mycobacterium tuberculosis
RFNKPGTFPLRFQTEVRDGCPS

SEQ ID NO: 1552953 - protein, 18 aa, Mycobacterium tuberculosis
RHCRRIAVLAAVSIAATV

SEQ ID NO: 1552954 - protein, 18 aa, Mycobacterium tuberculosis
RYLCMLAEILRFHRAAAR

SEQ ID NO: 1552955 - protein, 21 aa, Mycobacterium tuberculosis
RYPRNGWPALFHVRSGASLAG

SEQ ID NO: 1552956 - protein, 19 aa, Mycobacterium tuberculosis
SAAIASLFSGYARDYQALS

SEQ ID NO: 1552957 - protein, 27 aa, Mycobacterium tuberculosis
SAQVAAYHQRFVQALSTGAGAYASAEA

SEQ ID NO: 1552958 - protein, 25 aa, Mycobacterium tuberculosis
TDSFYRPKRPGSYPIVLATYEIVCS

SEQ ID NO: 1552959 - protein, 17 aa, Mycobacterium tuberculosis
TETWINLQVGDCLADLP

SEQ ID NO: 1552960 - protein, 18 aa, Mycobacterium tuberculosis
TLTGRPLIGNGANGTPGT

SEQ ID NO: 1552961 - protein, 17 aa, Mycobacterium tuberculosis
TMARWPRRRSMRFESSP

SEQ ID NO: 1552962 - protein, 22 aa, Mycobacterium tuberculosis
TVAPALSLGSWVAFARTPDGQT

SEQ ID NO: 1552963 - protein, 17 aa, Mycobacterium tuberculosis
TYRFSVPDPGTYWAHPH

SEQ ID NO: 1552964 - protein, 18 aa, Mycobacterium tuberculosis
VAAFKWRAQLPIEDSGRV

SEQ ID NO: 1552965 - protein, 19 aa, Mycobacterium tuberculosis
VNLKLQFLHDAFPNEFPDP

SEQ ID NO: 1552966 - protein, 17 aa, Mycobacterium tuberculosis
VPGKFYWMSPTQVRWRP

SEQ ID NO: 1552967 - protein, 21 aa, Mycobacterium tuberculosis
VSAAIAGLFGAHARQYQALSV

SEQ ID NO: 1552968 - protein, 19 aa, Mycobacterium tuberculosis
VVLSSGWDIMDFVRQLQKL

SEQ ID NO: 1552969 - protein, 17 aa, Mycobacterium tuberculosis
AAATVVWCAGMRASRLT

SEQ ID NO: 1552970 - protein, 30 aa, Mycobacterium tuberculosis; identical to SEQ ID NO: 1498895

SEQ ID NO: 1552971 - protein, 18 aa, Mycobacterium tuberculosis
AARNSAGFGAPRYGVKPI

SEQ ID NO: 1552972 - protein, 22 aa, Mycobacterium tuberculosis
ADLTRGCGPAGAAITAGPAVTA

SEQ ID NO: 1552973 - protein, 18 aa, Mycobacterium tuberculosis
AELLRPGLLVLPVRGPAR

SEQ ID NO: 1552974 - protein, 20 aa, Mycobacterium tuberculosis
AGGAGGWIHGHGGAGGDGGA

SEQ ID NO: 1552975 - protein, 17 aa, Mycobacterium tuberculosis
AGGNAGFGAGVPGDGGI

SEQ ID NO: 1552976 - protein, 19 aa, Mycobacterium tuberculosis
AGGSGAWLYGNGGAAGAGG

SEQ ID NO: 1552977 - protein, 17 aa, Mycobacterium tuberculosis
ALGRPLIGNGANGKPGT

SEQ ID NO: 1552978 - protein, 19 aa, Mycobacterium tuberculosis
ALLGRPLIGNGADGTAANP

SEQ ID NO: 1552979 - protein, 27 aa, Mycobacterium tuberculosis
ASAEAAAAEQIVLGVINAPTQALLGRP

SEQ ID NO: 1552980 - protein, 23 aa, Mycobacterium tuberculosis
ATAFPWRRQSALVQWYVETSGSP

SEQ ID NO: 1552981 - protein, 18 aa, Mycobacterium tuberculosis
ATGGTGFAGGAGGAGGAG

SEQ ID NO: 1552982 - protein, 22 aa, Mycobacterium tuberculosis
ATHSRLATFALALAAAALPLAG

SEQ ID NO: 1552983 - protein, 22 aa, Mycobacterium tuberculosis
AVCLLTAFLLIAVFGEVRFGDG

SEQ ID NO: 1552984 - protein, 24 aa, Mycobacterium tuberculosis
DDYLRVIGVPAMFAAGDVAAARMD

SEQ ID NO: 1552985 - protein, 21 aa, Mycobacterium tuberculosis
DEVSAHIAALFSGHGEGYQAI

SEQ ID NO: 1552986 - protein, 19 aa, Mycobacterium tuberculosis
EFLTAAAMDLASIGSTVSA

SEQ ID NO: 1552987 - protein, 22 aa, Mycobacterium tuberculosis
EPGIYFPGRWGARIEDIVIVTE

SEQ ID NO: 1552988 - protein, 30 aa, Mycobacterium tuberculosis; identical to SEQ ID NO: 235535

SEQ ID NO: 1552989 - protein, 22 aa, Mycobacterium tuberculosis
EVSAAIAALFSAHGRAYQVASA

SEQ ID NO: 1552990 - protein, 17 aa, Mycobacterium tuberculosis
FGGPGLAGGLFGNPGNG

SEQ ID NO: 1552991 - protein, 20 aa, Mycobacterium tuberculosis
FGTHAQEYQALSARVATFHE

SEQ ID NO: 1552992 - protein, 18 aa, Mycobacterium tuberculosis
FKPGFPMAEWASKRRAQL

SEQ ID NO: 1552993 - protein, 17 aa, Mycobacterium tuberculosis
FNLSLWSAYNVMLMHTV

SEQ ID NO: 1552994 - protein, 18 aa, Mycobacterium tuberculosis
FNYLDLVRYLAVGNLNPS

SEQ ID NO: 1552995 - protein, 19 aa, Mycobacterium tuberculosis
GATGGTGFAGGAGGAGGAG

SEQ ID NO: 1552996 - protein, 24 aa, Mycobacterium tuberculosis
GDGGEGASGLGLGLSGFDGGQGGQ

SEQ ID NO: 1552997 - protein, 19 aa, Mycobacterium tuberculosis
GGAGGLLWGNGGNGGSGAA

SEQ ID NO: 1552998 - protein, 21 aa, Mycobacterium tuberculosis
GGAGGRGGWLVGNGGNGGNGG

SEQ ID NO: 1552999 - protein, 17 aa, Mycobacterium tuberculosis
GGIRGPIGLGFRVPCFV

SEQ ID NO: 1553000 - protein, 24 aa, Mycobacterium tuberculosis
GKGGDTPNGLAINPGIGGNGGDTG

SEQ ID NO: 1553001 - protein, 23 aa, Mycobacterium tuberculosis
GNFLSRSGAVGVLGIGPNNGFPG

SEQ ID NO: 1553002 - protein, 18 aa, Mycobacterium tuberculosis
GNGGRGGLLVGNGGAGGA

SEQ ID NO: 1553003 - protein, 19 aa, Mycobacterium tuberculosis
GQNGGAGGLLWGNGGNGGA

SEQ ID NO: 1553004 - protein, 17 aa, Mycobacterium tuberculosis
GRAAVPWWPWAPLVRLM

SEQ ID NO: 1553005 - protein, 19 aa, Mycobacterium tuberculosis
GSAARLFGGGGAGGAGGTG

SEQ ID NO: 1553006 - protein, 17 aa, Mycobacterium tuberculosis
GSVIARLTGMHWWGPAS

SEQ ID NO: 1553007 - protein, 25 aa, Mycobacterium tuberculosis
GTGADGGAGGWLFGNGGNGGQGTIG

SEQ ID NO: 1553008 - protein, 19 aa, Mycobacterium tuberculosis
HPDLFWALRGGGGGNFGVT

SEQ ID NO: 1553009 - protein, 17 aa, Mycobacterium tuberculosis
HRIRFGATVVSARFDDG

SEQ ID NO: 1553010 - protein, 20 aa, Mycobacterium tuberculosis
IERYRAATLMARVRAAKGMK

SEQ ID NO: 1553011 - protein, 17 aa, Mycobacterium tuberculosis
INWLPWILRGVYPPPAM

SEQ ID NO: 1553012 - protein, 20 aa, Mycobacterium tuberculosis
IRPNPGIGHPCWANYFPVTR

SEQ ID NO: 1553013 - protein, 17 aa, Mycobacterium tuberculosis
KEGLTRLAADLSPAAGE

SEQ ID NO: 1553014 - protein, 19 aa, Mycobacterium tuberculosis
KGGASGMLIGNGGNGGSGG

SEQ ID NO: 1553015 - protein, 18 aa, Mycobacterium tuberculosis
LATVCLVASCANADPLGS

SEQ ID NO: 1553016 - protein, 17 aa, Mycobacterium tuberculosis
LDIDWVIGGCMSVDPTH

SEQ ID NO: 1553017 - protein, 30 aa, Mycobacterium tuberculosis; identical to SEQ ID NO: 235627

SEQ ID NO: 1553018 - protein, 17 aa, Mycobacterium tuberculosis
LGGIASMISEANAMAAV

SEQ ID NO: 1553019 - protein, 19 aa, Mycobacterium tuberculosis
LLPQVFRWARTVDPVQPLT

SEQ ID NO: 1553020 - protein, 17 aa, Mycobacterium tuberculosis
LRDGGCNDVILVLGAVE

SEQ ID NO: 1553021 - protein, 19 aa, Mycobacterium tuberculosis
LRDLLKFEFLFSGRAQFEK

SEQ ID NO: 1553022 - protein, 25 aa, Mycobacterium tuberculosis
LSAQMARFHQQFVQALTASVGSYAA

SEQ ID NO: 1553023 - protein, 19 aa, Mycobacterium tuberculosis
LTAAAGRYASTEAAVERSL

SEQ ID NO: 1553024 - protein, 18 aa, Mycobacterium tuberculosis
LTGGTGFAGGAGGVGGQG

SEQ ID NO: 1553025 - protein, 22 aa, Mycobacterium tuberculosis
LTNRSTIRWTLHQMVASGVVSV

SEQ ID NO: 1553026 - protein, 17 aa, Mycobacterium tuberculosis
LVEFRWELAVGDDPLSE

SEQ ID NO: 1553027 - protein, 26 aa, Mycobacterium tuberculosis
NAPTQLWLGRPLIGDGVHGAPGTGQP

SEQ ID NO: 1553028 - protein, 17 aa, Mycobacterium tuberculosis
NGGNAWLTGQGGNGGNA

SEQ ID NO: 1553029 - protein, 20 aa, Mycobacterium tuberculosis
NGGQMVPVLLDTGSTGLVMD

SEQ ID NO: 1553030 - protein, 17 aa, Mycobacterium tuberculosis
PELSGGIGNILNIGAGN

SEQ ID NO: 1553031 - protein, 18 aa, Mycobacterium tuberculosis
PINAQFVAATGRPLIGNG

SEQ ID NO: 1553032 - protein, 22 aa, Mycobacterium tuberculosis
PLLALRIPWYVTVLDLGSAGAV

SEQ ID NO: 1553033 - protein, 25 aa, Mycobacterium tuberculosis
PPPRRPAHRVLVGWLSLAAGLLAIA

SEQ ID NO: 1553034 - protein, 20 aa, Mycobacterium tuberculosis
QALWGRPLIGNGADGTAANP

SEQ ID NO: 1553035 - protein, 21 aa, Mycobacterium tuberculosis
QEYQALSARVATFHEQFVRSL

SEQ ID NO: 1553036 - protein, 21 aa, Mycobacterium tuberculosis
QGGAGGNGWAAEGITVGIGEQ

SEQ ID NO: 1553037 - protein, 19 aa, Mycobacterium tuberculosis
RLVMSGGFYRAIQRDDVEL

SEQ ID NO: 1553038 - protein, 20 aa, Mycobacterium tuberculosis
RYGLRHRIRFGATVVSARFD

SEQ ID NO: 1553039 - protein, 17 aa, Mycobacterium tuberculosis
SALFGHGGINGDGGTGG

SEQ ID NO: 1553040 - protein, 23 aa, Mycobacterium tuberculosis
SNGILWRGNFEGLFSAYLGFTIE

SEQ ID NO: 1553041 - protein, 17 aa, Mycobacterium tuberculosis
SSCTWQLSLFITDGVPP

SEQ ID NO: 1553042 - protein, 21 aa, Mycobacterium tuberculosis
SVPLVCLLAGLLLAATHGVSG

SEQ ID NO: 1553043 - protein, 18 aa, Mycobacterium tuberculosis
TLFGRPLIGDGANGTAEN

SEQ ID NO: 1553044 - protein, 20 aa, Mycobacterium tuberculosis
TLLGRPLIGNGADGLPGQNG

SEQ ID NO: 1553045 - protein, 23 aa, Mycobacterium tuberculosis
TQALLGRPLIGDGANATTPGGAG

SEQ ID NO: 1553046 - protein, 18 aa, Mycobacterium tuberculosis
VASCGWRGLNSLPLPGTQ

SEQ ID NO: 1553047 - protein, 18 aa, Mycobacterium tuberculosis
VGAICRWQAANPAGLIDI

SEQ ID NO: 1553048 - protein, 21 aa, Mycobacterium tuberculosis
VGAPMGWEAVFTRPFQAFWVE

SEQ ID NO: 1553049 - protein, 21 aa, Mycobacterium tuberculosis
VSAAIAALFSSYARDYQTLSV

SEQ ID NO: 1553050 - protein, 20 aa, Mycobacterium tuberculosis
VSAAIASLFGAHGQAYQAVS

SEQ ID NO: 1553051 - protein, 17 aa, Mycobacterium tuberculosis
VWPAVVFTLVTLLDDPV

SEQ ID NO: 1553052 - protein, 17 aa, Mycobacterium tuberculosis
WAALRWVGENAAELGGD

SEQ ID NO: 1553053 - protein, 17 aa, Mycobacterium tuberculosis
WPFAPAKHRAMLANLHP

SEQ ID NO: 1553054 - protein, 23 aa, Mycobacterium tuberculosis
YASTEAAVERSLLGAVNAPTEAL

SEQ ID NO: 1553055 - protein, 17 aa, Mycobacterium tuberculosis
AAARLGSDMGEFYMPYP

SEQ ID NO: 1553056 - protein, 23 aa, Mycobacterium tuberculosis
AAGGLGGNGGWLYGNGGAGGIGG

SEQ ID NO: 1553057 - protein, 17 aa, Mycobacterium tuberculosis
AAIAGLFGAHARQYQAL

SEQ ID NO: 1553058 - protein, 28 aa, Mycobacterium tuberculosis
ADEVSAAIASLFSGYARDYQALSAQMAR

SEQ ID NO: 1553059 - protein, 25 aa, Mycobacterium tuberculosis
ADEVSAALASLFSGHAVSYQQVAAQ

SEQ ID NO: 1553060 - protein, 17 aa, Mycobacterium tuberculosis
AELCAQYLAPVLDALKF

SEQ ID NO: 1553061 - protein, 25 aa, Mycobacterium tuberculosis
AGDEVSAAIAALFGTHAQEYQALSA

SEQ ID NO: 1553062 - protein, 19 aa, Mycobacterium tuberculosis
AGGAAGMFGTGGAGGTGGD

SEQ ID NO: 1553063 - protein, 17 aa, Mycobacterium tuberculosis
AGGAGGDAGMFFGSGGS

SEQ ID NO: 1553064 - protein, 17 aa, Mycobacterium tuberculosis
ALCLPLARALRRPTPSA

SEQ ID NO: 1553065 - protein, 19 aa, Mycobacterium tuberculosis
ALLGRPLIGDGANGGPGQD

SEQ ID NO: 1553066 - protein, 18 aa, Mycobacterium tuberculosis
ALLGRPLIGNGADGTAPG

SEQ ID NO: 1553067 - protein, 23 aa, Mycobacterium tuberculosis
ANGGAGGNAWLFGAGGSGGAGTN

SEQ ID NO: 1553068 - protein, 20 aa, Mycobacterium tuberculosis
APASTGLTGGTGFAGGAGGV

SEQ ID NO: 1553069 - protein, 18 aa, Mycobacterium tuberculosis
APISGCRGFSTSLLAKRN

SEQ ID NO: 1553070 - protein, 19 aa, Mycobacterium tuberculosis
AQRWKAIRGEAGWMTTYAY

SEQ ID NO: 1553071 - protein, 18 aa, Mycobacterium tuberculosis
ARSTLRHSHHLGGIAQTG

SEQ ID NO: 1553072 - protein, 17 aa, Mycobacterium tuberculosis
ATVCLVASCANADPLGS

SEQ ID NO: 1553073 - protein, 17 aa, Mycobacterium tuberculosis
DEVWPAVVFTLVTLLDD

SEQ ID NO: 1553074 - protein, 18 aa, Mycobacterium tuberculosis
DGGNAGFGAGVPGDGGDG

SEQ ID NO: 1553075 - protein, 21 aa, Mycobacterium tuberculosis
DGQNGGLLFGNGGNGFTQTTA

SEQ ID NO: 1553076 - protein, 23 aa, Mycobacterium tuberculosis
DGTRIPVSIVHRADIEFPAPALI

SEQ ID NO: 1553077 - protein, 23 aa, Mycobacterium tuberculosis
DPGIPARGIVAVCDFGGSGTGIT

SEQ ID NO: 1553078 - protein, 18 aa, Mycobacterium tuberculosis
DRIDERLVVVGLDNTVTY

SEQ ID NO: 1553079 - protein, 24 aa, Mycobacterium tuberculosis
EDFWRSAGLPAYRWPDPNGTRFPN

SEQ ID NO: 1553080 - protein, 20 aa, Mycobacterium tuberculosis
EFRCARCGVPYTDALPEMPE

SEQ ID NO: 1553081 - protein, 20 aa, Mycobacterium tuberculosis
EPMCKRLVMSGGFYRAIQRD

SEQ ID NO: 1553082 - protein, 17 aa, Mycobacterium tuberculosis
ERTRYVLSITWSDVETP

SEQ ID NO: 1553083 - protein, 21 aa, Mycobacterium tuberculosis
EVSTAIAALFGAQGQAYQAAS

SEQ ID NO: 1553084 - protein, 17 aa, Mycobacterium tuberculosis
FGVPVPNLTAWRDATVG

SEQ ID NO: 1553085 - protein, 18 aa, Mycobacterium tuberculosis
FISLNGGQMVPVLLDTGS

SEQ ID NO: 1553086 - protein, 20 aa, Mycobacterium tuberculosis
FMPNFALEWLINAYHRRGAD

SEQ ID NO: 1553087 - protein, 21 aa, Mycobacterium tuberculosis
FNKPGTFPLRFQTEVRDGCPS

SEQ ID NO: 1553088 - protein, 21 aa, Mycobacterium tuberculosis
FVAATGRPLIGNGANGAPGTG

SEQ ID NO: 1553089 - protein, 17 aa, Mycobacterium tuberculosis
FVTAAAGDLTNLGSSIS

SEQ ID NO: 1553090 - protein, 18 aa, Mycobacterium tuberculosis
GAAGWLYGSGGAGGAGGA

SEQ ID NO: 1553091 - protein, 18 aa, Mycobacterium tuberculosis
GAGGAAFSINFTAGDGGA

SEQ ID NO: 1553092 - protein, 21 aa, Mycobacterium tuberculosis
GAGGSARLIGAGGHGGDGGAG

SEQ ID NO: 1553093 - protein, 19 aa, Mycobacterium tuberculosis
GDKGEPCWPDGVVGSLTHC

SEQ ID NO: 1553094 - protein, 23 aa, Mycobacterium tuberculosis
GGAAGPAGWLFGDGGAGGNGGAA

SEQ ID NO: 1553095 - protein, 23 aa, Mycobacterium tuberculosis
GGAGGASGWLMGNGGNGGNGGTG

SEQ ID NO: 1553096 - protein, 22 aa, Mycobacterium tuberculosis
GGAGGDGGWLFGDGGAGGTGGN

SEQ ID NO: 1553097 - protein, 22 aa, Mycobacterium tuberculosis
GGAGGNGAWLFGNGGAGGGGGK

SEQ ID NO: 1553098 - protein, 19 aa, Mycobacterium tuberculosis
GGGLPPVPASPGGNGGGGD

SEQ ID NO: 1553099 - protein, 22 aa, Mycobacterium tuberculosis
GGNGGAGGWLFGNGGAGGAGGL

SEQ ID NO: 1553100 - protein, 22 aa, Mycobacterium tuberculosis
GGNGGAGGWLYGNGGAGGAGGT

SEQ ID NO: 1553101 - protein, 17 aa, Mycobacterium tuberculosis
GHEWKFAITKNGRHSLT

SEQ ID NO: 1553102 - protein, 19 aa, Mycobacterium tuberculosis
GRCLMPASSAARCAARIVG

SEQ ID NO: 1553103 - protein, 26 aa, Mycobacterium tuberculosis
HGGAGGAGGRAWLWGTGGAGGAGGDG

SEQ ID NO: 1553104 - protein, 17 aa, Mycobacterium tuberculosis
IDRLPNGVFLDWQQFQE

SEQ ID NO: 1553105 - protein, 19 aa, Mycobacterium tuberculosis
IERYRAATLMARVRAAKGM

SEQ ID NO: 1553106 - protein, 24 aa, Mycobacterium tuberculosis
IGTLKRAWIPLLILVVVAIAGFTV

SEQ ID NO: 1553107 - protein, 27 aa, Mycobacterium tuberculosis
IVGDEFCLLDGLLAWYAMIGSINNINS

SEQ ID NO: 1553108 - protein, 19 aa, Mycobacterium tuberculosis
KGCPKETWCVVNAGNYRGS

SEQ ID NO: 1553109 - protein, 20 aa, Mycobacterium tuberculosis
KGDKGEPCWPDGMVGSLTHC

SEQ ID NO: 1553110 - protein, 19 aa, Mycobacterium tuberculosis
KYLPLAPFRISYAYTNFGV

SEQ ID NO: 1553111 - protein, 19 aa, Mycobacterium tuberculosis
LDAFLKWHHGVREFLQSAI

SEQ ID NO: 1553112 - protein, 23 aa, Mycobacterium tuberculosis
LDSRAWRLPWPDGTVVYELDQPK

SEQ ID NO: 1553113 - protein, 17 aa, Mycobacterium tuberculosis
LIGNGADGLPGQNGGAG

SEQ ID NO: 1553114 - protein, 17 aa, Mycobacterium tuberculosis
LKELRRAAPYLVGALKL

SEQ ID NO: 1553115 - protein, 18 aa, Mycobacterium tuberculosis
LLLEVSWEAIEHAGVDPA

SEQ ID NO: 1553116 - protein, 20 aa, Mycobacterium tuberculosis
LRARGLKIFPLVGWAERGGY

SEQ ID NO: 1553117 - protein, 17 aa, Mycobacterium tuberculosis
LRPRYLCMLAEILRFHR

SEQ ID NO: 1553118 - protein, 17 aa, Mycobacterium tuberculosis
LSQDRFADFPALPLDPS

SEQ ID NO: 1553119 - protein, 17 aa, Mycobacterium tuberculosis
LVPEYIGNLLLYFQPDA

SEQ ID NO: 1553120 - protein, 19 aa, Mycobacterium tuberculosis
NGATGGWLYGNGGAGGQGA

SEQ ID NO: 1553121 - protein, 20 aa, Mycobacterium tuberculosis
NGGPGGWLIGNGGAGGSGAP

SEQ ID NO: 1553122 - protein, 23 aa, Mycobacterium tuberculosis
NGPFQALFGRPLIGDGANGAPGQ

SEQ ID NO: 1553123 - protein, 19 aa, Mycobacterium tuberculosis
NPDYLPGALLPPSIHATAD

SEQ ID NO: 1553124 - protein, 18 aa, Mycobacterium tuberculosis
NPNPPAIGFFISNLSITG

SEQ ID NO: 1553125 - protein, 19 aa, Mycobacterium tuberculosis
PAPRCWPSRCPIPRCVSRD

SEQ ID NO: 1553126 - protein, 19 aa, Mycobacterium tuberculosis
PEYIGNLLLYFQPDATVTM

SEQ ID NO: 1553127 - protein, 17 aa, Mycobacterium tuberculosis
PISGCRGFSTSLLAKRN

SEQ ID NO: 1553128 - protein, 19 aa, Mycobacterium tuberculosis
PKAGPLIAVKLHILTRKTL

SEQ ID NO: 1553129 - protein, 18 aa, Mycobacterium tuberculosis
PLKELRRAAPYLVGALKL

SEQ ID NO: 1553130 - protein, 25 aa, Mycobacterium tuberculosis
QAGGPGGPAGLWGNGGPGGAGGSGG

SEQ ID NO: 1553131 - protein, 22 aa, Mycobacterium tuberculosis
QLGARAALFHEQFVQALTGAAS

SEQ ID NO: 1553132 - protein, 23 aa, Mycobacterium tuberculosis
QSARTETWINLQVGDCLADLPPA

SEQ ID NO: 1553133 - protein, 24 aa, Mycobacterium tuberculosis
QWWGQPAWSWAVLGLRGRRPVKWN

SEQ ID NO: 1553134 - protein, 18 aa, Mycobacterium tuberculosis
RENLSWSAPRLHLVDLQY

SEQ ID NO: 1553135 - protein, 17 aa, Mycobacterium tuberculosis
RLFSLLHEFVHVVLHTE

SEQ ID NO: 1553136 - protein, 20 aa, Mycobacterium tuberculosis
RLGSDMGEFYMPYPGTRINQ

SEQ ID NO: 1553137 - protein, 19 aa, Mycobacterium tuberculosis
RLYWMSAWIDPDGTDGGPV

SEQ ID NO: 1553138 - protein, 18 aa, Mycobacterium tuberculosis
RPALGLSIGVTNLAAVAA

SEQ ID NO: 1553139 - protein, 20 aa, Mycobacterium tuberculosis
RPRGWPEWAEPDVVDAFADR

SEQ ID NO: 1553140 - protein, 19 aa, Mycobacterium tuberculosis
RRADAIAGTGGDGGNGGNG

SEQ ID NO: 1553141 - protein, 19 aa, Mycobacterium tuberculosis
RSAFVQLVLSNVFGQNAPA

SEQ ID NO: 1553142 - protein, 18 aa, Mycobacterium tuberculosis
SAAIAALFGTHAQEYQAL

SEQ ID NO: 1553143 - protein, 20 aa, Mycobacterium tuberculosis
SAAIASLFSGYARDYQALSA

SEQ ID NO: 1553144 - protein, 19 aa, Mycobacterium tuberculosis
SAALASLFSGHAVSYQQVA

SEQ ID NO: 1553145 - protein, 25 aa, Mycobacterium tuberculosis
SGGIRGPIGLGFRVPCLVISPYSRG

SEQ ID NO: 1553146 - protein, 18 aa, Mycobacterium tuberculosis
SGLFGVLTNVVWTNHGPC

SEQ ID NO: 1553147 - protein, 19 aa, Mycobacterium tuberculosis
SKPCAWLAEGLVRYLPARA

SEQ ID NO: 1553148 - protein, 26 aa, Mycobacterium tuberculosis
SPTQVRWRPFEFWPANTAVNIDAAGT

SEQ ID NO: 1553149 - protein, 19 aa, Mycobacterium tuberculosis
SVPLVCLLAGLLLAATHGV

SEQ ID NO: 1553150 - protein, 20 aa, Mycobacterium tuberculosis
TMVIPPIVFLPSMTIGGQTY

SEQ ID NO: 1553151 - protein, 17 aa, Mycobacterium tuberculosis
TPNRLYWMSAWIDPDGT

SEQ ID NO: 1553152 - protein, 20 aa, Mycobacterium tuberculosis
WAVLGLRGRRPVKWNDPITL

SEQ ID NO: 1553153 - protein, 25 aa, Mycobacterium tuberculosis
AAADEVSAHIAALFSGHGEGYQAIA

SEQ ID NO: 1553154 - protein, 17 aa, Mycobacterium tuberculosis
AAIAALFGTHAQEYQAL

SEQ ID NO: 1553155 - protein, 17 aa, Mycobacterium tuberculosis
AAIAALFSAHGRAYQVA

SEQ ID NO: 1553156 - protein, 18 aa, Mycobacterium tuberculosis
AAIASLFSGYARDYQALS

SEQ ID NO: 1553157 - protein, 18 aa, Mycobacterium tuberculosis
AALRAGQLVAAWTTTADP

SEQ ID NO: 1553158 - protein, 23 aa, Mycobacterium tuberculosis
AAQPIWWVVRAIEFSKDFETFVQ

SEQ ID NO: 1553159 - protein, 20 aa, Mycobacterium tuberculosis
AGDRGGAGGTGFISSDGGAG

SEQ ID NO: 1553160 - protein, 25 aa, Mycobacterium tuberculosis
AGGNGGRGAVLFGHGGNAGHGGAGG

SEQ ID NO: 1553161 - protein, 18 aa, Mycobacterium tuberculosis
AGKMTNWAIARPPGQTQA

SEQ ID NO: 1553162 - protein, 17 aa, Mycobacterium tuberculosis
AGLLKWQDGAVRDAAVA

SEQ ID NO: 1553163 - protein, 17 aa, Mycobacterium tuberculosis
ALRCLKRRLARTVFQAL

SEQ ID NO: 1553164 - protein, 24 aa, Mycobacterium tuberculosis
APTQALWGRPLIGNGADGTAANPN

SEQ ID NO: 1553165 - protein, 17 aa, Mycobacterium tuberculosis
AQLCERAELAAHWLSHG

SEQ ID NO: 1553166 - protein, 18 aa, Mycobacterium tuberculosis
AQLCERAELAAHWLSHGR

SEQ ID NO: 1553167 - protein, 18 aa, Mycobacterium tuberculosis
AQMARFHQQFVQALTASV

SEQ ID NO: 1553168 - protein, 17 aa, Mycobacterium tuberculosis
ARSGTGAARARVSALSA

SEQ ID NO: 1553169 - protein, 24 aa, Mycobacterium tuberculosis
ARSPRLRSPLALMVATRGARSPRL

SEQ ID NO: 1553170 - protein, 26 aa, Mycobacterium tuberculosis
ASAEAAAAEQIVLGVINAPTQALLGR

SEQ ID NO: 1553171 - protein, 24 aa, Mycobacterium tuberculosis
ASAQAAAFYAQFVQALSAGGGAYA

SEQ ID NO: 1553172 - protein, 25 aa, Mycobacterium tuberculosis
ASAQAAAFYAQFVQALSAGGGAYAA

SEQ ID NO: 1553173 - protein, 19 aa, Mycobacterium tuberculosis
AVKRMWLLLAIVVVAVVGG

SEQ ID NO: 1553174 - protein, 17 aa, Mycobacterium tuberculosis
AVVASLFARHAQAYQAL

SEQ ID NO: 1553175 - protein, 25 aa, Mycobacterium tuberculosis
CSTVAAFAAIAARPASPGGAAVGGA

SEQ ID NO: 1553176 - protein, 22 aa, Mycobacterium tuberculosis
DAGPPQRWFVVWLGTANNPVDK

SEQ ID NO: 1553177 - protein, 18 aa, Mycobacterium tuberculosis
DAVIAVHLRGHFLLTRNA

SEQ ID NO: 1553178 - protein, 24 aa, Mycobacterium tuberculosis
DEVSAALASLFSGHAVSYQQVAAQ

SEQ ID NO: 1553179 - protein, 17 aa, Mycobacterium tuberculosis
DGDWGPWYQTEYETEPR

SEQ ID NO: 1553180 - protein, 17 aa, Mycobacterium tuberculosis
DGGNAGFGAGVPGDGGD

SEQ ID NO: 1553181 - protein, 19 aa, Mycobacterium tuberculosis
DRWSRGRVALVGDAGYCCS

SEQ ID NO: 1553182 - protein, 17 aa, Mycobacterium tuberculosis
DVHIGPSDHVGWLDDRK

SEQ ID NO: 1553183 - protein, 21 aa, Mycobacterium tuberculosis
EHFNWLEGLGFQFERSYFPGK

SEQ ID NO: 1553184 - protein, 17 aa, Mycobacterium tuberculosis
ELLRPGLLVLPVRGPAR

SEQ ID NO: 1553185 - protein, 21 aa, Mycobacterium tuberculosis
EVSAAVAALFSAHAGQYQQLG

SEQ ID NO: 1553186 - protein, 24 aa, Mycobacterium tuberculosis
EVSLAISALFGQHAQAYQALSAQA

SEQ ID NO: 1553187 - protein, 21 aa, Mycobacterium tuberculosis
EVSTAIAALFGAHGQAYQALS

SEQ ID NO: 1553188 - protein, 17 aa, Mycobacterium tuberculosis
FKPGFPMAEWASKRRAQ

SEQ ID NO: 1553189 - protein, 17 aa, Mycobacterium tuberculosis
FSRWLSAKPDYLVTTEQ

SEQ ID NO: 1553190 - protein, 25 aa, Mycobacterium tuberculosis
GADEVSAAIAALFGAHGQAYQTVSA

SEQ ID NO: 1553191 - protein, 28 aa, Mycobacterium tuberculosis
GADEVSARIAALFGGFGLEYQAISAQVA

SEQ ID NO: 1553192 - protein, 22 aa, Mycobacterium tuberculosis
GADGGAGGWLFGNGANGTPGTG

SEQ ID NO: 1553193 - protein, 22 aa, Mycobacterium tuberculosis
GAGGASGWLMGNGGNGGNGGTG

SEQ ID NO: 1553194 - protein, 17 aa, Mycobacterium tuberculosis
GDAGMFFGSGGSGGAGG

SEQ ID NO: 1553195 - protein, 20 aa, Mycobacterium tuberculosis
GDGTCYWKRMGNPDGALIDN

SEQ ID NO: 1553196 - protein, 21 aa, Mycobacterium tuberculosis
GGKGGTGLMPGINGTGGAGGS

SEQ ID NO: 1553197 - protein, 25 aa, Mycobacterium tuberculosis
GGLMPGFGGAPWVGGHWGLGGEGHS

SEQ ID NO: 1553198 - protein, 17 aa, Mycobacterium tuberculosis
GGMATGFIGVVLVTAGK

SEQ ID NO: 1553199 - protein, 21 aa, Mycobacterium tuberculosis
GGNARLWGVGGAGGAGGDGGA

SEQ ID NO: 1553200 - protein, 22 aa, Mycobacterium tuberculosis
GGNGATGPWLFGDGGAGGGGGA

SEQ ID NO: 1553201 - protein, 24 aa, Mycobacterium tuberculosis
GGNGGRGAVLFGHGGNAGHGGAGG

SEQ ID NO: 1553202 - protein, 18 aa, Mycobacterium tuberculosis
GGNGGWLWGNGGNGGVGG

SEQ ID NO: 1553203 - protein, 24 aa, Mycobacterium tuberculosis
GGRCLMPASSAARCAARIVGGPRL

SEQ ID NO: 1553204 - protein, 19 aa, Mycobacterium tuberculosis
GLTCFEIFLAIAEAGSLGG

SEQ ID NO: 1553205 - protein, 22 aa, Mycobacterium tuberculosis
GNGATGPWLFGDGGPTPGSTGA

SEQ ID NO: 1553206 - protein, 17 aa, Mycobacterium tuberculosis
GNGGWLFGNGGAGGSGG

SEQ ID NO: 1553207 - protein, 18 aa, Mycobacterium tuberculosis
GPYHLKRLLGRGGMGEVY

SEQ ID NO: 1553208 - protein, 17 aa, Mycobacterium tuberculosis
GQQCDRLAAVLMPDTAT

SEQ ID NO: 1553209 - protein, 22 aa, Mycobacterium tuberculosis
GRALRWPRFPLVIEAAVAAVDH

SEQ ID NO: 1553210 - protein, 18 aa, Mycobacterium tuberculosis
GSAAKLFGDGGAGGAGGM

SEQ ID NO: 1553211 - protein, 24 aa, Mycobacterium tuberculosis
GSGADNPTGAGFAGGAGGTGGAAG

SEQ ID NO: 1553212 - protein, 23 aa, Mycobacterium tuberculosis
GTAFLAARGGYFVADLSSGHTGR

SEQ ID NO: 1553213 - protein, 25 aa, Mycobacterium tuberculosis
GTGADGGAGGWLFGNGGNGGSGATG

SEQ ID NO: 1553214 - protein, 17 aa, Mycobacterium tuberculosis
GVMWKRFSETGAIKAKS

SEQ ID NO: 1553215 - protein, 17 aa, Mycobacterium tuberculosis
HEPGWVVAPGMQGMQVQ

SEQ ID NO: 1553216 - protein, 19 aa, Mycobacterium tuberculosis
HFVRLPAMLFGVGRYTVTM

SEQ ID NO: 1553217 - protein, 19 aa, Mycobacterium tuberculosis
IDLLLKRAASLGIQIRYET

SEQ ID NO: 1553218 - protein, 20 aa, Mycobacterium tuberculosis
IGGKGGDAFATFAKAGNGGA

SEQ ID NO: 1553219 - protein, 26 aa, Mycobacterium tuberculosis
IVGDEFCLLDGLLAWYATIGSINNIN

SEQ ID NO: 1553220 - protein, 17 aa, Mycobacterium tuberculosis
IWCFPKFDVPLPTAVRW

SEQ ID NO: 1553221 - protein, 17 aa, Mycobacterium tuberculosis
KLTPGFHGLHIHQVGKC

SEQ ID NO: 1553222 - protein, 18 aa, Mycobacterium tuberculosis
KPQLAFLPRQAFLDTNII

SEQ ID NO: 1553223 - protein, 20 aa, Mycobacterium tuberculosis
KPSRVPVWFMRQAGRSLPEY

SEQ ID NO: 1553224 - protein, 20 aa, Mycobacterium tuberculosis
KSTWRSVPLVGHIPSAPGNP

SEQ ID NO: 1553225 - protein, 20 aa, Mycobacterium tuberculosis
LAVLACPLAGPAGPAAPGGP

SEQ ID NO: 1553226 - protein, 19 aa, Mycobacterium tuberculosis
LEFLSCFLGLMLHGAVPVP

SEQ ID NO: 1553227 - protein, 23 aa, Mycobacterium tuberculosis
LEHPKMPLVPLIDGWETVVEMEA

SEQ ID NO: 1553228 - protein, 19 aa, Mycobacterium tuberculosis
LKIVSCYQYGKGSTADWLG

SEQ ID NO: 1553229 - protein, 17 aa, Mycobacterium tuberculosis
LLGRPLIGDGAVGTASS

SEQ ID NO: 1553230 - protein, 20 aa, Mycobacterium tuberculosis
LMPASSAARCAARIVGGRCL

SEQ ID NO: 1553231 - protein, 17 aa, Mycobacterium tuberculosis
LNSAFSFGGPKCLVKVI

SEQ ID NO: 1553232 - protein, 17 aa, Mycobacterium tuberculosis
LTGWQWLGPSSVRMGAA

SEQ ID NO: 1553233 - protein, 22 aa, Mycobacterium tuberculosis
LVPEYIGNLLLYFQPDATVTML

SEQ ID NO: 1553234 - protein, 17 aa, Mycobacterium tuberculosis
LWLGRPLIGDGVHGAPG

SEQ ID NO: 1553235 - protein, 24 aa, Mycobacterium tuberculosis
NFSNGVLWRGDYEGLWGLSGGSTI

SEQ ID NO: 1553236 - protein, 35 aa, Mycobacterium tuberculosis
NGGDGGCRRVWRRYRRQRWCRRQRRADRQRRQRRQ

SEQ ID NO: 1553237 - protein, 19 aa, Mycobacterium tuberculosis
NGGDGGWLIGNGGAGGSGA

SEQ ID NO: 1553238 - protein, 17 aa, Mycobacterium tuberculosis
NTGRPLIGNGANGAPGT

SEQ ID NO: 1553239 - protein, 18 aa, Mycobacterium tuberculosis
PARPAARFVRPAIPSALS

SEQ ID NO: 1553240 - protein, 23 aa, Mycobacterium tuberculosis
PFTIPEIHIPKIPIDVLGSVGLG

SEQ ID NO: 1553241 - protein, 20 aa, Mycobacterium tuberculosis
PGATGGTGFAGGAGGAGGAG

SEQ ID NO: 1553242 - protein, 21 aa, Mycobacterium tuberculosis
PPEHLQWIGQWGIFDALRAGR

SEQ ID NO: 1553243 - protein, 21 aa, Mycobacterium tuberculosis
PPEHLQWIGQWGIFDALRPGR

SEQ ID NO: 1553244 - protein, 17 aa, Mycobacterium tuberculosis
PPMFRWMAPDPSAPMPG

SEQ ID NO: 1553245 - protein, 18 aa, Mycobacterium tuberculosis
PRGWPEWAEPDVVDAFAD

SEQ ID NO: 1553246 - protein, 19 aa, Mycobacterium tuberculosis
PTPRPASVITIARPGTSLS

SEQ ID NO: 1553247 - protein, 20 aa, Mycobacterium tuberculosis
QAAAVPVVFLTAWYGLADLA

SEQ ID NO: 1553248 - protein, 22 aa, Mycobacterium tuberculosis
QAGALPALFSGLARRPRRRQID

SEQ ID NO: 1553249 - protein, 18 aa, Mycobacterium tuberculosis
QAGGKGWDGGPIGNGQVG

SEQ ID NO: 1553250 - protein, 18 aa, Mycobacterium tuberculosis
QALFGRPLIGDGANGAPG

SEQ ID NO: 1553251 - protein, 22 aa, Mycobacterium tuberculosis
QALLGRPLIGDGANATTPGGAG

SEQ ID NO: 1553252 - protein, 23 aa, Mycobacterium tuberculosis
QFVKRLGTHAAIFTVPNFLELDY

SEQ ID NO: 1553253 - protein, 18 aa, Mycobacterium tuberculosis
QLLLLPLTSLRGLRHTLK

SEQ ID NO: 1553254 - protein, 19 aa, Mycobacterium tuberculosis
QLWLGRPLIGDGVHGAPGT

SEQ ID NO: 1553255 - protein, 21 aa, Mycobacterium tuberculosis
RALGRYGVCANVICPRARTAM

SEQ ID NO: 1553256 - protein, 23 aa, Mycobacterium tuberculosis
RAYFRGECLRRFGADIAAASWDS

SEQ ID NO: 1553257 - protein, 20 aa, Mycobacterium tuberculosis
REVQDVWIWVRPYFDDRATA

SEQ ID NO: 1553258 - protein, 22 aa, Mycobacterium tuberculosis
RLFPRGLAAFIELRDQRCRTPY

SEQ ID NO: 1553259 - protein, 18 aa, Mycobacterium tuberculosis
RLGWPLRPPPAVVRQFDA

SEQ ID NO: 1553260 - protein, 26 aa, Mycobacterium tuberculosis
RNPERVWGWYLWRHYLVANVEPNDGH

SEQ ID NO: 1553261 - protein, 21 aa, Mycobacterium tuberculosis
RRVGVPDARCVLPLAHRVTQA

SEQ ID NO: 1553262 - protein, 20 aa, Mycobacterium tuberculosis
RTADFAVRAVAALAAADATD

SEQ ID NO: 1553263 - protein, 17 aa, Mycobacterium tuberculosis
SAMSGWWNQAHSAAAGA

SEQ ID NO: 1553264 - protein, 17 aa, Mycobacterium tuberculosis
SGAGTGLAGVAAVAAFT

SEQ ID NO: 1553265 - protein, 20 aa, Mycobacterium tuberculosis
SGTGAARARVSALSAAAARA

SEQ ID NO: 1553266 - protein, 20 aa, Mycobacterium tuberculosis
SIAVAALFGMHGQAYQALSV

SEQ ID NO: 1553267 - protein, 37 aa, Mycobacterium tuberculosis; identical to SEQ ID NO: 1502307

SEQ ID NO: 1553268 - protein, 19 aa, Mycobacterium tuberculosis
SRLGWPLRPPPAVVRQFDA

SEQ ID NO: 1553269 - protein, 18 aa, Mycobacterium tuberculosis
STAIAALFGAHGQAYQAL

SEQ ID NO: 1553270 - protein, 17 aa, Mycobacterium tuberculosis
TAVAALFGAHGQAYQAL

SEQ ID NO: 1553271 - protein, 17 aa, Mycobacterium tuberculosis
TCVMWTLALTRPPDVRE

SEQ ID NO: 1553272 - protein, 20 aa, Mycobacterium tuberculosis
TILGRFSASFGETFASGPYF

SEQ ID NO: 1553273 - protein, 24 aa, Mycobacterium tuberculosis
TPFVPARPVPPCPPAPPDPNQLAL

SEQ ID NO: 1553274 - protein, 25 aa, Mycobacterium tuberculosis
TPIAAGPRRARSGAGTGLAGVAAVA

SEQ ID NO: 1553275 - protein, 24 aa, Mycobacterium tuberculosis
TQALLGRPLIGDGANATTPGGAGG

SEQ ID NO: 1553276 - protein, 22 aa, Mycobacterium tuberculosis
TQALWGRPLIGNGADGTAANPN

SEQ ID NO: 1553277 - protein, 18 aa, Mycobacterium tuberculosis
TTSGYRAGLLASIAASCT

SEQ ID NO: 1553278 - protein, 18 aa, Mycobacterium tuberculosis
VCANVICPRARTAMTADV

SEQ ID NO: 1553279 - protein, 21 aa, Mycobacterium tuberculosis
VPGRSVSRWGAFLDDVGGFDC

SEQ ID NO: 1553280 - protein, 20 aa, Mycobacterium tuberculosis
VSAAIAALFGAHARAYQALS

SEQ ID NO: 1553281 - protein, 20 aa, Mycobacterium tuberculosis
VSAAVAALFSAHAGQYQQLG

SEQ ID NO: 1553282 - protein, 19 aa, Mycobacterium tuberculosis
VSAHIAALFSGHGEGYQAI

SEQ ID NO: 1553283 - protein, 24 aa, Mycobacterium tuberculosis
VSPLLDPINEFFLANTGRPLIGNG

SEQ ID NO: 1553284 - protein, 17 aa, Mycobacterium tuberculosis
WIGQWGIFDALRAGREV

SEQ ID NO: 1553285 - protein, 17 aa, Mycobacterium tuberculosis
WIGQWGIFDALRPGREV

SEQ ID NO: 1553286 - protein, 17 aa, Mycobacterium tuberculosis
WPAKLRLLDGFRQRENL

SEQ ID NO: 1553287 - protein, 17 aa, Mycobacterium tuberculosis
WVVMSFVVAVPEALAAA

SEQ ID NO: 1553288 - protein, 18 aa, Mycobacterium tuberculosis
WWWQRPRTNAVAADSLVG

SEQ ID NO: 1553289 - protein, 18 aa, Mycobacterium tuberculosis
AAACRAAAGPRGHGGQTG

SEQ ID NO: 1553290 - protein, 20 aa, Mycobacterium tuberculosis
AAEADCALSAVSAGPAVAVE

SEQ ID NO: 1553291 - protein, 21 aa, Mycobacterium tuberculosis
AAFAPGVCKVGGRTLRGAGHA

SEQ ID NO: 1553292 - protein, 36 aa, Mycobacterium tuberculosis; identical to SEQ ID NO: 235025

SEQ ID NO: 1553293 - protein, 36 aa, Mycobacterium tuberculosis
AAGADEVSARIAALFGGLGLEYQAISAQVAAYHQRF

SEQ ID NO: 1553294 - protein, 17 aa, Mycobacterium tuberculosis
AAGGFGGNGGWLYGNWG

SEQ ID NO: 1553295 - protein, 17 aa, Mycobacterium tuberculosis
AAGGLGGNGGWLYGNGG

SEQ ID NO: 1553296 - protein, 18 aa, Mycobacterium tuberculosis
AAGRAAPRLTVWVPVAVN

SEQ ID NO: 1553297 - protein, 17 aa, Mycobacterium tuberculosis
AAIAALFGAHARAYQAL

SEQ ID NO: 1553298 - protein, 17 aa, Mycobacterium tuberculosis
AAIAALFSSYARDYQTL

SEQ ID NO: 1553299 - protein, 18 aa, Mycobacterium tuberculosis
AAIAGLFGAHARQYQALS

SEQ ID NO: 1553300 - protein, 17 aa, Mycobacterium tuberculosis
AALKIPAGVPFYEESTF

SEQ ID NO: 1553301 - protein, 17 aa, Mycobacterium tuberculosis
AALRAGQLVAAWTTTAD

SEQ ID NO: 1553302 - protein, 21 aa, Mycobacterium tuberculosis
AAQPIWWVVRAIEFSKDFETF

SEQ ID NO: 1553303 - protein, 26 aa, Mycobacterium tuberculosis
AARVLAIWPDWVRRWPTPSATATAST

SEQ ID NO: 1553304 - protein, 19 aa, Mycobacterium tuberculosis
AAVAACWPATAAPAVPVAT

SEQ ID NO: 1553305 - protein, 17 aa, Mycobacterium tuberculosis
AAVAALFSAHAGQYQQL

SEQ ID NO: 1553306 - protein, 17 aa, Mycobacterium tuberculosis
AAVGVEGKVIWSGVRGI

SEQ ID NO: 1553307 - protein, 17 aa, Mycobacterium tuberculosis
AAVRRVVSVGADGGNGG

SEQ ID NO: 1553308 - protein, 18 aa, Mycobacterium tuberculosis
ACVVLRVARFFVEGDDMP

SEQ ID NO: 1553309 - protein, 19 aa, Mycobacterium tuberculosis
ACVVLRVARFFVEGDDMPD

SEQ ID NO: 1553310 - protein, 24 aa, Mycobacterium tuberculosis
ADEVSAAIAALFGAHGQAYQTVSA

SEQ ID NO: 1553311 - protein, 25 aa, Mycobacterium tuberculosis
ADEVSAAIATLFGSHAREYQAISTQ

SEQ ID NO: 1553312 - protein, 24 aa, Mycobacterium tuberculosis
ADEVSARIAALFGGFGLEYQAISA

SEQ ID NO: 1553313 - protein, 25 aa, Mycobacterium tuberculosis
ADEVSARIAALFGGFGLEYQAISAQ

SEQ ID NO: 1553314 - protein, 26 aa, Mycobacterium tuberculosis
ADEVSARIAALFGGFGLEYQAISAQV

SEQ ID NO: 1553315 - protein, 20 aa, Mycobacterium tuberculosis
ADNPTGAGFAGGAGGTGGAA

SEQ ID NO: 1553316 - protein, 24 aa, Mycobacterium tuberculosis
AEAAAAEQIVLGVINAPTQALLGR

SEQ ID NO: 1553317 - protein, 17 aa, Mycobacterium tuberculosis
AEDIIVWSSTEFGYVTL

SEQ ID NO: 1553318 - protein, 21 aa, Mycobacterium tuberculosis
AFATDCARIARVRPCGAVGAV

SEQ ID NO: 1553319 - protein, 21 aa, Mycobacterium tuberculosis
AGCYSAKMGCPGRERPNPGQP

SEQ ID NO: 1553320 - protein, 18 aa, Mycobacterium tuberculosis
AGFYASICNAVWDGNVSL

SEQ ID NO: 1553321 - protein, 18 aa, Mycobacterium tuberculosis
AGGAGGDAGMFFGSGGSG

SEQ ID NO: 1553322 - protein, 19 aa, Mycobacterium tuberculosis
AGGGWWPAVRQWRRRRQRR

SEQ ID NO: 1553323 - protein, 17 aa, Mycobacterium tuberculosis
AGGLLFGYGGAGGAGGY

SEQ ID NO: 1553324 - protein, 23 aa, Mycobacterium tuberculosis
AGGNARLWGVGGAGGAGGDGGAG

SEQ ID NO: 1553325 - protein, 19 aa, Mycobacterium tuberculosis
AGGNGGWLFGNGGAGGSGG

SEQ ID NO: 1553326 - protein, 20 aa, Mycobacterium tuberculosis
AGGSGGWLLGNGGVGGAGGQ

SEQ ID NO: 1553327 - protein, 20 aa, Mycobacterium tuberculosis
AGGTGGWLFGNGGAGGTGGA

SEQ ID NO: 1553328 - protein, 22 aa, Mycobacterium tuberculosis
AGLAANGAWLFGNGGAGGGGGK

SEQ ID NO: 1553329 - protein, 28 aa, Mycobacterium tuberculosis
AGLLFGAGGHRWIRRKPGLGWGTVGPVG

SEQ ID NO: 1553330 - protein, 17 aa, Mycobacterium tuberculosis
AGLPRLSWFAGLTWFAG

SEQ ID NO: 1553331 - protein, 18 aa, Mycobacterium tuberculosis
AGLPRLSWFAGLTWFAGG

SEQ ID NO: 1553332 - protein, 31 aa, Mycobacterium tuberculosis
AGLSLRQDFAFRFHWLLRVGFADCVDSRQSA

SEQ ID NO: 1553333 - protein, 26 aa, Mycobacterium tuberculosis
AGPGGFRRGRSALAFGSGGVGGAGGL

SEQ ID NO: 1553334 - protein, 21 aa, Mycobacterium tuberculosis
AGPPQRWFVVWLGTANNPVDK

SEQ ID NO: 1553335 - protein, 23 aa, Mycobacterium tuberculosis
AGTGGRGGLLAGQHANSGNGGGG

SEQ ID NO: 1553336 - protein, 17 aa, Mycobacterium tuberculosis
AGVCALAAVTGINTAVA

SEQ ID NO: 1553337 - protein, 17 aa, Mycobacterium tuberculosis
AIADIPAAAALAAVTAV

SEQ ID NO: 1553338 - protein, 17 aa, Mycobacterium tuberculosis
AIPEIALTFGVDIPIHI

SEQ ID NO: 1553339 - protein, 18 aa, Mycobacterium tuberculosis
AIRPEFSANVAIDSFTVP

SEQ ID NO: 1553340 - protein, 29 aa, Mycobacterium tuberculosis
AISAQVAAYHQRFVQALSTGAGAYASAEA

SEQ ID NO: 1553341 - protein, 17 aa, Mycobacterium tuberculosis
AKMLRLNAGLGNVGNYN

SEQ ID NO: 1553342 - protein, 23 aa, Mycobacterium tuberculosis
ALAAVPARAGRRSAVAADAAVAA

SEQ ID NO: 1553343 - protein, 19 aa, Mycobacterium tuberculosis
ALAGWGVAASGMWPSPANS

SEQ ID NO: 1553344 - protein, 17 aa, Mycobacterium tuberculosis
ALCAFTAVLTVLAVTGL

SEQ ID NO: 1553345 - protein, 18 aa, Mycobacterium tuberculosis
ALDITLPMPPRWTQVPDP

SEQ ID NO: 1553346 - protein, 24 aa, Mycobacterium tuberculosis
ALIRARFPTLTARQVMQRIESTAH

SEQ ID NO: 1553347 - protein, 17 aa, Mycobacterium tuberculosis
ALLFGFGGAGGAGGHGG

SEQ ID NO: 1553348 - protein, 18 aa, Mycobacterium tuberculosis
ALLGRPLIGDGAVGTASS

SEQ ID NO: 1553349 - protein, 18 aa, Mycobacterium tuberculosis
ALLGRPLIGNGADGAAGT

SEQ ID NO: 1553350 - protein, 28 aa, Mycobacterium tuberculosis
ALPRRPKFALLKGRRNYLCLNKIHNSVT

SEQ ID NO: 1553351 - protein, 23 aa, Mycobacterium tuberculosis
ALPTARRPWRFGRHDQRVAHRAA

SEQ ID NO: 1553352 - protein, 18 aa, Mycobacterium tuberculosis
ALWGRPLIGNGADGTAAN

SEQ ID NO: 1553353 - protein, 25 aa, Mycobacterium tuberculosis
ALWTGDYHGLVGFSFSIDIAGSTLL

SEQ ID NO: 1553354 - protein, 23 aa, Mycobacterium tuberculosis
AMPPSSVVGLWTFDGREGRTEVP

SEQ ID NO: 1553355 - protein, 24 aa, Mycobacterium tuberculosis
ANAKRWGVLHVIWRQGYYPGIGAP

SEQ ID NO: 1553356 - protein, 21 aa, Mycobacterium tuberculosis
ANGGPGGWLIGNGGAGGSGAP

SEQ ID NO: 1553357 - protein, 19 aa, Mycobacterium tuberculosis
ANGNFAFGDGNGGHGGNGG

SEQ ID NO: 1553358 - protein, 24 aa, Mycobacterium tuberculosis
APALECLDCPGCQPRGPDGLAWCP

SEQ ID NO: 1553359 - protein, 19 aa, Mycobacterium tuberculosis
APASTGLTGGTGFAGGAGG

SEQ ID NO: 1553360 - protein, 20 aa, Mycobacterium tuberculosis
APASTGLTGGTGFAGGAGGA

SEQ ID NO: 1553361 - protein, 25 aa, Mycobacterium tuberculosis
APGGQWRFAPGLLLGCGVAMGGNGR

SEQ ID NO: 1553362 - protein, 21 aa, Mycobacterium tuberculosis
APRIPVVMGVRVGPVVLVGGC

SEQ ID NO: 1553363 - protein, 17 aa, Mycobacterium tuberculosis
APRLTVWVPVAVNPGAA

SEQ ID NO: 1553364 - protein, 24 aa, Mycobacterium tuberculosis
APTPPAPRRARVTARAAVVARRAA

SEQ ID NO: 1553365 - protein, 24 aa, Mycobacterium tuberculosis
APTQLWLGRPLIGDGVHGAPGTGQ

SEQ ID NO: 1553366 - protein, 17 aa, Mycobacterium tuberculosis
APVKIFLTASAETRARR

SEQ ID NO: 1553367 - protein, 17 aa, Mycobacterium tuberculosis
AQLAPWAQAVRALPNPT

SEQ ID NO: 1553368 - protein, 17 aa, Mycobacterium tuberculosis
AQMARFHQQFVQALTAS

SEQ ID NO: 1553369 - protein, 17 aa, Mycobacterium tuberculosis
AQRLWLGVCPVPGSRAA

SEQ ID NO: 1553370 - protein, 19 aa, Mycobacterium tuberculosis
AQTVARWLVLYLRRPGGQT

SEQ ID NO: 1553371 - protein, 25 aa, Mycobacterium tuberculosis
AQVAAYHQRFVQALSTGAGAYASAE

SEQ ID NO: 1553372 - protein, 17 aa, Mycobacterium tuberculosis
AQVALAWLISLPGVVAI

SEQ ID NO: 1553373 - protein, 25 aa, Mycobacterium tuberculosis
AQVVPWASLLQRFPGLGAGATGATG

SEQ ID NO: 1553374 - protein, 17 aa, Mycobacterium tuberculosis
ARADIRGPYVINADGAP

SEQ ID NO: 1553375 - protein, 24 aa, Mycobacterium tuberculosis
ARFAAALAPRGVWHAACRPGTVRR

SEQ ID NO: 1553376 - protein, 20 aa, Mycobacterium tuberculosis
ARLVGAMSVPPTWEGSVPAR

SEQ ID NO: 1553377 - protein, 17 aa, Mycobacterium tuberculosis
ARNSAGFGAPRYGVKPI

SEQ ID NO: 1553378 - protein, 19 aa, Mycobacterium tuberculosis
ARPSPFYIMDEVEAALDDV

SEQ ID NO: 1553379 - protein, 17 aa, Mycobacterium tuberculosis
ARRLCPRILLACLFVAE

SEQ ID NO: 1553380 - protein, 24 aa, Mycobacterium tuberculosis
ARRRDWRPRRLVMGQQRRRWHRRP

SEQ ID NO: 1553381 - protein, 18 aa, Mycobacterium tuberculosis
ARRRRWGCRVDRQRRQRW

SEQ ID NO: 1553382 - protein, 24 aa, Mycobacterium tuberculosis
ASAAEWLPRVIIPEATISALPPAS

SEQ ID NO: 1553383 - protein, 29 aa, Mycobacterium tuberculosis
ASAGSSVGCDGCYGGARRLRARTGTPAVR

SEQ ID NO: 1553384 - protein, 17 aa, Mycobacterium tuberculosis
ASDRGAGALGFVGTAGK

SEQ ID NO: 1553385 - protein, 24 aa, Mycobacterium tuberculosis
ASGGVGLLGWAWVVAGAVDLLTTG

SEQ ID NO: 1553386 - protein, 17 aa, Mycobacterium tuberculosis
ASLRCPWCVDAHTTMLY

SEQ ID NO: 1553387 - protein, 17 aa, Mycobacterium tuberculosis
ASLRLLVRGGRFLEMGK

SEQ ID NO: 1553388 - protein, 17 aa, Mycobacterium tuberculosis
ASSAARCAARIVGGRCL

SEQ ID NO: 1553389 - protein, 27 aa, Mycobacterium tuberculosis
ASSTWADSPRAWPIRAPSRLQVWRTRA

SEQ ID NO: 1553390 - protein, 22 aa, Mycobacterium tuberculosis
ASTEAAVERSLLGAVNAPTEAL

SEQ ID NO: 1553391 - protein, 17 aa, Mycobacterium tuberculosis
ATDGRFRFLRVYPNPEV

SEQ ID NO: 1553392 - protein, 21 aa, Mycobacterium tuberculosis
ATLVGRLSVPAAWSTAAPATT

SEQ ID NO: 1553393 - protein, 17 aa, Mycobacterium tuberculosis
ATMARWPRRRSMRFESS

SEQ ID NO: 1553394 - protein, 25 aa, Mycobacterium tuberculosis
ATPLRPGIWPAYADHRMAMAGAIIG

SEQ ID NO: 1553395 - protein, 18 aa, Mycobacterium tuberculosis
ATRPRWHPPVTIPPLPHH

SEQ ID NO: 1553396 - protein, 28 aa, Mycobacterium tuberculosis
AVKWALAARVGPAVLARTPALNGSAGAN

SEQ ID NO: 1553397 - protein, 17 aa, Mycobacterium tuberculosis
AVLAVAVVVAFLTTGCI

SEQ ID NO: 1553398 - protein, 21 aa, Mycobacterium tuberculosis
AVMPVCCWMFGIGGPRRPPGG

SEQ ID NO: 1553399 - protein, 22 aa, Mycobacterium tuberculosis
AVMVGFCTATAATAFSQTTAGV

SEQ ID NO: 1553400 - protein, 18 aa, Mycobacterium tuberculosis
AWLVWFGGGFIPLVPGAP

SEQ ID NO: 1553401 - protein, 19 aa, Mycobacterium tuberculosis
AWRTKRLIVFDVDSTLVQG

SEQ ID NO: 1553402 - protein, 18 aa, Mycobacterium tuberculosis
AYFRGECLRRFGADIAAA

SEQ ID NO: 1553403 - protein, 22 aa, Mycobacterium tuberculosis
AYFRGECLRRFGADIAAASWDS

SEQ ID NO: 1553404 - protein, 19 aa, Mycobacterium tuberculosis
CAPAAAGVPVVIPVVNDWP

SEQ ID NO: 1553405 - protein, 20 aa, Mycobacterium tuberculosis
CCAVCSGLVLAGALAPSKPN

SEQ ID NO: 1553406 - protein, 19 aa, Mycobacterium tuberculosis
CGQVVAGGAGISFSNGSNG

SEQ ID NO: 1553407 - protein, 17 aa, Mycobacterium tuberculosis
CGVSLALACDLVLASDN

SEQ ID NO: 1553408 - protein, 18 aa, Mycobacterium tuberculosis
CLALWLSGCSSPKPDAEE

SEQ ID NO: 1553409 - protein, 23 aa, Mycobacterium tuberculosis
CLPHRPCRTWPRRAYLASASRGI

SEQ ID NO: 1553410 - protein, 24 aa, Mycobacterium tuberculosis
CPPWSWRWSLRWIRRAAAHRCATA

SEQ ID NO: 1553411 - protein, 17 aa, Mycobacterium tuberculosis
CRAGPGGFRRGRSALAF

SEQ ID NO: 1553412 - protein, 18 aa, Mycobacterium tuberculosis
CRCLFKKKKKTNKKKKKK

SEQ ID NO: 1553413 - protein, 28 aa, Mycobacterium tuberculosis
CRGDYRLRHFGVRITRILALLLAVLLAV

SEQ ID NO: 1553414 - protein, 18 aa, Mycobacterium tuberculosis
CRGPNLGWRVVRGRRDRQ

SEQ ID NO: 1553415 - protein, 25 aa, Mycobacterium tuberculosis
CRQCAHPGIVGRPLIGDGANGGPGQ

SEQ ID NO: 1553416 - protein, 26 aa, Mycobacterium tuberculosis
CRRRQRRVRQYRRCQLRVGQCGSGGG

SEQ ID NO: 1553417 - protein, 17 aa, Mycobacterium tuberculosis
CRSLRQWREHRLRRRSP

SEQ ID NO: 1553418 - protein, 17 aa, Mycobacterium tuberculosis
CTDDLRVARIRGCGADE

SEQ ID NO: 1553419 - protein, 25 aa, Mycobacterium tuberculosis
CTGCRAADATTCWPSSPTRSAPRWV

SEQ ID NO: 1553420 - protein, 18 aa, Mycobacterium tuberculosis
CTGYERFERYLLGLDDGI

SEQ ID NO: 1553421 - protein, 23 aa, Mycobacterium tuberculosis
CTPTRRLGRTTARARAQRAESSS

SEQ ID NO: 1553422 - protein, 17 aa, Mycobacterium tuberculosis
CVDRMGFSFLANIGTAS

SEQ ID NO: 1553423 - protein, 19 aa, Mycobacterium tuberculosis
DAHGVPFLGIRGMSDGPGD

SEQ ID NO: 1553424 - protein, 17 aa, Mycobacterium tuberculosis
DAVRYSVRFAKPVLLPA

SEQ ID NO: 1553425 - protein, 21 aa, Mycobacterium tuberculosis
DEATGRWGLRVARVELRSIDP

SEQ ID NO: 1553426 - protein, 23 aa, Mycobacterium tuberculosis
DEFQCGPRMPMLPGAWDLGTWDR

SEQ ID NO: 1553427 - protein, 17 aa, Mycobacterium tuberculosis
DEGRWHVRWTTSGLHPK

SEQ ID NO: 1553428 - protein, 22 aa, Mycobacterium tuberculosis
DEVSAAIAALFGTHAQEYQALS

SEQ ID NO: 1553429 - protein, 27 aa, Mycobacterium tuberculosis
DEVSAAIASLFSGYARDYQALSAQMAR

SEQ ID NO: 1553430 - protein, 22 aa, Mycobacterium tuberculosis
DEVSTAIAALFGAQGQAYQAAS

SEQ ID NO: 1553431 - protein, 22 aa, Mycobacterium tuberculosis
DEVSVLIAALFEAYAQEYQALS

SEQ ID NO: 1553432 - protein, 20 aa, Mycobacterium tuberculosis
DFAAEAAFVFAMIAVDLSRL

SEQ ID NO: 1553433 - protein, 23 aa, Mycobacterium tuberculosis
DFWRSAGLPAYRWPDPNGTRFPN

SEQ ID NO: 1553434 - protein, 23 aa, Mycobacterium tuberculosis
DGGRAVLVLSDWPAPQAPQSASG

SEQ ID NO: 1553435 - protein, 27 aa, Mycobacterium tuberculosis
DGKKNKKIFFFFFFFFLKKKKKKKKKK

SEQ ID NO: 1553436 - protein, 17 aa, Mycobacterium tuberculosis
DGLPILCLGARGWQPGW

SEQ ID NO: 1553437 - protein, 17 aa, Mycobacterium tuberculosis
DGLPPRLWRNFLAKPPL

SEQ ID NO: 1553438 - protein, 19 aa, Mycobacterium tuberculosis
DGLTLGEALALWLSGQEQL

SEQ ID NO: 1553439 - protein, 17 aa, Mycobacterium tuberculosis
DGPDDWSANSVFGLPAL

SEQ ID NO: 1553440 - protein, 19 aa, Mycobacterium tuberculosis
DGQDGGLLFGNGGAGYNSA

SEQ ID NO: 1553441 - protein, 27 aa, Mycobacterium tuberculosis
DLIDYPAGAAFSWWPTMLLPPGSHQDN

SEQ ID NO: 1553442 - protein, 19 aa, Mycobacterium tuberculosis
DLTRGCGPAGAAITAGPAV

SEQ ID NO: 1553443 - protein, 22 aa, Mycobacterium tuberculosis
DMLEMLPTPWGLVRSGVAPDHP

SEQ ID NO: 1553444 - protein, 20 aa, Mycobacterium tuberculosis
DMPGRFVVAAAMVRHLLTDP

SEQ ID NO: 1553445 - protein, 20 aa, Mycobacterium tuberculosis
DNLRHTVRFAAAVQAALEDG

SEQ ID NO: 1553446 - protein, 17 aa, Mycobacterium tuberculosis
DPLGVLYWQVPKGSTLD

SEQ ID NO: 1553447 - protein, 17 aa, Mycobacterium tuberculosis
DPRRPVPALAIATGPDG

SEQ ID NO: 1553448 - protein, 23 aa, Mycobacterium tuberculosis
DPTGRHAFGASFLARIFPPGSHI

SEQ ID NO: 1553449 - protein, 24 aa, Mycobacterium tuberculosis
DPYQAFVLMAAWLAMRYGELTELR

SEQ ID NO: 1553450 - protein, 20 aa, Mycobacterium tuberculosis
DRGAGALGFVGTAGKESVGQ

SEQ ID NO: 1553451 - protein, 17 aa, Mycobacterium tuberculosis
DTDRVTLFRAWYSRRNF

SEQ ID NO: 1553452 - protein, 18 aa, Mycobacterium tuberculosis
DTGRCRVPLILRLDPKIG

SEQ ID NO: 1553453 - protein, 23 aa, Mycobacterium tuberculosis
DVISVTWKPVGRHAYRNVTLAEG

SEQ ID NO: 1553454 - protein, 20 aa, Mycobacterium tuberculosis
DYYWCPGQPFDPAWGPNWDP

SEQ ID NO: 1553455 - protein, 25 aa, Mycobacterium tuberculosis
EDFWRSAGLPAYRWPDPNGSRFPNG

SEQ ID NO: 1553456 - protein, 23 aa, Mycobacterium tuberculosis
EFHLCVVEAPTLHNAAEALHRQF

SEQ ID NO: 1553457 - protein, 18 aa, Mycobacterium tuberculosis
EFPIHWTSTGGIGPIIIP

SEQ ID NO: 1553458 - protein, 18 aa, Mycobacterium tuberculosis
EFVTAAAGDLTNLGSSIS

SEQ ID NO: 1553459 - protein, 19 aa, Mycobacterium tuberculosis
EFVTAAAGDLTNLGSSISA

SEQ ID NO: 1553460 - protein, 17 aa, Mycobacterium tuberculosis
ENLSWSAPRLHLVDLQY

SEQ ID NO: 1553461 - protein, 19 aa, Mycobacterium tuberculosis
EPMCKRLVMSGGFYRAIQR

SEQ ID NO: 1553462 - protein, 18 aa, Mycobacterium tuberculosis
EPNSRPALPPAPPAPPEL

SEQ ID NO: 1553463 - protein, 18 aa, Mycobacterium tuberculosis
EPPNRMRIGLMGIVVALL

SEQ ID NO: 1553464 - protein, 19 aa, Mycobacterium tuberculosis
EPPNRMRIGLMGIVVALLV

SEQ ID NO: 1553465 - protein, 19 aa, Mycobacterium tuberculosis
EPREFFTTNAFWSVPSDPT

SEQ ID NO: 1553466 - protein, 19 aa, Mycobacterium tuberculosis
EPRLWNMSTVLPILQDTTI

SEQ ID NO: 1553467 - protein, 28 aa, Mycobacterium tuberculosis
ERCGSPAWDLPTVFGPIAITYNIKGVST

SEQ ID NO: 1553468 - protein, 18 aa, Mycobacterium tuberculosis
ESGVRRLRCRPVHPQPSL

SEQ ID NO: 1553469 - protein, 18 aa, Mycobacterium tuberculosis
ETAAAPGLFLRFSAAPGG

SEQ ID NO: 1553470 - protein, 22 aa, Mycobacterium tuberculosis
ETTAPVWITMLWPLADRPPVGP

SEQ ID NO: 1553471 - protein, 21 aa, Mycobacterium tuberculosis
EVSAAIAALFGAHGQAYQTVS

SEQ ID NO: 1553472 - protein, 21 aa, Mycobacterium tuberculosis
EVSAAIAALFSAHGRAYQVAS

SEQ ID NO: 1553473 - protein, 22 aa, Mycobacterium tuberculosis
EVSAALASLFSGHAVSYQQVAA

SEQ ID NO: 1553474 - protein, 20 aa, Mycobacterium tuberculosis
EWRPRPRRQPARRSRPSPRP

SEQ ID NO: 1553475 - protein, 18 aa, Mycobacterium tuberculosis
FAIPPIGVGGFTLPQITT

SEQ ID NO: 1553476 - protein, 17 aa, Mycobacterium tuberculosis
FALPDCAGHPTWYEPSE

SEQ ID NO: 1553477 - protein, 17 aa, Mycobacterium tuberculosis
FAQAAAVPVVFLTAWYG

SEQ ID NO: 1553478 - protein, 26 aa, Mycobacterium tuberculosis
FAQLVMSNWFGLNAPLIAAVEGAYEQ

SEQ ID NO: 1553479 - protein, 29 aa, Mycobacterium tuberculosis
FDLPPRWFAGWSRLGLRTSLRYKVPRMPF

SEQ ID NO: 1553480 - protein, 22 aa, Mycobacterium tuberculosis
FEFRCARCGVPYTDALPEMPEP

SEQ ID NO: 1553481 - protein, 17 aa, Mycobacterium tuberculosis
FELLAARRRDQLIDIDV

SEQ ID NO: 1553482 - protein, 17 aa, Mycobacterium tuberculosis
FGSLMSGFANFDDEVSG

SEQ ID NO: 1553483 - protein, 18 aa, Mycobacterium tuberculosis
FHAPVCAGVDWRRRGVCG

SEQ ID NO: 1553484 - protein, 17 aa, Mycobacterium tuberculosis
FISLNGGQMVPVLLDTG

SEQ ID NO: 1553485 - protein, 23 aa, Mycobacterium tuberculosis
FLFDFRDGIELNPIVIPGSSIPI

SEQ ID NO: 1553486 - protein, 23 aa, Mycobacterium tuberculosis
FLSGDYQGLVGLNLVIDMPLPIS

SEQ ID NO: 1553487 - protein, 20 aa, Mycobacterium tuberculosis
FPDLPSFPGFPGFPEFPAIP

SEQ ID NO: 1553488 - protein, 17 aa, Mycobacterium tuberculosis
FPSLCHFSGGIPAPEAD

SEQ ID NO: 1553489 - protein, 19 aa, Mycobacterium tuberculosis
FQALFGRPLIGDGANGAPG

SEQ ID NO: 1553490 - protein, 20 aa, Mycobacterium tuberculosis
FRNGDPFIWDRGRELGMVNR

SEQ ID NO: 1553491 - protein, 21 aa, Mycobacterium tuberculosis
FRRLAVFVGCFFVDDAQAVAC

SEQ ID NO: 1553492 - protein, 23 aa, Mycobacterium tuberculosis
FSNGVLWRGDYEGLWGLSGGSTI

SEQ ID NO: 1553493 - protein, 24 aa, Mycobacterium tuberculosis
FTAWAVGWLPYIGILAPQINFFYY

SEQ ID NO: 1553494 - protein, 21 aa, Mycobacterium tuberculosis
FTIPEIHIPKIPIDVLGSVGL

SEQ ID NO: 1553495 - protein, 19 aa, Mycobacterium tuberculosis
FTYRFSVPDPGTYWAHPHV

SEQ ID NO: 1553496 - protein, 25 aa, Mycobacterium tuberculosis
GAAGGVGGRGGWLLGNGGTGGAGGA

SEQ ID NO: 1553497 - protein, 23 aa, Mycobacterium tuberculosis
GAGGAGFSRALIVAGDNGGDGGN

SEQ ID NO: 1553498 - protein, 18 aa, Mycobacterium tuberculosis
GAGGLLWGNGGNGGSGAA

SEQ ID NO: 1553499 - protein, 17 aa, Mycobacterium tuberculosis
GAGPLLIGNGGVGGLGG

SEQ ID NO: 1553500 - protein, 18 aa, Mycobacterium tuberculosis
GAICRWHAANPAGLIDIT

SEQ ID NO: 1553501 - protein, 17 aa, Mycobacterium tuberculosis
GAICRWQAANPAGLIDI

SEQ ID NO: 1553502 - protein, 19 aa, Mycobacterium tuberculosis
GALIFGEFDLPQLVVHPYT

SEQ ID NO: 1553503 - protein, 24 aa, Mycobacterium tuberculosis
GANGGAGGNAWLFGAGGSGGAGTN

SEQ ID NO: 1553504 - protein, 18 aa, Mycobacterium tuberculosis
GAPGGWLIGNGGAGGSGA

SEQ ID NO: 1553505 - protein, 19 aa, Mycobacterium tuberculosis
GAPGGWLLGNGGAGGSAAA

SEQ ID NO: 1553506 - protein, 19 aa, Mycobacterium tuberculosis
GAPYAWGGAAPGGFDCSGL

SEQ ID NO: 1553507 - protein, 34 aa, Mycobacterium tuberculosis
GASPTAPGPLAFPAPKAWPARPASAGRRRACRSR

SEQ ID NO: 1553508 - protein, 30 aa, Mycobacterium tuberculosis
GAVRRARPGVPEAQRPGGGVSCQFVQALNA

SEQ ID NO: 1553509 - protein, 19 aa, Mycobacterium tuberculosis
GCADLHRSDRDAAWPAIAA

SEQ ID NO: 1553510 - protein, 25 aa, Mycobacterium tuberculosis
GCGQYRRLERGFGQCRRRQRRVRQY

SEQ ID NO: 1553511 - protein, 19 aa, Mycobacterium tuberculosis
GDAALALLRAELRPGDVVL

SEQ ID NO: 1553512 - protein, 23 aa, Mycobacterium tuberculosis
GDEVSAAIAALFGTHAQEYQALS

SEQ ID NO: 1553513 - protein, 17 aa, Mycobacterium tuberculosis
GDFTYRFSVPDPGTYWA

SEQ ID NO: 1553514 - protein, 17 aa, Mycobacterium tuberculosis
GDRGGAGGTGFISSDGG

SEQ ID NO: 1553515 - protein, 17 aa, Mycobacterium tuberculosis
GDYQGLIGLPLLGIPVT

SEQ ID NO: 1553516 - protein, 18 aa, Mycobacterium tuberculosis
GEALALWLSGQEQLMPRD

SEQ ID NO: 1553517 - protein, 17 aa, Mycobacterium tuberculosis
GECLRRFGADIAAASWD

SEQ ID NO: 1553518 - protein, 19 aa, Mycobacterium tuberculosis
GENRFPYDIEFIIRGESEQ

SEQ ID NO: 1553519 - protein, 25 aa, Mycobacterium tuberculosis
GEQTHKRPIKKKKKKKKKKKKKKKK

SEQ ID NO: 1553520 - protein, 22 aa, Mycobacterium tuberculosis
GERFVLGVGFGWNVEELADHGV

SEQ ID NO: 1553521 - protein, 18 aa, Mycobacterium tuberculosis
GFDISARMGAAISDAAPQ

SEQ ID NO: 1553522 - protein, 18 aa, Mycobacterium tuberculosis
GGAAGMFGTGGAGGTGGD

SEQ ID NO: 1553523 - protein, 17 aa, Mycobacterium tuberculosis
GGAGFGSGVAGAAGAGG

SEQ ID NO: 1553524 - protein, 24 aa, Mycobacterium tuberculosis
GGAGGAGGRAWLWGTGGAGGAGGD

SEQ ID NO: 1553525 - protein, 21 aa, Mycobacterium tuberculosis
GGAGGDGGWLFGDGGAGGTGG

SEQ ID NO: 1553526 - protein, 17 aa, Mycobacterium tuberculosis
GGAGGFGAVLFGNGGAG

SEQ ID NO: 1553527 - protein, 23 aa, Mycobacterium tuberculosis
GGAGGNGGWLWGNGGNGGVGGTS

SEQ ID NO: 1553528 - protein, 20 aa, Mycobacterium tuberculosis
GGAGGNGWAAEGITVGIGEQ

SEQ ID NO: 1553529 - protein, 21 aa, Mycobacterium tuberculosis
GGAGGRGGWLVGNGGNGGNGA

SEQ ID NO: 1553530 - protein, 27 aa, Mycobacterium tuberculosis
GGAGVQCGAGGAGISFSNVSNGGTGGT

SEQ ID NO: 1553531 - protein, 20 aa, Mycobacterium tuberculosis
GGASGWLMGNGGNGGNGGTG

SEQ ID NO: 1553532 - protein, 41 aa, Mycobacterium tuberculosis
GGCRRGPRRWSRASAMLVSSCRGCPRRGRHSTRASSSISGW

SEQ ID NO: 1553533 - protein, 18 aa, Mycobacterium tuberculosis
GGDAGMFFGSGGSGGAGG

SEQ ID NO: 1553534 - protein, 30 aa, Mycobacterium tuberculosis
GGEESLQVVAPVRRRGLFRLDAGVVAAIEQ

SEQ ID NO: 1553535 - protein, 27 aa, Mycobacterium tuberculosis
GGFGGNGFAGVGGRGGMGGSGGTGGTG

SEQ ID NO: 1553536 - protein, 22 aa, Mycobacterium tuberculosis
GGFGGNGGWLYGNWGSDGILGA

SEQ ID NO: 1553537 - protein, 20 aa, Mycobacterium tuberculosis
GGGGEGPPAPPPAPPPPTPN

SEQ ID NO: 1553538 - protein, 20 aa, Mycobacterium tuberculosis
GGGGFSILLGLGGLGGLGSP

SEQ ID NO: 1553539 - protein, 21 aa, Mycobacterium tuberculosis
GGGGGGGRGGKKKKKKKKKKK

SEQ ID NO: 1553540 - protein, 18 aa, Mycobacterium tuberculosis
GGGLPPVPASPGGNGGGG

SEQ ID NO: 1553541 - protein, 22 aa, Mycobacterium tuberculosis
GGGSFGLPGLNGSCGDGGDGGN

SEQ ID NO: 1553542 - protein, 21 aa, Mycobacterium tuberculosis
GGGSFGLPGLNGSGGDGGDGG

SEQ ID NO: 1553543 - protein, 19 aa, Mycobacterium tuberculosis
GGKGGDAFATFAKAGNGGA

SEQ ID NO: 1553544 - protein, 21 aa, Mycobacterium tuberculosis
GGLGGNGGWLYGNGGAGGIGG

SEQ ID NO: 1553545 - protein, 24 aa, Mycobacterium tuberculosis
GGNGGRAGLLLGVGGTGGSGGAGG

SEQ ID NO: 1553546 - protein, 22 aa, Mycobacterium tuberculosis
GGNGGRGGMLIGNGGAGGAGGT

SEQ ID NO: 1553547 - protein, 31 aa, Mycobacterium tuberculosis
GGRGRRPRRVAVRRWRGWRERRGRGRRRRRR

SEQ ID NO: 1553548 - protein, 21 aa, Mycobacterium tuberculosis
GGSFGLPGLNGSCGDGGDGGN

SEQ ID NO: 1553549 - protein, 23 aa, Mycobacterium tuberculosis
GHCMGAIVAFEFARLAERNGVPV

SEQ ID NO: 1553550 - protein, 20 aa, Mycobacterium tuberculosis
GILCGSIVSGLRMRPGNWAG

SEQ ID NO: 1553551 - protein, 18 aa, Mycobacterium tuberculosis
GIPGGSWAQPGVAATVAP

SEQ ID NO: 1553552 - protein, 20 aa, Mycobacterium tuberculosis
GKFNRPYLCRSRCVHTSSSH

SEQ ID NO: 1553553 - protein, 20 aa, Mycobacterium tuberculosis
GKGGASGMLIGNGGNGGSGG

SEQ ID NO: 1553554 - protein, 21 aa, Mycobacterium tuberculosis
GKGGASGMLIGNGGNGGSGGV

SEQ ID NO: 1553555 - protein, 21 aa, Mycobacterium tuberculosis
GKGGDGFGVFGKGGAGGTGGR

SEQ ID NO: 1553556 - protein, 36 aa, Mycobacterium tuberculosis; identical to SEQ ID NO: 235584

SEQ ID NO: 1553557 - protein, 19 aa, Mycobacterium tuberculosis
GLPLWPYLVCGALAASAAA

SEQ ID NO: 1553558 - protein, 17 aa, Mycobacterium tuberculosis
GLSRAWDKATLRIVSKA

SEQ ID NO: 1553559 - protein, 18 aa, Mycobacterium tuberculosis
GLTAGVWPGAAAAAMAAA

SEQ ID NO: 1553560 - protein, 18 aa, Mycobacterium tuberculosis
GLVSRCLRFGSAVAGSYT

SEQ ID NO: 1553561 - protein, 23 aa, Mycobacterium tuberculosis
GMNFPGWAFWCPSTGFEAAVGRM

SEQ ID NO: 1553562 - protein, 17 aa, Mycobacterium tuberculosis
GNGGWLWGNGGNGGVGG

SEQ ID NO: 1553563 - protein, 17 aa, Mycobacterium tuberculosis
GPAGSILHDGGNGGHGG

SEQ ID NO: 1553564 - protein, 17 aa, Mycobacterium tuberculosis
GPFPRSRFASTQSSTSA

SEQ ID NO: 1553565 - protein, 18 aa, Mycobacterium tuberculosis
GQITGLRSGFGGAGGAGG

SEQ ID NO: 1553566 - protein, 20 aa, Mycobacterium tuberculosis
GQNGGLLFGNGGNGFTQTTA

SEQ ID NO: 1553567 - protein, 22 aa, Mycobacterium tuberculosis
GQPGGPGGLLWGNGGNGGSGVA

SEQ ID NO: 1553568 - protein, 19 aa, Mycobacterium tuberculosis
GQRAHFGPITIPNITVVGP

SEQ ID NO: 1553569 - protein, 21 aa, Mycobacterium tuberculosis
GRPGQHGLRQCRQRQLWCLQP

SEQ ID NO: 1553570 - protein, 42 aa, Mycobacterium tuberculosis
GRPSPPLPLPPPPLPPFFFFFFFFIFFFFFLKKKKRKKKKKK

SEQ ID NO: 1553571 - protein, 27 aa, Mycobacterium tuberculosis
GRRPIPRPGWCRWCRISTIRPILTILR

SEQ ID NO: 1553572 - protein, 18 aa, Mycobacterium tuberculosis
GSGADNPTGAGFAGGAGG

SEQ ID NO: 1553573 - protein, 23 aa, Mycobacterium tuberculosis
GSGADNPTGAGFAGGAGGTGGAA

SEQ ID NO: 1553574 - protein, 17 aa, Mycobacterium tuberculosis
GSGGWLYGNGGNGGIGG

SEQ ID NO: 1553575 - protein, 19 aa, Mycobacterium tuberculosis
GSGNGRAGLPGSGNVGNGN

SEQ ID NO: 1553576 - protein, 21 aa, Mycobacterium tuberculosis
GSTMTLPLISMRFEGEDWILG

SEQ ID NO: 1553577 - protein, 17 aa, Mycobacterium tuberculosis
GSVCWLVGCSSGASSTT

SEQ ID NO: 1553578 - protein, 22 aa, Mycobacterium tuberculosis
GTAFLAARGGYFVADLSSGHTG

SEQ ID NO: 1553579 - protein, 21 aa, Mycobacterium tuberculosis
GTGAPACRWERGVVVGQRRQR

SEQ ID NO: 1553580 - protein, 28 aa, Mycobacterium tuberculosis
GTGGAGGRAELLFGAGGAGGAGTDGGPG

SEQ ID NO: 1553581 - protein, 24 aa, Mycobacterium tuberculosis
GTGGFPGNGNAGGNGGPGGASEDG

SEQ ID NO: 1553582 - protein, 18 aa, Mycobacterium tuberculosis
GTGGQLWGSGGAGGEGGA

SEQ ID NO: 1553583 - protein, 20 aa, Mycobacterium tuberculosis
GTGGRGGWLAGAGGAGGAGG

SEQ ID NO: 1553584 - protein, 21 aa, Mycobacterium tuberculosis
GTRLPVWLTQWGYRRPAEDTV

SEQ ID NO: 1553585 - protein, 25 aa, Mycobacterium tuberculosis
GTVGFDCSGLVLSLVCWGGHQAAAL

SEQ ID NO: 1553586 - protein, 17 aa, Mycobacterium tuberculosis
GVGGCLFGNGGHVAAGG

SEQ ID NO: 1553587 - protein, 18 aa, Mycobacterium tuberculosis
GVVSPGFIGAPLALAALG

SEQ ID NO: 1553588 - protein, 17 aa, Mycobacterium tuberculosis
GYPTACFVSINRHKSVA

SEQ ID NO: 1553589 - protein, 20 aa, Mycobacterium tuberculosis
HAYSRASAMASVFHRDDPEW

SEQ ID NO: 1553590 - protein, 23 aa, Mycobacterium tuberculosis
HEVGYRLRVRMALDEGRYKIAKL

SEQ ID NO: 1553591 - protein, 21 aa, Mycobacterium tuberculosis
HGGPHYLCLAIHAMVTDDSSR

SEQ ID NO: 1553592 - protein, 28 aa, Mycobacterium tuberculosis
HGMSGSATRAWGRCRGSATSGWATPAAT

SEQ ID NO: 1553593 - protein, 20 aa, Mycobacterium tuberculosis
HGPAKWAFRSWCTSRSCDTL

SEQ ID NO: 1553594 - protein, 17 aa, Mycobacterium tuberculosis
HHPCCGDLVYGADPKLA

SEQ ID NO: 1553595 - protein, 17 aa, Mycobacterium tuberculosis
HILIDLPAVPGFGNTTG

SEQ ID NO: 1553596 - protein, 17 aa, Mycobacterium tuberculosis
HLPGFPVQFFVYKQIAA

SEQ ID NO: 1553597 - protein, 21 aa, Mycobacterium tuberculosis
HPAEVTWHWWWLGAADLGGLL

SEQ ID NO: 1553598 - protein, 18 aa, Mycobacterium tuberculosis
HPHCAWTVIIDESYPEAE

SEQ ID NO: 1553599 - protein, 23 aa, Mycobacterium tuberculosis
HQKLCEVYKLAARAVQIATNGDN

SEQ ID NO: 1553600 - protein, 23 aa, Mycobacterium tuberculosis
HSQAAGSRACRWMRRNIRVTLGA

SEQ ID NO: 1553601 - protein, 25 aa, Mycobacterium tuberculosis
HSWRKRPATGWGMGSLRPKIDVVRV

SEQ ID NO: 1553602 - protein, 27 aa, Mycobacterium tuberculosis
HTTLSIGPFPFRWDYIPPTPANGPIPA

SEQ ID NO: 1553603 - protein, 27 aa, Mycobacterium tuberculosis
IALTFGVDIPIHIPINIDAGVVTLQGF

SEQ ID NO: 1553604 - protein, 20 aa, Mycobacterium tuberculosis
IANGSFAPSFVGFGGNGGNG

SEQ ID NO: 1553605 - protein, 23 aa, Mycobacterium tuberculosis
IARVIMRSAIGFFASFTVSSGVL

SEQ ID NO: 1553606 - protein, 17 aa, Mycobacterium tuberculosis
IASASCIASAAPAAAVT

SEQ ID NO: 1553607 - protein, 19 aa, Mycobacterium tuberculosis
IATTRFLLDVNISGGLPAF

SEQ ID NO: 1553608 - protein, 18 aa, Mycobacterium tuberculosis
IAYDASQQVFGFAPYPAV

SEQ ID NO: 1553609 - protein, 17 aa, Mycobacterium tuberculosis
ICRRSRLMSRIAGSGAM

SEQ ID NO: 1553610 - protein, 17 aa, Mycobacterium tuberculosis
IDARPAVLLVIPADTPD

SEQ ID NO: 1553611 - protein, 20 aa, Mycobacterium tuberculosis
IDNLRAAFVWNRENSDTEGA

SEQ ID NO: 1553612 - protein, 24 aa, Mycobacterium tuberculosis
IDVSGGLPAFTLFPGGLNIPQNAI

SEQ ID NO: 1553613 - protein, 20 aa, Mycobacterium tuberculosis
IGGAGGNVWHTCKYSRRGPL

SEQ ID NO: 1553614 - protein, 21 aa, Mycobacterium tuberculosis
IGGKGGDAFATFAKAGNGGAG

SEQ ID NO: 1553615 - protein, 17 aa, Mycobacterium tuberculosis
IGLELNGGVGPITVLPI

SEQ ID NO: 1553616 - protein, 17 aa, Mycobacterium tuberculosis
IGSALSLASAVAAAQTS

SEQ ID NO: 1553617 - protein, 20 aa, Mycobacterium tuberculosis
IKINPITLWPAQNFNQTITL

SEQ ID NO: 1553618 - protein, 19 aa, Mycobacterium tuberculosis
IKPGLSLGGYAAFARYDNN

SEQ ID NO: 1553619 - protein, 18 aa, Mycobacterium tuberculosis
IMRSAIGFFASFTVSSGV

SEQ ID NO: 1553620 - protein, 18 aa, Mycobacterium tuberculosis
IPAIPIGLVLNGDIGPIT

SEQ ID NO: 1553621 - protein, 17 aa, Mycobacterium tuberculosis
IPAQTPVTLGLSGGNDP

SEQ ID NO: 1553622 - protein, 19 aa, Mycobacterium tuberculosis
IPGLLCWVGEYAGQVREEY

SEQ ID NO: 1553623 - protein, 18 aa, Mycobacterium tuberculosis
IPLIKIPAAPGFGNSTTS

SEQ ID NO: 1553624 - protein, 17 aa, Mycobacterium tuberculosis
IPVCTRLGLSPPDVRTL

SEQ ID NO: 1553625 - protein, 21 aa, Mycobacterium tuberculosis
IRAPSRLQVWRTRATTARECS

SEQ ID NO: 1553626 - protein, 22 aa, Mycobacterium tuberculosis
IRATGRLRQRCAGLARTAVRHR

SEQ ID NO: 1553627 - protein, 19 aa, Mycobacterium tuberculosis
IRIDRFELLAARRRDQLID

SEQ ID NO: 1553628 - protein, 21 aa, Mycobacterium tuberculosis
IRPNPGIGHPCWANYFPVTRT

SEQ ID NO: 1553629 - protein, 17 aa, Mycobacterium tuberculosis
IRSGVTFAAKGVATRGA

SEQ ID NO: 1553630 - protein, 28 aa, Mycobacterium tuberculosis
ISAQVAAYHQRFVQALSTGAGAYASAEA

SEQ ID NO: 1553631 - protein, 20 aa, Mycobacterium tuberculosis
ISCRVREGFVMRLAIVGTAA

SEQ ID NO: 1553632 - protein, 21 aa, Mycobacterium tuberculosis
ISGGLPAFTLFAGGLTIPTNA

SEQ ID NO: 1553633 - protein, 24 aa, Mycobacterium tuberculosis
KAAARLGSDMGEFYMPYPGTRINQ

SEQ ID NO: 1553634 - protein, 17 aa, Mycobacterium tuberculosis
KAAECRAGARAWRRHEP

SEQ ID NO: 1553635 - protein, 23 aa, Mycobacterium tuberculosis
KALDITLPMPPRWTQVPDPNVPD

SEQ ID NO: 1553636 - protein, 25 aa, Mycobacterium tuberculosis
KGGKCGWSTAAAEWRRRRSPPPGIS

SEQ ID NO: 1553637 - protein, 17 aa, Mycobacterium tuberculosis
KGGNGGDGDGFIGGSGG

SEQ ID NO: 1553638 - protein, 19 aa, Mycobacterium tuberculosis
KGRLAALAIAAMASASLVT

SEQ ID NO: 1553639 - protein, 24 aa, Mycobacterium tuberculosis
KKKGEGGGGGGGGEGGGGPPKKKN

SEQ ID NO: 1553640 - protein, 20 aa, Mycobacterium tuberculosis
KKKKGGGRGGGGGGGGGGGK

SEQ ID NO: 1553641 - protein, 47 aa, Mycobacterium tuberculosis
KKKKKKREGGGGGWGGPPPSRTGSNPLDLKPATVQPPTQEVAAAPNI

SEQ ID NO: 1553642 - protein, 26 aa, Mycobacterium tuberculosis
KKKKKKRGREGGGGGGGGGGGGGGGG

SEQ ID NO: 1553643 - protein, 21 aa, Mycobacterium tuberculosis
KKLSGLRARNGLLTASGDNAS

SEQ ID NO: 1553644 - protein, 18 aa, Mycobacterium tuberculosis
KLGFPVPIRHWLRAGELL

SEQ ID NO: 1553645 - protein, 17 aa, Mycobacterium tuberculosis
KPFVRWLTDLCVQLSEV

SEQ ID NO: 1553646 - protein, 27 aa, Mycobacterium tuberculosis
KPWGNGRGGNAWVLLGMFATRPRWHPP

SEQ ID NO: 1553647 - protein, 38 aa, Mycobacterium tuberculosis
KQIRKKQGGQWGGLCVWPRPLEPGVLGGGGEESLQVVA

SEQ ID NO: 1553648 - protein, 28 aa, Mycobacterium tuberculosis
KQKKKKGKGGGWGGGGGGGGGGGGGGGE

SEQ ID NO: 1553649 - protein, 17 aa, Mycobacterium tuberculosis
KRLQVILDRQIMRKLAG

SEQ ID NO: 1553650 - protein, 26 aa, Mycobacterium tuberculosis
KVILSRCVEVPFAIDFPLTYRLGRRH

SEQ ID NO: 1553651 - protein, 21 aa, Mycobacterium tuberculosis
KWPRRMRKMFLSLIQRQLPEG

SEQ ID NO: 1553652 - protein, 18 aa, Mycobacterium tuberculosis
LAAAAAWDGLAAELGLAA

SEQ ID NO: 1553653 - protein, 18 aa, Mycobacterium tuberculosis
LAGLPAWLASGAPAAAMT

SEQ ID NO: 1553654 - protein, 18 aa, Mycobacterium tuberculosis
LAGPYAWSNALSAGYTAE

SEQ ID NO: 1553655 - protein, 17 aa, Mycobacterium tuberculosis
LAISALFGQHAQAYQAL

SEQ ID NO: 1553656 - protein, 19 aa, Mycobacterium tuberculosis
LAKLARAGFRVSDVKPPSS

SEQ ID NO: 1553657 - protein, 26 aa, Mycobacterium tuberculosis
LANAKRWGVLHVIWRQGYYPGIGAPS

SEQ ID NO: 1553658 - protein, 26 aa, Mycobacterium tuberculosis
LAPLPISGRPVAAWMGALNTSIRLSR

SEQ ID NO: 1553659 - protein, 21 aa, Mycobacterium tuberculosis
LAYDRAWWFARFVAAAYGTAK

SEQ ID NO: 1553660 - protein, 19 aa, Mycobacterium tuberculosis
LCTDDLRVARIRGCGADEL

SEQ ID NO: 1553661 - protein, 27 aa, Mycobacterium tuberculosis
LDAFGCAMCRGELRAGLRSERRGQRAA

SEQ ID NO: 1553662 - protein, 18 aa, Mycobacterium tuberculosis
LDAFLKWHHGVREFLQSA

SEQ ID NO: 1553663 - protein, 17 aa, Mycobacterium tuberculosis
LDIGNALALGNVGGVNL

SEQ ID NO: 1553664 - protein, 23 aa, Mycobacterium tuberculosis
LDIPRVPVTLNYLFGSQPGGPLK

SEQ ID NO: 1553665 - protein, 19 aa, Mycobacterium tuberculosis
LDPKIGLPDIRAVLTAVVN

SEQ ID NO: 1553666 - protein, 22 aa, Mycobacterium tuberculosis
LDVQPRLAILLGECAVPAEGRV

SEQ ID NO: 1553667 - protein, 21 aa, Mycobacterium tuberculosis
LELNSRPALPLAPPASPVPVV

SEQ ID NO: 1553668 - protein, 20 aa, Mycobacterium tuberculosis
LFGSHAREYQAISTQVAAFH

SEQ ID NO: 1553669 - protein, 18 aa, Mycobacterium tuberculosis
LFKRNICHQAIFYRRGLF

SEQ ID NO: 1553670 - protein, 20 aa, Mycobacterium tuberculosis
LFPPELSGGIGNILNIGAGN

SEQ ID NO: 1553671 - protein, 23 aa, Mycobacterium tuberculosis
LFSMPIHQVMVMPGSVMTIPGMR

SEQ ID NO: 1553672 - protein, 20 aa, Mycobacterium tuberculosis
LGAIGIDLTDVFAVLEEEGV

SEQ ID NO: 1553673 - protein, 20 aa, Mycobacterium tuberculosis
LGALSSWYVWAALGLYPSTP

SEQ ID NO: 1553674 - protein, 20 aa, Mycobacterium tuberculosis
LGARAALFHEQFVQALTGAA

SEQ ID NO: 1553675 - protein, 19 aa, Mycobacterium tuberculosis
LGGQPGFAGGPGGKGGAGG

SEQ ID NO: 1553676 - protein, 19 aa, Mycobacterium tuberculosis
LGLRPRLAIGIHQPGGRCA

SEQ ID NO: 1553677 - protein, 19 aa, Mycobacterium tuberculosis
LGWYYLRIPSLVGIGQYTL

SEQ ID NO: 1553678 - protein, 23 aa, Mycobacterium tuberculosis
LHLPGVAFGHDWLTGTSRYSGLL

SEQ ID NO: 1553679 - protein, 19 aa, Mycobacterium tuberculosis
LKAAECRAGARAWRRHEPQ

SEQ ID NO: 1553680 - protein, 17 aa, Mycobacterium tuberculosis
LKIVSCYQYGKGSTADW

SEQ ID NO: 1553681 - protein, 20 aa, Mycobacterium tuberculosis
LKYLPLAPFRISYAYTNFGV

SEQ ID NO: 1553682 - protein, 18 aa, Mycobacterium tuberculosis
LLDVNISGGLPAFTLFAG

SEQ ID NO: 1553683 - protein, 17 aa, Mycobacterium tuberculosis
LLGRPLIGNGADGTAPG

SEQ ID NO: 1553684 - protein, 18 aa, Mycobacterium tuberculosis
LLRFCLERGYQLRVIEQM

SEQ ID NO: 1553685 - protein, 20 aa, Mycobacterium tuberculosis
LMPASSAARCAARIVGGPRL

SEQ ID NO: 1553686 - protein, 18 aa, Mycobacterium tuberculosis
LMPASSAARCAARIVGGR

SEQ ID NO: 1553687 - protein, 20 aa, Mycobacterium tuberculosis
LNDNRVDAIVGWRQAGGNLA

SEQ ID NO: 1553688 - protein, 22 aa, Mycobacterium tuberculosis
LPDIKCVYWAGGNPFHHHQNLP

SEQ ID NO: 1553689 - protein, 21 aa, Mycobacterium tuberculosis
LPGELMSALSQGLSQFGINIP

SEQ ID NO: 1553690 - protein, 18 aa, Mycobacterium tuberculosis
LPGSWGPDLVGVAGDGGL

SEQ ID NO: 1553691 - protein, 17 aa, Mycobacterium tuberculosis
LPGYIFSGVAPVVTEML

SEQ ID NO: 1553692 - protein, 19 aa, Mycobacterium tuberculosis
LPLDRAAVIIADLAQSTPT

SEQ ID NO: 1553693 - protein, 17 aa, Mycobacterium tuberculosis
LPMPPRWTQVPDPNVPD

SEQ ID NO: 1553694 - protein, 17 aa, Mycobacterium tuberculosis
LPPRLWRNFLAKPPLPA

SEQ ID NO: 1553695 - protein, 27 aa, Mycobacterium tuberculosis
LPRRPKFALLKGRRNYLCLNKIHNSVT

SEQ ID NO: 1553696 - protein, 17 aa, Mycobacterium tuberculosis
LQMGGWGAGARRGKAAV

SEQ ID NO: 1553697 - protein, 18 aa, Mycobacterium tuberculosis
LREIRMALTLDKTFTKSE

SEQ ID NO: 1553698 - protein, 30 aa, Mycobacterium tuberculosis
LRKQILRLDQRWLIARVIMRSAIGFFASFT

SEQ ID NO: 1553699 - protein, 21 aa, Mycobacterium tuberculosis
LRLRLSLDLTNLIERYLANDV

SEQ ID NO: 1553700 - protein, 25 aa, Mycobacterium tuberculosis
LRVYRFGGSLHLDWWYDTRRIPAAT

SEQ ID NO: 1553701 - protein, 20 aa, Mycobacterium tuberculosis
LRWSWLLSVLAAVGLGLATA

SEQ ID NO: 1553702 - protein, 21 aa, Mycobacterium tuberculosis
LSDLQPGDVLTFYSDASHAGI

SEQ ID NO: 1553703 - protein, 17 aa, Mycobacterium tuberculosis
LSFLSVSSVDYWAYRPA

SEQ ID NO: 1553704 - protein, 19 aa, Mycobacterium tuberculosis
LSGLGYPASTPVLGAQPID

SEQ ID NO: 1553705 - protein, 17 aa, Mycobacterium tuberculosis
LSSPVILGIGIGGAGGD

SEQ ID NO: 1553706 - protein, 20 aa, Mycobacterium tuberculosis
LSTRCSLPISGLQAIGLMQA

SEQ ID NO: 1553707 - protein, 17 aa, Mycobacterium tuberculosis
LSVPAAWSTAAPATTAG

SEQ ID NO: 1553708 - protein, 17 aa, Mycobacterium tuberculosis
LSWFAGLTWFAGGSTGA

SEQ ID NO: 1553709 - protein, 20 aa, Mycobacterium tuberculosis
LTAAAGRYASTEAAVERSLL

SEQ ID NO: 1553710 - protein, 19 aa, Mycobacterium tuberculosis
LTAAAGRYASTEVAVERSL

SEQ ID NO: 1553711 - protein, 18 aa, Mycobacterium tuberculosis
LTGGTGFAGGAGGAGGAG

SEQ ID NO: 1553712 - protein, 17 aa, Mycobacterium tuberculosis
LTGRPLIGNGANGTPGT

SEQ ID NO: 1553713 - protein, 21 aa, Mycobacterium tuberculosis
LVIPVCTRLGLSPPDVRTLSK

SEQ ID NO: 1553714 - protein, 18 aa, Mycobacterium tuberculosis
LVSGDYQGLIGLPLLGIP

SEQ ID NO: 1553715 - protein, 18 aa, Mycobacterium tuberculosis
LWLGRPLIGDGVHGAPGT

SEQ ID NO: 1553716 - protein, 19 aa, Mycobacterium tuberculosis
LYAEMWAQDALAMYGYAAA

SEQ ID NO: 1553717 - protein, 17 aa, Mycobacterium tuberculosis
LYKRLPGDLSILTPSPA

SEQ ID NO: 1553718 - protein, 18 aa, Mycobacterium tuberculosis
LYVLHALGRCGSSTTRVS

SEQ ID NO: 1553719 - protein, 17 aa, Mycobacterium tuberculosis
LYWMSAWIDPDGTDGGP

SEQ ID NO: 1553720 - protein, 24 aa, Mycobacterium tuberculosis
MATIRNAVFLGHAFAALNPATVTA

SEQ ID NO: 1553721 - protein, 17 aa, Mycobacterium tuberculosis
MDFTLGLPVLGPITGQL

SEQ ID NO: 1553722 - protein, 18 aa, Mycobacterium tuberculosis
MGPMQFLPGTRARYATDG

SEQ ID NO: 1553723 - protein, 18 aa, Mycobacterium tuberculosis
MGSLRPKIDVVRVVAEGV

SEQ ID NO: 1553724 - protein, 17 aa, Mycobacterium tuberculosis
MLFGAERLLASSGSPTA

SEQ ID NO: 1553725 - protein, 19 aa, Mycobacterium tuberculosis
MPGGIYAPMMHPWSTGKDV

SEQ ID NO: 1553726 - protein, 17 aa, Mycobacterium tuberculosis
MSFVIAAPEVIAAAATD

SEQ ID NO: 1553727 - protein, 27 aa, Mycobacterium tuberculosis
MTIPGMRLPFTSIVPFVVYYGPVELPQ

SEQ ID NO: 1553728 - protein, 17 aa, Mycobacterium tuberculosis
MYELFSVGWGKPDLRDQ

SEQ ID NO: 1553729 - protein, 20 aa, Mycobacterium tuberculosis
NALCAAAVALECGASVEQVA

SEQ ID NO: 1553730 - protein, 19 aa, Mycobacterium tuberculosis
NASWLCWKAHWTASSTRPK

SEQ ID NO: 1553731 - protein, 17 aa, Mycobacterium tuberculosis
NATERYPMFTARIRALA

SEQ ID NO: 1553732 - protein, 23 aa, Mycobacterium tuberculosis
NAVEPWVQYGFNLTAWAVGWLPY

SEQ ID NO: 1553733 - protein, 25 aa, Mycobacterium tuberculosis
NELGHPWTVLRATRRTDYLILEMAA

SEQ ID NO: 1553734 - protein, 27 aa, Mycobacterium tuberculosis
NGAFWRGDYQGLLGFSYRPAVLPQTPF

SEQ ID NO: 1553735 - protein, 23 aa, Mycobacterium tuberculosis
NGAFWRGDYQGLLGFSYTSTIIP

SEQ ID NO: 1553736 - protein, 22 aa, Mycobacterium tuberculosis
NGGAGGNAWLFGAGGSGGAGTN

SEQ ID NO: 1553737 - protein, 20 aa, Mycobacterium tuberculosis
NGGDGDGFIGGSGGTGGTGG

SEQ ID NO: 1553738 - protein, 18 aa, Mycobacterium tuberculosis
NGGNANWFGSGGAGGQGG

SEQ ID NO: 1553739 - protein, 20 aa, Mycobacterium tuberculosis
NGGTGDGFIGGSGGTGGTGG

SEQ ID NO: 1553740 - protein, 22 aa, Mycobacterium tuberculosis
NGILWRGNYEGLFSYSYSLDVP

SEQ ID NO: 1553741 - protein, 24 aa, Mycobacterium tuberculosis
NGMLWRGDHEGLFGLSYGITIPQF

SEQ ID NO: 1553742 - protein, 19 aa, Mycobacterium tuberculosis
NGRGRWLAIAASLVVSAAI

SEQ ID NO: 1553743 - protein, 21 aa, Mycobacterium tuberculosis
NGVLWRGDYEGLWGLSGGSTI

SEQ ID NO: 1553744 - protein, 22 aa, Mycobacterium tuberculosis
NGVLWRGDYQGLLGFSSGANVL

SEQ ID NO: 1553745 - protein, 24 aa, Mycobacterium tuberculosis
NHATYRTWLTRLLRDGKKNKKIFF

SEQ ID NO: 1553746 - protein, 19 aa, Mycobacterium tuberculosis
NLRCSYCMPERGLRWLPGE

SEQ ID NO: 1553747 - protein, 18 aa, Mycobacterium tuberculosis
NNVRRLAGPYAWSNALSA

SEQ ID NO: 1553748 - protein, 20 aa, Mycobacterium tuberculosis
NRAVYRLDVIRCDRPNVVLG

SEQ ID NO: 1553749 - protein, 27 aa, Mycobacterium tuberculosis
NYSNGFFWRGDYQGLIGLSTTITIPEI

SEQ ID NO: 1553750 - protein, 25 aa, Mycobacterium tuberculosis
NYSNGVLWRGDYQGLIGADIALEIP

SEQ ID NO: 1553751 - protein, 24 aa, Mycobacterium tuberculosis
PAAMVARWVVPAGRAVPAAPVAPA

SEQ ID NO: 1553752 - protein, 19 aa, Mycobacterium tuberculosis
PAATPGCGCFGQRPDPGGE

SEQ ID NO: 1553753 - protein, 22 aa, Mycobacterium tuberculosis
PAIQPKLTFTWRIMPQNLSDAG

SEQ ID NO: 1553754 - protein, 19 aa, Mycobacterium tuberculosis
PARRCRAGPGGFRRGRSAL

SEQ ID NO: 1553755 - protein, 20 aa, Mycobacterium tuberculosis
PAVAAHCCWALADRAASAAP

SEQ ID NO: 1553756 - protein, 20 aa, Mycobacterium tuberculosis
PCATSGWPTPAPATSGSGWW

SEQ ID NO: 1553757 - protein, 17 aa, Mycobacterium tuberculosis
PCGAMVMVLLFLGVVFL

SEQ ID NO: 1553758 - protein, 18 aa, Mycobacterium tuberculosis
PCRKRWPRFGTRSAMHLD

SEQ ID NO: 1553759 - protein, 17 aa, Mycobacterium tuberculosis
PDGYRLSVDYAVRITSR

SEQ ID NO: 1553760 - protein, 17 aa, Mycobacterium tuberculosis
PEAIPVPHVPPLGAEPG

SEQ ID NO: 1553761 - protein, 22 aa, Mycobacterium tuberculosis
PEFLSAEIFQPLGLAMVVDPVG

SEQ ID NO: 1553762 - protein, 18 aa, Mycobacterium tuberculosis
PEHLQWIGQWGIFDALRA

SEQ ID NO: 1553763 - protein, 20 aa, Mycobacterium tuberculosis
PEIPAHLDVNIPIDIPITGS

SEQ ID NO: 1553764 - protein, 21 aa, Mycobacterium tuberculosis
PEPNSRPALPPAPPAPPELPV

SEQ ID NO: 1553765 - protein, 25 aa, Mycobacterium tuberculosis
PETTAPVWITMLWPLADRPRLAPGA

SEQ ID NO: 1553766 - protein, 26 aa, Mycobacterium tuberculosis
PETVAAAALDVARIGSSIGAANAAAA

SEQ ID NO: 1553767 - protein, 19 aa, Mycobacterium tuberculosis
PGAGGNGGNANWFGSGGAG

SEQ ID NO: 1553768 - protein, 21 aa, Mycobacterium tuberculosis
PGAKGAHGFTPTSGGDGGDGG

SEQ ID NO: 1553769 - protein, 20 aa, Mycobacterium tuberculosis
PGATGGTGFAGGAGGAGGSG

SEQ ID NO: 1553770 - protein, 21 aa, Mycobacterium tuberculosis
PGATGGTGFAGGAGGAGKAGG

SEQ ID NO: 1553771 - protein, 24 aa, Mycobacterium tuberculosis
PGLDWRWLVLWWKSHAPHIANNLM

SEQ ID NO: 1553772 - protein, 18 aa, Mycobacterium tuberculosis
PGPAARPTPIKALVRTVS

SEQ ID NO: 1553773 - protein, 18 aa, Mycobacterium tuberculosis
PGPPPTVWSRRWRQRWAP

SEQ ID NO: 1553774 - protein, 18 aa, Mycobacterium tuberculosis
PGPPRLAATVGPAPARPA

SEQ ID NO: 1553775 - protein, 20 aa, Mycobacterium tuberculosis
PGRGTTFCTAGMVPPWNPAV

SEQ ID NO: 1553776 - protein, 17 aa, Mycobacterium tuberculosis
PIDLQVIGGIGPIHVQP

SEQ ID NO: 1553777 - protein, 17 aa, Mycobacterium tuberculosis
PINEFFLANTGRPLIGN

SEQ ID NO: 1553778 - protein, 19 aa, Mycobacterium tuberculosis
PKTAALLFGNGGNGFTQTT

SEQ ID NO: 1553779 - protein, 38 aa, Mycobacterium tuberculosis
PLAHIALASGCCDLAGCVLAAWGWVVMSFVVAVPEALA

SEQ ID NO: 1553780 - protein, 41 aa, Mycobacterium tuberculosis; identical to SEQ ID NO: 236024

SEQ ID NO: 1553781 - protein, 17 aa, Mycobacterium tuberculosis
PLPLAINVIGHINALST

SEQ ID NO: 1553782 - protein, 18 aa, Mycobacterium tuberculosis
PLPSGTYCKIPQDAQLQV

SEQ ID NO: 1553783 - protein, 23 aa, Mycobacterium tuberculosis
PLRAKISFWFDRKYRVPADAAAA

SEQ ID NO: 1553784 - protein, 18 aa, Mycobacterium tuberculosis
PMPEFKPPIPVRWSPTSP

SEQ ID NO: 1553785 - protein, 21 aa, Mycobacterium tuberculosis
PPALSLGSWVAFARTPDGQTM

SEQ ID NO: 1553786 - protein, 19 aa, Mycobacterium tuberculosis
PPIGVFTLFRHRRRVRRFA

SEQ ID NO: 1553787 - protein, 17 aa, Mycobacterium tuberculosis
PPMDFTLGLPVLGPITG

SEQ ID NO: 1553788 - protein, 25 aa, Mycobacterium tuberculosis
PPPTVFRCGWCRWTRRGRSTTPAVT

SEQ ID NO: 1553789 - protein, 25 aa, Mycobacterium tuberculosis
PPSRLTGCYWWNWPPTTIRPTGSPT

SEQ ID NO: 1553790 - protein, 19 aa, Mycobacterium tuberculosis
PQLTAAFGGALWAARRPGD

SEQ ID NO: 1553791 - protein, 26 aa, Mycobacterium tuberculosis
PRGSPRRHAAMLLPVGRYPPTSRHGI

SEQ ID NO: 1553792 - protein, 21 aa, Mycobacterium tuberculosis
PRHRIRFAARVCRRRRRPLDR

SEQ ID NO: 1553793 - protein, 21 aa, Mycobacterium tuberculosis
PRIGVPDIWALPGRPAGRRLP

SEQ ID NO: 1553794 - protein, 17 aa, Mycobacterium tuberculosis
PRLPRLIPGGDYVMAGG

SEQ ID NO: 1553795 - protein, 19 aa, Mycobacterium tuberculosis
PRLSWFAGLTWFAGGSTGA

SEQ ID NO: 1553796 - protein, 17 aa, Mycobacterium tuberculosis
PRLWRNFLAKPPLPALF

SEQ ID NO: 1553797 - protein, 17 aa, Mycobacterium tuberculosis
PRPDLRPPSRLRSVRAL

SEQ ID NO: 1553798 - protein, 19 aa, Mycobacterium tuberculosis
PRRCCRPGCPHYAVATLTF

SEQ ID NO: 1553799 - protein, 18 aa, Mycobacterium tuberculosis
PRSLRPPLPPLPNAELPA

SEQ ID NO: 1553800 - protein, 18 aa, Mycobacterium tuberculosis
PSPPRPSLPPSPASLPPI

SEQ ID NO: 1553801 - protein, 21 aa, Mycobacterium tuberculosis
PSPVRRVCVTVGALVALACMV

SEQ ID NO: 1553802 - protein, 19 aa, Mycobacterium tuberculosis
PSRRWRRERRQWRQRRQWR

SEQ ID NO: 1553803 - protein, 18 aa, Mycobacterium tuberculosis
PSVKRWQRDRRKRWRRVS

SEQ ID NO: 1553804 - protein, 18 aa, Mycobacterium tuberculosis
PTAPRRPSDPGALVKAPS

SEQ ID NO: 1553805 - protein, 17 aa, Mycobacterium tuberculosis
PTAVRWAMRIPGGKAVH

SEQ ID NO: 1553806 - protein, 18 aa, Mycobacterium tuberculosis
PTLLAHYGVDAVITDEDH

SEQ ID NO: 1553807 - protein, 18 aa, Mycobacterium tuberculosis
PTPIKALVRTVSPMSPCS

SEQ ID NO: 1553808 - protein, 24 aa, Mycobacterium tuberculosis
PTQVRWRPFEFWPANTAVNIDAAG

SEQ ID NO: 1553809 - protein, 25 aa, Mycobacterium tuberculosis
PTQVRWRPFEFWPANTAVNIDAAGT

SEQ ID NO: 1553810 - protein, 23 aa, Mycobacterium tuberculosis
PVGGFSFALPAGWVESDAAHLDY

SEQ ID NO: 1553811 - protein, 18 aa, Mycobacterium tuberculosis
PVLDRLIAFTGRQPTAGH

SEQ ID NO: 1553812 - protein, 19 aa, Mycobacterium tuberculosis
PVSPWARYSAQLHHRSIQP

SEQ ID NO: 1553813 - protein, 18 aa, Mycobacterium tuberculosis
PVVRTPRPAIDGRFSAAG

SEQ ID NO: 1553814 - protein, 20 aa, Mycobacterium tuberculosis
QAAAFYAQFVQALSAGGGAY

SEQ ID NO: 1553815 - protein, 20 aa, Mycobacterium tuberculosis
QALLGRPLIGNGANGADGTG

SEQ ID NO: 1553816 - protein, 26 aa, Mycobacterium tuberculosis
QCRQCAHPGIVGRPLIGDGANGGPGQ

SEQ ID NO: 1553817 - protein, 25 aa, Mycobacterium tuberculosis
QDGILTIVGFAWRGDHVQILDSLPE

SEQ ID NO: 1553818 - protein, 17 aa, Mycobacterium tuberculosis
QHLDIGNALALGNVGGV

SEQ ID NO: 1553819 - protein, 23 aa, Mycobacterium tuberculosis
QLDRFAIRLELRYLSERDETSML

SEQ ID NO: 1553820 - protein, 18 aa, Mycobacterium tuberculosis
QPGPCATSGWPTPAPATS

SEQ ID NO: 1553821 - protein, 18 aa, Mycobacterium tuberculosis
QPLPEFLSAEIFQPLGLA

SEQ ID NO: 1553822 - protein, 19 aa, Mycobacterium tuberculosis
QPYWYWALDRESIGGSVSA

SEQ ID NO: 1553823 - protein, 23 aa, Mycobacterium tuberculosis
QQLGARAALFHEQFVQALTGAAS

SEQ ID NO: 1553824 - protein, 30 aa, Mycobacterium tuberculosis
QRDRRKRWRRVSGRTGLPRRQWLDMWASTT

SEQ ID NO: 1553825 - protein, 22 aa, Mycobacterium tuberculosis
QRFRRLRLPSVRRFTTPDRAAL

SEQ ID NO: 1553826 - protein, 17 aa, Mycobacterium tuberculosis
QRGWRFPDRLDRVYVNS

SEQ ID NO: 1553827 - protein, 18 aa, Mycobacterium tuberculosis
QTAGAAFRGTRTVGETLS

SEQ ID NO: 1553828 - protein, 17 aa, Mycobacterium tuberculosis
QVVPAAMVARWVVPAGR

SEQ ID NO: 1553829 - protein, 17 aa, Mycobacterium tuberculosis
RAALAAMVLPASVAGAG

SEQ ID NO: 1553830 - protein, 20 aa, Mycobacterium tuberculosis
RAGKMTNWAIARPPGQTQAL

SEQ ID NO: 1553831 - protein, 17 aa, Mycobacterium tuberculosis
RAKRPDGDWGPWYQTEY

SEQ ID NO: 1553832 - protein, 19 aa, Mycobacterium tuberculosis
RALGGRWVRWVNMVAFLPS

SEQ ID NO: 1553833 - protein, 17 aa, Mycobacterium tuberculosis
RARRHRAATAAACRAAA

SEQ ID NO: 1553834 - protein, 35 aa, Mycobacterium tuberculosis
RASSTWADSPRAWPIRAPSRLQVWRTRATTARECS

SEQ ID NO: 1553835 - protein, 23 aa, Mycobacterium tuberculosis
REKLFPLICRYAVAYHVVFIPSA

SEQ ID NO: 1553836 - protein, 19 aa, Mycobacterium tuberculosis
RELFTDILPAHIVKDIPGG

SEQ ID NO: 1553837 - protein, 21 aa, Mycobacterium tuberculosis
RFADWLVRVVEAFADRPDQPL

SEQ ID NO: 1553838 - protein, 20 aa, Mycobacterium tuberculosis
RFDFAFSLNVMEHIDLPDEA

SEQ ID NO: 1553839 - protein, 19 aa, Mycobacterium tuberculosis
RGAGALGFVGTAGKESVGQ

SEQ ID NO: 1553840 - protein, 17 aa, Mycobacterium tuberculosis
RGGAGGTGFISSDGGAG

SEQ ID NO: 1553841 - protein, 18 aa, Mycobacterium tuberculosis
RGILPFSVASVVSGFANI

SEQ ID NO: 1553842 - protein, 18 aa, Mycobacterium tuberculosis
RGQRGQRPSVKRWQRDRR

SEQ ID NO: 1553843 - protein, 20 aa, Mycobacterium tuberculosis
RGRQRRVRHLGHGMSGSATR

SEQ ID NO: 1553844 - protein, 25 aa, Mycobacterium tuberculosis
RGRRARWLRQCCRRRRRRGRRRRHG

SEQ ID NO: 1553845 - protein, 29 aa, Mycobacterium tuberculosis
RGRWYRRGRRCRWERGVVVGQRRQRRCRR

SEQ ID NO: 1553846 - protein, 20 aa, Mycobacterium tuberculosis
RHGIGRRTGLPGSPTRGPAN

SEQ ID NO: 1553847 - protein, 17 aa, Mycobacterium tuberculosis
RHLRLPLRNVLWEGDEA

SEQ ID NO: 1553848 - protein, 20 aa, Mycobacterium tuberculosis
RHPHCAWTVIIDESYPEAEG

SEQ ID NO: 1553849 - protein, 20 aa, Mycobacterium tuberculosis
RIAEIPLDIDATLISDGTGT

SEQ ID NO: 1553850 - protein, 17 aa, Mycobacterium tuberculosis
RIDERLVVVGLDNTVTY

SEQ ID NO: 1553851 - protein, 20 aa, Mycobacterium tuberculosis
RIPLISIPAAPGFGNSTTNP

SEQ ID NO: 1553852 - protein, 19 aa, Mycobacterium tuberculosis
RKPGLGWGTVGPVGPAATP

SEQ ID NO: 1553853 - protein, 19 aa, Mycobacterium tuberculosis
RLAISELTGAYWAGPAAAS

SEQ ID NO: 1553854 - protein, 17 aa, Mycobacterium tuberculosis
RLDNARFLLPVVGVPPD

SEQ ID NO: 1553855 - protein, 17 aa, Mycobacterium tuberculosis
RLGPARTAAICAVSPAL

SEQ ID NO: 1553856 - protein, 23 aa, Mycobacterium tuberculosis
RLGVPLGPAVRAGGCTAMAAPAA

SEQ ID NO: 1553857 - protein, 17 aa, Mycobacterium tuberculosis
RLLRLCARYSAHPTVIF

SEQ ID NO: 1553858 - protein, 18 aa, Mycobacterium tuberculosis
RLRCRPVHPQPSLRRRAR

SEQ ID NO: 1553859 - protein, 20 aa, Mycobacterium tuberculosis
RLSDPFITIDAFQVVAGVLF

SEQ ID NO: 1553860 - protein, 25 aa, Mycobacterium tuberculosis
RNPERVWGWYLWRHYLVANVEPNDG

SEQ ID NO: 1553861 - protein, 27 aa, Mycobacterium tuberculosis
RPALPPAPPCPPVWLPCPPSPPAPPAP

SEQ ID NO: 1553862 - protein, 17 aa, Mycobacterium tuberculosis
RPASAGRRRACRSRGAG

SEQ ID NO: 1553863 - protein, 17 aa, Mycobacterium tuberculosis
RPATTRGVEGISCSPQM

SEQ ID NO: 1553864 - protein, 18 aa, Mycobacterium tuberculosis
RPATTRGVEGISCSPQMM

SEQ ID NO: 1553865 - protein, 20 aa, Mycobacterium tuberculosis
RPDGDWGPWYQTEYETEPRD

SEQ ID NO: 1553866 - protein, 18 aa, Mycobacterium tuberculosis
RPGKLAWPTAAGWTSSCR

SEQ ID NO: 1553867 - protein, 22 aa, Mycobacterium tuberculosis
RPGNWAGIYACWGTENREAAVR

SEQ ID NO: 1553868 - protein, 25 aa, Mycobacterium tuberculosis
RPGRCRQCPPGLCHLPGGLRRQRSL

SEQ ID NO: 1553869 - protein, 17 aa, Mycobacterium tuberculosis
RPHTRRWAGPAFLLNQM

SEQ ID NO: 1553870 - protein, 18 aa, Mycobacterium tuberculosis
RPPPAPRLTFRPADSAAD

SEQ ID NO: 1553871 - protein, 25 aa, Mycobacterium tuberculosis
RPRWHRPHCARRCGCFARGPASATG

SEQ ID NO: 1553872 - protein, 18 aa, Mycobacterium tuberculosis
RPSPFYIMDEVEAALDDV

SEQ ID NO: 1553873 - protein, 19 aa, Mycobacterium tuberculosis
RQGYYPGIGAPSWTADYGS

SEQ ID NO: 1553874 - protein, 25 aa, Mycobacterium tuberculosis
RRCGRRRRCRWSRRVAGRQRWQRWQ

SEQ ID NO: 1553875 - protein, 17 aa, Mycobacterium tuberculosis
RRLAGPYAWSNALSAGY

SEQ ID NO: 1553876 - protein, 18 aa, Mycobacterium tuberculosis
RRLRARTGTPAVRAVSAC

SEQ ID NO: 1553877 - protein, 25 aa, Mycobacterium tuberculosis
RRPGRRRRHRCGGRADVGHSARPCF

SEQ ID NO: 1553878 - protein, 18 aa, Mycobacterium tuberculosis
RRPRRSRRGRARRPATAV

SEQ ID NO: 1553879 - protein, 18 aa, Mycobacterium tuberculosis
RRRARGGAGGTVFGSGGA

SEQ ID NO: 1553880 - protein, 19 aa, Mycobacterium tuberculosis
RRRPGWVAPGGQWRFAPGL

SEQ ID NO: 1553881 - protein, 25 aa, Mycobacterium tuberculosis
RRRRHGLRLGRGRRCRRSRHCRWPR

SEQ ID NO: 1553882 - protein, 18 aa, Mycobacterium tuberculosis
RRTGLPGSPTRGPANSIT

SEQ ID NO: 1553883 - protein, 17 aa, Mycobacterium tuberculosis
RSPRLRSPLALMGGDPR

SEQ ID NO: 1553884 - protein, 17 aa, Mycobacterium tuberculosis
RSPRLRSPLGLAGDREP

SEQ ID NO: 1553885 - protein, 20 aa, Mycobacterium tuberculosis
RSRRGRARRPATAVWAATLS

SEQ ID NO: 1553886 - protein, 17 aa, Mycobacterium tuberculosis
RSTLRHSHHLGGIAQTG

SEQ ID NO: 1553887 - protein, 17 aa, Mycobacterium tuberculosis
RSWLRARGLKIFPLVGW

SEQ ID NO: 1553888 - protein, 17 aa, Mycobacterium tuberculosis
RTGKFNRPYLCRSRCVH

SEQ ID NO: 1553889 - protein, 23 aa, Mycobacterium tuberculosis
RTIVELCALWAVHLHFDPSPEPW

SEQ ID NO: 1553890 - protein, 26 aa, Mycobacterium tuberculosis
RTPRCGLCPLDWCAWRHAGYPPSDGP

SEQ ID NO: 1553891 - protein, 18 aa, Mycobacterium tuberculosis
RTRRGCVGKPIGQHHRQG

SEQ ID NO: 1553892 - protein, 23 aa, Mycobacterium tuberculosis
RVYRRLPPCPGWVRPAVSGLPNL

SEQ ID NO: 1553893 - protein, 20 aa, Mycobacterium tuberculosis
RWPRGAGCVCGRPRPPTWSS

SEQ ID NO: 1553894 - protein, 18 aa, Mycobacterium tuberculosis
RWQVRPGPVAARRWDIEP

SEQ ID NO: 1553895 - protein, 27 aa, Mycobacterium tuberculosis
RWRRRIRFCRRRRYRPAPPLAADAAVD

SEQ ID NO: 1553896 - protein, 18 aa, Mycobacterium tuberculosis
SAAIAALFGAHGQAYQTV

SEQ ID NO: 1553897 - protein, 19 aa, Mycobacterium tuberculosis
SAAIAALFSSYARDYQTLS

SEQ ID NO: 1553898 - protein, 19 aa, Mycobacterium tuberculosis
SAAIAGLFGAHARQYQALS

SEQ ID NO: 1553899 - protein, 20 aa, Mycobacterium tuberculosis
SAAVAALFARFGQEYQAVSA

SEQ ID NO: 1553900 - protein, 18 aa, Mycobacterium tuberculosis
SAAVAALFSAHAGQYQQL

SEQ ID NO: 1553901 - protein, 18 aa, Mycobacterium tuberculosis
SAAVAAVFSSYAQQYQAL

SEQ ID NO: 1553902 - protein, 25 aa, Mycobacterium tuberculosis
SAEAAAAEQIVLGVINAPTQALLGR

SEQ ID NO: 1553903 - protein, 19 aa, Mycobacterium tuberculosis
SALLFPSLCHFSGGIPAPE

SEQ ID NO: 1553904 - protein, 21 aa, Mycobacterium tuberculosis
SALLFPSLCHFSGGIPAPEAD

SEQ ID NO: 1553905 - protein, 20 aa, Mycobacterium tuberculosis
SAQMARFHQQFVHALTASVG

SEQ ID NO: 1553906 - protein, 27 aa, Mycobacterium tuberculosis
SASKDVQQQLPAGSPVKKKKKKKKKKK

SEQ ID NO: 1553907 - protein, 18 aa, Mycobacterium tuberculosis
SASLSFSSLSGWARLGLR

SEQ ID NO: 1553908 - protein, 17 aa, Mycobacterium tuberculosis
SCGWRGLNSLPLPGTQG

SEQ ID NO: 1553909 - protein, 21 aa, Mycobacterium tuberculosis
SCPNTRIVLGWLFAGCDGSSI

SEQ ID NO: 1553910 - protein, 19 aa, Mycobacterium tuberculosis
SDLQPGDVLTFYSDASHAG

SEQ ID NO: 1553911 - protein, 17 aa, Mycobacterium tuberculosis
SETWRLYGVAARNDGIA

SEQ ID NO: 1553912 - protein, 22 aa, Mycobacterium tuberculosis
SFSSLSGWARLGLRERFIGLTD

SEQ ID NO: 1553913 - protein, 18 aa, Mycobacterium tuberculosis
SFTIPGFQIRVLLGPAAV

SEQ ID NO: 1553914 - protein, 17 aa, Mycobacterium tuberculosis
SGAGGAGVQCGAGGAGI

SEQ ID NO: 1553915 - protein, 19 aa, Mycobacterium tuberculosis
SGGAARMFAAPAAATAAVT

SEQ ID NO: 1553916 - protein, 21 aa, Mycobacterium tuberculosis
SGGAGGTCGQVVAGGAGISFS

SEQ ID NO: 1553917 - protein, 24 aa, Mycobacterium tuberculosis
SGGIRGPIGLGFRVPCLVISPYSR

SEQ ID NO: 1553918 - protein, 19 aa, Mycobacterium tuberculosis
SGGLFGFGGGRAGHGGLRQ

SEQ ID NO: 1553919 - protein, 20 aa, Mycobacterium tuberculosis
SGLFPFHFTLNGGIGPISIP

SEQ ID NO: 1553920 - protein, 27 aa, Mycobacterium tuberculosis
SGLMNTGFLPFRFQPVYIDYSPSGIGT

SEQ ID NO: 1553921 - protein, 20 aa, Mycobacterium tuberculosis
SGRFCVPVVRTPRPQLTAAF

SEQ ID NO: 1553922 - protein, 17 aa, Mycobacterium tuberculosis
SGSFAIGLAMMLAPMVA

SEQ ID NO: 1553923 - protein, 17 aa, Mycobacterium tuberculosis
SIVSGLRMRPGNWAGIY

SEQ ID NO: 1553924 - protein, 24 aa, Mycobacterium tuberculosis
SLDVPRITILDAHFTGAFRPGGRP

SEQ ID NO: 1553925 - protein, 32 aa, Mycobacterium tuberculosis
SMNCRNGFQWSAHFDPRYGSASKDVQQQLPAG

SEQ ID NO: 1553926 - protein, 25 aa, Mycobacterium tuberculosis
SNGILWRGNFEGLFGLNVGITIPEF

SEQ ID NO: 1553927 - protein, 17 aa, Mycobacterium tuberculosis
SNLARYGIAPTYPGDFA

SEQ ID NO: 1553928 - protein, 19 aa, Mycobacterium tuberculosis
SNTLMGLRCPPWSWRWSLR

SEQ ID NO: 1553929 - protein, 19 aa, Mycobacterium tuberculosis
SPLLAPINEFFLANTGRPL

SEQ ID NO: 1553930 - protein, 19 aa, Mycobacterium tuberculosis
SPRASRPALPPAPPCPPVW

SEQ ID NO: 1553931 - protein, 25 aa, Mycobacterium tuberculosis
SPTQVRWRPFEFLAANGVRSRSDAA

SEQ ID NO: 1553932 - protein, 18 aa, Mycobacterium tuberculosis
SQLPAGVVPTRWTPTMVT

SEQ ID NO: 1553933 - protein, 19 aa, Mycobacterium tuberculosis
SQMSFVIAVPEALTMAASD

SEQ ID NO: 1553934 - protein, 17 aa, Mycobacterium tuberculosis
SRDLLGIALLSNADPAA

SEQ ID NO: 1553935 - protein, 21 aa, Mycobacterium tuberculosis
SRRFCVPVVRTPRPAIDGRFS

SEQ ID NO: 1553936 - protein, 18 aa, Mycobacterium tuberculosis
SSCTWQLSLFIPDGVPPP

SEQ ID NO: 1553937 - protein, 18 aa, Mycobacterium tuberculosis
SSCTWQLSLFITDGVPPP

SEQ ID NO: 1553938 - protein, 20 aa, Mycobacterium tuberculosis
STEVAVERSLLGAVNAPTEA

SEQ ID NO: 1553939 - protein, 20 aa, Mycobacterium tuberculosis
STPFGWTFPYAGPRMHILAT

SEQ ID NO: 1553940 - protein, 17 aa, Mycobacterium tuberculosis
STPGAKGAHGFTPTSGG

SEQ ID NO: 1553941 - protein, 19 aa, Mycobacterium tuberculosis
STWRSVPLVGHIPSAPGNP

SEQ ID NO: 1553942 - protein, 23 aa, Mycobacterium tuberculosis
SVPLVCLLAGLLLAATHGVSGGT

SEQ ID NO: 1553943 - protein, 21 aa, Mycobacterium tuberculosis
SVSIPSWWQPYVLSVASLTSA

SEQ ID NO: 1553944 - protein, 25 aa, Mycobacterium tuberculosis
SYVGRPRPTAPWCSTYVSYLGTSTT

SEQ ID NO: 1553945 - protein, 24 aa, Mycobacterium tuberculosis
TAATANCRSPAGGGTRAAGATVAA

SEQ ID NO: 1553946 - protein, 20 aa, Mycobacterium tuberculosis
TAGDRWQRRGSPPFLMPLGG

SEQ ID NO: 1553947 - protein, 18 aa, Mycobacterium tuberculosis
TAPLTLFGHCMGAIVAFE

SEQ ID NO: 1553948 - protein, 17 aa, Mycobacterium tuberculosis
TARVCWRNAPAPAPAPT

SEQ ID NO: 1553949 - protein, 17 aa, Mycobacterium tuberculosis
TDLSTRCSLPISGLQAI

SEQ ID NO: 1553950 - protein, 25 aa, Mycobacterium tuberculosis
TEFNVALPWRKEVSLSKSSLHPASV

SEQ ID NO: 1553951 - protein, 18 aa, Mycobacterium tuberculosis
TETWINLQVGDCLADLPP

SEQ ID NO: 1553952 - protein, 17 aa, Mycobacterium tuberculosis
TGAAWNVGSFNFGTANA

SEQ ID NO: 1553953 - protein, 21 aa, Mycobacterium tuberculosis
TGDHQMGFGGFNSGSGNIGFG

SEQ ID NO: 1553954 - protein, 28 aa, Mycobacterium tuberculosis
TGGAGGAGGWLFGVGGAGGVGGAGGGTG

SEQ ID NO: 1553955 - protein, 23 aa, Mycobacterium tuberculosis
TGGNGALLFGFRGAGGAGGHGGA

SEQ ID NO: 1553956 - protein, 17 aa, Mycobacterium tuberculosis
TGGTGFSGGAGGAGGAG

SEQ ID NO: 1553957 - protein, 23 aa, Mycobacterium tuberculosis
TGLPELGAWLAGAARFTVVTHAA

SEQ ID NO: 1553958 - protein, 23 aa, Mycobacterium tuberculosis
TGPIVIGSFFLPAFNIPGIDVPA

SEQ ID NO: 1553959 - protein, 18 aa, Mycobacterium tuberculosis
TGRRARMPAPRRPMSSSR

SEQ ID NO: 1553960 - protein, 17 aa, Mycobacterium tuberculosis
TGWQWLGPSSVRMGAAV

SEQ ID NO: 1553961 - protein, 17 aa, Mycobacterium tuberculosis
TIDLPVPDDWRLLPESS

SEQ ID NO: 1553962 - protein, 18 aa, Mycobacterium tuberculosis
TIPAQTPVTLGLSGGNDP

SEQ ID NO: 1553963 - protein, 20 aa, Mycobacterium tuberculosis
TIPEIHIPKIPIDVLGSVGL

SEQ ID NO: 1553964 - protein, 26 aa, Mycobacterium tuberculosis
TIPEIPYRYDLSVPIDIPITGTVVAT

SEQ ID NO: 1553965 - protein, 17 aa, Mycobacterium tuberculosis
TLFRRLAVFVGCFFVDD

SEQ ID NO: 1553966 - protein, 17 aa, Mycobacterium tuberculosis
TLKKLSGLRARNGLLTA

SEQ ID NO: 1553967 - protein, 23 aa, Mycobacterium tuberculosis
TLKKLSGLRARNGLLTASGDNAS

SEQ ID NO: 1553968 - protein, 24 aa, Mycobacterium tuberculosis
TMTGPRPGGFGALDGRTNEICAQG

SEQ ID NO: 1553969 - protein, 19 aa, Mycobacterium tuberculosis
TMVIPPIVFLPSMTIGGQT

SEQ ID NO: 1553970 - protein, 20 aa, Mycobacterium tuberculosis
TNPGTLMWWIARSLELLQDF

SEQ ID NO: 1553971 - protein, 17 aa, Mycobacterium tuberculosis
TPAALYWGARLTLVSRV

SEQ ID NO: 1553972 - protein, 41 aa, Mycobacterium tuberculosis
TPRPLAHIALASGCCDLAGCVLAAWGWVVMSFVVAVPEALA

SEQ ID NO: 1553973 - protein, 17 aa, Mycobacterium tuberculosis
TQLPNWWGPILAPALAG

SEQ ID NO: 1553974 - protein, 25 aa, Mycobacterium tuberculosis
TREAYRIGGDWVQYRSYPGIGTKQP

SEQ ID NO: 1553975 - protein, 20 aa, Mycobacterium tuberculosis
TRRKGRLAALAIAAMASASL

SEQ ID NO: 1553976 - protein, 17 aa, Mycobacterium tuberculosis
TRVPEFLERLGVGAPEA

SEQ ID NO: 1553977 - protein, 17 aa, Mycobacterium tuberculosis
TSCLSGLGYPASTPVLG

SEQ ID NO: 1553978 - protein, 22 aa, Mycobacterium tuberculosis
TVPVGILCLEFLVHAWDFAIAT

SEQ ID NO: 1553979 - protein, 17 aa, Mycobacterium tuberculosis
VAAEGMVAVAAVAAVAA

SEQ ID NO: 1553980 - protein, 18 aa, Mycobacterium tuberculosis
VAASGMWPSPANSPDVGS

SEQ ID NO: 1553981 - protein, 20 aa, Mycobacterium tuberculosis
VAATGRPLIGNGANGAPGTG

SEQ ID NO: 1553982 - protein, 18 aa, Mycobacterium tuberculosis
VAGRMMGRLGWYVESMLS

SEQ ID NO: 1553983 - protein, 22 aa, Mycobacterium tuberculosis
VAGWWTPPAWAIGPPVVDAAAQ

SEQ ID NO: 1553984 - protein, 18 aa, Mycobacterium tuberculosis
VAPVRAGPVVPRASSSAP

SEQ ID NO: 1553985 - protein, 18 aa, Mycobacterium tuberculosis
VARAGCYSAKMGCPGRER

SEQ ID NO: 1553986 - protein, 17 aa, Mycobacterium tuberculosis
VATEVRAALAAMVLPAS

SEQ ID NO: 1553987 - protein, 21 aa, Mycobacterium tuberculosis
VCLLTAFLLIAVFGEVRFGDG

SEQ ID NO: 1553988 - protein, 20 aa, Mycobacterium tuberculosis
VCRGPNLGWRVVRGRRDRQR

SEQ ID NO: 1553989 - protein, 18 aa, Mycobacterium tuberculosis
VDKFPRMVDYVVPTGVRI

SEQ ID NO: 1553990 - protein, 21 aa, Mycobacterium tuberculosis
VGAAARGGRRLVIAMMYGLVK

SEQ ID NO: 1553991 - protein, 18 aa, Mycobacterium tuberculosis
VGGKVMLFGAERLLASSG

SEQ ID NO: 1553992 - protein, 19 aa, Mycobacterium tuberculosis
VGGLYVHWIVTGIAPGSGS

SEQ ID NO: 1553993 - protein, 20 aa, Mycobacterium tuberculosis
VGPRQWRWPLGEIDRPFEMR

SEQ ID NO: 1553994 - protein, 18 aa, Mycobacterium tuberculosis
VGVFFLFFCVSARPTRSA

SEQ ID NO: 1553995 - protein, 18 aa, Mycobacterium tuberculosis
VGVPDARCVLPLAHRVTQ

SEQ ID NO: 1553996 - protein, 20 aa, Mycobacterium tuberculosis
VIDMPLPISLGVNIPIDIPI

SEQ ID NO: 1553997 - protein, 23 aa, Mycobacterium tuberculosis
VIVAPMFHAWGFSQLVLASSLAC

SEQ ID NO: 1553998 - protein, 23 aa, Mycobacterium tuberculosis
VKANLFYRGLRFHRFPAVGDTLY

SEQ ID NO: 1553999 - protein, 17 aa, Mycobacterium tuberculosis
VLACPLAGPAGPAAPGG

SEQ ID NO: 1554000 - protein, 26 aa, Mycobacterium tuberculosis
VLRYPRPRLGAGFDRPVQRWQAGHQY

SEQ ID NO: 1554001 - protein, 17 aa, Mycobacterium tuberculosis
VNLKLQFLHDAFPNEFP

SEQ ID NO: 1554002 - protein, 21 aa, Mycobacterium tuberculosis
VPGRGTTFCTAGMVPPWNPAV

SEQ ID NO: 1554003 - protein, 19 aa, Mycobacterium tuberculosis
VPLILRLDPKIGLPDIRAV

SEQ ID NO: 1554004 - protein, 21 aa, Mycobacterium tuberculosis
VPRRCCRPGCPHYAVATLTFV

SEQ ID NO: 1554005 - protein, 17 aa, Mycobacterium tuberculosis
VQALNMGAVCYAAAETA

SEQ ID NO: 1554006 - protein, 19 aa, Mycobacterium tuberculosis
VQALNMGAVCYAAAETANA

SEQ ID NO: 1554007 - protein, 23 aa, Mycobacterium tuberculosis
VQDPFGGIVFRLPGGHRNRQAAG

SEQ ID NO: 1554008 - protein, 24 aa, Mycobacterium tuberculosis
VRAKRPDGDWGPWYQTEYETEPRD

SEQ ID NO: 1554009 - protein, 23 aa, Mycobacterium tuberculosis
VRTFARRRIDAILADVAPADGPD

SEQ ID NO: 1554010 - protein, 17 aa, Mycobacterium tuberculosis
VRVVEAFADRPDQPLRE

SEQ ID NO: 1554011 - protein, 17 aa, Mycobacterium tuberculosis
VRYSVRFAKPVLLPATA

SEQ ID NO: 1554012 - protein, 20 aa, Mycobacterium tuberculosis
VSAAIAALFSAHGRAYQVAS

SEQ ID NO: 1554013 - protein, 21 aa, Mycobacterium tuberculosis
VSAALASLFSGHAVSYQQVAA

SEQ ID NO: 1554014 - protein, 20 aa, Mycobacterium tuberculosis
VSAAVAALFGSYAQSYQAFG

SEQ ID NO: 1554015 - protein, 24 aa, Mycobacterium tuberculosis
VSHYDVYPAFGFRFDLKKSGVSVT

SEQ ID NO: 1554016 - protein, 21 aa, Mycobacterium tuberculosis
VSIAVAALFGMHGQAYQALSV

SEQ ID NO: 1554017 - protein, 22 aa, Mycobacterium tuberculosis
VSIAVAALFGMHGQAYQALSVQ

SEQ ID NO: 1554018 - protein, 17 aa, Mycobacterium tuberculosis
VSISCRVREGFVMRLAI

SEQ ID NO: 1554019 - protein, 21 aa, Mycobacterium tuberculosis
VSLAISALFGQHAQAYQALSA

SEQ ID NO: 1554020 - protein, 23 aa, Mycobacterium tuberculosis
VSLAISALFGQHAQAYQALSAQA

SEQ ID NO: 1554021 - protein, 24 aa, Mycobacterium tuberculosis
VSRVLGCLVTAVTVATVVTLGPAA

SEQ ID NO: 1554022 - protein, 20 aa, Mycobacterium tuberculosis
VSVLIAALFEAYAQEYQALS

SEQ ID NO: 1554023 - protein, 17 aa, Mycobacterium tuberculosis
VVAAMHWDGPKAQVIGL

SEQ ID NO: 1554024 - protein, 23 aa, Mycobacterium tuberculosis
VVMVAGVILWRFFGDALSNRSHT

SEQ ID NO: 1554025 - protein, 18 aa, Mycobacterium tuberculosis
VVRTPRPQLTAAFGGALW

SEQ ID NO: 1554026 - protein, 25 aa, Mycobacterium tuberculosis
WAARARWANPAAWRLPGDDVTALRG

SEQ ID NO: 1554027 - protein, 25 aa, Mycobacterium tuberculosis
WCMPACWRKTTLRVWVWSPTNPGAS

SEQ ID NO: 1554028 - protein, 18 aa, Mycobacterium tuberculosis
WGGSGRWYRAPGPPTVVP

SEQ ID NO: 1554029 - protein, 19 aa, Mycobacterium tuberculosis
WKTAGDRRGLVWGNGGTGG

SEQ ID NO: 1554030 - protein, 17 aa, Mycobacterium tuberculosis
WLYGNWGSDGILGAGLL

SEQ ID NO: 1554031 - protein, 18 aa, Mycobacterium tuberculosis
WMLSCGPSTCARGGTVSE

SEQ ID NO: 1554032 - protein, 22 aa, Mycobacterium tuberculosis
WQRRGSPPFLMPLGGAGGGGDR

SEQ ID NO: 1554033 - protein, 17 aa, Mycobacterium tuberculosis
WRLSGLGLRVIAHDPYR

SEQ ID NO: 1554034 - protein, 19 aa, Mycobacterium tuberculosis
WRSAGLPAYRWPDPNGTRF

SEQ ID NO: 1554035 - protein, 20 aa, Mycobacterium tuberculosis
WRTRATTARECSIRVIISRV

SEQ ID NO: 1554036 - protein, 17 aa, Mycobacterium tuberculosis
WSAPRLHLVDLQYSDVR

SEQ ID NO: 1554037 - protein, 18 aa, Mycobacterium tuberculosis
WSARGVDVTPFFAVLNGP

SEQ ID NO: 1554038 - protein, 19 aa, Mycobacterium tuberculosis
WTIPAQTPVTLGLSGGNDP

SEQ ID NO: 1554039 - protein, 18 aa, Mycobacterium tuberculosis
WVAAAGIVIAVIGYQRIS

SEQ ID NO: 1554040 - protein, 21 aa, Mycobacterium tuberculosis
YAEGRLGWRTLDFEVEVLPIG

SEQ ID NO: 1554041 - protein, 18 aa, Mycobacterium tuberculosis
YFKYHVFDEGLGFDPIEC

SEQ ID NO: 1554042 - protein, 17 aa, Mycobacterium tuberculosis
YIGNLLLYFQPDATVTM

SEQ ID NO: 1554043 - protein, 17 aa, Mycobacterium tuberculosis
YISALALLAKREQWAEF

SEQ ID NO: 1554044 - protein, 17 aa, Mycobacterium tuberculosis
YISTELISGGRTGKFNR

SEQ ID NO: 1554045 - protein, 18 aa, Mycobacterium tuberculosis
YLALEWLDRMDLVNGKLI

SEQ ID NO: 1554046 - protein, 24 aa, Mycobacterium tuberculosis
YNAVEPWVQYGFNFTAWAVGWLPY

SEQ ID NO: 1554047 - protein, 20 aa, Mycobacterium tuberculosis
YPLFNLWGPAFHERYPNVTI

SEQ ID NO: 1554048 - protein, 18 aa, Mycobacterium tuberculosis
YPRNGWPALFHVRSGASL

SEQ ID NO: 1554049 - protein, 17 aa, Mycobacterium tuberculosis
YQALSARVATFHEQFVR

SEQ ID NO: 1554050 - protein, 18 aa, Mycobacterium tuberculosis
YQILQPWVDAAFKKRGID

SEQ ID NO: 1554051 - protein, 19 aa, Mycobacterium tuberculosis
YRELGHWQLGQQIKRPRRP

SEQ ID NO: 1554052 - protein, 17 aa, Mycobacterium tuberculosis
YRGVGQGSLQFSITTPD

SEQ ID NO: 1554053 - protein, 26 aa, Mycobacterium tuberculosis
YSNGILWRGDYQGLIGYSYALTIPEI

SEQ ID NO: 1554054 - protein, 20 aa, Mycobacterium tuberculosis
YSNGLLWRGGYEGLVGVRVG

SEQ ID NO: 1554055 - protein, 18 aa, Mycobacterium tuberculosis
YTCLYRSLLHPNTFNDVD

SEQ ID NO: 1554056 - protein, 21 aa, Mycobacterium tuberculosis
YYRRAEICRERLGPVLRRLTV

SEQ ID NO: 1554057 - protein, 19 aa, Mycobacterium tuberculosis
YYWCPGQPFDPAWGPNWDP

SEQ ID NO: 1554058 - protein, 28 aa, Mycobacterium tuberculosis
LAECAGLHDPYFDFILDRPDASTVRIGA

SEQ ID NO: 1554059 - protein, 25 aa, Mycobacterium tuberculosis
AAAKYWRQQTYDDCVLMSAADVIGQ

SEQ ID NO: 1554060 - protein, 26 aa, Mycobacterium tuberculosis
AAGAVVAAALRAIRAAAAPGTSSLSL

SEQ ID NO: 1554061 - protein, 24 aa, Mycobacterium tuberculosis
AAGVITIAVALAAPPPAAHAKNGD

SEQ ID NO: 1554062 - protein, 17 aa, Mycobacterium tuberculosis
AALFARFGQEYQAVSAQ

SEQ ID NO: 1554063 - protein, 19 aa, Mycobacterium tuberculosis
AFKTATFALAAGAVALGLA

SEQ ID NO: 1554064 - protein, 18 aa, Mycobacterium tuberculosis
AHMVLTVNGKIPGLSLKT

SEQ ID NO: 1554065 - protein, 23 aa, Mycobacterium tuberculosis
AKAVEALRRSDFGGRIILFGDEE

SEQ ID NO: 1554066 - protein, 24 aa, Mycobacterium tuberculosis
ALARQFVAMVTAAAGRRILDQSGF

SEQ ID NO: 1554067 - protein, 17 aa, Mycobacterium tuberculosis
ALMLFQIRQADGSVTRF

SEQ ID NO: 1554068 - protein, 19 aa, Mycobacterium tuberculosis
ALYSPNLWQHLTDGLSELV

SEQ ID NO: 1554069 - protein, 23 aa, Mycobacterium tuberculosis
ANDPQAIYLNYIGSAGGVFQRDG

SEQ ID NO: 1554070 - protein, 24 aa, Mycobacterium tuberculosis
APREPYVHWIVIGIAPGAGSTADG

SEQ ID NO: 1554071 - protein, 24 aa, Mycobacterium tuberculosis
ASEIYPPLKAWQRMGRPTIAVNAN

SEQ ID NO: 1554072 - protein, 21 aa, Mycobacterium tuberculosis
ASELFFGRPAPTPQQWLQIVT

SEQ ID NO: 1554073 - protein, 26 aa, Mycobacterium tuberculosis
ASGQPLPEFLSAEIFQPLGLAMVVDP

SEQ ID NO: 1554074 - protein, 24 aa, Mycobacterium tuberculosis
AVKGGVPFLPLNRIPQLAGSINDI

SEQ ID NO: 1554075 - protein, 19 aa, Mycobacterium tuberculosis
AVLSAQPVYFDYWSARGVD

SEQ ID NO: 1554076 - protein, 23 aa, Mycobacterium tuberculosis
AVVPHAVLVLSACGFKPGFPMAE

SEQ ID NO: 1554077 - protein, 25 aa, Mycobacterium tuberculosis
CQTYKWETFLTSELPQWLSANRAVK

SEQ ID NO: 1554078 - protein, 18 aa, Mycobacterium tuberculosis
CYLLAFLGGSAVAWVVVT

SEQ ID NO: 1554079 - protein, 23 aa, Mycobacterium tuberculosis
DAARLLTERFAAPLLLSSRTTEH

SEQ ID NO: 1554080 - protein, 29 aa, Mycobacterium tuberculosis
DAQRILFHDMPVVPLWDYISVVGWSSQVS

SEQ ID NO: 1554081 - protein, 23 aa, Mycobacterium tuberculosis
DASQQVFGFAPYPAVAPGQPAKV

SEQ ID NO: 1554082 - protein, 26 aa, Mycobacterium tuberculosis
DDPEFHPPRLGDLKRSCLDIGLAERV

SEQ ID NO: 1554083 - protein, 31 aa, Mycobacterium tuberculosis; identical to SEQ ID NO: 236241

SEQ ID NO: 1554084 - protein, 28 aa, Mycobacterium tuberculosis
DGVLVWTMSNPRWTCDYGLAVVPHAVLV

SEQ ID NO: 1554085 - protein, 24 aa, Mycobacterium tuberculosis
DINTPAFEWYYQSGLSIVMPVGGQ

SEQ ID NO: 1554086 - protein, 31 aa, Mycobacterium tuberculosis; identical to SEQ ID NO: 236251

SEQ ID NO: 1554087 - protein, 17 aa, Mycobacterium tuberculosis
DMHMAIASALNMYDNVL

SEQ ID NO: 1554088 - protein, 18 aa, Mycobacterium tuberculosis
DPFLPNEGAPGRGPLLAA

SEQ ID NO: 1554089 - protein, 24 aa, Mycobacterium tuberculosis
DVAALALIRFPATGDKIGSLVINP

SEQ ID NO: 1554090 - protein, 21 aa, Mycobacterium tuberculosis
EAALGVFQTLPKRVHERFDLV

SEQ ID NO: 1554091 - protein, 19 aa, Mycobacterium tuberculosis
EIYLNTFRHLYGLDCSHIA

SEQ ID NO: 1554092 - protein, 27 aa, Mycobacterium tuberculosis
ETGSTLLYPLFNLWGPAFHERYPNVTI

SEQ ID NO: 1554093 - protein, 17 aa, Mycobacterium tuberculosis
EVLNRVLTDLPPLIKHF

SEQ ID NO: 1554094 - protein, 20 aa, Mycobacterium tuberculosis
FGYQLTFFRRALAPPGEGVA

SEQ ID NO: 1554095 - protein, 25 aa, Mycobacterium tuberculosis
GAASGLPIALWSKPAQGIKQIINEI

SEQ ID NO: 1554096 - protein, 23 aa, Mycobacterium tuberculosis
GGILGVLHMGLPTGLSISGYSGG

SEQ ID NO: 1554097 - protein, 20 aa, Mycobacterium tuberculosis
GGRIILFGDEEHLPYDRPPL

SEQ ID NO: 1554098 - protein, 17 aa, Mycobacterium tuberculosis
GLILFASATWRARPRLA

SEQ ID NO: 1554099 - protein, 25 aa, Mycobacterium tuberculosis
GLVSQFFGKYFTPEQARQLIAEQAA

SEQ ID NO: 1554100 - protein, 26 aa, Mycobacterium tuberculosis
GRPGEYAELPYLFTDQYDLGMEYVGH

SEQ ID NO: 1554101 - protein, 25 aa, Mycobacterium tuberculosis
GSPNEYVVGWIKRGPTGVIGTNKKD

SEQ ID NO: 1554102 - protein, 26 aa, Mycobacterium tuberculosis
GWDETVFFRNGDPFIWDRGRELGMVN

SEQ ID NO: 1554103 - protein, 18 aa, Mycobacterium tuberculosis
GWLRAKTGSLTAINSLVG

SEQ ID NO: 1554104 - protein, 24 aa, Mycobacterium tuberculosis
HGEAGVVAIFAQALLSGKPTRVFG

SEQ ID NO: 1554105 - protein, 28 aa, Mycobacterium tuberculosis
HGLTEEPRLFYMHYWAVDDAVTLARALR

SEQ ID NO: 1554106 - protein, 25 aa, Mycobacterium tuberculosis
HHYRFTLYHLPAVPPLAGLAGTQAA

SEQ ID NO: 1554107 - protein, 27 aa, Mycobacterium tuberculosis
IAGLPIPPIIHYGAIAYAPSGASGKAW

SEQ ID NO: 1554108 - protein, 22 aa, Mycobacterium tuberculosis
IDADFVVFDGILYATLTPNQWS

SEQ ID NO: 1554109 - protein, 19 aa, Mycobacterium tuberculosis
IDNAFLTGTGFSGALRALE

SEQ ID NO: 1554110 - protein, 19 aa, Mycobacterium tuberculosis
IGRQMHMDPFLPNEGAPGR

SEQ ID NO: 1554111 - protein, 17 aa, Mycobacterium tuberculosis
IIAAFTTAVGAAAIGLA

SEQ ID NO: 1554112 - protein, 31 aa, Mycobacterium tuberculosis; identical to SEQ ID NO: 236530

SEQ ID NO: 1554113 - protein, 27 aa, Mycobacterium tuberculosis
IPVSALEGLLLDLSQINAALGATSMKV

SEQ ID NO: 1554114 - protein, 27 aa, Mycobacterium tuberculosis
IRESGATPSFLGYHGYPASICASINDR

SEQ ID NO: 1554115 - protein, 28 aa, Mycobacterium tuberculosis
ISRGPDPLGVLYWQVPKGSTLDSTIGQT

SEQ ID NO: 1554116 - protein, 18 aa, Mycobacterium tuberculosis
KFAAFLRGVNVGGVNLKM

SEQ ID NO: 1554117 - protein, 20 aa, Mycobacterium tuberculosis
KNEFIPRPIEYTWNGTQWVR

SEQ ID NO: 1554118 - protein, 19 aa, Mycobacterium tuberculosis
KPRNKGLRFEFYANLDTAY

SEQ ID NO: 1554119 - protein, 24 aa, Mycobacterium tuberculosis
KRSCLDIGLAERVLGWRPQIELAD

SEQ ID NO: 1554120 - protein, 18 aa, Mycobacterium tuberculosis
LLAKMRSASRRALTSLVD

SEQ ID NO: 1554121 - protein, 28 aa, Mycobacterium tuberculosis
LLASGAATALIAIPTACSFSIGTSHSHS

SEQ ID NO: 1554122 - protein, 26 aa, Mycobacterium tuberculosis
LLSIPTSPFAISTYFSALLADPTTTP

SEQ ID NO: 1554123 - protein, 20 aa, Mycobacterium tuberculosis
LNRVLTDLPPLIKHFADKQE

SEQ ID NO: 1554124 - protein, 18 aa, Mycobacterium tuberculosis
LSAIAALALVVAYQTLGS

SEQ ID NO: 1554125 - protein, 30 aa, Mycobacterium tuberculosis; identical to SEQ ID NO: 237334

SEQ ID NO: 1554126 - protein, 27 aa, Mycobacterium tuberculosis
LWSSLTTMILPVGGAPYVLRPKSRQDY

SEQ ID NO: 1554127 - protein, 26 aa, Mycobacterium tuberculosis
MARTVRNLLAPPLRLRGPVTRADGGK

SEQ ID NO: 1554128 - protein, 26 aa, Mycobacterium tuberculosis
MAVDMLEMLPTPWGLVRSGVAPDHPK

SEQ ID NO: 1554129 - protein, 25 aa, Mycobacterium tuberculosis
MRRRSTMYLTYWTAGDTRNRGREML

SEQ ID NO: 1554130 - protein, 25 aa, Mycobacterium tuberculosis
NGQAYQFPMGLGLVSQFFGKYFTPE

SEQ ID NO: 1554131 - protein, 17 aa, Mycobacterium tuberculosis
NITRLPVRYTFDNRYFS

SEQ ID NO: 1554132 - protein, 20 aa, Mycobacterium tuberculosis
PLHQDPIPVSALEGLLLDLS

SEQ ID NO: 1554133 - protein, 20 aa, Mycobacterium tuberculosis
PNEGAPGRGPLLAAGSVLAI

SEQ ID NO: 1554134 - protein, 17 aa, Mycobacterium tuberculosis
PPECSAALLFKGSPLRP

SEQ ID NO: 1554135 - protein, 26 aa, Mycobacterium tuberculosis
PRSMLFPHLYGPLPVRAVIGAAAYPP

SEQ ID NO: 1554136 - protein, 18 aa, Mycobacterium tuberculosis
QGPAGWLRAKTGSLTAIN

SEQ ID NO: 1554137 - protein, 18 aa, Mycobacterium tuberculosis
QIVPYLRSWESVIGHQRT

SEQ ID NO: 1554138 - protein, 33 aa, Mycobacterium tuberculosis; identical to SEQ ID NO: 236802

SEQ ID NO: 1554139 - protein, 26 aa, Mycobacterium tuberculosis
RCVEVPFAIDFPLTYRLGRRHNTPVR

SEQ ID NO: 1554140 - protein, 21 aa, Mycobacterium tuberculosis
RWTIAILAVVAALMAALVAQL

SEQ ID NO: 1554141 - protein, 17 aa, Mycobacterium tuberculosis
RYFDYAEGRLGWRTLDF

SEQ ID NO: 1554142 - protein, 19 aa, Mycobacterium tuberculosis
SNYLLLGEIVHRASGQPLP

SEQ ID NO: 1554143 - protein, 24 aa, Mycobacterium tuberculosis
SSALLAGCQFGGLNSLPLPGTAGH

SEQ ID NO: 1554144 - protein, 24 aa, Mycobacterium tuberculosis
SVQIDHIVPLSYAWDMGAYRWPNS

SEQ ID NO: 1554145 - protein, 18 aa, Mycobacterium tuberculosis
SWSSCSNRRFVEVTPGQD

SEQ ID NO: 1554146 - protein, 21 aa, Mycobacterium tuberculosis
TAALLGIAALLAGCIKPNTFD

SEQ ID NO: 1554147 - protein, 26 aa, Mycobacterium tuberculosis
TCKGANIAPPLTWSAPFGGALVVDDP

SEQ ID NO: 1554148 - protein, 20 aa, Mycobacterium tuberculosis
TDRSGRVLTFAFISNEAGPN

SEQ ID NO: 1554149 - protein, 24 aa, Mycobacterium tuberculosis
TPMRLRYFATLSDGVLVWTMSNPR

SEQ ID NO: 1554150 - protein, 28 aa, Mycobacterium tuberculosis
TQAGQFALTYPRRLGFGLGSSVVSLSWR

SEQ ID NO: 1554151 - protein, 24 aa, Mycobacterium tuberculosis
TTNTQLLWYRPDLVNSPPTDWNAM

SEQ ID NO: 1554152 - protein, 24 aa, Mycobacterium tuberculosis
VAGREFLSFWLDGDSRVLAGMNVN

SEQ ID NO: 1554153 - protein, 29 aa, Mycobacterium tuberculosis
VDHYAEIGLLGFALIADALGGVDVCLKEP

SEQ ID NO: 1554154 - protein, 27 aa, Mycobacterium tuberculosis
VGDQRLRIDLSALRIIGDGLAWAPAGF

SEQ ID NO: 1554155 - protein, 28 aa, Mycobacterium tuberculosis
VGWDWFGLQFYNGTALMLFQIRQADGSV

SEQ ID NO: 1554156 - protein, 18 aa, Mycobacterium tuberculosis
VKIPGGALCGKLAVPVDY

SEQ ID NO: 1554157 - protein, 18 aa, Mycobacterium tuberculosis
VLAIEPMLTLGTTKTVVL

SEQ ID NO: 1554158 - protein, 26 aa, Mycobacterium tuberculosis
VLSSGWDIMDFVRQLQKLAGGNVAFA

SEQ ID NO: 1554159 - protein, 19 aa, Mycobacterium tuberculosis
WLQIVTELAPVFKAAGFRP

SEQ ID NO: 1554160 - protein, 33 aa, Mycobacterium tuberculosis; identical to SEQ ID NO: 237094

SEQ ID NO: 1554161 - protein, 18 aa, Mycobacterium tuberculosis
WQRLDDVPLVPASTNKIL

SEQ ID NO: 1554162 - protein, 17 aa, Mycobacterium tuberculosis
WYNAHPHFEQVSPDLSG

SEQ ID NO: 1554163 - protein, 19 aa, Mycobacterium tuberculosis
YATLTPNQWSDFGPAADIY

SEQ ID NO: 1554164 - protein, 19 aa, Mycobacterium tuberculosis
YQALSIRLAAVLSPITEID

SEQ ID NO: 1554165 - protein, 18 aa, Mycobacterium tuberculosis
YRGRADLVLLYIDPAALD

SEQ ID NO: 1554166 - protein, 19 aa, Mycobacterium tuberculosis
AAASPYVGWLSTVASQAQL

SEQ ID NO: 1554167 - protein, 27 aa, Mycobacterium tuberculosis
AAESLWALLARVLPEPWRVEALVLLAF

SEQ ID NO: 1554168 - protein, 22 aa, Mycobacterium tuberculosis
AALITALLVLTGCTKSISGTAV

SEQ ID NO: 1554169 - protein, 30 aa, Mycobacterium tuberculosis; identical to SEQ ID NO: 236105

SEQ ID NO: 1554170 - protein, 28 aa, Mycobacterium tuberculosis
AIGRIRAMHMALLPDRVPAAEALSWGLV

SEQ ID NO: 1554171 - protein, 24 aa, Mycobacterium tuberculosis
AIPGGQFRWLTVDLPPIVDLRTRL

SEQ ID NO: 1554172 - protein, 19 aa, Mycobacterium tuberculosis
AIRGNRVLIGFSLPGKTIG

SEQ ID NO: 1554173 - protein, 30 aa, Mycobacterium tuberculosis; identical to SEQ ID NO: 236123

SEQ ID NO: 1554174 - protein, 25 aa, Mycobacterium tuberculosis
ALAAATPMVVWLQTASTQAKTRAMQ

SEQ ID NO: 1554175 - protein, 27 aa, Mycobacterium tuberculosis
ALAALLAVAGLFVPFIVGVPTAYDGEP

SEQ ID NO: 1554176 - protein, 25 aa, Mycobacterium tuberculosis
ALAGRRVVINLWAHWCAPCMTELPV

SEQ ID NO: 1554177 - protein, 23 aa, Mycobacterium tuberculosis
ALDRVSAFQLGFINGTPACAAID

SEQ ID NO: 1554178 - protein, 19 aa, Mycobacterium tuberculosis
ALSQPLTDLSTRCSLPISG

SEQ ID NO: 1554179 - protein, 17 aa, Mycobacterium tuberculosis
ALVLVGCIRVVGGRARM

SEQ ID NO: 1554180 - protein, 17 aa, Mycobacterium tuberculosis
APKWWFTVGGQVRPGER

SEQ ID NO: 1554181 - protein, 22 aa, Mycobacterium tuberculosis
APTETLLGRPLIGDGAPGTATS

SEQ ID NO: 1554182 - protein, 29 aa, Mycobacterium tuberculosis
APTVALTAYLRALPADGWLRVLCTCVEIG

SEQ ID NO: 1554183 - protein, 17 aa, Mycobacterium tuberculosis
APWAPFAVDFHLANVGG

SEQ ID NO: 1554184 - protein, 17 aa, Mycobacterium tuberculosis
ARITLTNAAAILDNAAA

SEQ ID NO: 1554185 - protein, 24 aa, Mycobacterium tuberculosis
ASDNAFFMLAHTNVGLMPDGGASA

SEQ ID NO: 1554186 - protein, 21 aa, Mycobacterium tuberculosis
ATMFVALLGLSTISSKADDID

SEQ ID NO: 1554187 - protein, 18 aa, Mycobacterium tuberculosis
ATVALSLALAGCSFNIKT

SEQ ID NO: 1554188 - protein, 20 aa, Mycobacterium tuberculosis
AVALFIAAIVVLVVAIRRPK

SEQ ID NO: 1554189 - protein, 20 aa, Mycobacterium tuberculosis
AVLTATNFFGINTIPIALTE

SEQ ID NO: 1554190 - protein, 18 aa, Mycobacterium tuberculosis
AWEGLAADLWASASSFES

SEQ ID NO: 1554191 - protein, 19 aa, Mycobacterium tuberculosis
CSVLALGLLAGCAPPRTGP

SEQ ID NO: 1554192 - protein, 22 aa, Mycobacterium tuberculosis
CVAYIGISFLDQASQRGLGEAQ

SEQ ID NO: 1554193 - protein, 24 aa, Mycobacterium tuberculosis
DEVSALQAALFTAYGTFYQQVSAE

SEQ ID NO: 1554194 - protein, 22 aa, Mycobacterium tuberculosis
DLGVITAIPQPLRALAHTRGVR

SEQ ID NO: 1554195 - protein, 25 aa, Mycobacterium tuberculosis
DNLTVLRTLLRLMDRDPDDFDHVTD

SEQ ID NO: 1554196 - protein, 25 aa, Mycobacterium tuberculosis
DPANPAFRDGAAPKWWFTVGGQVRP

SEQ ID NO: 1554197 - protein, 20 aa, Mycobacterium tuberculosis
DQVADWLAARQPKLVTSAHW

SEQ ID NO: 1554198 - protein, 24 aa, Mycobacterium tuberculosis
DRDVASVFLPLQRVLGCQQNTAGS

SEQ ID NO: 1554199 - protein, 25 aa, Mycobacterium tuberculosis
DSVVPLIVNLYAFGARDFDLKSALH

SEQ ID NO: 1554200 - protein, 17 aa, Mycobacterium tuberculosis
DVDYPLLAKMRSASRRA

SEQ ID NO: 1554201 - protein, 25 aa, Mycobacterium tuberculosis
EARRHGWTFPYLYDETQDVARAFSA

SEQ ID NO: 1554202 - protein, 18 aa, Mycobacterium tuberculosis
EFYLVHRTRRFEPAVQGR

SEQ ID NO: 1554203 - protein, 24 aa, Mycobacterium tuberculosis
EINWIRGFLPPLPPISPPGFPSLP

SEQ ID NO: 1554204 - protein, 27 aa, Mycobacterium tuberculosis
ELSALGTLRLIQAFTPALAQSHGAIVN

SEQ ID NO: 1554205 - protein, 27 aa, Mycobacterium tuberculosis
ENFWRSAGLPEFRWPDPNGTRFPNGAP

SEQ ID NO: 1554206 - protein, 23 aa, Mycobacterium tuberculosis
EVDKLISRLLAGPALAIAKTKNA

SEQ ID NO: 1554207 - protein, 29 aa, Mycobacterium tuberculosis
EVEDQLFRFSRILDVQPRLAILLGDCAVP

SEQ ID NO: 1554208 - protein, 30 aa, Mycobacterium tuberculosis; identical to SEQ ID NO: 236328

SEQ ID NO: 1554209 - protein, 27 aa, Mycobacterium tuberculosis
FLREVQDVWIWVRPYFDDRATAAAKQL

SEQ ID NO: 1554210 - protein, 30 aa, Mycobacterium tuberculosis; identical to SEQ ID NO: 236339

SEQ ID NO: 1554211 - protein, 24 aa, Mycobacterium tuberculosis
GADPLWFTSLFSQHTLDLLELGLG

SEQ ID NO: 1554212 - protein, 21 aa, Mycobacterium tuberculosis
GAKLRCRLTDGSKTYGISVIV

SEQ ID NO: 1554213 - protein, 28 aa, Mycobacterium tuberculosis
GDPGSPTIDLPVPDDWRLLPESSRAPYG

SEQ ID NO: 1554214 - protein, 27 aa, Mycobacterium tuberculosis
GEPAPAVPGIPMPLPPNAPPGARTQPL

SEQ ID NO: 1554215 - protein, 18 aa, Mycobacterium tuberculosis
GETFFTTAYFDPNMAHMD

SEQ ID NO: 1554216 - protein, 27 aa, Mycobacterium tuberculosis
GGDGGDIAYPYYLINGRIPVAATSFKA

SEQ ID NO: 1554217 - protein, 28 aa, Mycobacterium tuberculosis
GGKWAINPMFIDPLPQHAPYVCGEAFIN

SEQ ID NO: 1554218 - protein, 20 aa, Mycobacterium tuberculosis
GGMPMMLMPMSISGAGAGMP

SEQ ID NO: 1554219 - protein, 25 aa, Mycobacterium tuberculosis
GGVIDMSHEMAPTTRLKILQVAATV

SEQ ID NO: 1554220 - protein, 25 aa, Mycobacterium tuberculosis
GHYDAEWIIILDDWTDGIGKSPQQL

SEQ ID NO: 1554221 - protein, 20 aa, Mycobacterium tuberculosis
GIYACWGTENREAAVRFVKG

SEQ ID NO: 1554222 - protein, 25 aa, Mycobacterium tuberculosis
GLDGFLERPGIAAYLRLGYGPQTAE

SEQ ID NO: 1554223 - protein, 18 aa, Mycobacterium tuberculosis
GLKLVKVETLSQAVDALH

SEQ ID NO: 1554224 - protein, 20 aa, Mycobacterium tuberculosis
GQFELNRPATLIAALPAILG

SEQ ID NO: 1554225 - protein, 25 aa, Mycobacterium tuberculosis
GQGAPPFRMWDPGSGPAGGRAWDGL

SEQ ID NO: 1554226 - protein, 27 aa, Mycobacterium tuberculosis
GRRALQTWRRLAVTRYPVVGLFERIWE

SEQ ID NO: 1554227 - protein, 21 aa, Mycobacterium tuberculosis
GSLTHILTFLAAETGGCSGSR

SEQ ID NO: 1554228 - protein, 17 aa, Mycobacterium tuberculosis
HERGLPMQSPWTALRTA

SEQ ID NO: 1554229 - protein, 22 aa, Mycobacterium tuberculosis
IAPFMSYGKFTGDAPLGTCAFW

SEQ ID NO: 1554230 - protein, 23 aa, Mycobacterium tuberculosis
IEDYWMAVYSESLKGTFRPVGKL

SEQ ID NO: 1554231 - protein, 19 aa, Mycobacterium tuberculosis
IEVVDAPWAPFAVDFHLAN

SEQ ID NO: 1554232 - protein, 18 aa, Mycobacterium tuberculosis
IKLAWITAVVAGLMVGVA

SEQ ID NO: 1554233 - protein, 23 aa, Mycobacterium tuberculosis
INNAFRVPSMKPLAGTTFEHIRD

SEQ ID NO: 1554234 - protein, 19 aa, Mycobacterium tuberculosis
IRRASNVCWPTPRPPMRIW

SEQ ID NO: 1554235 - protein, 20 aa, Mycobacterium tuberculosis
IRVNSVAPGYIWGDTLKSYF

SEQ ID NO: 1554236 - protein, 32 aa, Mycobacterium tuberculosis; identical to SEQ ID NO: 237303

SEQ ID NO: 1554237 - protein, 17 aa, Mycobacterium tuberculosis
ISYPLYGVQQVGAPCPK

SEQ ID NO: 1554238 - protein, 33 aa, Mycobacterium tuberculosis; identical to SEQ ID NO: 236549

SEQ ID NO: 1554239 - protein, 26 aa, Mycobacterium tuberculosis
KAVDVLARIMGSSYQRLVAAGVAKFF

SEQ ID NO: 1554240 - protein, 18 aa, Mycobacterium tuberculosis
KRCWANQVIFGVTGPQAF

SEQ ID NO: 1554241 - protein, 24 aa, Mycobacterium tuberculosis
LAADGSVLDTWFPAPELTESGTSA

SEQ ID NO: 1554242 - protein, 18 aa, Mycobacterium tuberculosis
LAGMSLLASAIGLAAFGA

SEQ ID NO: 1554243 - protein, 18 aa, Mycobacterium tuberculosis
LAGPYAWSNALSAGYTAE

SEQ ID NO: 1554244 - protein, 26 aa, Mycobacterium tuberculosis
LALGERRLVRLLRLGGTAVLPTYFEI

SEQ ID NO: 1554245 - protein, 22 aa, Mycobacterium tuberculosis
LGIVISGHWLLQNPMFAGYAAV

SEQ ID NO: 1554246 - protein, 17 aa, Mycobacterium tuberculosis
LMLAACILATGVAGLGV

SEQ ID NO: 1554247 - protein, 18 aa, Mycobacterium tuberculosis
LNTTPALVPGERTDALAL

SEQ ID NO: 1554248 - protein, 18 aa, Mycobacterium tuberculosis
LPGNPRVLSIAQFWDRAA

SEQ ID NO: 1554249 - protein, 19 aa, Mycobacterium tuberculosis
LQFKPGTRFDYSNSNYLLL

SEQ ID NO: 1554250 - protein, 18 aa, Mycobacterium tuberculosis
LRCILGDPVVDAVVAVRQ

SEQ ID NO: 1554251 - protein, 25 aa, Mycobacterium tuberculosis
LRTTIDWYRDNESWWRPLKDATEAR

SEQ ID NO: 1554252 - protein, 28 aa, Mycobacterium tuberculosis
LSTLLNQPFQALPPFPPVFGGSDSLGDS

SEQ ID NO: 1554253 - protein, 18 aa, Mycobacterium tuberculosis
LTDLSTRCSLPISGLQAI

SEQ ID NO: 1554254 - protein, 23 aa, Mycobacterium tuberculosis
LVATALVLVAILLGVTAVLLGLS

SEQ ID NO: 1554255 - protein, 17 aa, Mycobacterium tuberculosis
LYALSAVTMLAACSSNG

SEQ ID NO: 1554256 - protein, 27 aa, Mycobacterium tuberculosis
MGTPEDLVGMCLFLLSDSASWITGQIF

SEQ ID NO: 1554257 - protein, 18 aa, Mycobacterium tuberculosis
MTRYSWQSYLIATASFAE

SEQ ID NO: 1554258 - protein, 21 aa, Mycobacterium tuberculosis
NDIEILLTATMLRCGRPTACY

SEQ ID NO: 1554259 - protein, 36 aa, Mycobacterium tuberculosis; identical to SEQ ID NO: 237698

SEQ ID NO: 1554260 - protein, 23 aa, Mycobacterium tuberculosis
NLDPVLVGERLIGPLYAHGVAGA

SEQ ID NO: 1554261 - protein, 24 aa, Mycobacterium tuberculosis
NMGRKFLEQLGILQPTDTGITNAP

SEQ ID NO: 1554262 - protein, 28 aa, Mycobacterium tuberculosis
NPEPFLHTNVIGTFTILEAVRRHGVRLH

SEQ ID NO: 1554263 - protein, 24 aa, Mycobacterium tuberculosis
NPSGAAIPAFKPLGGRELGAGMSA

SEQ ID NO: 1554264 - protein, 36 aa, Mycobacterium tuberculosis; identical to SEQ ID NO: 236699

SEQ ID NO: 1554265 - protein, 27 aa, Mycobacterium tuberculosis
PAGGRAWDGLWDPTLPMIPSANIPGDP

SEQ ID NO: 1554266 - protein, 26 aa, Mycobacterium tuberculosis
PEPWRVEALVLLAFSAYARGDGPLAG

SEQ ID NO: 1554267 - protein, 27 aa, Mycobacterium tuberculosis
PGGQMLFDLPPRWFAGWSRLGLRTSLR

SEQ ID NO: 1554268 - protein, 21 aa, Mycobacterium tuberculosis
PGQWDPTLPALVSAGAPGDPL

SEQ ID NO: 1554269 - protein, 33 aa, Mycobacterium tuberculosis; identical to SEQ ID NO: 146912

SEQ ID NO: 1554270 - protein, 24 aa, Mycobacterium tuberculosis
PRRVLDPAIYREAALRLDHHFAIS

SEQ ID NO: 1554271 - protein, 25 aa, Mycobacterium tuberculosis
PSANPYLASAAILGLALDGMKTKAV

SEQ ID NO: 1554272 - protein, 17 aa, Mycobacterium tuberculosis
PSQGAVFVLQLNADALD

SEQ ID NO: 1554273 - protein, 40 aa, Mycobacterium tuberculosis; identical to SEQ ID NO: 236762

SEQ ID NO: 1554274 - protein, 23 aa, Mycobacterium tuberculosis
QAGDLLGIALLSNADPAAPTVEQ

SEQ ID NO: 1554275 - protein, 20 aa, Mycobacterium tuberculosis
QARRYEAVRVWRSGLCSASN

SEQ ID NO: 1554276 - protein, 24 aa, Mycobacterium tuberculosis
QFQAKYPMHAIIRQQLTDAAVRPA

SEQ ID NO: 1554277 - protein, 21 aa, Mycobacterium tuberculosis
QRGFLDRLMAHPAVAGLSEGP

SEQ ID NO: 1554278 - protein, 25 aa, Mycobacterium tuberculosis
QRPHGFKALDITLPMPPRWTQVPDP

SEQ ID NO: 1554279 - protein, 19 aa, Mycobacterium tuberculosis
QSYLIATASFAEWIDRGRP

SEQ ID NO: 1554280 - protein, 24 aa, Mycobacterium tuberculosis
QTFAEFFDRRLALHSPEMAAKTIV

SEQ ID NO: 1554281 - protein, 18 aa, Mycobacterium tuberculosis
QVVLGWKVSDLKSSTAVI

SEQ ID NO: 1554282 - protein, 21 aa, Mycobacterium tuberculosis
RAYDGLFTRGGKWAINPMFID

SEQ ID NO: 1554283 - protein, 22 aa, Mycobacterium tuberculosis
RPTPEMLAYQYLQTLPEMARGD

SEQ ID NO: 1554284 - protein, 21 aa, Mycobacterium tuberculosis
RQLDAFLKWHHGVREFLQSAI

SEQ ID NO: 1554285 - protein, 23 aa, Mycobacterium tuberculosis
RQVDLIRAQLTRQLRLELGHESV

SEQ ID NO: 1554286 - protein, 30 aa, Mycobacterium tuberculosis; identical to SEQ ID NO: 236853

SEQ ID NO: 1554287 - protein, 25 aa, Mycobacterium tuberculosis
RRRLLAVLIALALPGAAVALLAEPS

SEQ ID NO: 1554288 - protein, 21 aa, Mycobacterium tuberculosis
RRWSQYLAWVADHIGLKVIHG

SEQ ID NO: 1554289 - protein, 27 aa, Mycobacterium tuberculosis
RTVSGQLTLLVPFIDRVRARVDLRERV

SEQ ID NO: 1554290 - protein, 17 aa, Mycobacterium tuberculosis
SDKALARITLTNAAAIL

SEQ ID NO: 1554291 - protein, 21 aa, Mycobacterium tuberculosis
SFTSVPMLFATPTYYAQFADT

SEQ ID NO: 1554292 - protein, 26 aa, Mycobacterium tuberculosis
SGPFFKAMVVNLLPYQILQPWVDAAF

SEQ ID NO: 1554293 - protein, 24 aa, Mycobacterium tuberculosis
SGRQYMSWISLEDEVRALQFAIAQ

SEQ ID NO: 1554294 - protein, 20 aa, Mycobacterium tuberculosis
SKQFTATAILLLVEAGKLTL

SEQ ID NO: 1554295 - protein, 25 aa, Mycobacterium tuberculosis
SLNNRMLSQIWSHWSLLSAPSCAAQ

SEQ ID NO: 1554296 - protein, 31 aa, Mycobacterium tuberculosis; identical to SEQ ID NO: 223091

SEQ ID NO: 1554297 - protein, 21 aa, Mycobacterium tuberculosis
SVAATLAPFSLPPVSLAGLAA

SEQ ID NO: 1554298 - protein, 21 aa, Mycobacterium tuberculosis
TAAEVPLAFALAAGSFRDATR

SEQ ID NO: 1554299 - protein, 25 aa, Mycobacterium tuberculosis
TADGINYRVLWQAAGPDTISGATIP

SEQ ID NO: 1554300 - protein, 25 aa, Mycobacterium tuberculosis
TDVTPKLFLPTLSGLTQGPGFPNLS

SEQ ID NO: 1554301 - protein, 20 aa, Mycobacterium tuberculosis
TGGAAGLLGWGANGGAGGLG

SEQ ID NO: 1554302 - protein, 26 aa, Mycobacterium tuberculosis
TGVGRFRYPRNGWPALFHVRSGASLA

SEQ ID NO: 1554303 - protein, 23 aa, Mycobacterium tuberculosis
TIATGLIGALRQAGHTVAPFKVG

SEQ ID NO: 1554304 - protein, 23 aa, Mycobacterium tuberculosis
TLGEALALWLSGQEQLMPRDLVY

SEQ ID NO: 1554305 - protein, 24 aa, Mycobacterium tuberculosis
TQQVDGYIRVYPQMKDLIGTLQAH

SEQ ID NO: 1554306 - protein, 20 aa, Mycobacterium tuberculosis
VAGAAILVAGLSGCSSNKST

SEQ ID NO: 1554307 - protein, 18 aa, Mycobacterium tuberculosis
VAILSKLTGDIDPAKVLQ

SEQ ID NO: 1554308 - protein, 18 aa, Mycobacterium tuberculosis
VAPGYIWGDTLKSYFDHQ

SEQ ID NO: 1554309 - protein, 21 aa, Mycobacterium tuberculosis
VCSLALMLAMFGANVYASRMA

SEQ ID NO: 1554310 - protein, 18 aa, Mycobacterium tuberculosis
VEGKVIWSGVRGIADLAS

SEQ ID NO: 1554311 - protein, 22 aa, Mycobacterium tuberculosis
VFLAVLVIFAIIVVAKSVALIP

SEQ ID NO: 1554312 - protein, 24 aa, Mycobacterium tuberculosis
VGLFERIWEIRANLSAYDASYVAL

SEQ ID NO: 1554313 - protein, 18 aa, Mycobacterium tuberculosis
VGTPLIALGPVLAGAPGD

SEQ ID NO: 1554314 - protein, 19 aa, Mycobacterium tuberculosis
VHDALVGKSVVIFRTPDAH

SEQ ID NO: 1554315 - protein, 17 aa, Mycobacterium tuberculosis
VLIGFSLPGKTIGMQSR

SEQ ID NO: 1554316 - protein, 24 aa, Mycobacterium tuberculosis
VLVAVVLVGWPAAGAPPSCAGLGG

SEQ ID NO: 1554317 - protein, 19 aa, Mycobacterium tuberculosis
VNAFFSSRCNLIAWDRGVF

SEQ ID NO: 1554318 - protein, 18 aa, Mycobacterium tuberculosis
VPLFAVFLAAGCTTTTTG

SEQ ID NO: 1554319 - protein, 24 aa, Mycobacterium tuberculosis
VPRPLMGSLIQRVPLDGAALSTLL

SEQ ID NO: 1554320 - protein, 23 aa, Mycobacterium tuberculosis
VVNVYAIAVLKRTSQPALARQFV

SEQ ID NO: 1554321 - protein, 20 aa, Mycobacterium tuberculosis
WGVVNGTKAFLPHVIASGDG

SEQ ID NO: 1554322 - protein, 18 aa, Mycobacterium tuberculosis
WLSDYGLTGLLRRSIVVL

SEQ ID NO: 1554323 - protein, 30 aa, Mycobacterium tuberculosis; identical to SEQ ID NO: 237102

SEQ ID NO: 1554324 - protein, 29 aa, Mycobacterium tuberculosis
YEDRSFTFTLKTPPAAKLLLKAAGVAKGS

SEQ ID NO: 1554325 - protein, 24 aa, Mycobacterium tuberculosis
YFAEINLAGFYDLAQTLGGVDVCL

SEQ ID NO: 1554326 - protein, 21 aa, Mycobacterium tuberculosis
YKSATFLQRNLPRGTTQGQAF

SEQ ID NO: 1554327 - protein, 20 aa, Mycobacterium tuberculosis
YWCPGQPFDPAWGPNWDPYT

SEQ ID NO: 1554328 - protein, 22 aa, Mycobacterium tuberculosis
AATAIGIPPQVAAALTVVATQR

SEQ ID NO: 1554329 - protein, 24 aa, Mycobacterium tuberculosis
ADQQPVFDRALATIPDALAVLADE

SEQ ID NO: 1554330 - protein, 23 aa, Mycobacterium tuberculosis
ADVVAYLVNVTVRPGYNFANADA

SEQ ID NO: 1554331 - protein, 24 aa, Mycobacterium tuberculosis
AGGMLRRMRPLFSVGLGARLGSGR

SEQ ID NO: 1554332 - protein, 17 aa, Mycobacterium tuberculosis
AGLLYLVSELDGHPMCG

SEQ ID NO: 1554333 - protein, 18 aa, Mycobacterium tuberculosis
ALAALFAMIALTGSACLA

SEQ ID NO: 1554334 - protein, 22 aa, Mycobacterium tuberculosis
ALTSPGLTPTLPGSLAAPGTTL

SEQ ID NO: 1554335 - protein, 19 aa, Mycobacterium tuberculosis
AMHDMFVNTLGISAGTYGV

SEQ ID NO: 1554336 - protein, 31 aa, Mycobacterium tuberculosis; identical to SEQ ID NO: 236155

SEQ ID NO: 1554337 - protein, 25 aa, Mycobacterium tuberculosis
AQTLIPPPPIVAPPPPRPAPPQQPP

SEQ ID NO: 1554338 - protein, 30 aa, Mycobacterium tuberculosis; identical to SEQ ID NO: 236177

SEQ ID NO: 1554339 - protein, 21 aa, Mycobacterium tuberculosis
ASFLDQVHFQPLPPAVVKLSD

SEQ ID NO: 1554340 - protein, 25 aa, Mycobacterium tuberculosis
ASNVVRWVPHRYWPPHTRVSVGVQE

SEQ ID NO: 1554341 - protein, 26 aa, Mycobacterium tuberculosis
ASVVATALTFPFAGGLGLMSNRASEV

SEQ ID NO: 1554342 - protein, 24 aa, Mycobacterium tuberculosis
ATDLCEFVEFPSQLLQVCGDSFAG

SEQ ID NO: 1554343 - protein, 23 aa, Mycobacterium tuberculosis
AVAEVTRLRQGWGAWPVCAARAG

SEQ ID NO: 1554344 - protein, 50 aa, Mycobacterium tuberculosis; identical to SEQ ID NO: 236208

SEQ ID NO: 1554345 - protein, 24 aa, Mycobacterium tuberculosis
AVIAAASLLPKSWIAVGTGRADDV

SEQ ID NO: 1554346 - protein, 18 aa, Mycobacterium tuberculosis
AVPPLQPIPGVASVSPAN

SEQ ID NO: 1554347 - protein, 27 aa, Mycobacterium tuberculosis
AVPVELPLCALLTAWVRGQARPEARAQ

SEQ ID NO: 1554348 - protein, 27 aa, Mycobacterium tuberculosis
AVSIGILLSLIAPLGPPLARADGTSQL

SEQ ID NO: 1554349 - protein, 17 aa, Mycobacterium tuberculosis
AVVASLFARHAQAYQAL

SEQ ID NO: 1554350 - protein, 29 aa, Mycobacterium tuberculosis
CWQTITRELWPAPYLVMDTGASLAPYNHV

SEQ ID NO: 1554351 - protein, 24 aa, Mycobacterium tuberculosis
DGAALPWSLTLKTTAPSAAPNILA

SEQ ID NO: 1554352 - protein, 28 aa, Mycobacterium tuberculosis
DLGALSSWYVWAALGLYPSTPGTTILTV

SEQ ID NO: 1554353 - protein, 37 aa, Mycobacterium tuberculosis; identical to SEQ ID NO: 236254

SEQ ID NO: 1554354 - protein, 26 aa, Mycobacterium tuberculosis
DLPSSTQLPVWLAHAGIDVLRSHPIV

SEQ ID NO: 1554355 - protein, 25 aa, Mycobacterium tuberculosis
DPLIPNPPPIPVPPPAAQTLIPPPP

SEQ ID NO: 1554356 - protein, 30 aa, Mycobacterium tuberculosis; identical to SEQ ID NO: 236279

SEQ ID NO: 1554357 - protein, 22 aa, Mycobacterium tuberculosis
DVDTFYTCLYRSLLHPNTFNDV

SEQ ID NO: 1554358 - protein, 20 aa, Mycobacterium tuberculosis
EQTLAALSLVLNGGGLGQVQ

SEQ ID NO: 1554359 - protein, 25 aa, Mycobacterium tuberculosis
FDASGLIQYAYAGAGLKLPRSSGQM

SEQ ID NO: 1554360 - protein, 19 aa, Mycobacterium tuberculosis
FPEVDRVSWFPVARARTKL

SEQ ID NO: 1554361 - protein, 19 aa, Mycobacterium tuberculosis
FVQTRLRENVLLQAKVCQS

SEQ ID NO: 1554362 - protein, 23 aa, Mycobacterium tuberculosis
GAGSIFKIFTTAAALDMGMGINA

SEQ ID NO: 1554363 - protein, 24 aa, Mycobacterium tuberculosis
GARKDTVIVLPKQKMRAVLVADNP

SEQ ID NO: 1554364 - protein, 27 aa, Mycobacterium tuberculosis
GFDEQPRLFYMHFWAENDAVALARTLR

SEQ ID NO: 1554365 - protein, 23 aa, Mycobacterium tuberculosis
GLSQFGINIPPVPSLTGSGDAST

SEQ ID NO: 1554366 - protein, 19 aa, Mycobacterium tuberculosis
GNALWARLQPCVNWISQHW

SEQ ID NO: 1554367 - protein, 23 aa, Mycobacterium tuberculosis
GNKRTIVGYFTSAVGLYPGDQVR

SEQ ID NO: 1554368 - protein, 22 aa, Mycobacterium tuberculosis
GPERRYIMVIESLQPADDATAR

SEQ ID NO: 1554369 - protein, 26 aa, Mycobacterium tuberculosis
GPVVYQMQPVVFGAPLPLDPASAPDV

SEQ ID NO: 1554370 - protein, 22 aa, Mycobacterium tuberculosis
GRPVTCDDLVLAWAAQSGRFPG

SEQ ID NO: 1554371 - protein, 17 aa, Mycobacterium tuberculosis
GRYIGFDGVIHSVASGH

SEQ ID NO: 1554372 - protein, 24 aa, Mycobacterium tuberculosis
GSRGLRYATVIALVAALVGGVYVL

SEQ ID NO: 1554373 - protein, 19 aa, Mycobacterium tuberculosis
GVDWKGTLTGLAGYASGDL

SEQ ID NO: 1554374 - protein, 20 aa, Mycobacterium tuberculosis
GYATNYYMLQHSLVLQPANQ

SEQ ID NO: 1554375 - protein, 18 aa, Mycobacterium tuberculosis
IAAYLRLGYGPQTAEFRA

SEQ ID NO: 1554376 - protein, 24 aa, Mycobacterium tuberculosis
IAGGVYKFFIARRDPVTMSGMLIP

SEQ ID NO: 1554377 - protein, 24 aa, Mycobacterium tuberculosis
IDSMHLGRYLGISDLMVAAPRQES

SEQ ID NO: 1554378 - protein, 35 aa, Mycobacterium tuberculosis; identical to SEQ ID NO: 236527

SEQ ID NO: 1554379 - protein, 18 aa, Mycobacterium tuberculosis
INASDLNWQQAALLAGMV

SEQ ID NO: 1554380 - protein, 20 aa, Mycobacterium tuberculosis
ITNFYNIYDPAQGTLNGLLS

SEQ ID NO: 1554381 - protein, 17 aa, Mycobacterium tuberculosis
KDVVLSAGWDEDLFRRM

SEQ ID NO: 1554382 - protein, 24 aa, Mycobacterium tuberculosis
KKNLYTVYFAMKFSQPFSSYGTWD

SEQ ID NO: 1554383 - protein, 26 aa, Mycobacterium tuberculosis
KLSKQPFSLQLIGPPPSPVQRYPLYC

SEQ ID NO: 1554384 - protein, 19 aa, Mycobacterium tuberculosis
LAARVLVALAALFAMIALT

SEQ ID NO: 1554385 - protein, 17 aa, Mycobacterium tuberculosis
LDVNPRYISLIPVNVVA

SEQ ID NO: 1554386 - protein, 18 aa, Mycobacterium tuberculosis
LIFYGPEGTQSVALYLGK

SEQ ID NO: 1554387 - protein, 18 aa, Mycobacterium tuberculosis
LKILQVAATVTAYFASRP

SEQ ID NO: 1554388 - protein, 23 aa, Mycobacterium tuberculosis
LNDMTHWLAMVLADGVYNGRRIT

SEQ ID NO: 1554389 - protein, 18 aa, Mycobacterium tuberculosis
LPGLGFTQPLPPAADDHI

SEQ ID NO: 1554390 - protein, 23 aa, Mycobacterium tuberculosis
LSAGYTFMGFAEDLPAVGSTVCS

SEQ ID NO: 1554391 - protein, 20 aa, Mycobacterium tuberculosis
LSSLSPLFGSKAIDLCNPTD

SEQ ID NO: 1554392 - protein, 22 aa, Mycobacterium tuberculosis
LTLRLLAASAGILSAAAFAAPA

SEQ ID NO: 1554393 - protein, 17 aa, Mycobacterium tuberculosis
MLQQTLNTTPALVPGER

SEQ ID NO: 1554394 - protein, 20 aa, Mycobacterium tuberculosis
NAQLVVYRLIGDFDPAEAIT

SEQ ID NO: 1554395 - protein, 24 aa, Mycobacterium tuberculosis
NEPSRTWFAAMKPIANNFGEVQLP

SEQ ID NO: 1554396 - protein, 28 aa, Mycobacterium tuberculosis
NFSGRARMSSMLWTFQVNQADGVACPDG

SEQ ID NO: 1554397 - protein, 17 aa, Mycobacterium tuberculosis
NLMAVARKDVVLSAGWD

SEQ ID NO: 1554398 - protein, 25 aa, Mycobacterium tuberculosis
NLVAARFIQLTPVYTGGAVLPDNGR

SEQ ID NO: 1554399 - protein, 18 aa, Mycobacterium tuberculosis
NNAAIYGGMKLDLLLTVP

SEQ ID NO: 1554400 - protein, 32 aa, Mycobacterium tuberculosis
NSGPALTRSLSLLATFPFPNETFQNFQRGEYA

SEQ ID NO: 1554401 - protein, 26 aa, Mycobacterium tuberculosis
NWNYAHTNYLLLGLALEKAAGQDMPT

SEQ ID NO: 1554402 - protein, 27 aa, Mycobacterium tuberculosis
NYQMAVEPIIWRTYAQTLPPDAIETTI

SEQ ID NO: 1554403 - protein, 26 aa, Mycobacterium tuberculosis
PADLQSLLVPPAPGPAPAPPAPGAGP

SEQ ID NO: 1554404 - protein, 22 aa, Mycobacterium tuberculosis
PAPPPPPLPEDGGPPPPVGSQV

SEQ ID NO: 1554405 - protein, 17 aa, Mycobacterium tuberculosis
PELFCMIRNFHDAAPKV

SEQ ID NO: 1554406 - protein, 25 aa, Mycobacterium tuberculosis
PIAADDFWYLWQQMVTQPGVVDPAG

SEQ ID NO: 1554407 - protein, 19 aa, Mycobacterium tuberculosis
PIANGLTYNFTFKFEKAGQ

SEQ ID NO: 1554408 - protein, 17 aa, Mycobacterium tuberculosis
PTATLLDTYSPELFCMI

SEQ ID NO: 1554409 - protein, 20 aa, Mycobacterium tuberculosis
PVHAECAGLLYLVSELDGHP

SEQ ID NO: 1554410 - protein, 20 aa, Mycobacterium tuberculosis
PVILVILLSVAAGAGAWLLV

SEQ ID NO: 1554411 - protein, 24 aa, Mycobacterium tuberculosis
QSGSIGLGFAIPVDQAKRIADELI

SEQ ID NO: 1554412 - protein, 25 aa, Mycobacterium tuberculosis
QVHDADTIVLRRSRPLQISLDGHDA

SEQ ID NO: 1554413 - protein, 23 aa, Mycobacterium tuberculosis
RAAPYLVGALKLILTQPFDVDTV

SEQ ID NO: 1554414 - protein, 17 aa, Mycobacterium tuberculosis
RAPWRLLQVYQDPANTT

SEQ ID NO: 1554415 - protein, 20 aa, Mycobacterium tuberculosis
RAVDMAIKLGLRSYANPGTA

SEQ ID NO: 1554416 - protein, 26 aa, Mycobacterium tuberculosis
RAVNRPTPLMLPSVAVRAAFGEFADE

SEQ ID NO: 1554417 - protein, 21 aa, Mycobacterium tuberculosis
RELLVAMAMLVSVTGCARHAS

SEQ ID NO: 1554418 - protein, 35 aa, Mycobacterium tuberculosis; identical to SEQ ID NO: 236824

SEQ ID NO: 1554419 - protein, 26 aa, Mycobacterium tuberculosis
RLAGMTTWVASIALLAAALSGCGAGQ

SEQ ID NO: 1554420 - protein, 21 aa, Mycobacterium tuberculosis
RSYRPLTLDYRLNPVAVIGDS

SEQ ID NO: 1554421 - protein, 26 aa, Mycobacterium tuberculosis
RTNGMTPYLVRVLGTQPTPVQQAPVQ

SEQ ID NO: 1554422 - protein, 17 aa, Mycobacterium tuberculosis
RTWQMLAARGVRIAADV

SEQ ID NO: 1554423 - protein, 29 aa, Mycobacterium tuberculosis
SDIERLRKLWDVPALAFVGIGNGTQVALA

SEQ ID NO: 1554424 - protein, 19 aa, Mycobacterium tuberculosis
SGRWRAGAARRLTSLVAAA

SEQ ID NO: 1554425 - protein, 21 aa, Mycobacterium tuberculosis
SLAVLGWNMSVSNLRWSGDYV

SEQ ID NO: 1554426 - protein, 29 aa, Mycobacterium tuberculosis
SPVNAAISALVLPSAFRPIPDPNTPTGSR

SEQ ID NO: 1554427 - protein, 22 aa, Mycobacterium tuberculosis
SRVAFLGWSMGGYGALLLGSRL

SEQ ID NO: 1554428 - protein, 22 aa, Mycobacterium tuberculosis
SSLFGLIAVPGQSAYNAAKFAV

SEQ ID NO: 1554429 - protein, 25 aa, Mycobacterium tuberculosis
TGQPWVVSFQLNWPRDHGPTVTGWM

SEQ ID NO: 1554430 - protein, 19 aa, Mycobacterium tuberculosis
TLLDTYSPELFCMIRNFHD

SEQ ID NO: 1554431 - protein, 22 aa, Mycobacterium tuberculosis
TLVGLMLTLLPAPTSAAGSNTA

SEQ ID NO: 1554432 - protein, 21 aa, Mycobacterium tuberculosis
TNTICLDIDWVIGGCMSVDPT

SEQ ID NO: 1554433 - protein, 18 aa, Mycobacterium tuberculosis
TQFNFHAAMYQAVGAQAI

SEQ ID NO: 1554434 - protein, 18 aa, Mycobacterium tuberculosis
TTALFVVATGCSSATNVA

SEQ ID NO: 1554435 - protein, 23 aa, Mycobacterium tuberculosis
TTNPLHVRLGQRPTLMFDNTTMM

SEQ ID NO: 1554436 - protein, 17 aa, Mycobacterium tuberculosis
TVVYFQVTVPQAAVYEI

SEQ ID NO: 1554437 - protein, 25 aa, Mycobacterium tuberculosis
VDAKGNTIAWLYSQRRFEVPSDKIA

SEQ ID NO: 1554438 - protein, 23 aa, Mycobacterium tuberculosis
VEIPGLPPITIPLLAPPPPAPPP

SEQ ID NO: 1554439 - protein, 28 aa, Mycobacterium tuberculosis
VFDDVHVAPRVIFLPGPAAALTSDDHGT

SEQ ID NO: 1554440 - protein, 29 aa, Mycobacterium tuberculosis
VFGVLLAVVTVPFVALGPGPTFDTLGEID

SEQ ID NO: 1554441 - protein, 22 aa, Mycobacterium tuberculosis
VGALVLVLVYKQFRGEFTPKTE

SEQ ID NO: 1554442 - protein, 18 aa, Mycobacterium tuberculosis
VLAALRETGFITYQPRDR

SEQ ID NO: 1554443 - protein, 17 aa, Mycobacterium tuberculosis
VLGAIPRTAELELPTRY

SEQ ID NO: 1554444 - protein, 17 aa, Mycobacterium tuberculosis
VLPILQDTTIVAAGPSV

SEQ ID NO: 1554445 - protein, 18 aa, Mycobacterium tuberculosis
VRSLTGVPIDYFAEINLA

SEQ ID NO: 1554446 - protein, 29 aa, Mycobacterium tuberculosis
VTFAQPYPAWRELFTDILPAHIVKDIPGG

SEQ ID NO: 1554447 - protein, 24 aa, Mycobacterium tuberculosis
VVLARTGVVLSPAGGMLRRMRPLF

SEQ ID NO: 1554448 - protein, 31 aa, Mycobacterium tuberculosis; identical to SEQ ID NO: 237082

SEQ ID NO: 1554449 - protein, 30 aa, Mycobacterium tuberculosis; identical to SEQ ID NO: 237084

SEQ ID NO: 1554450 - protein, 17 aa, Mycobacterium tuberculosis
WVGAVPQVGLAASALPT

SEQ ID NO: 1554451 - protein, 21 aa, Mycobacterium tuberculosis
YAALGYLKYPKAVTVASVMDP

SEQ ID NO: 1554452 - protein, 25 aa, Mycobacterium tuberculosis
YNGDPLTFAWVNHMKIFFNNKGVVA

SEQ ID NO: 1554453 - protein, 18 aa, Mycobacterium tuberculosis
YTSNAQLVVYRLIGDFDP

SEQ ID NO: 1554454 - protein, 28 aa, Mycobacterium tuberculosis
AAAFAAATLLLTPALAPPASAGCPDAEV

SEQ ID NO: 1554455 - protein, 17 aa, Mycobacterium tuberculosis
AAVFLALAMGVVLGSGF

SEQ ID NO: 1554456 - protein, 23 aa, Mycobacterium tuberculosis
AFGWVAFEFGVHRYGLQQRLAPH

SEQ ID NO: 1554457 - protein, 24 aa, Mycobacterium tuberculosis
AGIERTFVAYLKMAGKTAQDTSFD

SEQ ID NO: 1554458 - protein, 17 aa, Mycobacterium tuberculosis
AGWLVERAGFGKGYPDA

SEQ ID NO: 1554459 - protein, 19 aa, Mycobacterium tuberculosis
AHLPLIDLTPRQAALNPPP

SEQ ID NO: 1554460 - protein, 17 aa, Mycobacterium tuberculosis
AIQPIYGPTLDGTLPGN

SEQ ID NO: 1554461 - protein, 18 aa, Mycobacterium tuberculosis
ALADKLLPARFTAALAQA

SEQ ID NO: 1554462 - protein, 17 aa, Mycobacterium tuberculosis
ALCVPRDAIARDAGVPI

SEQ ID NO: 1554463 - protein, 22 aa, Mycobacterium tuberculosis
ALIVLAVPMPALPGMLAHIRKS

SEQ ID NO: 1554464 - protein, 18 aa, Mycobacterium tuberculosis
ALYWGARLTLVSRVDELA

SEQ ID NO: 1554465 - protein, 24 aa, Mycobacterium tuberculosis
AMTVPPAEVAANRALLAALVATNV

SEQ ID NO: 1554466 - protein, 26 aa, Mycobacterium tuberculosis
ANGGITMRPYLVGSLKGPDLANISTT

SEQ ID NO: 1554467 - protein, 27 aa, Mycobacterium tuberculosis
APVLWDEMPTLPLYRQQRTLLMSTKMY

SEQ ID NO: 1554468 - protein, 22 aa, Mycobacterium tuberculosis
ASAIGMLSVPPAWAGQATLVST

SEQ ID NO: 1554469 - protein, 31 aa, Mycobacterium tuberculosis; identical to SEQ ID NO: 236203

SEQ ID NO: 1554470 - protein, 17 aa, Mycobacterium tuberculosis
AVASPCAYFLVYESTET

SEQ ID NO: 1554471 - protein, 26 aa, Mycobacterium tuberculosis
DAEPGRITVILALHDLINGGHVGHYG

SEQ ID NO: 1554472 - protein, 24 aa, Mycobacterium tuberculosis
DELKLYDTPAMPPPIFVAASGPQS

SEQ ID NO: 1554473 - protein, 19 aa, Mycobacterium tuberculosis
DGRFRFLRVYPNPEVYAPV

SEQ ID NO: 1554474 - protein, 18 aa, Mycobacterium tuberculosis
DPDVHYPYLYGSPGGRTR

SEQ ID NO: 1554475 - protein, 29 aa, Mycobacterium tuberculosis
DPVLAEWFLRRFSLLDSLYMVPSVPIIGR

SEQ ID NO: 1554476 - protein, 32 aa, Mycobacterium tuberculosis
DVPDVVLLDDRWWFHFALSGVLTALDDLFGQV

SEQ ID NO: 1554477 - protein, 26 aa, Mycobacterium tuberculosis
DVRALELDLHYLPRLEGHGAPGVTVC

SEQ ID NO: 1554478 - protein, 39 aa, Mycobacterium tuberculosis; identical to SEQ ID NO: 236302

SEQ ID NO: 1554479 - protein, 25 aa, Mycobacterium tuberculosis
ELKTNSSLLTSILTYHVVAGQTSPA

SEQ ID NO: 1554480 - protein, 18 aa, Mycobacterium tuberculosis
ELPVMAEYQRRVGPAVLV

SEQ ID NO: 1554481 - protein, 24 aa, Mycobacterium tuberculosis
ERASPYVVGALKLGLTAPFNIDEV

SEQ ID NO: 1554482 - protein, 25 aa, Mycobacterium tuberculosis
FDCSGLVRYAFAGVGVLIPRFSGDQ

SEQ ID NO: 1554483 - protein, 26 aa, Mycobacterium tuberculosis
FEPWSVADFSRYLSTLGLPAAGDAVT

SEQ ID NO: 1554484 - protein, 22 aa, Mycobacterium tuberculosis
FMPNFALEWLINAYHRRGADIE

SEQ ID NO: 1554485 - protein, 20 aa, Mycobacterium tuberculosis
FYSLRYSSTALERAEDPILN

SEQ ID NO: 1554486 - protein, 23 aa, Mycobacterium tuberculosis
GAAASLVGFNRAPAGPSGGPVAA

SEQ ID NO: 1554487 - protein, 20 aa, Mycobacterium tuberculosis
GALLLGSRLGPARTAAICAV

SEQ ID NO: 1554488 - protein, 21 aa, Mycobacterium tuberculosis
GCHLPAAWRTAPPPLNMRPAN

SEQ ID NO: 1554489 - protein, 24 aa, Mycobacterium tuberculosis
GEVRWVSARDLRFGYRTSVLKHAD

SEQ ID NO: 1554490 - protein, 23 aa, Mycobacterium tuberculosis
GGSADDIFWLSNAYFAAYADSGR

SEQ ID NO: 1554491 - protein, 26 aa, Mycobacterium tuberculosis
GKSLAYLVPAIIRALCDDAPVVVSTA

SEQ ID NO: 1554492 - protein, 19 aa, Mycobacterium tuberculosis
GNLWLSEVFGAELIIPSYN

SEQ ID NO: 1554493 - protein, 24 aa, Mycobacterium tuberculosis
GRGTRLPVWLTQWGYRRPAEDTVD

SEQ ID NO: 1554494 - protein, 32 aa, Mycobacterium tuberculosis; identical to SEQ ID NO: 236469

SEQ ID NO: 1554495 - protein, 28 aa, Mycobacterium tuberculosis
GTRGLRTYVQLFVLIAAANDVRCDVASN

SEQ ID NO: 1554496 - protein, 17 aa, Mycobacterium tuberculosis
GTRWECHLTQLELQWGR

SEQ ID NO: 1554497 - protein, 20 aa, Mycobacterium tuberculosis
HAFPASRWRRYDKLERFPRG

SEQ ID NO: 1554498 - protein, 30 aa, Mycobacterium tuberculosis; identical to SEQ ID NO: 236505

SEQ ID NO: 1554499 - protein, 29 aa, Mycobacterium tuberculosis
ILSSMERAGLLLPLGWDPRLPVMGQKYIS

SEQ ID NO: 1554500 - protein, 24 aa, Mycobacterium tuberculosis
KSARPATVWIAQDGSHHLVRASID

SEQ ID NO: 1554501 - protein, 34 aa, Mycobacterium tuberculosis; identical to SEQ ID NO: 236586

SEQ ID NO: 1554502 - protein, 21 aa, Mycobacterium tuberculosis
LLLVLAFAGGYAVAACKTVTL

SEQ ID NO: 1554503 - protein, 18 aa, Mycobacterium tuberculosis
LQVGDCLADLPPADLSRI

SEQ ID NO: 1554504 - protein, 24 aa, Mycobacterium tuberculosis
LVANDRWWGTKAITKRITVWPQGA

SEQ ID NO: 1554505 - protein, 29 aa, Mycobacterium tuberculosis
NHAAVSTSVLSALFLGAGAALLSACSSPQ

SEQ ID NO: 1554506 - protein, 24 aa, Mycobacterium tuberculosis
NISVKLFDDWSNLGSISELSTSRV

SEQ ID NO: 1554507 - protein, 17 aa, Mycobacterium tuberculosis
PALWLSAGSVAPGSFDG

SEQ ID NO: 1554508 - protein, 25 aa, Mycobacterium tuberculosis
PASMTPFPTMYELFSVGWGKPDLRD

SEQ ID NO: 1554509 - protein, 23 aa, Mycobacterium tuberculosis
PEVYAPVTGFYSLRYSSTALERA

SEQ ID NO: 1554510 - protein, 25 aa, Mycobacterium tuberculosis
PHVSNAVRFAFWGAEEFGLIGSRNY

SEQ ID NO: 1554511 - protein, 19 aa, Mycobacterium tuberculosis
PRVLSIAQFWDRAAGHDRI

SEQ ID NO: 1554512 - protein, 23 aa, Mycobacterium tuberculosis
PTPSTVICLLQPANGQLLTGSAR

SEQ ID NO: 1554513 - protein, 21 aa, Mycobacterium tuberculosis
QAIDLLKGVLMPSIMQAVQNG

SEQ ID NO: 1554514 - protein, 17 aa, Mycobacterium tuberculosis
QLAFGARVGQRLADARE

SEQ ID NO: 1554515 - protein, 19 aa, Mycobacterium tuberculosis
QQRTLLMSTKMYAVSRNPT

SEQ ID NO: 1554516 - protein, 18 aa, Mycobacterium tuberculosis
QSGMAKFAAFLRGVNVGG

SEQ ID NO: 1554517 - protein, 21 aa, Mycobacterium tuberculosis
RALWIAALSFGLGGVAVAAEP

SEQ ID NO: 1554518 - protein, 21 aa, Mycobacterium tuberculosis
RDALFHWGVAMLPAGPAGRVS

SEQ ID NO: 1554519 - protein, 28 aa, Mycobacterium tuberculosis
RELVVAWGKLYPQFGAVAALNLVKCVHW

SEQ ID NO: 1554520 - protein, 29 aa, Mycobacterium tuberculosis
RGDYLNVFTTFDLTLRRIGETFFTTAYFD

SEQ ID NO: 1554521 - protein, 24 aa, Mycobacterium tuberculosis
RHDRLIEAIVLIRQLWSGERISFT

SEQ ID NO: 1554522 - protein, 18 aa, Mycobacterium tuberculosis
RIKKVTERLPLPPNARRV

SEQ ID NO: 1554523 - protein, 20 aa, Mycobacterium tuberculosis
RIQASLWSWAPDEPRAGAGA

SEQ ID NO: 1554524 - protein, 23 aa, Mycobacterium tuberculosis
RIVTPRVMQFTLRANVPKLADTQ

SEQ ID NO: 1554525 - protein, 27 aa, Mycobacterium tuberculosis
RPATLIAALPAILGFVPEKSLVLVSLA

SEQ ID NO: 1554526 - protein, 27 aa, Mycobacterium tuberculosis
RPQPQPVELLLRAITPPRAPAASPNVG

SEQ ID NO: 1554527 - protein, 17 aa, Mycobacterium tuberculosis
RRPKFALLKGRRNYLCL

SEQ ID NO: 1554528 - protein, 18 aa, Mycobacterium tuberculosis
RSLKVDGARVQRPLWAST

SEQ ID NO: 1554529 - protein, 22 aa, Mycobacterium tuberculosis
RVAAVFLRELLAADLQPVVERV

SEQ ID NO: 1554530 - protein, 33 aa, Mycobacterium tuberculosis; identical to SEQ ID NO: 236870

SEQ ID NO: 1554531 - protein, 25 aa, Mycobacterium tuberculosis
SDYDGFTLAGIPSGGLFSGAEVKKS

SEQ ID NO: 1554532 - protein, 23 aa, Mycobacterium tuberculosis
SETPVPELTWVPAGGGAPVGNPA

SEQ ID NO: 1554533 - protein, 17 aa, Mycobacterium tuberculosis
SILTYHVVAGQTSPANV

SEQ ID NO: 1554534 - protein, 26 aa, Mycobacterium tuberculosis
SIYSSCAVPPLVAYLDTGKLPDTDTY

SEQ ID NO: 1554535 - protein, 18 aa, Mycobacterium tuberculosis
SPEALLPVYTPQVISRHP

SEQ ID NO: 1554536 - protein, 25 aa, Mycobacterium tuberculosis
TAEPLPRWWRPAGSLFDQFLGAAET

SEQ ID NO: 1554537 - protein, 17 aa, Mycobacterium tuberculosis
TFAAATYMNGPSVSYLS

SEQ ID NO: 1554538 - protein, 23 aa, Mycobacterium tuberculosis
TGVFPVDLPPITGPPPPLGDAHL

SEQ ID NO: 1554539 - protein, 25 aa, Mycobacterium tuberculosis
TKAITKRITVWPQGADIQDRVNNRS

SEQ ID NO: 1554540 - protein, 21 aa, Mycobacterium tuberculosis
TLVLVLVLCLAGVTAVSMQVR

SEQ ID NO: 1554541 - protein, 17 aa, Mycobacterium tuberculosis
TRRALALCVPRDAIARD

SEQ ID NO: 1554542 - protein, 19 aa, Mycobacterium tuberculosis
TVPDIGIARFRDAFASDLA

SEQ ID NO: 1554543 - protein, 23 aa, Mycobacterium tuberculosis
TVPGTTPSIWTGSPAPSGLSGHD

SEQ ID NO: 1554544 - protein, 18 aa, Mycobacterium tuberculosis
TWRGIANVPLPVGRGMGP

SEQ ID NO: 1554545 - protein, 24 aa, Mycobacterium tuberculosis
VDEDYLLYECDGQWVLAAGVQAMV

SEQ ID NO: 1554546 - protein, 33 aa, Mycobacterium tuberculosis; identical to SEQ ID NO: 237036

SEQ ID NO: 1554547 - protein, 32 aa, Mycobacterium tuberculosis; identical to SEQ ID NO: 1531391

SEQ ID NO: 1554548 - protein, 26 aa, Mycobacterium tuberculosis
VPLAPLTTLRVGPIARRVITCTSAEQ

SEQ ID NO: 1554549 - protein, 26 aa, Mycobacterium tuberculosis
VPYARSTPLFYYNKAAWQQAGLPDRG

SEQ ID NO: 1554550 - protein, 32 aa, Mycobacterium tuberculosis; identical to SEQ ID NO: 237071

SEQ ID NO: 1554551 - protein, 18 aa, Mycobacterium tuberculosis
WANADLISWTFQGPNWAF

SEQ ID NO: 1554552 - protein, 20 aa, Mycobacterium tuberculosis
WECHLTQLELQWGRTIGQFP

SEQ ID NO: 1554553 - protein, 30 aa, Mycobacterium tuberculosis; identical to SEQ ID NO: 237097

SEQ ID NO: 1554554 - protein, 18 aa, Mycobacterium tuberculosis
YTVFAPTNAAFSKLPAST

SEQ ID NO: 1554555 - protein, 23 aa, Mycobacterium tuberculosis
YTYHSKTLGWCDIAYNALVDKYG

SEQ ID NO: 1554556 - protein, 21 aa, Mycobacterium tuberculosis
YWVRKPTYHNSFWYSSCMVTF

SEQ ID NO: 1554557 - protein, 24 aa, Mycobacterium tuberculosis
AAKSLGWRAAPIPRNAPGCRGCCQ

SEQ ID NO: 1554558 - protein, 18 aa, Mycobacterium tuberculosis
ADVLINNAFRVPSMKPLA

SEQ ID NO: 1554559 - protein, 19 aa, Mycobacterium tuberculosis
AGVGIKLPHYSGSQYNLGR

SEQ ID NO: 1554560 - protein, 25 aa, Mycobacterium tuberculosis
AIAPGAPPAALPPGAPPGDGPAPGV

SEQ ID NO: 1554561 - protein, 19 aa, Mycobacterium tuberculosis
AIKLKNWVATLTLSLKKDV

SEQ ID NO: 1554562 - protein, 20 aa, Mycobacterium tuberculosis
AITLWLGLVAQFGQMITGGS

SEQ ID NO: 1554563 - protein, 22 aa, Mycobacterium tuberculosis
AIYQRWQALGGMNSALGAPTSP

SEQ ID NO: 1554564 - protein, 26 aa, Mycobacterium tuberculosis
ALATIARWLLTRRSVILREVGPETTP

SEQ ID NO: 1554565 - protein, 38 aa, Mycobacterium tuberculosis; identical to SEQ ID NO: 236139

SEQ ID NO: 1554566 - protein, 17 aa, Mycobacterium tuberculosis
AQLNPRLPQLGYDVRRL

SEQ ID NO: 1554567 - protein, 22 aa, Mycobacterium tuberculosis
ASLAAGTWLLRALHGTPAALGA

SEQ ID NO: 1554568 - protein, 32 aa, Mycobacterium tuberculosis; identical to SEQ ID NO: 236193

SEQ ID NO: 1554569 - protein, 21 aa, Mycobacterium tuberculosis
ATFAKGAMYWSPVTDAQPITG

SEQ ID NO: 1554570 - protein, 25 aa, Mycobacterium tuberculosis
ATYGSSVLILPDALLDAVHISASLC

SEQ ID NO: 1554571 - protein, 26 aa, Mycobacterium tuberculosis
AVLPRSATPVLLPDVVAAAPGMTAAL

SEQ ID NO: 1554572 - protein, 18 aa, Mycobacterium tuberculosis
CRDIPFDVIQRLGLAYTP

SEQ ID NO: 1554573 - protein, 34 aa, Mycobacterium tuberculosis; identical to SEQ ID NO: 236245

SEQ ID NO: 1554574 - protein, 18 aa, Mycobacterium tuberculosis
DHGPFDLTLLPIGAYNTA

SEQ ID NO: 1554575 - protein, 21 aa, Mycobacterium tuberculosis
DLHKMRRLIIASEPVHAEGMR

SEQ ID NO: 1554576 - protein, 17 aa, Mycobacterium tuberculosis
DLTLLPIGAYNTAWPDI

SEQ ID NO: 1554577 - protein, 20 aa, Mycobacterium tuberculosis
DNPRYVIGIMLDNPARNSDG

SEQ ID NO: 1554578 - protein, 21 aa, Mycobacterium tuberculosis
DWADEVYVFGYPRVPMTAEMA

SEQ ID NO: 1554579 - protein, 19 aa, Mycobacterium tuberculosis
EDIRFGLYGALAHPMESAA

SEQ ID NO: 1554580 - protein, 22 aa, Mycobacterium tuberculosis
EFNVALPWRKEVSLSKSSLHPA

SEQ ID NO: 1554581 - protein, 21 aa, Mycobacterium tuberculosis
EPAESLPPPYDNRLAQPYGGY

SEQ ID NO: 1554582 - protein, 20 aa, Mycobacterium tuberculosis
ERSRWLFSNPEMTHLSVLRN

SEQ ID NO: 1554583 - protein, 17 aa, Mycobacterium tuberculosis
EVHLDRDFRVLDTEPAD

SEQ ID NO: 1554584 - protein, 26 aa, Mycobacterium tuberculosis
FDCSGLVLYSFAGVGIKLPHYSGSQY

SEQ ID NO: 1554585 - protein, 17 aa, Mycobacterium tuberculosis
FDVIQRLGLAYTPPEAE

SEQ ID NO: 1554586 - protein, 18 aa, Mycobacterium tuberculosis
FFDQFFLDATHSGIGQFV

SEQ ID NO: 1554587 - protein, 24 aa, Mycobacterium tuberculosis
FGRAWFVDLAPITDPDLVPVTVAG

SEQ ID NO: 1554588 - protein, 23 aa, Mycobacterium tuberculosis
GASIYNVSVLLDPNKGLANLLAN

SEQ ID NO: 1554589 - protein, 26 aa, Mycobacterium tuberculosis
GGGILGPHFSFSWYRGSPIGRERKTE

SEQ ID NO: 1554590 - protein, 20 aa, Mycobacterium tuberculosis
GLSLAVLAAAPTAGAEPTGA

SEQ ID NO: 1554591 - protein, 24 aa, Mycobacterium tuberculosis
GLVRTVHLPAPNVAGLLSAAGVPL

SEQ ID NO: 1554592 - protein, 24 aa, Mycobacterium tuberculosis
GPEGLPSVFVYDGYPGGAGFAERG

SEQ ID NO: 1554593 - protein, 28 aa, Mycobacterium tuberculosis
GPSLSLVLIDRIPFPRPDDPLLSARQRA

SEQ ID NO: 1554594 - protein, 17 aa, Mycobacterium tuberculosis
GWTGRFVSRILIDGSTL

SEQ ID NO: 1554595 - protein, 18 aa, Mycobacterium tuberculosis
IPVDPRTLSTSADNVWAI

SEQ ID NO: 1554596 - protein, 18 aa, Mycobacterium tuberculosis
KRLDGLPLAIELAAARLR

SEQ ID NO: 1554597 - protein, 26 aa, Mycobacterium tuberculosis
KSTFVALTLAPLLPGIVFVNADEIAK

SEQ ID NO: 1554598 - protein, 25 aa, Mycobacterium tuberculosis
KSYPLASFGAALLPPELGGPLPAQF

SEQ ID NO: 1554599 - protein, 23 aa, Mycobacterium tuberculosis
KTPVGAMALLAEALLASADDSET

SEQ ID NO: 1554600 - protein, 20 aa, Mycobacterium tuberculosis
KVTERLPLPPNARRVEDPEM

SEQ ID NO: 1554601 - protein, 18 aa, Mycobacterium tuberculosis
LAALALAPRLAGMAELVQ

SEQ ID NO: 1554602 - protein, 27 aa, Mycobacterium tuberculosis
LELPTRYLGLVTAVEYGRRARLAVQAM

SEQ ID NO: 1554603 - protein, 18 aa, Mycobacterium tuberculosis
LETDQAFGWVAFEFGVHR

SEQ ID NO: 1554604 - protein, 25 aa, Mycobacterium tuberculosis
LRNHARWAVLLRNLRFVIVDECHYY

SEQ ID NO: 1554605 - protein, 17 aa, Mycobacterium tuberculosis
LTALAAVTLVVVAGCEA

SEQ ID NO: 1554606 - protein, 19 aa, Mycobacterium tuberculosis
LTAMAATVVIVAWIANRPP

SEQ ID NO: 1554607 - protein, 17 aa, Mycobacterium tuberculosis
MLATLGLGRLERFLARD

SEQ ID NO: 1554608 - protein, 17 aa, Mycobacterium tuberculosis
NALPRRPKFALLKGRRN

SEQ ID NO: 1554609 - protein, 20 aa, Mycobacterium tuberculosis
NISAILISPPQAPPGTQWTP

SEQ ID NO: 1554610 - protein, 19 aa, Mycobacterium tuberculosis
PALLSPRDKLAQLLVVGVR

SEQ ID NO: 1554611 - protein, 24 aa, Mycobacterium tuberculosis
PARHFSGRFLSRNTTLWASWAFVG

SEQ ID NO: 1554612 - protein, 17 aa, Mycobacterium tuberculosis
PDDPLLSARQRAVAARG

SEQ ID NO: 1554613 - protein, 26 aa, Mycobacterium tuberculosis
PGRQKIFLYSAIARPGNSGGPIVAQD

SEQ ID NO: 1554614 - protein, 22 aa, Mycobacterium tuberculosis
PGSRLAFEFVPDTAIFADERWR

SEQ ID NO: 1554615 - protein, 25 aa, Mycobacterium tuberculosis
PIQIRTVGRLLGWRLGMDDVDPRSM

SEQ ID NO: 1554616 - protein, 24 aa, Mycobacterium tuberculosis
PRARASFYGYGFNVGVTSSGRTEY

SEQ ID NO: 1554617 - protein, 21 aa, Mycobacterium tuberculosis
PSPSMGRDIPVAFLAGGPHAV

SEQ ID NO: 1554618 - protein, 29 aa, Mycobacterium tuberculosis
PVAQSYLRNFLAAPPPQRAAMAAQLQAVP

SEQ ID NO: 1554619 - protein, 32 aa, Mycobacterium tuberculosis; identical to SEQ ID NO: 236787

SEQ ID NO: 1554620 - protein, 20 aa, Mycobacterium tuberculosis
RGVVITYRNLLSNMRAMAVG

SEQ ID NO: 1554621 - protein, 31 aa, Mycobacterium tuberculosis; identical to SEQ ID NO: 236839

SEQ ID NO: 1554622 - protein, 23 aa, Mycobacterium tuberculosis
RPRVAVWGIHLLRRGGLTGDGIP

SEQ ID NO: 1554623 - protein, 27 aa, Mycobacterium tuberculosis
RPTPTITARLNFQLAFGARVGQRLADA

SEQ ID NO: 1554624 - protein, 18 aa, Mycobacterium tuberculosis
RQPVAVSASFLWAPDPGT

SEQ ID NO: 1554625 - protein, 24 aa, Mycobacterium tuberculosis
RRRAELLVWLNPRAAHPEFQPRAG

SEQ ID NO: 1554626 - protein, 21 aa, Mycobacterium tuberculosis
RSYRLHVPPAEPSGLVISLHG

SEQ ID NO: 1554627 - protein, 18 aa, Mycobacterium tuberculosis
RVWSKPGTGSTFTLALPA

SEQ ID NO: 1554628 - protein, 23 aa, Mycobacterium tuberculosis
SAYAIDMLLQPRTSHAAPAAAIG

SEQ ID NO: 1554629 - protein, 20 aa, Mycobacterium tuberculosis
SGIGQFVILASGLDARAYRL

SEQ ID NO: 1554630 - protein, 26 aa, Mycobacterium tuberculosis
SGMLVPVHWGTFRLAPHPWGEPVERL

SEQ ID NO: 1554631 - protein, 24 aa, Mycobacterium tuberculosis
SLVGQFVFPNFANPIQLICSAIQA

SEQ ID NO: 1554632 - protein, 19 aa, Mycobacterium tuberculosis
SMCNNGWTYPPFADTRRGE

SEQ ID NO: 1554633 - protein, 32 aa, Mycobacterium tuberculosis; identical to SEQ ID NO: 236920

SEQ ID NO: 1554634 - protein, 17 aa, Mycobacterium tuberculosis
SPDEVRRFARERSRWLF

SEQ ID NO: 1554635 - protein, 28 aa, Mycobacterium tuberculosis
SRNTTLWASWAFVGPNHRAYFGGDTGYT

SEQ ID NO: 1554636 - protein, 26 aa, Mycobacterium tuberculosis
SSDLRVGQPVLAIGSPLGLEGTVTTG

SEQ ID NO: 1554637 - protein, 20 aa, Mycobacterium tuberculosis
TAATLGLAALGFAGTASASS

SEQ ID NO: 1554638 - protein, 31 aa, Mycobacterium tuberculosis; identical to SEQ ID NO: 236953

SEQ ID NO: 1554639 - protein, 30 aa, Mycobacterium tuberculosis; identical to SEQ ID NO: 236956

SEQ ID NO: 1554640 - protein, 26 aa, Mycobacterium tuberculosis
TGTGERLVFGPVALGLVPVTVTNHVV

SEQ ID NO: 1554641 - protein, 28 aa, Mycobacterium tuberculosis
TYPSIYDPAMRTLIAFGGKYPTSVIPST

SEQ ID NO: 1554642 - protein, 34 aa, Mycobacterium tuberculosis; identical to SEQ ID NO: 237009

SEQ ID NO: 1554643 - protein, 17 aa, Mycobacterium tuberculosis
VALRSWRPRVAVWGIHL

SEQ ID NO: 1554644 - protein, 17 aa, Mycobacterium tuberculosis
VAPVRTAGMTPYVVRYI

SEQ ID NO: 1554645 - protein, 23 aa, Mycobacterium tuberculosis
VGDDLVPYRTLVTQAPVGVMVGH

SEQ ID NO: 1554646 - protein, 31 aa, Mycobacterium tuberculosis; identical to SEQ ID NO: 237065

SEQ ID NO: 1554647 - protein, 21 aa, Mycobacterium tuberculosis
VRRFARERSRWLFSNPEMTHL

SEQ ID NO: 1554648 - protein, 24 aa, Mycobacterium tuberculosis
VSQMLQCIVTLMPLGAAVVDTHRD

SEQ ID NO: 1554649 - protein, 26 aa, Mycobacterium tuberculosis
WESVLLARIRPRRRPRRVLLLCDVSR

SEQ ID NO: 1554650 - protein, 17 aa, Mycobacterium tuberculosis
WHNWRVTWNPSGMYFWL

SEQ ID NO: 1554651 - protein, 20 aa, Mycobacterium tuberculosis
WIPMVIVIVVAVAAVTVSRL

SEQ ID NO: 1554652 - protein, 23 aa, Mycobacterium tuberculosis
WRFSVPLVCLLAGLLLAATHGVS

SEQ ID NO: 1554653 - protein, 17 aa, Mycobacterium tuberculosis
YPPFADTRRGEEGYFVL

SEQ ID NO: 1554654 - protein, 22 aa, Mycobacterium tuberculosis
YPSAGIEQLIFAPQGSLAQSRT

SEQ ID NO: 1554655 - protein, 29 aa, Mycobacterium tuberculosis
AAAHHKPQLAFLPRQAFLDTNIIGTQTVL

SEQ ID NO: 1554656 - protein, 19 aa, Mycobacterium tuberculosis
AAALPYCDLFLPAHSLAGL

SEQ ID NO: 1554657 - protein, 23 aa, Mycobacterium tuberculosis
AAFYRLSSLRLWPDRRLSRRGVE

SEQ ID NO: 1554658 - protein, 26 aa, Mycobacterium tuberculosis
AGRLGLRPDVRRMPLFGLGCVAGAAG

SEQ ID NO: 1554659 - protein, 26 aa, Mycobacterium tuberculosis
AGRNYLYDAWAARFLVTARLNNSLPE

SEQ ID NO: 1554660 - protein, 19 aa, Mycobacterium tuberculosis
AHSHQPLRWGPPEAPDRYV

SEQ ID NO: 1554661 - protein, 24 aa, Mycobacterium tuberculosis
ALASSLLRVWMTRGRIQEGRAWFD

SEQ ID NO: 1554662 - protein, 25 aa, Mycobacterium tuberculosis
ALDRGALTAFLSWLESRPSPRARRR

SEQ ID NO: 1554663 - protein, 21 aa, Mycobacterium tuberculosis
ANIISDKLFQRVGARPDSVTC

SEQ ID NO: 1554664 - protein, 17 aa, Mycobacterium tuberculosis
APRGVVITYRNLLSNMR

SEQ ID NO: 1554665 - protein, 17 aa, Mycobacterium tuberculosis
ARRAWLAELAEERRTCV

SEQ ID NO: 1554666 - protein, 29 aa, Mycobacterium tuberculosis
ARRVADVLGIPFYVWDFAEKFKEDVINDF

SEQ ID NO: 1554667 - protein, 27 aa, Mycobacterium tuberculosis
ASNFNNLYYPLHSSLVGQFVFPNFANP

SEQ ID NO: 1554668 - protein, 24 aa, Mycobacterium tuberculosis
ATAIDPQHRLLLEVSWEAIEHAGV

SEQ ID NO: 1554669 - protein, 27 aa, Mycobacterium tuberculosis
DLRAQLQRLTALLQPTRPGGVSTLGAL

SEQ ID NO: 1554670 - protein, 17 aa, Mycobacterium tuberculosis
DVRLLFSLGLRAMERTA

SEQ ID NO: 1554671 - protein, 22 aa, Mycobacterium tuberculosis
EERRTCVFFESPRRLAACLNDA

SEQ ID NO: 1554672 - protein, 26 aa, Mycobacterium tuberculosis
ELLRPGLLVLPVRGPARFFGSEQMAA

SEQ ID NO: 1554673 - protein, 24 aa, Mycobacterium tuberculosis
FAIGLAMMLAPMVAAPGLAAADPA

SEQ ID NO: 1554674 - protein, 25 aa, Mycobacterium tuberculosis
FAVTNDGVIFFFNPGELLPEAAGPT

SEQ ID NO: 1554675 - protein, 26 aa, Mycobacterium tuberculosis
FCARDPFGIKPLFIATGAGGTAVASE

SEQ ID NO: 1554676 - protein, 24 aa, Mycobacterium tuberculosis
GDALFVQLHAPLRGVARGQTLVLY

SEQ ID NO: 1554677 - protein, 25 aa, Mycobacterium tuberculosis
GGIIGRACWPSWTPPPLMSRWSNRP

SEQ ID NO: 1554678 - protein, 22 aa, Mycobacterium tuberculosis
GGLPGDLTFSWYAVDKTGQPWV

SEQ ID NO: 1554679 - protein, 19 aa, Mycobacterium tuberculosis
GPHAVYLLDAFNAGPDVSN

SEQ ID NO: 1554680 - protein, 24 aa, Mycobacterium tuberculosis
GQSFTSVPMLFAKPSYYGQFTDSG

SEQ ID NO: 1554681 - protein, 19 aa, Mycobacterium tuberculosis
IDAPAGELVFGPNPLPAPN

SEQ ID NO: 1554682 - protein, 18 aa, Mycobacterium tuberculosis
IDSPQRLWEALLRGDDLV

SEQ ID NO: 1554683 - protein, 21 aa, Mycobacterium tuberculosis
IKVIAGAGLFAAAIALSPDAA

SEQ ID NO: 1554684 - protein, 19 aa, Mycobacterium tuberculosis
ILFAVIGVAVLVTAVSFTG

SEQ ID NO: 1554685 - protein, 35 aa, Mycobacterium tuberculosis; identical to SEQ ID NO: 236529

SEQ ID NO: 1554686 - protein, 23 aa, Mycobacterium tuberculosis
IQLDRSVWPYIGAKAGGLPGDLT

SEQ ID NO: 1554687 - protein, 18 aa, Mycobacterium tuberculosis
IQTEFNVALPWRKEVSLS

SEQ ID NO: 1554688 - protein, 19 aa, Mycobacterium tuberculosis
ITYDTLWQADTDPLPVVFP

SEQ ID NO: 1554689 - protein, 41 aa, Mycobacterium tuberculosis; identical to SEQ ID NO: 236557

SEQ ID NO: 1554690 - protein, 22 aa, Mycobacterium tuberculosis
KVLQFAPGELKNLPGFQGSGDG

SEQ ID NO: 1554691 - protein, 17 aa, Mycobacterium tuberculosis
LAGVLSALALAVGGAVG

SEQ ID NO: 1554692 - protein, 21 aa, Mycobacterium tuberculosis
LAVLTRLPAQVLGRVAFQVLA

SEQ ID NO: 1554693 - protein, 18 aa, Mycobacterium tuberculosis
LLLLNATMTQVFTADGLR

SEQ ID NO: 1554694 - protein, 17 aa, Mycobacterium tuberculosis
LTERPDLLMAATEDLLH

SEQ ID NO: 1554695 - protein, 23 aa, Mycobacterium tuberculosis
NGSRIYVLLPQTTTGRAVTSWVR

SEQ ID NO: 1554696 - protein, 23 aa, Mycobacterium tuberculosis
NSGYPEHTFTWETGLRLRAALNA

SEQ ID NO: 1554697 - protein, 18 aa, Mycobacterium tuberculosis
PAQVLGRVAFQVLAGLAE

SEQ ID NO: 1554698 - protein, 22 aa, Mycobacterium tuberculosis
PDSHDICFIPSGNTKAFLGERI

SEQ ID NO: 1554699 - protein, 19 aa, Mycobacterium tuberculosis
PEIVWYLDEPVADPALVPL

SEQ ID NO: 1554700 - protein, 20 aa, Mycobacterium tuberculosis
PFADLLVPKLTASVTDGAVG

SEQ ID NO: 1554701 - protein, 23 aa, Mycobacterium tuberculosis
PIVKNRQYNYPPLGANLFVGAQA

SEQ ID NO: 1554702 - protein, 24 aa, Mycobacterium tuberculosis
PQAARRFSVLSLPTTLIFDVDGRQ

SEQ ID NO: 1554703 - protein, 33 aa, Mycobacterium tuberculosis; identical to SEQ ID NO: 236767

SEQ ID NO: 1554704 - protein, 25 aa, Mycobacterium tuberculosis
QRLRGMFAFALWDTVTRELFCARDP

SEQ ID NO: 1554705 - protein, 20 aa, Mycobacterium tuberculosis
RDAGVLPVLKHFPGHGRGSG

SEQ ID NO: 1554706 - protein, 20 aa, Mycobacterium tuberculosis
RGSAYHYFPGGRTQLLCEAV

SEQ ID NO: 1554707 - protein, 17 aa, Mycobacterium tuberculosis
RIAGRLGLRPDVRRMPL

SEQ ID NO: 1554708 - protein, 18 aa, Mycobacterium tuberculosis
RLVWQSASLLLAYPDDGL

SEQ ID NO: 1554709 - protein, 25 aa, Mycobacterium tuberculosis
RVALQAIGRLLFAAGAVEVLTGIPG

SEQ ID NO: 1554710 - protein, 21 aa, Mycobacterium tuberculosis
RYYDMLRKFGLGQRTGVGLPG

SEQ ID NO: 1554711 - protein, 29 aa, Mycobacterium tuberculosis
SDHSRRLWTMLIFMLWHAIFVEHSVVPQI

SEQ ID NO: 1554712 - protein, 23 aa, Mycobacterium tuberculosis
SNALWCRWCLGYAQLMRGELAAA

SEQ ID NO: 1554713 - protein, 18 aa, Mycobacterium tuberculosis
TADTLRQLLPPEDRIILV

SEQ ID NO: 1554714 - protein, 21 aa, Mycobacterium tuberculosis
TLQAFLHWAITDGNKASFLDQ

SEQ ID NO: 1554715 - protein, 24 aa, Mycobacterium tuberculosis
TTERFMTRLGPLLRHHRVLICTPA

SEQ ID NO: 1554716 - protein, 21 aa, Mycobacterium tuberculosis
TTYPVWMMNAIGDISFHHATA

SEQ ID NO: 1554717 - protein, 22 aa, Mycobacterium tuberculosis
VDTSPYSVAYLIDSHQDRTGAD

SEQ ID NO: 1554718 - protein, 23 aa, Mycobacterium tuberculosis
VEPRARWERLYHLVNHVLEHHGD

SEQ ID NO: 1554719 - protein, 24 aa, Mycobacterium tuberculosis
VLAVPTQMWGFTNPLPPGSDEHIA

SEQ ID NO: 1554720 - protein, 35 aa, Mycobacterium tuberculosis; identical to SEQ ID NO: 237050

SEQ ID NO: 1554721 - protein, 24 aa, Mycobacterium tuberculosis
VNGRHLVLPLQQYPSLTDFGDANE

SEQ ID NO: 1554722 - protein, 20 aa, Mycobacterium tuberculosis
WGAPQLGRWKWHDPWVHASL

SEQ ID NO: 1554723 - protein, 21 aa, Mycobacterium tuberculosis
WIPLLILVVVAIAGFTVQRIR

SEQ ID NO: 1554724 - protein, 21 aa, Mycobacterium tuberculosis
WPGGRQYLPKAVIGATTRAFD

SEQ ID NO: 1554725 - protein, 28 aa, Mycobacterium tuberculosis
YDESNPLPPPWYPQPASLPAAGATGQPG

SEQ ID NO: 1554726 - protein, 21 aa, Mycobacterium tuberculosis
YGLLPGLALALTCGAGLLKWQ

SEQ ID NO: 1554727 - protein, 17 aa, Mycobacterium tuberculosis
YSDGRPVTCDDLVLAWA

SEQ ID NO: 1554728 - protein, 17 aa, Mycobacterium tuberculosis
AAAVSALLLTGCSGRDA

SEQ ID NO: 1554729 - protein, 19 aa, Mycobacterium tuberculosis
AEIIRLGTALGANGATLAG

SEQ ID NO: 1554730 - protein, 19 aa, Mycobacterium tuberculosis
AFTIEARALTFQPKRIRRQ

SEQ ID NO: 1554731 - protein, 17 aa, Mycobacterium tuberculosis
AGCALVMHKPHSAGSSN

SEQ ID NO: 1554732 - protein, 27 aa, Mycobacterium tuberculosis
AGWRGDYPSMIEFLAPLFTAGAGSNDV

SEQ ID NO: 1554733 - protein, 25 aa, Mycobacterium tuberculosis
AIQPKLTFTWRIMPQNLSDAGISWK

SEQ ID NO: 1554734 - protein, 29 aa, Mycobacterium tuberculosis
AMTASAEYLRLLRRHNVAAALSGAGPSLI

SEQ ID NO: 1554735 - protein, 28 aa, Mycobacterium tuberculosis
APDAGPPQRWFVVWLGTANNPVDKGAAK

SEQ ID NO: 1554736 - protein, 19 aa, Mycobacterium tuberculosis
ASGRVAYTLGLHGPAVTVD

SEQ ID NO: 1554737 - protein, 19 aa, Mycobacterium tuberculosis
ASLLASWVGAVPQVGLAAS

SEQ ID NO: 1554738 - protein, 24 aa, Mycobacterium tuberculosis
ATLQSHRAWLFADAARHEMRDRWA

SEQ ID NO: 1554739 - protein, 23 aa, Mycobacterium tuberculosis
CGSIVSGLRMRPGNWAGIYACWG

SEQ ID NO: 1554740 - protein, 25 aa, Mycobacterium tuberculosis
DGLGSYFWQHNWGSPKGYTHPAAHL

SEQ ID NO: 1554741 - protein, 17 aa, Mycobacterium tuberculosis
DLLSRARDSLQSHGSIA

SEQ ID NO: 1554742 - protein, 25 aa, Mycobacterium tuberculosis
DQLKTDAKLLSSILTYHVIAGQASP

SEQ ID NO: 1554743 - protein, 22 aa, Mycobacterium tuberculosis
EAAWRNLSLALPLSAAVQRAFN

SEQ ID NO: 1554744 - protein, 27 aa, Mycobacterium tuberculosis
EDAGFDPNLPPPLAPDFLSPPAEEAPP

SEQ ID NO: 1554745 - protein, 31 aa, Mycobacterium tuberculosis; identical to SEQ ID NO: 237199

SEQ ID NO: 1554746 - protein, 25 aa, Mycobacterium tuberculosis
EVENPKCHLAWTTLAGIGRVESHHG

SEQ ID NO: 1554747 - protein, 17 aa, Mycobacterium tuberculosis
GESRLFVPVLRSAINSH

SEQ ID NO: 1554748 - protein, 24 aa, Mycobacterium tuberculosis
GFLNEGLPYRVPYPQTTPVQESGP

SEQ ID NO: 1554749 - protein, 25 aa, Mycobacterium tuberculosis
GGDARFLSLLSIRQLATEPSLSGPG

SEQ ID NO: 1554750 - protein, 23 aa, Mycobacterium tuberculosis
GHPRLGHNLALHPATMLAGLFDD

SEQ ID NO: 1554751 - protein, 26 aa, Mycobacterium tuberculosis
GIGHPCWANYFPVTRAVPEPPSIRQC

SEQ ID NO: 1554752 - protein, 24 aa, Mycobacterium tuberculosis
GLQVKTIWVARAVSVLFPQITNIF

SEQ ID NO: 1554753 - protein, 19 aa, Mycobacterium tuberculosis
GLVVWFNTLLVSAGGSVLS

SEQ ID NO: 1554754 - protein, 22 aa, Mycobacterium tuberculosis
GLYGHKSTWRSVPLVGHIPSAP

SEQ ID NO: 1554755 - protein, 21 aa, Mycobacterium tuberculosis
GNTKAFLGERIGVRRGVVVDA

SEQ ID NO: 1554756 - protein, 23 aa, Mycobacterium tuberculosis
GPVQRWRREVPFDVHLMIFGDST

SEQ ID NO: 1554757 - protein, 23 aa, Mycobacterium tuberculosis
GSDMGEFYMPYPGTRINQETVSL

SEQ ID NO: 1554758 - protein, 23 aa, Mycobacterium tuberculosis
GSTFTLALPALIEAYHDDERPEQ

SEQ ID NO: 1554759 - protein, 25 aa, Mycobacterium tuberculosis
GVSRSYWDQLKWNALANIAGTPATT

SEQ ID NO: 1554760 - protein, 24 aa, Mycobacterium tuberculosis
HDPLVQGLRALGHRVNLAEQSSGL

SEQ ID NO: 1554761 - protein, 19 aa, Mycobacterium tuberculosis
HGFTIGQRRGLGIAGPGPN

SEQ ID NO: 1554762 - protein, 18 aa, Mycobacterium tuberculosis
HQWIAAHLSWNGGANDGW

SEQ ID NO: 1554763 - protein, 20 aa, Mycobacterium tuberculosis
LALAMGVVLGSGFFSDTLLS

SEQ ID NO: 1554764 - protein, 24 aa, Mycobacterium tuberculosis
LARYGIAPAYPWDFIRDVINNTLP

SEQ ID NO: 1554765 - protein, 23 aa, Mycobacterium tuberculosis
LLDATAALVLALVKACRGVRLLA

SEQ ID NO: 1554766 - protein, 23 aa, Mycobacterium tuberculosis
LLMTGAGYWVAHGALGGITISQA

SEQ ID NO: 1554767 - protein, 17 aa, Mycobacterium tuberculosis
LVVLDNCEHLLDATAAL

SEQ ID NO: 1554768 - protein, 18 aa, Mycobacterium tuberculosis
LYETFTFNGGQYAFPEQW

SEQ ID NO: 1554769 - protein, 30 aa, Mycobacterium tuberculosis; identical to SEQ ID NO: 236652

SEQ ID NO: 1554770 - protein, 26 aa, Mycobacterium tuberculosis
NAKRWGVLHVIWRQGYYPGIGAPSWT

SEQ ID NO: 1554771 - protein, 20 aa, Mycobacterium tuberculosis
PGLLTIEDLAGYLAKRRQPL

SEQ ID NO: 1554772 - protein, 17 aa, Mycobacterium tuberculosis
PNSFILATNFSFTGVTP

SEQ ID NO: 1554773 - protein, 25 aa, Mycobacterium tuberculosis
PPEHLQWIGQWGIFDALRAGREVVR

SEQ ID NO: 1554774 - protein, 18 aa, Mycobacterium tuberculosis
PPLRRLDLKRGEPVLITA

SEQ ID NO: 1554775 - protein, 25 aa, Mycobacterium tuberculosis
PTTLSVPFSAFPKPQNYPGLPTVSF

SEQ ID NO: 1554776 - protein, 19 aa, Mycobacterium tuberculosis
PVGVRRLRNYHSTRSAHYC

SEQ ID NO: 1554777 - protein, 17 aa, Mycobacterium tuberculosis
QADTDPLPVVFPIVQGE

SEQ ID NO: 1554778 - protein, 21 aa, Mycobacterium tuberculosis
QTMRANLERWAPLLPEGATLV

SEQ ID NO: 1554779 - protein, 22 aa, Mycobacterium tuberculosis
QVAAPLAAYVPAVRTGNLVYTA

SEQ ID NO: 1554780 - protein, 17 aa, Mycobacterium tuberculosis
RCRRTLRAIIAAARLNP

SEQ ID NO: 1554781 - protein, 29 aa, Mycobacterium tuberculosis
RDRQWGFVNAWVSFYAAGLFAMNNGVPWS

SEQ ID NO: 1554782 - protein, 23 aa, Mycobacterium tuberculosis
RDSLLTTHPLPNIGRVVITGNPV

SEQ ID NO: 1554783 - protein, 17 aa, Mycobacterium tuberculosis
RGRWLAIAASLVVSAAI

SEQ ID NO: 1554784 - protein, 18 aa, Mycobacterium tuberculosis
RLWEALLRGDDLVGEIPA

SEQ ID NO: 1554785 - protein, 17 aa, Mycobacterium tuberculosis
RMRPGNWAGIYACWGTE

SEQ ID NO: 1554786 - protein, 20 aa, Mycobacterium tuberculosis
RRTLRAIIAAARLNPTQLDP

SEQ ID NO: 1554787 - protein, 29 aa, Mycobacterium tuberculosis
RSTTDTVLRFLGGRPALVVLDNCEHLLDA

SEQ ID NO: 1554788 - protein, 28 aa, Mycobacterium tuberculosis
RSVIASLTGWQWLGPSSVRMGAAVTPYV

SEQ ID NO: 1554789 - protein, 17 aa, Mycobacterium tuberculosis
RWLAIAASLVVSAAILY

SEQ ID NO: 1554790 - protein, 19 aa, Mycobacterium tuberculosis
SDWDTYRSLAPLQGLLFPQ

SEQ ID NO: 1554791 - protein, 24 aa, Mycobacterium tuberculosis
SGEGCVVLLLKRLPDAVRDGDRVL

SEQ ID NO: 1554792 - protein, 19 aa, Mycobacterium tuberculosis
SGMYFWLDYADGIEPYFSV

SEQ ID NO: 1554793 - protein, 23 aa, Mycobacterium tuberculosis
SVVGLVHTPGLVTLAPGARIADA

SEQ ID NO: 1554794 - protein, 18 aa, Mycobacterium tuberculosis
SYSGVFVHSAPWSVGAQG

SEQ ID NO: 1554795 - protein, 23 aa, Mycobacterium tuberculosis
TAGQLPLEAGKLVRTGKLGADVN

SEQ ID NO: 1554796 - protein, 28 aa, Mycobacterium tuberculosis
TDPRHTPPHAWYIAFAPAQAPKVAVAVL

SEQ ID NO: 1554797 - protein, 18 aa, Mycobacterium tuberculosis
TGFIGVVLVTAGKASADP

SEQ ID NO: 1554798 - protein, 26 aa, Mycobacterium tuberculosis
TTRYNPDYLPGALLPPSIHATADAEE

SEQ ID NO: 1554799 - protein, 21 aa, Mycobacterium tuberculosis
TVGGLMLPVGVRRLRNYHSTR

SEQ ID NO: 1554800 - protein, 24 aa, Mycobacterium tuberculosis
VAAADQLVLTRLIIGRTARRHGLR

SEQ ID NO: 1554801 - protein, 18 aa, Mycobacterium tuberculosis
VDLLNMIDPLKLNAVLTA

SEQ ID NO: 1554802 - protein, 17 aa, Mycobacterium tuberculosis
VGAIRYVSDRRPGGAWM

SEQ ID NO: 1554803 - protein, 18 aa, Mycobacterium tuberculosis
VLEVEFALDPSGRSAPLR

SEQ ID NO: 1554804 - protein, 19 aa, Mycobacterium tuberculosis
VLVTVFTLIRDRTEPVMSA

SEQ ID NO: 1554805 - protein, 34 aa, Mycobacterium tuberculosis; identical to SEQ ID NO: 237072

SEQ ID NO: 1554806 - protein, 22 aa, Mycobacterium tuberculosis
VTAITAPDWQQGLSASVRAGLA

SEQ ID NO: 1554807 - protein, 26 aa, Mycobacterium tuberculosis
VTIVNLIRVLLRNPAVWEKTALIIAY

SEQ ID NO: 1554808 - protein, 20 aa, Mycobacterium tuberculosis
WLMQRENVPLSPDPGPPLVL

SEQ ID NO: 1554809 - protein, 26 aa, Mycobacterium tuberculosis
YARPDIPIHYLLADTFTICDQYFSSL

SEQ ID NO: 1554810 - protein, 17 aa, Mycobacterium tuberculosis
YFHGITLHKNGVTANMS

SEQ ID NO: 1554811 - protein, 25 aa, Mycobacterium tuberculosis
YNHGAYVFLGPGFTPGSPSGGSGGS

SEQ ID NO: 1554812 - protein, 30 aa, Mycobacterium tuberculosis; identical to SEQ ID NO: 942065

SEQ ID NO: 1554813 - protein, 26 aa, Mycobacterium tuberculosis
AANSWLDAFAHWRRAQGLPATSIAWG

SEQ ID NO: 1554814 - protein, 27 aa, Mycobacterium tuberculosis
ADLVYHLTTLFPPVRPRQWLEIRYLDS

SEQ ID NO: 1554815 - protein, 26 aa, Mycobacterium tuberculosis
AEGARAFQTLLRYGRAYSGYAPIMGT

SEQ ID NO: 1554816 - protein, 25 aa, Mycobacterium tuberculosis
AELPGEPPRLFVVTRSAASVLPSDL

SEQ ID NO: 1554817 - protein, 22 aa, Mycobacterium tuberculosis
ALGTPAPSFTLPQPATGATVSL

SEQ ID NO: 1554818 - protein, 23 aa, Mycobacterium tuberculosis
ALQQLVPRTPAALYWGARLTLVS

SEQ ID NO: 1554819 - protein, 19 aa, Mycobacterium tuberculosis
ATIALQRQLVDRDLPQLVD

SEQ ID NO: 1554820 - protein, 17 aa, Mycobacterium tuberculosis
AVRAFMQAAIGPGQEGL

SEQ ID NO: 1554821 - protein, 26 aa, Mycobacterium tuberculosis
CGSPAWDLPTVFGPIAITYNIKGVST

SEQ ID NO: 1554822 - protein, 28 aa, Mycobacterium tuberculosis
DCAASPAGWLFVSRWTAGGNSLHIRAGD

SEQ ID NO: 1554823 - protein, 17 aa, Mycobacterium tuberculosis
DDPFRALDMLASLWSST

SEQ ID NO: 1554824 - protein, 23 aa, Mycobacterium tuberculosis
DEVWPAVVFTLVTLLDDPVAADL

SEQ ID NO: 1554825 - protein, 28 aa, Mycobacterium tuberculosis
DGAYLVTGGLGGLGLFLAGELAAAGCGR

SEQ ID NO: 1554826 - protein, 18 aa, Mycobacterium tuberculosis
DILAPTTSLLFKYNPEYT

SEQ ID NO: 1554827 - protein, 23 aa, Mycobacterium tuberculosis
DMPIATLAAMRRGEQLPFGLRGF

SEQ ID NO: 1554828 - protein, 20 aa, Mycobacterium tuberculosis
DQISLLLRRTIDPDRPLSDY

SEQ ID NO: 1554829 - protein, 22 aa, Mycobacterium tuberculosis
DQYGSIPLPKSFQAKLAAAVNA

SEQ ID NO: 1554830 - protein, 24 aa, Mycobacterium tuberculosis
DRFADFPALPLDPSAMVAQVGPQV

SEQ ID NO: 1554831 - protein, 22 aa, Mycobacterium tuberculosis
EELRKMFNSLGIQYGPAFSGLV

SEQ ID NO: 1554832 - protein, 25 aa, Mycobacterium tuberculosis
EGPSNPLILVFGRVSELSTCSWSTH

SEQ ID NO: 1554833 - protein, 24 aa, Mycobacterium tuberculosis
EHGRTPWRDLFGPAVTLADGGFDI

SEQ ID NO: 1554834 - protein, 25 aa, Mycobacterium tuberculosis
EPALLSRALTACGLIAVAVARADAA

SEQ ID NO: 1554835 - protein, 37 aa, Mycobacterium tuberculosis
FGEPSSGFSSMLWGGGSLPTIGPLYSSKTINLCAPDD

SEQ ID NO: 1554836 - protein, 24 aa, Mycobacterium tuberculosis
FKYNPEYTCFLQGAKWYLDNGGYA

SEQ ID NO: 1554837 - protein, 23 aa, Mycobacterium tuberculosis
FWRSAGLPAYRWPDPNGTRFPNG

SEQ ID NO: 1554838 - protein, 20 aa, Mycobacterium tuberculosis
FYRRGLFGTIGPYNLRYRVL

SEQ ID NO: 1554839 - protein, 18 aa, Mycobacterium tuberculosis
GGLQFTAGTWRANGGSGS

SEQ ID NO: 1554840 - protein, 26 aa, Mycobacterium tuberculosis
GHFVPNLTIGLPVVESLLAVTDIPMD

SEQ ID NO: 1554841 - protein, 17 aa, Mycobacterium tuberculosis
GPVWVFSGQGSQWPGMG

SEQ ID NO: 1554842 - protein, 21 aa, Mycobacterium tuberculosis
GRALSILNDPFRVGGLPATNG

SEQ ID NO: 1554843 - protein, 22 aa, Mycobacterium tuberculosis
HPGIDWAKYALKAPVMMVRSPD

SEQ ID NO: 1554844 - protein, 17 aa, Mycobacterium tuberculosis
IADVDFVRLPGGSLTTL

SEQ ID NO: 1554845 - protein, 32 aa, Mycobacterium tuberculosis; identical to SEQ ID NO: 236518

SEQ ID NO: 1554846 - protein, 17 aa, Mycobacterium tuberculosis
ILTAAAALLTLDRQARI

SEQ ID NO: 1554847 - protein, 18 aa, Mycobacterium tuberculosis
IVLVRRWPKVISRAMVMR

SEQ ID NO: 1554848 - protein, 28 aa, Mycobacterium tuberculosis
KADFDPYQFLLIPLARITGIEDPALRES

SEQ ID NO: 1554849 - protein, 24 aa, Mycobacterium tuberculosis
KFRTGGYMIDFWGVGYQVAKRMGI

SEQ ID NO: 1554850 - protein, 42 aa, Mycobacterium tuberculosis
KQASAAKFIWFFATRTRFGLWFRNVAMRTMNFGPLATLFAGS

SEQ ID NO: 1554851 - protein, 32 aa, Mycobacterium tuberculosis; identical to SEQ ID NO: 237314

SEQ ID NO: 1554852 - protein, 21 aa, Mycobacterium tuberculosis
LAVLTAAPLLLAAAGCGSKPP

SEQ ID NO: 1554853 - protein, 17 aa, Mycobacterium tuberculosis
LAVTLPPELPVAAAAAV

SEQ ID NO: 1554854 - protein, 25 aa, Mycobacterium tuberculosis
LDTSSFYRPTQPGSYPIVLATYEIV

SEQ ID NO: 1554855 - protein, 26 aa, Mycobacterium tuberculosis
LFKRNICHQAIFYRRGLFGTIGPYNL

SEQ ID NO: 1554856 - protein, 18 aa, Mycobacterium tuberculosis
LIGKRFGVPVPNLTPWRA

SEQ ID NO: 1554857 - protein, 21 aa, Mycobacterium tuberculosis
LIVLMVCLAGCGGDQLLARHA

SEQ ID NO: 1554858 - protein, 25 aa, Mycobacterium tuberculosis
LRGDRTMFLFVFRAEHDNPGVAPKD

SEQ ID NO: 1554859 - protein, 17 aa, Mycobacterium tuberculosis
LRRSGLGGHPRLGHNLA

SEQ ID NO: 1554860 - protein, 25 aa, Mycobacterium tuberculosis
LRWSWLLSVLAAVGLGLATAPAQAA

SEQ ID NO: 1554861 - protein, 18 aa, Mycobacterium tuberculosis
MKTILALRHGVVPQNLHF

SEQ ID NO: 1554862 - protein, 27 aa, Mycobacterium tuberculosis
MLAGLFDDDVFAWRGVLQSAAVHEFHE

SEQ ID NO: 1554863 - protein, 19 aa, Mycobacterium tuberculosis
MPTLLQRKVLSPLGLTATA

SEQ ID NO: 1554864 - protein, 31 aa, Mycobacterium tuberculosis; identical to SEQ ID NO: 236681

SEQ ID NO: 1554865 - protein, 18 aa, Mycobacterium tuberculosis
NLSLYAVDLALLTHSHPH

SEQ ID NO: 1554866 - protein, 28 aa, Mycobacterium tuberculosis
PDSEAMLLAAIYVAALRSYGFAAHAETA

SEQ ID NO: 1554867 - protein, 31 aa, Mycobacterium tuberculosis; identical to SEQ ID NO: 163281

SEQ ID NO: 1554868 - protein, 23 aa, Mycobacterium tuberculosis
PLEPYLDILPHFDTLLVMSVEPG

SEQ ID NO: 1554869 - protein, 21 aa, Mycobacterium tuberculosis
PRPWDPLPCANLTQGPFGGPD

SEQ ID NO: 1554870 - protein, 25 aa, Mycobacterium tuberculosis
PSWEEITEVLEWLSPLPGGSVVSVE

SEQ ID NO: 1554871 - protein, 19 aa, Mycobacterium tuberculosis
PVAAQQFQFALPAGVASEE

SEQ ID NO: 1554872 - protein, 17 aa, Mycobacterium tuberculosis
PVRVNPGARYRAMEQFF

SEQ ID NO: 1554873 - protein, 17 aa, Mycobacterium tuberculosis
QGLPATSIAWGAWAEIG

SEQ ID NO: 1554874 - protein, 20 aa, Mycobacterium tuberculosis
QLVRILLRGPMVIVGLAQRG

SEQ ID NO: 1554875 - protein, 19 aa, Mycobacterium tuberculosis
QQLLFFDRNIPLGSPTRNP

SEQ ID NO: 1554876 - protein, 17 aa, Mycobacterium tuberculosis
QRLPFFNQGTRVSAYFA

SEQ ID NO: 1554877 - protein, 23 aa, Mycobacterium tuberculosis
RANRVFDERLLTIEWERGELPEV

SEQ ID NO: 1554878 - protein, 18 aa, Mycobacterium tuberculosis
RGLMRVIDSEHPHLGATA

SEQ ID NO: 1554879 - protein, 29 aa, Mycobacterium tuberculosis
RIRDKPMPLFQLLVLCMLASKPIGAATAA

SEQ ID NO: 1554880 - protein, 22 aa, Mycobacterium tuberculosis
RLGIRLVIVLVRRWPKVISRAM

SEQ ID NO: 1554881 - protein, 18 aa, Mycobacterium tuberculosis
RLVSDQISLLLRRTIDPD

SEQ ID NO: 1554882 - protein, 20 aa, Mycobacterium tuberculosis
RPDTPLPCAGATVGPFGGPD

SEQ ID NO: 1554883 - protein, 18 aa, Mycobacterium tuberculosis
RRHGLRVSLSPAPFAGSI

SEQ ID NO: 1554884 - protein, 18 aa, Mycobacterium tuberculosis
RVLADWDFNIRCFSNPAL

SEQ ID NO: 1554885 - protein, 29 aa, Mycobacterium tuberculosis
RVRGRDDRLRWWAGPWPDDERWWDPDRAS

SEQ ID NO: 1554886 - protein, 17 aa, Mycobacterium tuberculosis
RYALIDDPYAAPLVRAV

SEQ ID NO: 1554887 - protein, 17 aa, Mycobacterium tuberculosis
SDAWFLIRVVTAPDGTA

SEQ ID NO: 1554888 - protein, 42 aa, Mycobacterium tuberculosis; identical to SEQ ID NO: 237407

SEQ ID NO: 1554889 - protein, 28 aa, Mycobacterium tuberculosis
SMIIQFVVKTLVAMLDWGLNPQQAVSLV

SEQ ID NO: 1554890 - protein, 22 aa, Mycobacterium tuberculosis
TDELIDRCWAPKVHGAWNIHRA

SEQ ID NO: 1554891 - protein, 26 aa, Mycobacterium tuberculosis
THEAPAPPRGLSAVPLEPGQQTVGFS

SEQ ID NO: 1554892 - protein, 19 aa, Mycobacterium tuberculosis
TYRFSVPDPGTYWAHPHVG

SEQ ID NO: 1554893 - protein, 23 aa, Mycobacterium tuberculosis
VAAATAILAVVLAIGGCSTEGDA

SEQ ID NO: 1554894 - protein, 30 aa, Mycobacterium tuberculosis; identical to SEQ ID NO: 237115

SEQ ID NO: 1554895 - protein, 20 aa, Mycobacterium tuberculosis
YVATLLLKLVDEKKLRLDDK

SEQ ID NO: 1554896 - protein, 25 aa, Mycobacterium tuberculosis
AAAPLVTLYKQYVVRFGLGYREEVH

SEQ ID NO: 1554897 - protein, 23 aa, Mycobacterium tuberculosis
APFLSYGQFTGSAPRDLCALWPV

SEQ ID NO: 1554898 - protein, 19 aa, Mycobacterium tuberculosis
APIVLKGLFRLKSNCPSAL

SEQ ID NO: 1554899 - protein, 25 aa, Mycobacterium tuberculosis
AQGIPPQFLVDILTNLRTDRLVRSH

SEQ ID NO: 1554900 - protein, 21 aa, Mycobacterium tuberculosis
ARPFIAFYNNCANAILRLVGV

SEQ ID NO: 1554901 - protein, 17 aa, Mycobacterium tuberculosis
AVLQLRGAGGLPSAAIG

SEQ ID NO: 1554902 - protein, 23 aa, Mycobacterium tuberculosis
CVDSAVMHYFLDGTLPPTSLRCA

SEQ ID NO: 1554903 - protein, 17 aa, Mycobacterium tuberculosis
DAYKSATFLQRNLPRGT

SEQ ID NO: 1554904 - protein, 19 aa, Mycobacterium tuberculosis
DQRIRQVAPFLSYGQFTGS

SEQ ID NO: 1554905 - protein, 18 aa, Mycobacterium tuberculosis
DYVPFTDWVDGRVLLDGR

SEQ ID NO: 1554906 - protein, 24 aa, Mycobacterium tuberculosis
ERTLASVALILTGGGIVNLDVIQT

SEQ ID NO: 1554907 - protein, 32 aa, Mycobacterium tuberculosis; identical to SEQ ID NO: 236320

SEQ ID NO: 1554908 - protein, 26 aa, Mycobacterium tuberculosis
FKCPAAPFEAAFLIAAQLGDRYATGT

SEQ ID NO: 1554909 - protein, 18 aa, Mycobacterium tuberculosis
FRALDMLASLWSSTGMSL

SEQ ID NO: 1554910 - protein, 29 aa, Mycobacterium tuberculosis
FSDDFIEWSVSFSQKPFPLPCDIAKELTR

SEQ ID NO: 1554911 - protein, 27 aa, Mycobacterium tuberculosis
GCQTYKWETFLTSELPGWLQANRHVKP

SEQ ID NO: 1554912 - protein, 19 aa, Mycobacterium tuberculosis
GFGRYLVSATTPFTRDDLT

SEQ ID NO: 1554913 - protein, 26 aa, Mycobacterium tuberculosis
GGVGAFLNALFAGPAKMLRLNAGLGN

SEQ ID NO: 1554914 - protein, 25 aa, Mycobacterium tuberculosis
GIQCFLRDLPATWPPFIRPGVVTTH

SEQ ID NO: 1554915 - protein, 20 aa, Mycobacterium tuberculosis
GLSESGWIPVDPRTLSTSAD

SEQ ID NO: 1554916 - protein, 29 aa, Mycobacterium tuberculosis
IGATPPDMTLFLDLKQTPPQPLVSAVAQV

SEQ ID NO: 1554917 - protein, 18 aa, Mycobacterium tuberculosis
LALLLIGANAFFVGAEFA

SEQ ID NO: 1554918 - protein, 19 aa, Mycobacterium tuberculosis
LLLAVLLAVSGVAGCSADT

SEQ ID NO: 1554919 - protein, 17 aa, Mycobacterium tuberculosis
LLNVGKLIANNTRVWVY

SEQ ID NO: 1554920 - protein, 17 aa, Mycobacterium tuberculosis
LPARTPAYRVPLPELPH

SEQ ID NO: 1554921 - protein, 17 aa, Mycobacterium tuberculosis
LSLQATAFHQQFVQALT

SEQ ID NO: 1554922 - protein, 20 aa, Mycobacterium tuberculosis
LVDAPLPSWTHRTLMLSRED

SEQ ID NO: 1554923 - protein, 19 aa, Mycobacterium tuberculosis
NAGLGLVFLGADPLRSPVR

SEQ ID NO: 1554924 - protein, 29 aa, Mycobacterium tuberculosis
NALYSPQRWKYLTSGLLGLQRGSDAGDLL

SEQ ID NO: 1554925 - protein, 18 aa, Mycobacterium tuberculosis
NDPLLNVGKLIANNTRVW

SEQ ID NO: 1554926 - protein, 18 aa, Mycobacterium tuberculosis
PEIPYYSATLWDPRERPS

SEQ ID NO: 1554927 - protein, 20 aa, Mycobacterium tuberculosis
PFAVLRRVDRWFWSRRRRPP

SEQ ID NO: 1554928 - protein, 25 aa, Mycobacterium tuberculosis
PRDLCALWPVPATSTPHPAAPAGAG

SEQ ID NO: 1554929 - protein, 17 aa, Mycobacterium tuberculosis
PRRVLLLCDVSRSMQPY

SEQ ID NO: 1554930 - protein, 22 aa, Mycobacterium tuberculosis
QSMTGHHLAMALATRARIAVAE

SEQ ID NO: 1554931 - protein, 25 aa, Mycobacterium tuberculosis
RAENIVPLYRRNALTERQLLAVNEV

SEQ ID NO: 1554932 - protein, 19 aa, Mycobacterium tuberculosis
RAGIELLAFGGRFVEIGKR

SEQ ID NO: 1554933 - protein, 18 aa, Mycobacterium tuberculosis
RDYRVLSAALLEVTFCGF

SEQ ID NO: 1554934 - protein, 24 aa, Mycobacterium tuberculosis
SGGANSPALYLLDGLRAQDDFSGW

SEQ ID NO: 1554935 - protein, 18 aa, Mycobacterium tuberculosis
TIGQLCDAAIRYSDGTAA

SEQ ID NO: 1554936 - protein, 24 aa, Mycobacterium tuberculosis
TRNRGREMLAFATAYRDAGVKPPR

SEQ ID NO: 1554937 - protein, 27 aa, Mycobacterium tuberculosis
VCGELGLPYLVLARPPWDPGTAIIAVS

SEQ ID NO: 1554938 - protein, 28 aa, Mycobacterium tuberculosis
VVFSQGVAIMIWTLMNARNSRDSLLTTH

SEQ ID NO: 1554939 - protein, 26 aa, Mycobacterium tuberculosis
VVLGAAALIVALTRPTNSGPATAAGT

SEQ ID NO: 1554940 - protein, 17 aa, Mycobacterium tuberculosis
VVRPLPRVPQSLPLADA

SEQ ID NO: 1554941 - protein, 17 aa, Mycobacterium tuberculosis
WPDPNGTRFPNGAPPAA

SEQ ID NO: 1554942 - protein, 27 aa, Mycobacterium tuberculosis
ADEVSVLIAALFEAYAQEYQALSAQAL

SEQ ID NO: 1554943 - protein, 24 aa, Mycobacterium tuberculosis
ALAADLLFLALRDALTEKLDIPIH

SEQ ID NO: 1554944 - protein, 19 aa, Mycobacterium tuberculosis
AQFVAIAARYHIKPLFVLF

SEQ ID NO: 1554945 - protein, 20 aa, Mycobacterium tuberculosis
ARAAAPLAPLALAMVLASCG

SEQ ID NO: 1554946 - protein, 22 aa, Mycobacterium tuberculosis
ARGGRRLVIAMMYGLVKEGGPT

SEQ ID NO: 1554947 - protein, 26 aa, Mycobacterium tuberculosis
ARYHIKPLFVLFDSCWDPLPRPGRQR

SEQ ID NO: 1554948 - protein, 17 aa, Mycobacterium tuberculosis
AVRARLRRRGPVTVYGV

SEQ ID NO: 1554949 - protein, 22 aa, Mycobacterium tuberculosis
CTLGYVDPALKIAFTAGHCRGG

SEQ ID NO: 1554950 - protein, 19 aa, Mycobacterium tuberculosis
DDIAWLPATAQLAVLAAKK

SEQ ID NO: 1554951 - protein, 23 aa, Mycobacterium tuberculosis
DDVGFLVALAAKLVHDFDIAPGH

SEQ ID NO: 1554952 - protein, 18 aa, Mycobacterium tuberculosis
DLNWRPRFDLNAVAARLA

SEQ ID NO: 1554953 - protein, 31 aa, Mycobacterium tuberculosis
DPHSRQLLAAQIIWTLARADIRGPYVINADG

SEQ ID NO: 1554954 - protein, 17 aa, Mycobacterium tuberculosis
DRIIDLLSRARDSLQSH

SEQ ID NO: 1554955 - protein, 34 aa, Mycobacterium tuberculosis; identical to SEQ ID NO: 226075

SEQ ID NO: 1554956 - protein, 32 aa, Mycobacterium tuberculosis; identical to SEQ ID NO: 237566

SEQ ID NO: 1554957 - protein, 25 aa, Mycobacterium tuberculosis
EIEYGINWLPWILRGVYPPPAMPPQ

SEQ ID NO: 1554958 - protein, 17 aa, Mycobacterium tuberculosis
FAATVALLAAGFSPATA

SEQ ID NO: 1554959 - protein, 19 aa, Mycobacterium tuberculosis
FHRFALAILGLALPVALVA

SEQ ID NO: 1554960 - protein, 24 aa, Mycobacterium tuberculosis
GLARARWGLLEPPEPWLPEAALAQ

SEQ ID NO: 1554961 - protein, 21 aa, Mycobacterium tuberculosis
GNLDPIIAFYPKHVLYEVFGP

SEQ ID NO: 1554962 - protein, 21 aa, Mycobacterium tuberculosis
GQGVGFGGWYAPVALHVDTES

SEQ ID NO: 1554963 - protein, 24 aa, Mycobacterium tuberculosis
GVKPGRSYTARQLLDGLLLVSGND

SEQ ID NO: 1554964 - protein, 17 aa, Mycobacterium tuberculosis
IALLAAITPAAGERPES

SEQ ID NO: 1554965 - protein, 28 aa, Mycobacterium tuberculosis
IGTLGFTIPGFTIPAAPLPLTIDIDGQI

SEQ ID NO: 1554966 - protein, 24 aa, Mycobacterium tuberculosis
KRLGLDRQWLHARSLAFAHPADGR

SEQ ID NO: 1554967 - protein, 32 aa, Mycobacterium tuberculosis; identical to SEQ ID NO: 236587

SEQ ID NO: 1554968 - protein, 18 aa, Mycobacterium tuberculosis
LGAVLAGCASVPSTSAPQ

SEQ ID NO: 1554969 - protein, 24 aa, Mycobacterium tuberculosis
LLPGQFVQPFISAAFSDLGLDPAT

SEQ ID NO: 1554970 - protein, 17 aa, Mycobacterium tuberculosis
LPLLLAAGTVLGQAPRA

SEQ ID NO: 1554971 - protein, 17 aa, Mycobacterium tuberculosis
LQMTGMYQAIANDGVRV

SEQ ID NO: 1554972 - protein, 19 aa, Mycobacterium tuberculosis
LRRRGPVTVYGVDKFPRMV

SEQ ID NO: 1554973 - protein, 33 aa, Mycobacterium tuberculosis; identical to SEQ ID NO: 236638

SEQ ID NO: 1554974 - protein, 24 aa, Mycobacterium tuberculosis
MGSWLPLHHDMGLVGSLFAALFNS

SEQ ID NO: 1554975 - protein, 18 aa, Mycobacterium tuberculosis
PAFHAFPASRWRRYDKLE

SEQ ID NO: 1554976 - protein, 17 aa, Mycobacterium tuberculosis
PILALLALLALLALIVG

SEQ ID NO: 1554977 - protein, 23 aa, Mycobacterium tuberculosis
PPASTIKVLLALVALDELDLNST

SEQ ID NO: 1554978 - protein, 38 aa, Mycobacterium tuberculosis; identical to SEQ ID NO: 236752

SEQ ID NO: 1554979 - protein, 26 aa, Mycobacterium tuberculosis
QGKAALEVNWPFVFASMLENAVKGGV

SEQ ID NO: 1554980 - protein, 24 aa, Mycobacterium tuberculosis
RAPPKVWFHDLLHPNGRPYRDGEV

SEQ ID NO: 1554981 - protein, 17 aa, Mycobacterium tuberculosis
RARLRRRGPVTVYGVDK

SEQ ID NO: 1554982 - protein, 21 aa, Mycobacterium tuberculosis
REDWAALYKKAFAPLNELAGS

SEQ ID NO: 1554983 - protein, 17 aa, Mycobacterium tuberculosis
RGFYDRSLRCRDPHARL

SEQ ID NO: 1554984 - protein, 21 aa, Mycobacterium tuberculosis
RPVKPPPRRPAHRVLVGWLSL

SEQ ID NO: 1554985 - protein, 18 aa, Mycobacterium tuberculosis
RRIAVLAAVSIAATVVAG

SEQ ID NO: 1554986 - protein, 19 aa, Mycobacterium tuberculosis
RTVVGQRIVFAPGAAHMSP

SEQ ID NO: 1554987 - protein, 23 aa, Mycobacterium tuberculosis
SADRAHRWYQAHGWLVGANYITS

SEQ ID NO: 1554988 - protein, 30 aa, Mycobacterium tuberculosis; identical to SEQ ID NO: 236886

SEQ ID NO: 1554989 - protein, 22 aa, Mycobacterium tuberculosis
SDGVPVLYRPSDLATLTDGAGP

SEQ ID NO: 1554990 - protein, 17 aa, Mycobacterium tuberculosis
SSNLLFRRNSVSGAVEV

SEQ ID NO: 1554991 - protein, 24 aa, Mycobacterium tuberculosis
TAGGDLPLPLRWGEYRAGGLARAR

SEQ ID NO: 1554992 - protein, 22 aa, Mycobacterium tuberculosis
TIDAPIGRHRGHEWKFAITKNG

SEQ ID NO: 1554993 - protein, 30 aa, Mycobacterium tuberculosis; identical to SEQ ID NO: 237442

SEQ ID NO: 1554994 - protein, 17 aa, Mycobacterium tuberculosis
TVRVFLHDLLWAQDAPG

SEQ ID NO: 1554995 - protein, 17 aa, Mycobacterium tuberculosis
VARFAAALAPRGSGTLL

SEQ ID NO: 1554996 - protein, 19 aa, Mycobacterium tuberculosis
VFLDWQQFQETYKRNTLYF

SEQ ID NO: 1554997 - protein, 31 aa, Mycobacterium tuberculosis; identical to SEQ ID NO: 237054

SEQ ID NO: 1554998 - protein, 19 aa, Mycobacterium tuberculosis
WYARADPPAPAPRPILPPL

SEQ ID NO: 1554999 - protein, 22 aa, Mycobacterium tuberculosis
YHPSAPAYALAADLLFLALRDA

SEQ ID NO: 1555000 - protein, 27 aa, Mycobacterium tuberculosis
ADPAGWPRLDWSMDAALLLAALASRAG

SEQ ID NO: 1555001 - protein, 32 aa, Mycobacterium tuberculosis; identical to SEQ ID NO: 236080

SEQ ID NO: 1555002 - protein, 23 aa, Mycobacterium tuberculosis
AMAAAAAPYAGWLGSVAAQAVAV

SEQ ID NO: 1555003 - protein, 24 aa, Mycobacterium tuberculosis
AMAAIATFAAPVALAAYPITGKLG

SEQ ID NO: 1555004 - protein, 27 aa, Mycobacterium tuberculosis
ATASFGVAPLLLWQVATRHFTNISVET

SEQ ID NO: 1555005 - protein, 26 aa, Mycobacterium tuberculosis
ATDTGSFRWASVRGYRLAARLVEIGV

SEQ ID NO: 1555006 - protein, 30 aa, Mycobacterium tuberculosis; identical to SEQ ID NO: 236195

SEQ ID NO: 1555007 - protein, 26 aa, Mycobacterium tuberculosis
AWLEATMARWPRRRSMRFESSPHGKR

SEQ ID NO: 1555008 - protein, 24 aa, Mycobacterium tuberculosis
DAGHSVRFLVRNPARLKTSVAKLG

SEQ ID NO: 1555009 - protein, 19 aa, Mycobacterium tuberculosis
DISLRNWIATLTLELEPTV

SEQ ID NO: 1555010 - protein, 27 aa, Mycobacterium tuberculosis
DRCWIKPGPICLSILRSPRQVCSTTHR

SEQ ID NO: 1555011 - protein, 18 aa, Mycobacterium tuberculosis
EIDIGHRTIPNYGGFDLG

SEQ ID NO: 1555012 - protein, 17 aa, Mycobacterium tuberculosis
ELGKQVEILPGLQAINA

SEQ ID NO: 1555013 - protein, 19 aa, Mycobacterium tuberculosis
EMLVLVMVGLVVLGPERLP

SEQ ID NO: 1555014 - protein, 18 aa, Mycobacterium tuberculosis
FPEAAGVVNVYAIAVLKR

SEQ ID NO: 1555015 - protein, 24 aa, Mycobacterium tuberculosis
GDEFCLLDGLLAWYATIGSINNIN

SEQ ID NO: 1555016 - protein, 23 aa, Mycobacterium tuberculosis
GVRSALWMHVIPGRGAAWLIVDV

SEQ ID NO: 1555017 - protein, 25 aa, Mycobacterium tuberculosis
GVVITPQAELLPTDKHFAPAVLNDV

SEQ ID NO: 1555018 - protein, 17 aa, Mycobacterium tuberculosis
IVVIKPSTGEILAIAQN

SEQ ID NO: 1555019 - protein, 19 aa, Mycobacterium tuberculosis
KIRSFADLTRPGLNVVVCQ

SEQ ID NO: 1555020 - protein, 18 aa, Mycobacterium tuberculosis
KLREIDGLLPTLIRGQGT

SEQ ID NO: 1555021 - protein, 17 aa, Mycobacterium tuberculosis
LEAAPITPLPAPEALID

SEQ ID NO: 1555022 - protein, 18 aa, Mycobacterium tuberculosis
LLGAWLEATMARWPRRRS

SEQ ID NO: 1555023 - protein, 18 aa, Mycobacterium tuberculosis
LPALAQLSPIIQQAAMNP

SEQ ID NO: 1555024 - protein, 26 aa, Mycobacterium tuberculosis
LQLSALLPEWRTELPLRYLESVITQL

SEQ ID NO: 1555025 - protein, 23 aa, Mycobacterium tuberculosis
NLAQYPSILVELGNMKNPADSAL

SEQ ID NO: 1555026 - protein, 20 aa, Mycobacterium tuberculosis
NRGFYPAEKFSRQALGLAGA

SEQ ID NO: 1555027 - protein, 21 aa, Mycobacterium tuberculosis
NWRVTWNPSGMYFWLDYADGI

SEQ ID NO: 1555028 - protein, 25 aa, Mycobacterium tuberculosis
NYSAVSLRLHPDIRLFTAIPEQRSS

SEQ ID NO: 1555029 - protein, 32 aa, Mycobacterium tuberculosis; identical to SEQ ID NO: 236711

SEQ ID NO: 1555030 - protein, 24 aa, Mycobacterium tuberculosis
PESLRSLPGCHLLVRPEVMRRDVD

SEQ ID NO: 1555031 - protein, 17 aa, Mycobacterium tuberculosis
PGGLLFGNGGNGGSGGV

SEQ ID NO: 1555032 - protein, 31 aa, Mycobacterium tuberculosis; identical to SEQ ID NO: 236739

SEQ ID NO: 1555033 - protein, 17 aa, Mycobacterium tuberculosis
PVATTGLYPPGSTFKMI

SEQ ID NO: 1555034 - protein, 18 aa, Mycobacterium tuberculosis
PYAAIYLRLMRAAVLRRA

SEQ ID NO: 1555035 - protein, 17 aa, Mycobacterium tuberculosis
PYAVWLDDWYARESNNN

SEQ ID NO: 1555036 - protein, 28 aa, Mycobacterium tuberculosis
RAAVPWWPWAPLVRLMWVLPPRLTRRFA

SEQ ID NO: 1555037 - protein, 19 aa, Mycobacterium tuberculosis
RADQYAQLSGLRLGKVISI

SEQ ID NO: 1555038 - protein, 26 aa, Mycobacterium tuberculosis
RDEGRWHVRWTTSGLHPKLGEHQTFA

SEQ ID NO: 1555039 - protein, 30 aa, Mycobacterium tuberculosis; identical to SEQ ID NO: 237734

SEQ ID NO: 1555040 - protein, 24 aa, Mycobacterium tuberculosis
RGLLRAMICQLAVWHSPEELLIAG

SEQ ID NO: 1555041 - protein, 21 aa, Mycobacterium tuberculosis
SGDGQWRLRQQRHFGCGGQPE

SEQ ID NO: 1555042 - protein, 31 aa, Mycobacterium tuberculosis; identical to SEQ ID NO: 226941

SEQ ID NO: 1555043 - protein, 21 aa, Mycobacterium tuberculosis
TALDEGLLPVLPQLSARHHVL

SEQ ID NO: 1555044 - protein, 27 aa, Mycobacterium tuberculosis
TGTVAYRFSWHLPKDRIWTYDGQLKMA

SEQ ID NO: 1555045 - protein, 21 aa, Mycobacterium tuberculosis
TIGAGLALALVLDGCGKRVEV

SEQ ID NO: 1555046 - protein, 28 aa, Mycobacterium tuberculosis
TPTSVHVGILPYPRNLDSLVLIASGGAF

SEQ ID NO: 1555047 - protein, 27 aa, Mycobacterium tuberculosis
VAMVLRRLLRLCARYSAHPTVIFASAT

SEQ ID NO: 1555048 - protein, 25 aa, Mycobacterium tuberculosis
VENNFPLVNLLVNRGPTVPILLDTG

SEQ ID NO: 1555049 - protein, 24 aa, Mycobacterium tuberculosis
VHVSSFTALFRPNLATLSADLPVA

SEQ ID NO: 1555050 - protein, 22 aa, Mycobacterium tuberculosis
VLVPGYLYHYSLDAGQAGRELF

SEQ ID NO: 1555051 - protein, 17 aa, Mycobacterium tuberculosis
VNLFGFDQLLPEDGRIQ

SEQ ID NO: 1555052 - protein, 18 aa, Mycobacterium tuberculosis
VWGGFPAAVSWRSTSEQV

SEQ ID NO: 1555053 - protein, 25 aa, Mycobacterium tuberculosis
AALADTAWQGPAATAMAAAAAPYAS

SEQ ID NO: 1555054 - protein, 29 aa, Mycobacterium tuberculosis
ACRKHHLLKTFWTGWRDVQLPDGTVIWTA

SEQ ID NO: 1555055 - protein, 20 aa, Mycobacterium tuberculosis
AGHRWPSFATQTLWRFFAAH

SEQ ID NO: 1555056 - protein, 27 aa, Mycobacterium tuberculosis
ALASGPAALAIPALGIGNTGIGNIFSI

SEQ ID NO: 1555057 - protein, 20 aa, Mycobacterium tuberculosis
ALLALLALLALIVGLGASGC

SEQ ID NO: 1555058 - protein, 25 aa, Mycobacterium tuberculosis
ALRDGSYLPMTFAANDIAWSDNKPS

SEQ ID NO: 1555059 - protein, 19 aa, Mycobacterium tuberculosis
AMGPMQFISETWRLYGVAA

SEQ ID NO: 1555060 - protein, 19 aa, Mycobacterium tuberculosis
ANYHLAWYAVTTRRGGSRG

SEQ ID NO: 1555061 - protein, 18 aa, Mycobacterium tuberculosis
APVVLTSCTWRGIANVPL

SEQ ID NO: 1555062 - protein, 22 aa, Mycobacterium tuberculosis
AQLRARSWWSGPDIYVVVDDYD

SEQ ID NO: 1555063 - protein, 26 aa, Mycobacterium tuberculosis
AQNFNTTFPVGPFFGLGVVNISGIEI

SEQ ID NO: 1555064 - protein, 23 aa, Mycobacterium tuberculosis
ARRDESVWCLALSAAARSPTSVL

SEQ ID NO: 1555065 - protein, 17 aa, Mycobacterium tuberculosis
ASPFGMALVAATVAAGK

SEQ ID NO: 1555066 - protein, 17 aa, Mycobacterium tuberculosis
ATTGLYPPGSTFKMITA

SEQ ID NO: 1555067 - protein, 18 aa, Mycobacterium tuberculosis
AWHGNWHMLIVTSIGTDA

SEQ ID NO: 1555068 - protein, 27 aa, Mycobacterium tuberculosis
CGLAGTVLRFVPPLAALGSVPVTFDGD

SEQ ID NO: 1555069 - protein, 17 aa, Mycobacterium tuberculosis
CNLIAWDRGVFMAVAQE

SEQ ID NO: 1555070 - protein, 29 aa, Mycobacterium tuberculosis
DPRLNTGLTPFLLGPVYISNNPSGVGTVV

SEQ ID NO: 1555071 - protein, 20 aa, Mycobacterium tuberculosis
DVAIPARWTLDNGATFRGVD

SEQ ID NO: 1555072 - protein, 18 aa, Mycobacterium tuberculosis
EFCDIDHSAPWPLGPTHP

SEQ ID NO: 1555073 - protein, 24 aa, Mycobacterium tuberculosis
FASGPYFKVLLANLVPGQILQPFV

SEQ ID NO: 1555074 - protein, 23 aa, Mycobacterium tuberculosis
FGSSRPMPLPPGRGILVTGAGDE

SEQ ID NO: 1555075 - protein, 27 aa, Mycobacterium tuberculosis
FNVNLKLQFLHDAFPNEFPDPTISVQI

SEQ ID NO: 1555076 - protein, 19 aa, Mycobacterium tuberculosis
GDPVAPPIPLLPARVDYDS

SEQ ID NO: 1555077 - protein, 20 aa, Mycobacterium tuberculosis
GFRVPCIVISPYSRGPLMVS

SEQ ID NO: 1555078 - protein, 29 aa, Mycobacterium tuberculosis
GHLGARLFSIIAWRTYLVRDPHALSLLDA

SEQ ID NO: 1555079 - protein, 22 aa, Mycobacterium tuberculosis
GKSLAYQLLVLNALATDSRARA

SEQ ID NO: 1555080 - protein, 30 aa, Mycobacterium tuberculosis; identical to SEQ ID NO: 237278

SEQ ID NO: 1555081 - protein, 20 aa, Mycobacterium tuberculosis
GVDLVPTLLDLLRLEVPADV

SEQ ID NO: 1555082 - protein, 26 aa, Mycobacterium tuberculosis
IAFGYSGLPFWPQGKTYDAYFTDAGG

SEQ ID NO: 1555083 - protein, 22 aa, Mycobacterium tuberculosis
IARVIMRSAIGFFASFTVSSGV

SEQ ID NO: 1555084 - protein, 23 aa, Mycobacterium tuberculosis
IGATAMLLASSCTWQLSLFITDG

SEQ ID NO: 1555085 - protein, 17 aa, Mycobacterium tuberculosis
LAKLREIDGLLPTLIRG

SEQ ID NO: 1555086 - protein, 24 aa, Mycobacterium tuberculosis
LDGQRFLLTAGFFETHRPYPHERY

SEQ ID NO: 1555087 - protein, 29 aa, Mycobacterium tuberculosis
LLTDPMLPAELLPADWPGAGLRAAYHDFA

SEQ ID NO: 1555088 - protein, 22 aa, Mycobacterium tuberculosis
LLTGTLPNRLYWLSANIDPAGT

SEQ ID NO: 1555089 - protein, 28 aa, Mycobacterium tuberculosis
LLVTDLAGGWIPPHVRLPANVTLLEPTA

SEQ ID NO: 1555090 - protein, 38 aa, Mycobacterium tuberculosis; identical to SEQ ID NO: 237685

SEQ ID NO: 1555091 - protein, 18 aa, Mycobacterium tuberculosis
LPVLPQLSARHHVLVAAV

SEQ ID NO: 1555092 - protein, 19 aa, Mycobacterium tuberculosis
LSALGITGQFRFGPITVSN

SEQ ID NO: 1555093 - protein, 25 aa, Mycobacterium tuberculosis
MAAAAAPYASWLSTAATRALSAAAQ

SEQ ID NO: 1555094 - protein, 25 aa, Mycobacterium tuberculosis
PEVNSALMFAGAGSGPTLAAAAAWD

SEQ ID NO: 1555095 - protein, 20 aa, Mycobacterium tuberculosis
PGFLPLQQFSWRIMPENLED

SEQ ID NO: 1555096 - protein, 27 aa, Mycobacterium tuberculosis
PGRDDLTDLLWRMGIRTIGQFAALSRT

SEQ ID NO: 1555097 - protein, 18 aa, Mycobacterium tuberculosis
QGALVVLIARDDPLDTYL

SEQ ID NO: 1555098 - protein, 28 aa, Mycobacterium tuberculosis
QMHLSLALNRLPQVAALFLAGHLGARLF

SEQ ID NO: 1555099 - protein, 18 aa, Mycobacterium tuberculosis
QNTNTGAFFIGHSGLLNS

SEQ ID NO: 1555100 - protein, 21 aa, Mycobacterium tuberculosis
RENLLIVHWHDLGRYLGVYHH

SEQ ID NO: 1555101 - protein, 24 aa, Mycobacterium tuberculosis
RIDPIPLNFDVLSSAGPINISIID

SEQ ID NO: 1555102 - protein, 17 aa, Mycobacterium tuberculosis
RLRQQRHFGCGGQPEFR

SEQ ID NO: 1555103 - protein, 17 aa, Mycobacterium tuberculosis
RLYWLSANIDPAGTDGG

SEQ ID NO: 1555104 - protein, 25 aa, Mycobacterium tuberculosis
RNRAHWDWLKWLPHNQHPNACDALG

SEQ ID NO: 1555105 - protein, 26 aa, Mycobacterium tuberculosis
SAVAAQLAPWAQAVRALPNPTAPALA

SEQ ID NO: 1555106 - protein, 24 aa, Mycobacterium tuberculosis
SGNPLMVLLEYLPHARDLGLHLVV

SEQ ID NO: 1555107 - protein, 26 aa, Mycobacterium tuberculosis
SHELTAVGDWMLLAAIEALIDEQDYL

SEQ ID NO: 1555108 - protein, 18 aa, Mycobacterium tuberculosis
SIIDAAIAELRHLNPLNI

SEQ ID NO: 1555109 - protein, 19 aa, Mycobacterium tuberculosis
SIPYRVPYPQVMPTQETTP

SEQ ID NO: 1555110 - protein, 22 aa, Mycobacterium tuberculosis
SNPLANFAPGYPPTIEPAQPAV

SEQ ID NO: 1555111 - protein, 25 aa, Mycobacterium tuberculosis
SVGPITISPITLFPAQNFNTTFPVG

SEQ ID NO: 1555112 - protein, 27 aa, Mycobacterium tuberculosis
SVPGLVRVLPPFLSRKHLPSRLAKLRE

SEQ ID NO: 1555113 - protein, 25 aa, Mycobacterium tuberculosis
TALHKHLLEQSPPIWWTHIAGHGDA

SEQ ID NO: 1555114 - protein, 17 aa, Mycobacterium tuberculosis
TGLYPPGSTFKMITAGA

SEQ ID NO: 1555115 - protein, 24 aa, Mycobacterium tuberculosis
TGQPGTPPLPMPYPRTGQGGEPRL

SEQ ID NO: 1555116 - protein, 20 aa, Mycobacterium tuberculosis
TLFRRLAVFVGCFFVDDAQA

SEQ ID NO: 1555117 - protein, 24 aa, Mycobacterium tuberculosis
TLTLVAFWWWQRPRTNAVAADSLV

SEQ ID NO: 1555118 - protein, 17 aa, Mycobacterium tuberculosis
TNIFGYRQDPLKWHPNG

SEQ ID NO: 1555119 - protein, 22 aa, Mycobacterium tuberculosis
TTSTLPGAGWTAAAPQAAAGTF

SEQ ID NO: 1555120 - protein, 26 aa, Mycobacterium tuberculosis
VAGSWHIRWAALTPARQAAVIVAARA

SEQ ID NO: 1555121 - protein, 24 aa, Mycobacterium tuberculosis
VDASLLLCNGGRRRFRGQVRDAWP

SEQ ID NO: 1555122 - protein, 24 aa, Mycobacterium tuberculosis
VGAAAPLAALSAAPMLATSAAAAD

SEQ ID NO: 1555123 - protein, 24 aa, Mycobacterium tuberculosis
VLAAALLFCGLLGPGTAPPATGGG

SEQ ID NO: 1555124 - protein, 25 aa, Mycobacterium tuberculosis
VQRRFIGLLMLSVLVAGCSSNPLAN

SEQ ID NO: 1555125 - protein, 24 aa, Mycobacterium tuberculosis
VSMVTALRILLSNPAVWEKTALIV

SEQ ID NO: 1555126 - protein, 17 aa, Mycobacterium tuberculosis
VSSDGVPVLYRPSDLAT

SEQ ID NO: 1555127 - protein, 18 aa, Mycobacterium tuberculosis
VTAAPLPGLGFTQPLPPA

SEQ ID NO: 1555128 - protein, 25 aa, Mycobacterium tuberculosis
VTIFPNGISIPNNPLALLASASIGT

SEQ ID NO: 1555129 - protein, 19 aa, Mycobacterium tuberculosis
VVHPIAHLAIPVTFSRRRD

SEQ ID NO: 1555130 - protein, 18 aa, Mycobacterium tuberculosis
VYFDYWSARGVDVTPFFA

SEQ ID NO: 1555131 - protein, 24 aa, Mycobacterium tuberculosis
YDAGTGIALIIRPPTRRAMAPRVY

SEQ ID NO: 1555132 - protein, 20 aa, Mycobacterium tuberculosis
YITEALKRLPTYATTLGEVV

SEQ ID NO: 1555133 - protein, 17 aa, Mycobacterium tuberculosis
YLANYHLAWYAVTTRRG

SEQ ID NO: 1555134 - protein, 29 aa, Mycobacterium tuberculosis
YSYIENYAPRPLLDLPWDIQESPAGMAVA

SEQ ID NO: 1555135 - protein, 25 aa, Mycobacterium tuberculosis
YTRQDIPIHYLLADTFTICDGYHCS

SEQ ID NO: 1555136 - protein, 25 aa, Mycobacterium tuberculosis
AAAASLAAIAIAFLAGCSSTKPVSQ

SEQ ID NO: 1555137 - protein, 17 aa, Mycobacterium tuberculosis
AALPALAAGGLPPGLPA

SEQ ID NO: 1555138 - protein, 17 aa, Mycobacterium tuberculosis
AALSDVPIFATFCAAVA

SEQ ID NO: 1555139 - protein, 41 aa, Mycobacterium tuberculosis; identical to SEQ ID NO: 236077

SEQ ID NO: 1555140 - protein, 28 aa, Mycobacterium tuberculosis
AGRSYRLYKPVGLPSSAPLVVMLHGGFG

SEQ ID NO: 1555141 - protein, 18 aa, Mycobacterium tuberculosis
ANPIAFLCGAIQAASRLG

SEQ ID NO: 1555142 - protein, 18 aa, Mycobacterium tuberculosis
APTLLYLAAAGVGTIGIV

SEQ ID NO: 1555143 - protein, 23 aa, Mycobacterium tuberculosis
ATSFSARLFNLLITNAPGTQSQM

SEQ ID NO: 1555144 - protein, 24 aa, Mycobacterium tuberculosis
DAAQPVAVPGPPPAPPAPRAAAPA

SEQ ID NO: 1555145 - protein, 30 aa, Mycobacterium tuberculosis
DATYGRGVYAWRLVRYYEDSTLATALANPT

SEQ ID NO: 1555146 - protein, 25 aa, Mycobacterium tuberculosis
ELIRFQTAFVSGPLRRASPSAVHPV

SEQ ID NO: 1555147 - protein, 18 aa, Mycobacterium tuberculosis
GAFFIGHSGLLNSGGGQH

SEQ ID NO: 1555148 - protein, 27 aa, Mycobacterium tuberculosis
GGFDCSGLVMWAFQQAGIALPHSSQAL

SEQ ID NO: 1555149 - protein, 33 aa, Mycobacterium tuberculosis; identical to SEQ ID NO: 236414

SEQ ID NO: 1555150 - protein, 26 aa, Mycobacterium tuberculosis
GISVNVTLIFSVQRYREVMDAYLTGM

SEQ ID NO: 1555151 - protein, 24 aa, Mycobacterium tuberculosis
GNGGGAGLFYGFGGAGGNGGMGGV

SEQ ID NO: 1555152 - protein, 22 aa, Mycobacterium tuberculosis
GPAPGVAPPPGGMPGLPFVQPD

SEQ ID NO: 1555153 - protein, 17 aa, Mycobacterium tuberculosis
GRRLMIGTAAAVVLPGL

SEQ ID NO: 1555154 - protein, 24 aa, Mycobacterium tuberculosis
GSDAWDRLFAGPRPTELHPFVELT

SEQ ID NO: 1555155 - protein, 17 aa, Mycobacterium tuberculosis
HVSLNWTHPDPATLWTL

SEQ ID NO: 1555156 - protein, 20 aa, Mycobacterium tuberculosis
IDFRDPAPFAVLRRVDRWFW

SEQ ID NO: 1555157 - protein, 19 aa, Mycobacterium tuberculosis
IHQTFSLGPLVVPDIVIPA

SEQ ID NO: 1555158 - protein, 26 aa, Mycobacterium tuberculosis
ISGIELINQWYYNPAFFAIMSDCANT

SEQ ID NO: 1555159 - protein, 23 aa, Mycobacterium tuberculosis
IYREPLSLRPFDYLPKPLRRSMG

SEQ ID NO: 1555160 - protein, 27 aa, Mycobacterium tuberculosis
KTSDGWRIDRLPNGVFLDWQQFQETYK

SEQ ID NO: 1555161 - protein, 19 aa, Mycobacterium tuberculosis
LGPLVVPDIVIPAFGGGTA

SEQ ID NO: 1555162 - protein, 27 aa, Mycobacterium tuberculosis
LHAYAMEANWALLLLDDDGAGERARTA

SEQ ID NO: 1555163 - protein, 19 aa, Mycobacterium tuberculosis
MWERRPGAADFCRIRVGVG

SEQ ID NO: 1555164 - protein, 17 aa, Mycobacterium tuberculosis
NWHMLIVTSIGTDARTR

SEQ ID NO: 1555165 - protein, 18 aa, Mycobacterium tuberculosis
PITIDRIPLNLGASVTVG

SEQ ID NO: 1555166 - protein, 19 aa, Mycobacterium tuberculosis
QHPEFVDVFLAIGRVGRSL

SEQ ID NO: 1555167 - protein, 37 aa, Mycobacterium tuberculosis; identical to SEQ ID NO: 237376

SEQ ID NO: 1555168 - protein, 26 aa, Mycobacterium tuberculosis
QTGAQLPCLPILFIVVDEFSELLSQH

SEQ ID NO: 1555169 - protein, 26 aa, Mycobacterium tuberculosis
RDSIVAINPLIRVRLHELRLAPSNAV

SEQ ID NO: 1555170 - protein, 24 aa, Mycobacterium tuberculosis
SAAAAALPAFSPPAQALGGGVGAF

SEQ ID NO: 1555171 - protein, 19 aa, Mycobacterium tuberculosis
SGPTTALTDVWRALRASMR

SEQ ID NO: 1555172 - protein, 33 aa, Mycobacterium tuberculosis; identical to SEQ ID NO: 237413

SEQ ID NO: 1555173 - protein, 24 aa, Mycobacterium tuberculosis
SPEVLNLLLVDFKGGATFLDLAGA

SEQ ID NO: 1555174 - protein, 24 aa, Mycobacterium tuberculosis
TAHTNLEFLSCFLGLMLHGAVPVP

SEQ ID NO: 1555175 - protein, 22 aa, Mycobacterium tuberculosis
TKLLETYSVPPLLHNQALAISV

SEQ ID NO: 1555176 - protein, 22 aa, Mycobacterium tuberculosis
TLAAAAAWDGLAAELGQAANSF

SEQ ID NO: 1555177 - protein, 33 aa, Mycobacterium tuberculosis; identical to SEQ ID NO: 227026

SEQ ID NO: 1555178 - protein, 17 aa, Mycobacterium tuberculosis
VQRLPLNVTWVNLTTGK

SEQ ID NO: 1555179 - protein, 25 aa, Mycobacterium tuberculosis
VTDAYARRILGWRVASTMATSMVLD

SEQ ID NO: 1555180 - protein, 22 aa, Mycobacterium tuberculosis
VVADRRRYYLGSISGKKVIVAM

SEQ ID NO: 1555181 - protein, 28 aa, Mycobacterium tuberculosis
VWLPPLDEPPMLGALLRDAEPAQAELAV

SEQ ID NO: 1555182 - protein, 19 aa, Mycobacterium tuberculosis
WYGKPKVLVDGWLDTAVGA

SEQ ID NO: 1555183 - protein, 24 aa, Mycobacterium tuberculosis
AAVLLLTPITVPAGYPGAVAPATA

SEQ ID NO: 1555184 - protein, 27 aa, Mycobacterium tuberculosis
ADFADLFPVPAKLWTIADLGGWGSVDP

SEQ ID NO: 1555185 - protein, 17 aa, Mycobacterium tuberculosis
AELSSRLPPRGLTQAAR

SEQ ID NO: 1555186 - protein, 33 aa, Mycobacterium tuberculosis; identical to SEQ ID NO: 236107

SEQ ID NO: 1555187 - protein, 21 aa, Mycobacterium tuberculosis
AGSPGGLLYGTGGAGGNGGPG

SEQ ID NO: 1555188 - protein, 22 aa, Mycobacterium tuberculosis
APLGEPLPAAPAELAPPADLAP

SEQ ID NO: 1555189 - protein, 20 aa, Mycobacterium tuberculosis
ARWVDWFNHRRLYQYCGDVP

SEQ ID NO: 1555190 - protein, 26 aa, Mycobacterium tuberculosis
ASGLDARAYRLAWPVGSIVYEVDMPE

SEQ ID NO: 1555191 - protein, 25 aa, Mycobacterium tuberculosis
ATAFRNFQYTVQAQKLWAQAGFRPV

SEQ ID NO: 1555192 - protein, 19 aa, Mycobacterium tuberculosis
ATLGILEHFPMSDYAPSKV

SEQ ID NO: 1555193 - protein, 23 aa, Mycobacterium tuberculosis
AVPLNSQYRWPAMAGAAVAVTRA

SEQ ID NO: 1555194 - protein, 20 aa, Mycobacterium tuberculosis
AVVLLIALGAVWTPVAFADG

SEQ ID NO: 1555195 - protein, 25 aa, Mycobacterium tuberculosis
DAGHSVRFLVRNPARLKTSVAKLGV

SEQ ID NO: 1555196 - protein, 34 aa, Mycobacterium tuberculosis; identical to SEQ ID NO: 236244

SEQ ID NO: 1555197 - protein, 17 aa, Mycobacterium tuberculosis
EDFWRSAGLPAYRWPDP

SEQ ID NO: 1555198 - protein, 22 aa, Mycobacterium tuberculosis
GAGGSGGLLWGNGGAGGAGGNG

SEQ ID NO: 1555199 - protein, 24 aa, Mycobacterium tuberculosis
GGAGGFGAVLFGNGGAGGSGAPGG

SEQ ID NO: 1555200 - protein, 18 aa, Mycobacterium tuberculosis
GGRRPLITEAIRGEGAIL

SEQ ID NO: 1555201 - protein, 17 aa, Mycobacterium tuberculosis
GLPALPAGLPPLPAVPA

SEQ ID NO: 1555202 - protein, 21 aa, Mycobacterium tuberculosis
GQSGLLFGNAGAGGAGAAGGA

SEQ ID NO: 1555203 - protein, 29 aa, Mycobacterium tuberculosis
GRAAVPWWPWAPLVRLMWVLPPRLTRRFA

SEQ ID NO: 1555204 - protein, 24 aa, Mycobacterium tuberculosis
GVRSALWMHVIPGRGAAWLIVDVR

SEQ ID NO: 1555205 - protein, 18 aa, Mycobacterium tuberculosis
GWGYPQPRSGQRARRATG

SEQ ID NO: 1555206 - protein, 21 aa, Mycobacterium tuberculosis
ILATMLVAGRLLATLMAAPSA

SEQ ID NO: 1555207 - protein, 18 aa, Mycobacterium tuberculosis
ILEHFPMSDYAPSKVDLN

SEQ ID NO: 1555208 - protein, 21 aa, Mycobacterium tuberculosis
KLCVQYLAPIVKNRQYNYPPL

SEQ ID NO: 1555209 - protein, 24 aa, Mycobacterium tuberculosis
LAEKRPPPAPRLTFRPADSAADVV

SEQ ID NO: 1555210 - protein, 18 aa, Mycobacterium tuberculosis
LDIRTGHVALRVLHDGTA

SEQ ID NO: 1555211 - protein, 26 aa, Mycobacterium tuberculosis
LRGRATLGSFSAWLGVTAKAAEAAAP

SEQ ID NO: 1555212 - protein, 18 aa, Mycobacterium tuberculosis
PHIAMTAAMLRQAGVDID

SEQ ID NO: 1555213 - protein, 25 aa, Mycobacterium tuberculosis
PPVCDCGGLIRPDIVWFGEPLPEEP

SEQ ID NO: 1555214 - protein, 24 aa, Mycobacterium tuberculosis
PSTGPSMGILPAGGVGGPGGSGGA

SEQ ID NO: 1555215 - protein, 18 aa, Mycobacterium tuberculosis
PVEGGWAWLPDEAQGARV

SEQ ID NO: 1555216 - protein, 27 aa, Mycobacterium tuberculosis
QALSAQAAMFHEQFVRALAAGGNSYAV

SEQ ID NO: 1555217 - protein, 18 aa, Mycobacterium tuberculosis
QLLIVDFRHTLLDVIESE

SEQ ID NO: 1555218 - protein, 23 aa, Mycobacterium tuberculosis
QPADHILAILRQLNAVVIHADSS

SEQ ID NO: 1555219 - protein, 17 aa, Mycobacterium tuberculosis
RAQLLIVDFRHTLLDVI

SEQ ID NO: 1555220 - protein, 19 aa, Mycobacterium tuberculosis
RPDIVWFGEPLPEEPWRSA

SEQ ID NO: 1555221 - protein, 20 aa, Mycobacterium tuberculosis
RTRAALRTCMHHKRFGELRE

SEQ ID NO: 1555222 - protein, 28 aa, Mycobacterium tuberculosis
SVLDQAGPYLPFNTPFTAAGMQYYTQMP

SEQ ID NO: 1555223 - protein, 24 aa, Mycobacterium tuberculosis
SWFAGYRGDLAFASLIVGGGSSEY

SEQ ID NO: 1555224 - protein, 20 aa, Mycobacterium tuberculosis
TAARWNLKTIADLAPHSADV

SEQ ID NO: 1555225 - protein, 23 aa, Mycobacterium tuberculosis
TLLGRLLVYDALEMSYRTITIRK

SEQ ID NO: 1555226 - protein, 18 aa, Mycobacterium tuberculosis
TNRALVLAALAAAQGRGA

SEQ ID NO: 1555227 - protein, 25 aa, Mycobacterium tuberculosis
TPISQKMIDALRPMMRLVVTNGTAK

SEQ ID NO: 1555228 - protein, 33 aa, Mycobacterium tuberculosis; identical to SEQ ID NO: 225712

SEQ ID NO: 1555229 - protein, 28 aa, Mycobacterium tuberculosis
VLVLTLTLVAFWWWQRPRTNAVAADSLV

SEQ ID NO: 1555230 - protein, 20 aa, Mycobacterium tuberculosis
WPEPISYTALDRGDLQRAMS

SEQ ID NO: 1555231 - protein, 19 aa, Mycobacterium tuberculosis
YLGGLQFTQSTWAAHGGGE

SEQ ID NO: 1555232 - protein, 21 aa, Mycobacterium tuberculosis
AAAFAAVLLAVVCLPANTAAA

SEQ ID NO: 1555233 - protein, 20 aa, Mycobacterium tuberculosis
AFHRFALAILGLALPVALVA

SEQ ID NO: 1555234 - protein, 23 aa, Mycobacterium tuberculosis
AGSWHIRWAALTPARQAAVIVAA

SEQ ID NO: 1555235 - protein, 25 aa, Mycobacterium tuberculosis
ASGLDARAYRLAWPVGSIVYEVDMP

SEQ ID NO: 1555236 - protein, 30 aa, Mycobacterium tuberculosis; identical to SEQ ID NO: 226013

SEQ ID NO: 1555237 - protein, 29 aa, Mycobacterium tuberculosis
DATYGRGVYAWRLVRYYEDSTLATALANP

SEQ ID NO: 1555238 - protein, 31 aa, Mycobacterium tuberculosis; identical to SEQ ID NO: 216916

SEQ ID NO: 1555239 - protein, 23 aa, Mycobacterium tuberculosis
DGPARIANYLDWLNRCGSYQVTN

SEQ ID NO: 1555240 - protein, 26 aa, Mycobacterium tuberculosis
DIHETMVIPPIVFLPSMTIGGQTYTI

SEQ ID NO: 1555241 - protein, 30 aa, Mycobacterium tuberculosis; identical to SEQ ID NO: 236267

SEQ ID NO: 1555242 - protein, 25 aa, Mycobacterium tuberculosis
DVSGGLPAFTLFPGGLNIPQNAIPL

SEQ ID NO: 1555243 - protein, 20 aa, Mycobacterium tuberculosis
EAIWPPARTLRYDRQSPWLA

SEQ ID NO: 1555244 - protein, 27 aa, Mycobacterium tuberculosis
EGISVNVTLIFSVQRYREVMDAYLTGM

SEQ ID NO: 1555245 - protein, 22 aa, Mycobacterium tuberculosis
EHVWALMGMPCGKYLVVMHDLW

SEQ ID NO: 1555246 - protein, 24 aa, Mycobacterium tuberculosis
ENAMEQFVYAYVRSCPGYTLDYNA

SEQ ID NO: 1555247 - protein, 17 aa, Mycobacterium tuberculosis
FEPVLASLRDLGCRALL

SEQ ID NO: 1555248 - protein, 17 aa, Mycobacterium tuberculosis
FTLIRDRTEPVMSAKLP

SEQ ID NO: 1555249 - protein, 22 aa, Mycobacterium tuberculosis
GGRAGLLLGVGGMGGNGGATSV

SEQ ID NO: 1555250 - protein, 20 aa, Mycobacterium tuberculosis
GNAALLFGNGGAGGAGGAGG

SEQ ID NO: 1555251 - protein, 28 aa, Mycobacterium tuberculosis
IGPIIIPDTTILPPIHLGLTGQANYGFA

SEQ ID NO: 1555252 - protein, 21 aa, Mycobacterium tuberculosis
ILLFLGAVLAGCASVPSTSAP

SEQ ID NO: 1555253 - protein, 17 aa, Mycobacterium tuberculosis
IPIPAIHIDFDGAADAG

SEQ ID NO: 1555254 - protein, 17 aa, Mycobacterium tuberculosis
IPQNAIPLTIDASGVLD

SEQ ID NO: 1555255 - protein, 27 aa, Mycobacterium tuberculosis
ISGIELINQWYYNPAFFAIMSDCANTQ

SEQ ID NO: 1555256 - protein, 19 aa, Mycobacterium tuberculosis
ITTSPIPLKIDVSGGLPAF

SEQ ID NO: 1555257 - protein, 26 aa, Mycobacterium tuberculosis
IVHVSSFTALFRPNLATLSADLPVAG

SEQ ID NO: 1555258 - protein, 30 aa, Mycobacterium tuberculosis
KIEPQPLRAKISFWFDRKYRVPADAAAAIL

SEQ ID NO: 1555259 - protein, 31 aa, Mycobacterium tuberculosis
KIEPQPLRAKISFWFDRKYRVPADAAAAILS

SEQ ID NO: 1555260 - protein, 28 aa, Mycobacterium tuberculosis
KTTSVLAAALLFCGLLGPGTAPPATGGG

SEQ ID NO: 1555261 - protein, 23 aa, Mycobacterium tuberculosis
LLCAMVLALAWLSAVAGCSRGGS

SEQ ID NO: 1555262 - protein, 28 aa, Mycobacterium tuberculosis
LLSGDRVIPQWVKIRNVDGFNGSFWHGG

SEQ ID NO: 1555263 - protein, 20 aa, Mycobacterium tuberculosis
LLSRSNWVLATALPASQDVP

SEQ ID NO: 1555264 - protein, 27 aa, Mycobacterium tuberculosis
LQLSALLPEWRTELPLRYLESVITQLS

SEQ ID NO: 1555265 - protein, 26 aa, Mycobacterium tuberculosis
MLAAVLLLTPITVPAGYPGAVAPATA

SEQ ID NO: 1555266 - protein, 32 aa, Mycobacterium tuberculosis
MRDRWAGFFNEFDVLLLPVTPTPAPLHHNKDH

SEQ ID NO: 1555267 - protein, 19 aa, Mycobacterium tuberculosis
NARFALWAVADGPARIANY

SEQ ID NO: 1555268 - protein, 24 aa, Mycobacterium tuberculosis
NFSNGVLWRGDYEGLWGLSGGSTI

SEQ ID NO: 1555269 - protein, 17 aa, Mycobacterium tuberculosis
NISIIDIPALPGFGNST

SEQ ID NO: 1555270 - protein, 19 aa, Mycobacterium tuberculosis
NSGSFNNGALWTGDHHGLV

SEQ ID NO: 1555271 - protein, 17 aa, Mycobacterium tuberculosis
NWIATLTLELEPTVRLP

SEQ ID NO: 1555272 - protein, 23 aa, Mycobacterium tuberculosis
PDSSVPIIIVPPTPGFGNATATP

SEQ ID NO: 1555273 - protein, 22 aa, Mycobacterium tuberculosis
PRQWLEIRYLDSVPDEVWPAVV

SEQ ID NO: 1555274 - protein, 24 aa, Mycobacterium tuberculosis
QAAGPWLKNALISNLNIVSTVNPG

SEQ ID NO: 1555275 - protein, 25 aa, Mycobacterium tuberculosis
QGKAALEVNWPFVFASMLENAVKGG

SEQ ID NO: 1555276 - protein, 21 aa, Mycobacterium tuberculosis
RDGQWWYESLSGAPIADWLAS

SEQ ID NO: 1555277 - protein, 23 aa, Mycobacterium tuberculosis
RLRLTRQALLAAAVVPLLAGCAL

SEQ ID NO: 1555278 - protein, 20 aa, Mycobacterium tuberculosis
RQRLQDIVKGGYRSANAAIV

SEQ ID NO: 1555279 - protein, 23 aa, Mycobacterium tuberculosis
RSLGYTGNFFQAAGPWLKNALIS

SEQ ID NO: 1555280 - protein, 22 aa, Mycobacterium tuberculosis
SAVFPTILARATPGDGWASLAS

SEQ ID NO: 1555281 - protein, 24 aa, Mycobacterium tuberculosis
SGPRWLALLLQPLSGPPSTSAKHT

SEQ ID NO: 1555282 - protein, 18 aa, Mycobacterium tuberculosis
SSQFVSGLLLSAASFTDG

SEQ ID NO: 1555283 - protein, 17 aa, Mycobacterium tuberculosis
TAAPLPGLGFTQPLPPA

SEQ ID NO: 1555284 - protein, 26 aa, Mycobacterium tuberculosis
TALHKHLLEQSPPIWWTHIAGHGDAA

SEQ ID NO: 1555285 - protein, 25 aa, Mycobacterium tuberculosis
TVTVPELLVVRPAPGVWHLVSTVSA

SEQ ID NO: 1555286 - protein, 20 aa, Mycobacterium tuberculosis
VADRRRYYLGSISGKKVIVA

SEQ ID NO: 1555287 - protein, 18 aa, Mycobacterium tuberculosis
VFLDWQQFQETYKRNTLY

SEQ ID NO: 1555288 - protein, 17 aa, Mycobacterium tuberculosis
VLTFDYLPQNAPEADAI

SEQ ID NO: 1555289 - protein, 17 aa, Mycobacterium tuberculosis
VNIGPFRIEPIDVPAVV

SEQ ID NO: 1555290 - protein, 17 aa, Mycobacterium tuberculosis
VSAMLVAGLVACGSNSP

SEQ ID NO: 1555291 - protein, 20 aa, Mycobacterium tuberculosis
VSNIAYTKKLWQAIRAQDVC

SEQ ID NO: 1555292 - protein, 43 aa, Mycobacterium tuberculosis
AAAASPLQALQLELLNAINAPTLALLGRPLIGDGTDAAPGSGG

SEQ ID NO: 1555293 - protein, 31 aa, Mycobacterium tuberculosis; identical to SEQ ID NO: 237484

SEQ ID NO: 1555294 - protein, 19 aa, Mycobacterium tuberculosis
AESIRPLVAPPPAPAPAPA

SEQ ID NO: 1555295 - protein, 20 aa, Mycobacterium tuberculosis
AESIRPLVAPPPAPAPAPAE

SEQ ID NO: 1555296 - protein, 24 aa, Mycobacterium tuberculosis
ALAADLLFLALRDALTEKLDILIH

SEQ ID NO: 1555297 - protein, 19 aa, Mycobacterium tuberculosis
ALQAARSYVVKLATMDCER

SEQ ID NO: 1555298 - protein, 18 aa, Mycobacterium tuberculosis
APGSWRTRTWWTGTPDSS

SEQ ID NO: 1555299 - protein, 31 aa, Mycobacterium tuberculosis; identical to SEQ ID NO: 1521248

SEQ ID NO: 1555300 - protein, 20 aa, Mycobacterium tuberculosis
ASTFTIVAIGTYCPAVIAPL

SEQ ID NO: 1555301 - protein, 27 aa, Mycobacterium tuberculosis
ATSPMDPALYLVWAQANAAAGYRYSVE

SEQ ID NO: 1555302 - protein, 18 aa, Mycobacterium tuberculosis
AWPAFRAATRWESSPTPP

SEQ ID NO: 1555303 - protein, 24 aa, Mycobacterium tuberculosis
DGLDYAVIKFDPAKVTPVAVFNGF

SEQ ID NO: 1555304 - protein, 25 aa, Mycobacterium tuberculosis
DRRLRLTRQALLAAAVVPLLAGCAL

SEQ ID NO: 1555305 - protein, 27 aa, Mycobacterium tuberculosis
DRSLHRVVLLALLPLGLAAAPGRTTRA

SEQ ID NO: 1555306 - protein, 20 aa, Mycobacterium tuberculosis
EALAATATYLTGIGSAISAA

SEQ ID NO: 1555307 - protein, 17 aa, Mycobacterium tuberculosis
EAVLTFDYLPQNAPEAD

SEQ ID NO: 1555308 - protein, 25 aa, Mycobacterium tuberculosis
EAVRARLRRRGPVTVYGVDKFPRMV

SEQ ID NO: 1555309 - protein, 19 aa, Mycobacterium tuberculosis
ELAQLLPKQSEFPASWTVD

SEQ ID NO: 1555310 - protein, 25 aa, Mycobacterium tuberculosis
ELGQPLPLFIKWDDADYGLRAAEHG

SEQ ID NO: 1555311 - protein, 25 aa, Mycobacterium tuberculosis
ELVVVVPPGHKWARRSRVVSARELA

SEQ ID NO: 1555312 - protein, 18 aa, Mycobacterium tuberculosis
FARILRPGGLAGITDVTV

SEQ ID NO: 1555313 - protein, 19 aa, Mycobacterium tuberculosis
FDPAKVTPVAVFNGFAING

SEQ ID NO: 1555314 - protein, 25 aa, Mycobacterium tuberculosis
FVEATFPIAAHYFAVFPLAKHMESA

SEQ ID NO: 1555315 - protein, 21 aa, Mycobacterium tuberculosis
GDGIALGLWAGVAVSDLEFIQ

SEQ ID NO: 1555316 - protein, 19 aa, Mycobacterium tuberculosis
GEHVVPIPRLLNVEDYLDY

SEQ ID NO: 1555317 - protein, 17 aa, Mycobacterium tuberculosis
GGSVQWVLGNLGAIPTV

SEQ ID NO: 1555318 - protein, 31 aa, Mycobacterium tuberculosis; identical to SEQ ID NO: 237631

SEQ ID NO: 1555319 - protein, 24 aa, Mycobacterium tuberculosis
GTAGNAGIGGAGGRGGDGGAGDSG

SEQ ID NO: 1555320 - protein, 27 aa, Mycobacterium tuberculosis
GTGGAGGRAELLFGAGGAGGAGTDGGP

SEQ ID NO: 1555321 - protein, 23 aa, Mycobacterium tuberculosis
GVAALPDWVPFATLFTVAAGTLL

SEQ ID NO: 1555322 - protein, 22 aa, Mycobacterium tuberculosis
GVGGTWHWNTYPGIAVDIPSFS

SEQ ID NO: 1555323 - protein, 19 aa, Mycobacterium tuberculosis
GWCGWVLFEKHQTDVAAGQ

SEQ ID NO: 1555324 - protein, 21 aa, Mycobacterium tuberculosis
HPSAPAYALAADLLFLALRDA

SEQ ID NO: 1555325 - protein, 29 aa, Mycobacterium tuberculosis
IAAVVLGAAALIVALTRPTNSGPATAAGT

SEQ ID NO: 1555326 - protein, 27 aa, Mycobacterium tuberculosis
IACITAQLPEWFRPGDFFPVPCCFPSC

SEQ ID NO: 1555327 - protein, 30 aa, Mycobacterium tuberculosis; identical to SEQ ID NO: 226398

SEQ ID NO: 1555328 - protein, 23 aa, Mycobacterium tuberculosis
IDRSRIKVIMDKVNGRWLASKVE

SEQ ID NO: 1555329 - protein, 27 aa, Mycobacterium tuberculosis
IFPGGFTIDPLPLSLALNISVPDSSVP

SEQ ID NO: 1555330 - protein, 19 aa, Mycobacterium tuberculosis
ILVVVIVGGFTVHRIRGFF

SEQ ID NO: 1555331 - protein, 18 aa, Mycobacterium tuberculosis
IVALLLGDSFHPGGATLT

SEQ ID NO: 1555332 - protein, 24 aa, Mycobacterium tuberculosis
KCCVQQITPDGRLIPFCAYNSVGY

SEQ ID NO: 1555333 - protein, 19 aa, Mycobacterium tuberculosis
LGFLGERAVNVLRLNLALD

SEQ ID NO: 1555334 - protein, 23 aa, Mycobacterium tuberculosis
LRDGSYLPMTFAANDIAWSDNKP

SEQ ID NO: 1555335 - protein, 20 aa, Mycobacterium tuberculosis
LRMFTGAGSAPMLAASVAWD

SEQ ID NO: 1555336 - protein, 30 aa, Mycobacterium tuberculosis
LSAQALAFHDQFVQALNMGAVCYAAAETAN

SEQ ID NO: 1555337 - protein, 19 aa, Mycobacterium tuberculosis
LTSATLGGLALPLQQTIDA

SEQ ID NO: 1555338 - protein, 31 aa, Mycobacterium tuberculosis; identical to SEQ ID NO: 236661

SEQ ID NO: 1555339 - protein, 23 aa, Mycobacterium tuberculosis
NAQRTAWIAEGLLGYLSAEAQDR

SEQ ID NO: 1555340 - protein, 25 aa, Mycobacterium tuberculosis
NFSNGILWRGNYEGLFSYSYSLDVP

SEQ ID NO: 1555341 - protein, 21 aa, Mycobacterium tuberculosis
NGGFSFFDGNGGDGGTGGTLI

SEQ ID NO: 1555342 - protein, 17 aa, Mycobacterium tuberculosis
PAALTGEWFGALAVIAP

SEQ ID NO: 1555343 - protein, 26 aa, Mycobacterium tuberculosis
PAQQRYPPWPASYDASLRVSWRQLQP

SEQ ID NO: 1555344 - protein, 17 aa, Mycobacterium tuberculosis
PGGLNIPQNAIPLTIDA

SEQ ID NO: 1555345 - protein, 19 aa, Mycobacterium tuberculosis
PIRIPSTLLGLLSEIPRCP

SEQ ID NO: 1555346 - protein, 27 aa, Mycobacterium tuberculosis
PIVRPQTLIYRAGVAAWWTSPMTRADG

SEQ ID NO: 1555347 - protein, 20 aa, Mycobacterium tuberculosis
PLDFFIDGFGRTAPSRSAFV

SEQ ID NO: 1555348 - protein, 20 aa, Mycobacterium tuberculosis
PRYPYRPEPPAPPPGGPPPG

SEQ ID NO: 1555349 - protein, 22 aa, Mycobacterium tuberculosis
PSRSAFVAGPWGAVASLSPELF

SEQ ID NO: 1555350 - protein, 19 aa, Mycobacterium tuberculosis
PYQGTVRMAFLLQGDHDAY

SEQ ID NO: 1555351 - protein, 23 aa, Mycobacterium tuberculosis
PYQGTVRMAFLLQGDHDAYFQHV

SEQ ID NO: 1555352 - protein, 18 aa, Mycobacterium tuberculosis
QFTAAKYFHPRPSSAGDG

SEQ ID NO: 1555353 - protein, 17 aa, Mycobacterium tuberculosis
QLDVPPRFQAKGLGSGG

SEQ ID NO: 1555354 - protein, 18 aa, Mycobacterium tuberculosis
RDSHPIRIPSTLLGLLSE

SEQ ID NO: 1555355 - protein, 24 aa, Mycobacterium tuberculosis
RSGFDAFVGLVSRCLRFGSAVAGS

SEQ ID NO: 1555356 - protein, 26 aa, Mycobacterium tuberculosis
SAHVAAFHDQFVHTLTAGAGSYMAAE

SEQ ID NO: 1555357 - protein, 23 aa, Mycobacterium tuberculosis
SDNLPSCITKYIPLHTPAVVMSI

SEQ ID NO: 1555358 - protein, 18 aa, Mycobacterium tuberculosis
SDQELAQLLPKQSEFPAS

SEQ ID NO: 1555359 - protein, 21 aa, Mycobacterium tuberculosis
SDTFGYFKYHVFDEGLGFDPI

SEQ ID NO: 1555360 - protein, 25 aa, Mycobacterium tuberculosis
SFATYFNAFPASYWRRWTTCKSVVL

SEQ ID NO: 1555361 - protein, 26 aa, Mycobacterium tuberculosis
SGLDSRAYRLRWPAGTIVFEVDQPQV

SEQ ID NO: 1555362 - protein, 18 aa, Mycobacterium tuberculosis
SSATWPEPISYTALDRGD

SEQ ID NO: 1555363 - protein, 18 aa, Mycobacterium tuberculosis
SSNLLFRRNSVSGAVEVL

SEQ ID NO: 1555364 - protein, 18 aa, Mycobacterium tuberculosis
STGKIYFDVTGPSPTIVA

SEQ ID NO: 1555365 - protein, 26 aa, Mycobacterium tuberculosis
SVPGYPNFFTVFGPYGYVGSSYFALI

SEQ ID NO: 1555366 - protein, 18 aa, Mycobacterium tuberculosis
TDRVFAIVIQDFQDPYTL

SEQ ID NO: 1555367 - protein, 28 aa, Mycobacterium tuberculosis
TGGAGGAGGWLFGVGGAGGVGGAGGGTG

SEQ ID NO: 1555368 - protein, 24 aa, Mycobacterium tuberculosis
TGIVYPLAVTGVGQLFFGDQANGA

SEQ ID NO: 1555369 - protein, 23 aa, Mycobacterium tuberculosis
THYFDNFFLDATRAGIRQAVILA

SEQ ID NO: 1555370 - protein, 21 aa, Mycobacterium tuberculosis
TRLADRGMRLTLRVYAYSSCC

SEQ ID NO: 1555371 - protein, 23 aa, Mycobacterium tuberculosis
TTSTLPGAGWTAAAPQAAAGTFI

SEQ ID NO: 1555372 - protein, 17 aa, Mycobacterium tuberculosis
TYLNDFAQLLAALGRRY

SEQ ID NO: 1555373 - protein, 40 aa, Mycobacterium tuberculosis; identical to SEQ ID NO: 237006

SEQ ID NO: 1555374 - protein, 18 aa, Mycobacterium tuberculosis
VAFLTTGCIRWSTQSRPV

SEQ ID NO: 1555375 - protein, 18 aa, Mycobacterium tuberculosis
VFTLIRDRTEPVMSAKLP

SEQ ID NO: 1555376 - protein, 18 aa, Mycobacterium tuberculosis
VHIYLQFDGLDEATHRRI

SEQ ID NO: 1555377 - protein, 19 aa, Mycobacterium tuberculosis
VIAVIGYQRISTSAVTGSL

SEQ ID NO: 1555378 - protein, 17 aa, Mycobacterium tuberculosis
VIDFKTTTLAGLGAAPT

SEQ ID NO: 1555379 - protein, 30 aa, Mycobacterium tuberculosis
VLLSGDRVIPQWVKIRNVDGFNGSFWHGGV

SEQ ID NO: 1555380 - protein, 19 aa, Mycobacterium tuberculosis
VPNAIPLAGLLADAPHGSK

SEQ ID NO: 1555381 - protein, 35 aa, Mycobacterium tuberculosis; identical to SEQ ID NO: 225762

SEQ ID NO: 1555382 - protein, 17 aa, Mycobacterium tuberculosis
VYFDYWSARGVDVTPFF

SEQ ID NO: 1555383 - protein, 18 aa, Mycobacterium tuberculosis
YVAFVTDAYARRILGWRV

SEQ ID NO: 1555384 - protein, 21 aa, Mycobacterium tuberculosis
YYAVRGVLLECTSYLQGADLD

SEQ ID NO: 1555385 - protein, 24 aa, Mycobacterium tuberculosis
AAAVDVTLLSRFYERFADHAVEVA

SEQ ID NO: 1555386 - protein, 19 aa, Mycobacterium tuberculosis
AFGRLLAVDIPALNLRRQL

SEQ ID NO: 1555387 - protein, 25 aa, Mycobacterium tuberculosis
AFNTPALNIHQIPLGFQVPGSIDAI

SEQ ID NO: 1555388 - protein, 27 aa, Mycobacterium tuberculosis
AGEACARAIAWYLAMARRSQGNESAAV

SEQ ID NO: 1555389 - protein, 29 aa, Mycobacterium tuberculosis
AGPDQPALRPLLDLLPIAGGSGTLGERFL

SEQ ID NO: 1555390 - protein, 23 aa, Mycobacterium tuberculosis
AHTNLEFLSCFLGLMLHGAVPVP

SEQ ID NO: 1555391 - protein, 20 aa, Mycobacterium tuberculosis
AIWCMDWPAVAAAAAAGLSA

SEQ ID NO: 1555392 - protein, 17 aa, Mycobacterium tuberculosis
ANPIAFLCGAIQAASRL

SEQ ID NO: 1555393 - protein, 22 aa, Mycobacterium tuberculosis
ATLGILEHFPMSDYAPSKVDLN

SEQ ID NO: 1555394 - protein, 18 aa, Mycobacterium tuberculosis
AVDIPALNLRRQLRAIWV

SEQ ID NO: 1555395 - protein, 18 aa, Mycobacterium tuberculosis
AYVLHRAWVGPMVLVVLD

SEQ ID NO: 1555396 - protein, 28 aa, Mycobacterium tuberculosis
DGLDYAVIKFDPAKVTPVAVFNGFAING

SEQ ID NO: 1555397 - protein, 26 aa, Mycobacterium tuberculosis
DGPAPGVAPPPGGMPGLPFVQPDGAG

SEQ ID NO: 1555398 - protein, 31 aa, Mycobacterium tuberculosis; identical to SEQ ID NO: 1513565

SEQ ID NO: 1555399 - protein, 17 aa, Mycobacterium tuberculosis
DPLLNVGKLIANNTRVW

SEQ ID NO: 1555400 - protein, 24 aa, Mycobacterium tuberculosis
DSILRVLAMHRFAKAPMLVGGQML

SEQ ID NO: 1555401 - protein, 31 aa, Mycobacterium tuberculosis; identical to SEQ ID NO: 237197

SEQ ID NO: 1555402 - protein, 18 aa, Mycobacterium tuberculosis
FKVRPSFSFFAVGPDGMP

SEQ ID NO: 1555403 - protein, 22 aa, Mycobacterium tuberculosis
FPANSLLNLDVFVGTPGATIPA

SEQ ID NO: 1555404 - protein, 20 aa, Mycobacterium tuberculosis
GAAVGLFGHGGAGGAGGLGK

SEQ ID NO: 1555405 - protein, 26 aa, Mycobacterium tuberculosis
GCQTYKWETFLTSELPGWLQANRHVK

SEQ ID NO: 1555406 - protein, 17 aa, Mycobacterium tuberculosis
GFDSVGLALSLYDEIIV

SEQ ID NO: 1555407 - protein, 17 aa, Mycobacterium tuberculosis
GIDYLVNNAAIYGGMKL

SEQ ID NO: 1555408 - protein, 26 aa, Mycobacterium tuberculosis
GNDSNGILWRGNFEGLFGLNVGITIP

SEQ ID NO: 1555409 - protein, 17 aa, Mycobacterium tuberculosis
GNYEGLAGFSFGYPIPL

SEQ ID NO: 1555410 - protein, 18 aa, Mycobacterium tuberculosis
GPGGAAVGLFGHGGAGGA

SEQ ID NO: 1555411 - protein, 19 aa, Mycobacterium tuberculosis
GQGALVVLIARDDPLDTYL

SEQ ID NO: 1555412 - protein, 18 aa, Mycobacterium tuberculosis
GVNLFGFDQLLPEDGRIQ

SEQ ID NO: 1555413 - protein, 35 aa, Mycobacterium tuberculosis; identical to SEQ ID NO: 237642

SEQ ID NO: 1555414 - protein, 24 aa, Mycobacterium tuberculosis
IEYGINWLPWILRGVYPPPAMPPQ

SEQ ID NO: 1555415 - protein, 22 aa, Mycobacterium tuberculosis
IGPVSLPIFGFGGAPGFGNDTT

SEQ ID NO: 1555416 - protein, 28 aa, Mycobacterium tuberculosis
IRDKPMPLFQLLVLCMLASKPIGAATAA

SEQ ID NO: 1555417 - protein, 23 aa, Mycobacterium tuberculosis
ITALVPGLTWRTDMDTWTGCGGE

SEQ ID NO: 1555418 - protein, 19 aa, Mycobacterium tuberculosis
ITEPLGYDTTYTWSGSAVG

SEQ ID NO: 1555419 - protein, 25 aa, Mycobacterium tuberculosis
ITIPEFPIHWTSTGGIGPIIIPDTT

SEQ ID NO: 1555420 - protein, 23 aa, Mycobacterium tuberculosis
ITVDPITLTIPGLSLDAAVSEIR

SEQ ID NO: 1555421 - protein, 24 aa, Mycobacterium tuberculosis
IYREPLSLRPFDYLPKPLRRSMGK

SEQ ID NO: 1555422 - protein, 17 aa, Mycobacterium tuberculosis
LAPPAPAELAPPAPADL

SEQ ID NO: 1555423 - protein, 20 aa, Mycobacterium tuberculosis
LAVLTAAPLLLAAAGCGSKP

SEQ ID NO: 1555424 - protein, 19 aa, Mycobacterium tuberculosis
LCVQYLAPIVKNRQYNYPP

SEQ ID NO: 1555425 - protein, 18 aa, Mycobacterium tuberculosis
LGGLQFTQSTWAAHGGGE

SEQ ID NO: 1555426 - protein, 29 aa, Mycobacterium tuberculosis
LLGAWLEATMARWPRRRSMRFESSPHGKR

SEQ ID NO: 1555427 - protein, 24 aa, Mycobacterium tuberculosis
LNVEPICAKLFAAAATISGVANTY

SEQ ID NO: 1555428 - protein, 26 aa, Mycobacterium tuberculosis
MDDLHRHLFTVLMDREWKHGVAAAVD

SEQ ID NO: 1555429 - protein, 21 aa, Mycobacterium tuberculosis
NFSNGILWRGNYEGLAGFSFG

SEQ ID NO: 1555430 - protein, 17 aa, Mycobacterium tuberculosis
NLALFTEAERRLTEAND

SEQ ID NO: 1555431 - protein, 56 aa, Mycobacterium tuberculosis; identical to SEQ ID NO: 1515202

SEQ ID NO: 1555432 - protein, 17 aa, Mycobacterium tuberculosis
PFYEESTFWNPSWTITH

SEQ ID NO: 1555433 - protein, 28 aa, Mycobacterium tuberculosis
PGGFDCSGLVMWAFQQAGIALPHSSQAL

SEQ ID NO: 1555434 - protein, 23 aa, Mycobacterium tuberculosis
PLGFQVPGSIDAITLFPGGLTFP

SEQ ID NO: 1555435 - protein, 30 aa, Mycobacterium tuberculosis
PPAPAPRPILPPLAPGQVLRIGPTAGTGTP

SEQ ID NO: 1555436 - protein, 20 aa, Mycobacterium tuberculosis
PQGPGPAAEKFFAALAIGDT

SEQ ID NO: 1555437 - protein, 19 aa, Mycobacterium tuberculosis
PRYPYRPEPPAPPPGGPPP

SEQ ID NO: 1555438 - protein, 21 aa, Mycobacterium tuberculosis
QDARWFLLCTVDGATVTTADG

SEQ ID NO: 1555439 - protein, 25 aa, Mycobacterium tuberculosis
QENAMEQFVYAYVRSCPGYTLDYNA

SEQ ID NO: 1555440 - protein, 17 aa, Mycobacterium tuberculosis
QGVGFGGWYAPVALHVD

SEQ ID NO: 1555441 - protein, 25 aa, Mycobacterium tuberculosis
QRDRAKMFALLWQSLRRQRQLLKRF

SEQ ID NO: 1555442 - protein, 19 aa, Mycobacterium tuberculosis
QVGAPYAWGGAAPGGFDCS

SEQ ID NO: 1555443 - protein, 25 aa, Mycobacterium tuberculosis
RAEESAFVLLALQAPVAGDLRAIVS

SEQ ID NO: 1555444 - protein, 18 aa, Mycobacterium tuberculosis
RMGALALHVAKIARRRHP

SEQ ID NO: 1555445 - protein, 25 aa, Mycobacterium tuberculosis
RPPVEADWLLLVELAADHDQTDRLA

SEQ ID NO: 1555446 - protein, 23 aa, Mycobacterium tuberculosis
RPRQWLEIRYLDSVPDEVWPAVV

SEQ ID NO: 1555447 - protein, 17 aa, Mycobacterium tuberculosis
RSVLATALVLVAGVILA

SEQ ID NO: 1555448 - protein, 18 aa, Mycobacterium tuberculosis
RWPDPNGTRFPNGAPPAA

SEQ ID NO: 1555449 - protein, 22 aa, Mycobacterium tuberculosis
RYLSVVVAITLMLTAESVSIAT

SEQ ID NO: 1555450 - protein, 21 aa, Mycobacterium tuberculosis
SEHLVAWMKAVVYGAAERWTD

SEQ ID NO: 1555451 - protein, 23 aa, Mycobacterium tuberculosis
SGGANSPALYLLDGLRAQDDFSG

SEQ ID NO: 1555452 - protein, 20 aa, Mycobacterium tuberculosis
SSYFALIETQAHHIIRCLKR

SEQ ID NO: 1555453 - protein, 23 aa, Mycobacterium tuberculosis
SYSLDVPRITILDAHFTGAFGPV

SEQ ID NO: 1555454 - protein, 20 aa, Mycobacterium tuberculosis
TAAVLITAPAVHSALRSGAS

SEQ ID NO: 1555455 - protein, 22 aa, Mycobacterium tuberculosis
TLGVITALDLRLHPTPSHRVTA

SEQ ID NO: 1555456 - protein, 18 aa, Mycobacterium tuberculosis
TLPARTPAYRVPLPELPH

SEQ ID NO: 1555457 - protein, 20 aa, Mycobacterium tuberculosis
TPPFDLPTVVIDRIPVELHA

SEQ ID NO: 1555458 - protein, 23 aa, Mycobacterium tuberculosis
TSEIEPFIVWTSSGAIGPTWYSV

SEQ ID NO: 1555459 - protein, 18 aa, Mycobacterium tuberculosis
VARFAAALAPRGSGTLLA

SEQ ID NO: 1555460 - protein, 33 aa, Mycobacterium tuberculosis; identical to SEQ ID NO: 237794

SEQ ID NO: 1555461 - protein, 25 aa, Mycobacterium tuberculosis
VLGVYGPPLKFDVSLPLSAISGFAR

SEQ ID NO: 1555462 - protein, 17 aa, Mycobacterium tuberculosis
YARADPPAPAPRPILPP

SEQ ID NO: 1555463 - protein, 23 aa, Mycobacterium tuberculosis
YFMIVFSGPIPDDKWLQAVQIVK

SEQ ID NO: 1555464 - protein, 17 aa, Mycobacterium tuberculosis
YPAAGLPDLALARGTAV

SEQ ID NO: 1555465 - protein, 20 aa, Mycobacterium tuberculosis
AAGAPTMALLAAGADEVSAA

SEQ ID NO: 1555466 - protein, 17 aa, Mycobacterium tuberculosis
AFHAFPASRWRRYDKLE

SEQ ID NO: 1555467 - protein, 29 aa, Mycobacterium tuberculosis
AGGAGGRGALLLGAGGQGGLGGAGGQGGT

SEQ ID NO: 1555468 - protein, 23 aa, Mycobacterium tuberculosis
AGGNGGWLYGSGGNGGAGGAGPA

SEQ ID NO: 1555469 - protein, 19 aa, Mycobacterium tuberculosis
AGLVIALLAAITPAAGERP

SEQ ID NO: 1555470 - protein, 27 aa, Mycobacterium tuberculosis
AKHTTTPSVLFLLLKTIATSRSHRAST

SEQ ID NO: 1555471 - protein, 18 aa, Mycobacterium tuberculosis
ALDEGLLPVLPQLSARHH

SEQ ID NO: 1555472 - protein, 20 aa, Mycobacterium tuberculosis
ALFHEQFVQALTGAASAYAS

SEQ ID NO: 1555473 - protein, 18 aa, Mycobacterium tuberculosis
ALSLQATAFHQQFVQALT

SEQ ID NO: 1555474 - protein, 26 aa, Mycobacterium tuberculosis
APGQPGAAGGLLFGNGGNGAAGGFGQ

SEQ ID NO: 1555475 - protein, 25 aa, Mycobacterium tuberculosis
AVELELYKRLPGDLSILTPSPASDT

SEQ ID NO: 1555476 - protein, 17 aa, Mycobacterium tuberculosis
DASLLLCNGGRRRFRGQ

SEQ ID NO: 1555477 - protein, 24 aa, Mycobacterium tuberculosis
DDVGFLVALAAKLVHDFDIAPGHV

SEQ ID NO: 1555478 - protein, 17 aa, Mycobacterium tuberculosis
DFSTAVTGGLFFSPTID

SEQ ID NO: 1555479 - protein, 24 aa, Mycobacterium tuberculosis
DGLGSYFWQHNWGSPKGYTHPAAH

SEQ ID NO: 1555480 - protein, 29 aa, Mycobacterium tuberculosis
DHIVDYYNFFLSGGFLAPPGRAPVLVYGP

SEQ ID NO: 1555481 - protein, 17 aa, Mycobacterium tuberculosis
DIRLEPDSILRVLAMHR

SEQ ID NO: 1555482 - protein, 20 aa, Mycobacterium tuberculosis
DISLRNWIATLTLELEPTVR

SEQ ID NO: 1555483 - protein, 25 aa, Mycobacterium tuberculosis
DPAGWPRLDWSMDAALLLAALASRA

SEQ ID NO: 1555484 - protein, 30 aa, Mycobacterium tuberculosis; identical to SEQ ID NO: 164669

SEQ ID NO: 1555485 - protein, 19 aa, Mycobacterium tuberculosis
DRLPNGVFLDWQQFQETYK

SEQ ID NO: 1555486 - protein, 18 aa, Mycobacterium tuberculosis
EFVTAAAGDLTNLGSSIS

SEQ ID NO: 1555487 - protein, 28 aa, Mycobacterium tuberculosis
EGLAGFSFGYPIPLFPAVGADVTGDIGP

SEQ ID NO: 1555488 - protein, 22 aa, Mycobacterium tuberculosis
EGNLHLNVLRCPPDREPALYAK

SEQ ID NO: 1555489 - protein, 26 aa, Mycobacterium tuberculosis
ETVRRDEFSRWLSAKPDYLVTTEQSV

SEQ ID NO: 1555490 - protein, 24 aa, Mycobacterium tuberculosis
FGAKSVEFIPPKTPSPKPLSPNAH

SEQ ID NO: 1555491 - protein, 27 aa, Mycobacterium tuberculosis
FGEPSSGFSSMLWGGGSLPTIGPLYSS

SEQ ID NO: 1555492 - protein, 25 aa, Mycobacterium tuberculosis
FSDNLPSCITKYIPLHTPAVVMSIN

SEQ ID NO: 1555493 - protein, 19 aa, Mycobacterium tuberculosis
FVQALNMGAVCYAAAETAN

SEQ ID NO: 1555494 - protein, 19 aa, Mycobacterium tuberculosis
GAAIWHMAWSDKDDAIDWQ

SEQ ID NO: 1555495 - protein, 21 aa, Mycobacterium tuberculosis
GGAGGLLFGDGGNGGAGGAGG

SEQ ID NO: 1555496 - protein, 21 aa, Mycobacterium tuberculosis
GGAGGLLFGNGGNGGNAGAGG

SEQ ID NO: 1555497 - protein, 25 aa, Mycobacterium tuberculosis
GGAGGNGGWLWGNGGNGGVGGTSVA

SEQ ID NO: 1555498 - protein, 25 aa, Mycobacterium tuberculosis
GGGTATFHEDPVAGVWAVGGVGGDG

SEQ ID NO: 1555499 - protein, 22 aa, Mycobacterium tuberculosis
GGNAGLLFGAGGTGGSGGAGLG

SEQ ID NO: 1555500 - protein, 23 aa, Mycobacterium tuberculosis
GLAGVTAYEILKKAAAKAPLRQT

SEQ ID NO: 1555501 - protein, 20 aa, Mycobacterium tuberculosis
GLVVWFNTLLVSAGGSVLSE

SEQ ID NO: 1555502 - protein, 22 aa, Mycobacterium tuberculosis
GRALSILNDPFRVGGLPATNGP

SEQ ID NO: 1555503 - protein, 26 aa, Mycobacterium tuberculosis
GWQGDYPSMIEFLAPLFTAGAGSNDV

SEQ ID NO: 1555504 - protein, 20 aa, Mycobacterium tuberculosis
HAYDRAATIGTLNVYRRNSP

SEQ ID NO: 1555505 - protein, 17 aa, Mycobacterium tuberculosis
IARFRDAFASDLAAHHR

SEQ ID NO: 1555506 - protein, 17 aa, Mycobacterium tuberculosis
IGQLCDAAIRYSDGTAA

SEQ ID NO: 1555507 - protein, 19 aa, Mycobacterium tuberculosis
ILAPLTPAAIFLVATIGAD

SEQ ID NO: 1555508 - protein, 19 aa, Mycobacterium tuberculosis
IMGEVVDRSIFMWTAAPHA

SEQ ID NO: 1555509 - protein, 17 aa, Mycobacterium tuberculosis
IPQFRTLVILSNHGPIN

SEQ ID NO: 1555510 - protein, 24 aa, Mycobacterium tuberculosis
LGACLALWLSGCSSPKPDAEEQGV

SEQ ID NO: 1555511 - protein, 18 aa, Mycobacterium tuberculosis
LIPYQPFTELQVDAPSTL

SEQ ID NO: 1555512 - protein, 37 aa, Mycobacterium tuberculosis; identical to SEQ ID NO: 237680

SEQ ID NO: 1555513 - protein, 18 aa, Mycobacterium tuberculosis
LLCNGGRRRFRGQVRDAW

SEQ ID NO: 1555514 - protein, 25 aa, Mycobacterium tuberculosis
LMVGSAVLTYLSYTAAFTSTDTVTV

SEQ ID NO: 1555515 - protein, 18 aa, Mycobacterium tuberculosis
LQMTGMYQAIANDGVRVP

SEQ ID NO: 1555516 - protein, 26 aa, Mycobacterium tuberculosis
LSAQALAFHDQFVQALNMGAVCYAAA

SEQ ID NO: 1555517 - protein, 23 aa, Mycobacterium tuberculosis
LVASGVIMFIWSQQRRLIYFPSA

SEQ ID NO: 1555518 - protein, 22 aa, Mycobacterium tuberculosis
LVRVLPPFLSRKHLPSRLAKLR

SEQ ID NO: 1555519 - protein, 19 aa, Mycobacterium tuberculosis
NMVDYLGLLDSRADETVRR

SEQ ID NO: 1555520 - protein, 19 aa, Mycobacterium tuberculosis
NRGFYPAEKFSRQALGLAG

SEQ ID NO: 1555521 - protein, 28 aa, Mycobacterium tuberculosis
NVAMVLRRLLRLCARYSAHPTVIFASAT

SEQ ID NO: 1555522 - protein, 18 aa, Mycobacterium tuberculosis
NWIATLTLELEPTVRLPA

SEQ ID NO: 1555523 - protein, 26 aa, Mycobacterium tuberculosis
PAAAASLAAIAIAFLAGCSSTKPVSQ

SEQ ID NO: 1555524 - protein, 28 aa, Mycobacterium tuberculosis
PGRDDLTDLLWRMGIRTIGQFAALSRTD

SEQ ID NO: 1555525 - protein, 18 aa, Mycobacterium tuberculosis
PLIGVRKAGLFTSSSFVL

SEQ ID NO: 1555526 - protein, 19 aa, Mycobacterium tuberculosis
PQGPGPAAEKFFAALAIGD

SEQ ID NO: 1555527 - protein, 17 aa, Mycobacterium tuberculosis
QLLATAALDLASIGSQV

SEQ ID NO: 1555528 - protein, 21 aa, Mycobacterium tuberculosis
QLLATAALDLASIGSQVSAAN

SEQ ID NO: 1555529 - protein, 29 aa, Mycobacterium tuberculosis
QTIAEQLMPHWMLSLRAADMRRGGTVPEV

SEQ ID NO: 1555530 - protein, 21 aa, Mycobacterium tuberculosis
QYNTYLKQYLALYTNGMNDVV

SEQ ID NO: 1555531 - protein, 30 aa, Mycobacterium tuberculosis; identical to SEQ ID NO: 226785

SEQ ID NO: 1555532 - protein, 17 aa, Mycobacterium tuberculosis
RGIEGFASRFPTVTASC

SEQ ID NO: 1555533 - protein, 20 aa, Mycobacterium tuberculosis
RPDNPLPCAGATVGPFGGPD

SEQ ID NO: 1555534 - protein, 25 aa, Mycobacterium tuberculosis
SAAIAALFGAHARAYQALSAQAAMF

SEQ ID NO: 1555535 - protein, 24 aa, Mycobacterium tuberculosis
SHYDVYPAFGFRFDLKKSGVSVTF

SEQ ID NO: 1555536 - protein, 20 aa, Mycobacterium tuberculosis
SMVSLSRIPNTGFHLGRLHS

SEQ ID NO: 1555537 - protein, 33 aa, Mycobacterium tuberculosis; identical to SEQ ID NO: 237418

SEQ ID NO: 1555538 - protein, 23 aa, Mycobacterium tuberculosis
SRLAIADDLAFGRLLAVDIPALN

SEQ ID NO: 1555539 - protein, 24 aa, Mycobacterium tuberculosis
SSNPLANFAPGYPPTIEPAQPAVS

SEQ ID NO: 1555540 - protein, 19 aa, Mycobacterium tuberculosis
SVVVAITLMLTAESVSIAT

SEQ ID NO: 1555541 - protein, 21 aa, Mycobacterium tuberculosis
TAVVLLIALGAVWTPVAFADG

SEQ ID NO: 1555542 - protein, 25 aa, Mycobacterium tuberculosis
TGANGAPGGWLLGNGGAGGSAAAGS

SEQ ID NO: 1555543 - protein, 17 aa, Mycobacterium tuberculosis
THHMYLPMDVDAGEDQP

SEQ ID NO: 1555544 - protein, 17 aa, Mycobacterium tuberculosis
TIDQALGGVLFIDEAYA

SEQ ID NO: 1555545 - protein, 21 aa, Mycobacterium tuberculosis
TSDGWRIDRLPNGVFLDWQQF

SEQ ID NO: 1555546 - protein, 23 aa, Mycobacterium tuberculosis
TSDYSPVFGCLFKGIARGVKEFA

SEQ ID NO: 1555547 - protein, 18 aa, Mycobacterium tuberculosis
VAGVWAVGGVGGDGGSGG

SEQ ID NO: 1555548 - protein, 22 aa, Mycobacterium tuberculosis
VDEVHGFRFFDNRDLLGFVDGT

SEQ ID NO: 1555549 - protein, 24 aa, Mycobacterium tuberculosis
VDVDAKLYGLPFGDGAYGAQDMSL

SEQ ID NO: 1555550 - protein, 18 aa, Mycobacterium tuberculosis
VKEFAPLIGVRKAGLFTS

SEQ ID NO: 1555551 - protein, 17 aa, Mycobacterium tuberculosis
VLVAIVLFAAASLLFGR

SEQ ID NO: 1555552 - protein, 26 aa, Mycobacterium tuberculosis
VRCSLVVSFLVPQCVWYARADPPAPA

SEQ ID NO: 1555553 - protein, 25 aa, Mycobacterium tuberculosis
WGGGSLPTIGPLYSSKTINLCAPDD

SEQ ID NO: 1555554 - protein, 18 aa, Mycobacterium tuberculosis
YGKPKVLVDGWLDTAVGA

SEQ ID NO: 1555555 - protein, 18 aa, Mycobacterium tuberculosis
YRFSVPDPGTYWAHPHVG

SEQ ID NO: 1555556 - protein, 17 aa, Mycobacterium tuberculosis
YVATLLLKLVDEKKLRL

SEQ ID NO: 1555557 - protein, 23 aa, Mycobacterium tuberculosis
AAADQLVLTRLIIGRTARRHGLR

SEQ ID NO: 1555558 - protein, 53 aa, Mycobacterium tuberculosis
AADEVSAAIAGLFGAHARQYQALSVQVAAFHEQFVQALTAAAGRYASTEAAVE

SEQ ID NO: 1555559 - protein, 25 aa, Mycobacterium tuberculosis
AAEAMYEQMWAADVAAMVGYHGGAS

SEQ ID NO: 1555560 - protein, 20 aa, Mycobacterium tuberculosis
AAFHDQFTLALTSSAGAYAS

SEQ ID NO: 1555561 - protein, 24 aa, Mycobacterium tuberculosis
AAIAALFSAHGRAYQVASAQAAAV

SEQ ID NO: 1555562 - protein, 22 aa, Mycobacterium tuberculosis
AAIGLMVPIGLAPPAMAAPCSG

SEQ ID NO: 1555563 - protein, 26 aa, Mycobacterium tuberculosis
AAMAAAAAPYAGWLAAAAARAAGASA

SEQ ID NO: 1555564 - protein, 21 aa, Mycobacterium tuberculosis
AGGAGGFGFLGGDGGAGGNAG

SEQ ID NO: 1555565 - protein, 24 aa, Mycobacterium tuberculosis
AGGAGGVGGLLFGDGGNGGAGGLG

SEQ ID NO: 1555566 - protein, 19 aa, Mycobacterium tuberculosis
AGPADIHLVAAKQSYGFAV

SEQ ID NO: 1555567 - protein, 23 aa, Mycobacterium tuberculosis
ALAAAAPVWPAPISGCRGFSTSL

SEQ ID NO: 1555568 - protein, 18 aa, Mycobacterium tuberculosis
AQAAAVHAQFVEALSAGA

SEQ ID NO: 1555569 - protein, 43 aa, Mycobacterium tuberculosis; identical to SEQ ID NO: 237530

SEQ ID NO: 1555570 - protein, 23 aa, Mycobacterium tuberculosis
ASGPYFKVLLANLVPGQILQPFV

SEQ ID NO: 1555571 - protein, 41 aa, Mycobacterium tuberculosis
ASTEAAVERSLLGAVNAPTEALLGRPLIGNGADGTAPGQPG

SEQ ID NO: 1555572 - protein, 20 aa, Mycobacterium tuberculosis
AVGVLAAGALVLSACGNDDN

SEQ ID NO: 1555573 - protein, 19 aa, Mycobacterium tuberculosis
AVVCDFADACVPVVKVLAP

SEQ ID NO: 1555574 - protein, 21 aa, Mycobacterium tuberculosis
AVVLLIALGAVWTPVAFADGC

SEQ ID NO: 1555575 - protein, 19 aa, Mycobacterium tuberculosis
AYQPKFTHHMYLPMDVDAG

SEQ ID NO: 1555576 - protein, 18 aa, Mycobacterium tuberculosis
CRRIAVLAAVSIAATVVA

SEQ ID NO: 1555577 - protein, 26 aa, Mycobacterium tuberculosis
CSVVAAATAILAVVLAIGGCSTEGDA

SEQ ID NO: 1555578 - protein, 27 aa, Mycobacterium tuberculosis
DEAGFGVLLPSWWDRRRKLGLVLSAYT

SEQ ID NO: 1555579 - protein, 18 aa, Mycobacterium tuberculosis
DGYRLSVDYAVRITSRGL

SEQ ID NO: 1555580 - protein, 17 aa, Mycobacterium tuberculosis
DHTEWAQWGSLPSLRVY

SEQ ID NO: 1555581 - protein, 34 aa, Mycobacterium tuberculosis; identical to SEQ ID NO: 1390422

SEQ ID NO: 1555582 - protein, 31 aa, Mycobacterium tuberculosis; identical to SEQ ID NO: 237871

SEQ ID NO: 1555583 - protein, 18 aa, Mycobacterium tuberculosis
EWAQWGSLPSLRVYPSQV

SEQ ID NO: 1555584 - protein, 18 aa, Mycobacterium tuberculosis
GAGGLLYGSGGNGGSGLA

SEQ ID NO: 1555585 - protein, 29 aa, Mycobacterium tuberculosis
GAGGPAGLALPPGPARPAGAAVPAVRCSA

SEQ ID NO: 1555586 - protein, 22 aa, Mycobacterium tuberculosis
GDRLLTELGWALRRAPLPPTGP

SEQ ID NO: 1555587 - protein, 26 aa, Mycobacterium tuberculosis
GDVNTGFWNGGPFNTGFGNGGNTNFG

SEQ ID NO: 1555588 - protein, 17 aa, Mycobacterium tuberculosis
GFGGWYAPVALHVDTES

SEQ ID NO: 1555589 - protein, 21 aa, Mycobacterium tuberculosis
GGFTTFLDAAGGAGGAGGAGG

SEQ ID NO: 1555590 - protein, 26 aa, Mycobacterium tuberculosis
GITIPEFPIHWTSTGGIGPIIIPDTT

SEQ ID NO: 1555591 - protein, 20 aa, Mycobacterium tuberculosis
GLGNIGSWNLGGGNVGLLNL

SEQ ID NO: 1555592 - protein, 21 aa, Mycobacterium tuberculosis
GMTGMPMVPPGALGAGAEGAN

SEQ ID NO: 1555593 - protein, 26 aa, Mycobacterium tuberculosis
GNFSNGILWRGNFEGLFGLNVGITIP

SEQ ID NO: 1555594 - protein, 19 aa, Mycobacterium tuberculosis
GPHWRLLSAVKELDPSWAR

SEQ ID NO: 1555595 - protein, 27 aa, Mycobacterium tuberculosis
GQYGAPPIAIGPLYQPKTLQLCADGDS

SEQ ID NO: 1555596 - protein, 19 aa, Mycobacterium tuberculosis
GRGAAWLIVDVRDVAALHA

SEQ ID NO: 1555597 - protein, 21 aa, Mycobacterium tuberculosis
GSLYHAGVKLDWMVATTLLTG

SEQ ID NO: 1555598 - protein, 20 aa, Mycobacterium tuberculosis
GVGPTLLLCPMSLVGNWQQE

SEQ ID NO: 1555599 - protein, 25 aa, Mycobacterium tuberculosis
GWALRRAPLPPTGPHWRLLSAVKEL

SEQ ID NO: 1555600 - protein, 18 aa, Mycobacterium tuberculosis
HRFGRVHTYAKARKTSLR

SEQ ID NO: 1555601 - protein, 18 aa, Mycobacterium tuberculosis
IDAPAGELVFGPNPLPAP

SEQ ID NO: 1555602 - protein, 24 aa, Mycobacterium tuberculosis
IQALNRDFTLPGERIHVVFRSDES

SEQ ID NO: 1555603 - protein, 17 aa, Mycobacterium tuberculosis
IRSFADLTRPGLNVVVC

SEQ ID NO: 1555604 - protein, 29 aa, Mycobacterium tuberculosis
ITSRGLYVHSAPWALPALGLENVSHGCIS

SEQ ID NO: 1555605 - protein, 21 aa, Mycobacterium tuberculosis
KFEWLDNDVVQWVPDRFWPAH

SEQ ID NO: 1555606 - protein, 34 aa, Mycobacterium tuberculosis; identical to SEQ ID NO: 237662

SEQ ID NO: 1555607 - protein, 21 aa, Mycobacterium tuberculosis
LAQYPSILVELGNMKNPADSA

SEQ ID NO: 1555608 - protein, 25 aa, Mycobacterium tuberculosis
LEVNTLFQSLIDLLHKIDPLETNAT

SEQ ID NO: 1555609 - protein, 35 aa, Mycobacterium tuberculosis; identical to SEQ ID NO: 225280

SEQ ID NO: 1555610 - protein, 23 aa, Mycobacterium tuberculosis
LGDNGYIPIPDEFKSRLSTAVNA

SEQ ID NO: 1555611 - protein, 19 aa, Mycobacterium tuberculosis
LGEDYLRLSALGSYGAFFN

SEQ ID NO: 1555612 - protein, 27 aa, Mycobacterium tuberculosis
LGSYGAFFNIYFCSVTIKINGPAGSDI

SEQ ID NO: 1555613 - protein, 19 aa, Mycobacterium tuberculosis
LIVEPRLAKSVAAADRNSG

SEQ ID NO: 1555614 - protein, 19 aa, Mycobacterium tuberculosis
LPSAIYHRFGRVHTYAKAR

SEQ ID NO: 1555615 - protein, 28 aa, Mycobacterium tuberculosis
LRPYQQRGLAWLAFLSSLGLGSCLADDM

SEQ ID NO: 1555616 - protein, 26 aa, Mycobacterium tuberculosis
LSAQAALFHEQFVHAMTAGAGAYAGA

SEQ ID NO: 1555617 - protein, 22 aa, Mycobacterium tuberculosis
LSEQLLHAFAGQGPTIGSLLAQ

SEQ ID NO: 1555618 - protein, 25 aa, Mycobacterium tuberculosis
LSVQASAFHQQFVQALTAGAYSYAS

SEQ ID NO: 1555619 - protein, 22 aa, Mycobacterium tuberculosis
LVVVFGDFRFGPTTVYHATFTD

SEQ ID NO: 1555620 - protein, 23 aa, Mycobacterium tuberculosis
MGSWLPLHHDMGLVGSLFAALFN

SEQ ID NO: 1555621 - protein, 22 aa, Mycobacterium tuberculosis
MLVSSWQMPGGIYAPMMHPWST

SEQ ID NO: 1555622 - protein, 19 aa, Mycobacterium tuberculosis
NKLRTMPGALSAALAAAAP

SEQ ID NO: 1555623 - protein, 21 aa, Mycobacterium tuberculosis
PALDLDALLGGLRPVLKGFDA

SEQ ID NO: 1555624 - protein, 30 aa, Mycobacterium tuberculosis
PDAQGILCGSIVFGLRMRPGNWAGIYACWG

SEQ ID NO: 1555625 - protein, 40 aa, Mycobacterium tuberculosis; identical to SEQ ID NO: 1393006

SEQ ID NO: 1555626 - protein, 25 aa, Mycobacterium tuberculosis
PGDPLHLPGFPVQFFVYKQIAANNA

SEQ ID NO: 1555627 - protein, 27 aa, Mycobacterium tuberculosis
PGGAGGAGGLLFGNGGAGAAGAPGQAG

SEQ ID NO: 1555628 - protein, 25 aa, Mycobacterium tuberculosis
PMLAASVAWDGLAAELAVAASSFGS

SEQ ID NO: 1555629 - protein, 21 aa, Mycobacterium tuberculosis
PRGSAYHYFPGGRTQLLCEAV

SEQ ID NO: 1555630 - protein, 17 aa, Mycobacterium tuberculosis
PTLLQRKVLSPLGLTAT

SEQ ID NO: 1555631 - protein, 17 aa, Mycobacterium tuberculosis
PVLASAASDLGGIASMI

SEQ ID NO: 1555632 - protein, 22 aa, Mycobacterium tuberculosis
PVQRWRREVPFDVHLMIFGDST

SEQ ID NO: 1555633 - protein, 19 aa, Mycobacterium tuberculosis
QFTEFAELLVPHLAARFGR

SEQ ID NO: 1555634 - protein, 19 aa, Mycobacterium tuberculosis
QQRLWRTRESLAEVLGVYG

SEQ ID NO: 1555635 - protein, 30 aa, Mycobacterium tuberculosis; identical to SEQ ID NO: 1528335

SEQ ID NO: 1555636 - protein, 27 aa, Mycobacterium tuberculosis
QSGDGPPIFLLSLKAGGTGLNLTAANH

SEQ ID NO: 1555637 - protein, 19 aa, Mycobacterium tuberculosis
RDEMVARFQSGDGPPIFLL

SEQ ID NO: 1555638 - protein, 25 aa, Mycobacterium tuberculosis
RDGAEWIHLVDLDAAFGRGSNHELL

SEQ ID NO: 1555639 - protein, 20 aa, Mycobacterium tuberculosis
REHLGVRPPVEADWLLLVEL

SEQ ID NO: 1555640 - protein, 28 aa, Mycobacterium tuberculosis
RHHFSQYFVDYFITPLVAAVWSCGGADA

SEQ ID NO: 1555641 - protein, 18 aa, Mycobacterium tuberculosis
RIFPELVPALRTACPSGL

SEQ ID NO: 1555642 - protein, 24 aa, Mycobacterium tuberculosis
RLAELWSIMDFLNPGLLGSSERFR

SEQ ID NO: 1555643 - protein, 25 aa, Mycobacterium tuberculosis
RLRASTRPYILRRLKTDPAIIDDLP

SEQ ID NO: 1555644 - protein, 22 aa, Mycobacterium tuberculosis
RNRGREMLAFATAYRDAGVKPP

SEQ ID NO: 1555645 - protein, 30 aa, Mycobacterium tuberculosis; identical to SEQ ID NO: 1389247

SEQ ID NO: 1555646 - protein, 27 aa, Mycobacterium tuberculosis
RYPARYLFVFLDHHGMLSVFGSPTWRT

SEQ ID NO: 1555647 - protein, 18 aa, Mycobacterium tuberculosis
SDWDTYRSLAPLQGLLFP

SEQ ID NO: 1555648 - protein, 25 aa, Mycobacterium tuberculosis
SGATGAPGGWLLGDGGAGGSGAAGS

SEQ ID NO: 1555649 - protein, 23 aa, Mycobacterium tuberculosis
SGDGQWRLRQQRHFGCGGQPEFR

SEQ ID NO: 1555650 - protein, 24 aa, Mycobacterium tuberculosis
SNEGFFNTGMFNNGIYNSGVASTG

SEQ ID NO: 1555651 - protein, 18 aa, Mycobacterium tuberculosis
SVDYAVRITSRGLYVHSA

SEQ ID NO: 1555652 - protein, 21 aa, Mycobacterium tuberculosis
TDGEGWLTELSTRDLREVFAL

SEQ ID NO: 1555653 - protein, 20 aa, Mycobacterium tuberculosis
TGAGYWVAHGALGGITISQA

SEQ ID NO: 1555654 - protein, 23 aa, Mycobacterium tuberculosis
TGQPGTPPLPMPYPRTGQGGEPR

SEQ ID NO: 1555655 - protein, 26 aa, Mycobacterium tuberculosis
TPAGSLWRLEFLLQSTQDPSLLVPAE

SEQ ID NO: 1555656 - protein, 24 aa, Mycobacterium tuberculosis
TPTGYLGPPPVPTSSPPTTPAGAP

SEQ ID NO: 1555657 - protein, 17 aa, Mycobacterium tuberculosis
TQPALDLDALLGGLRPV

SEQ ID NO: 1555658 - protein, 17 aa, Mycobacterium tuberculosis
VALLEWLQTTHPEPKVA

SEQ ID NO: 1555659 - protein, 17 aa, Mycobacterium tuberculosis
VCLAGCGGDQLLARHAS

SEQ ID NO: 1555660 - protein, 21 aa, Mycobacterium tuberculosis
VDAALGWQRDGAEWIHLVDLD

SEQ ID NO: 1555661 - protein, 32 aa, Mycobacterium tuberculosis
VEQQLLNAINAPTLALLGRPLIGNGADGAAGT

SEQ ID NO: 1555662 - protein, 21 aa, Mycobacterium tuberculosis
VGKALYARRFTLPQALAAVRD

SEQ ID NO: 1555663 - protein, 26 aa, Mycobacterium tuberculosis
VLDTDSFYRPKRPGSYPIVLATYEIV

SEQ ID NO: 1555664 - protein, 22 aa, Mycobacterium tuberculosis
VRADGWLGDLLAGAAAASLQPL

SEQ ID NO: 1555665 - protein, 19 aa, Mycobacterium tuberculosis
VRVPYRARVPMTRAALMHR

SEQ ID NO: 1555666 - protein, 24 aa, Mycobacterium tuberculosis
VVDEVHGFRFFDNRDLLGFVDGTE

SEQ ID NO: 1555667 - protein, 23 aa, Mycobacterium tuberculosis
YHGWGFHEDGAASGLRAARRLGA

SEQ ID NO: 1555668 - protein, 24 aa, Mycobacterium tuberculosis
YNHGAYVFLGPGFTPGSPSGGSGG

SEQ ID NO: 1555669 - protein, 26 aa, Mycobacterium tuberculosis
AAAAALAALIDEPMFAKSVAAAATNS

SEQ ID NO: 1555670 - protein, 33 aa, Mycobacterium tuberculosis; identical to SEQ ID NO: 225833

SEQ ID NO: 1555671 - protein, 33 aa, Mycobacterium tuberculosis; identical to SEQ ID NO: 228289

SEQ ID NO: 1555672 - protein, 26 aa, Mycobacterium tuberculosis
AAINAPTQTLLGRPLIGNGADGLPGQ

SEQ ID NO: 1555673 - protein, 19 aa, Mycobacterium tuberculosis
AALIDDPMFAKSVAAAAIT

SEQ ID NO: 1555674 - protein, 44 aa, Mycobacterium tuberculosis; identical to SEQ ID NO: 236073

SEQ ID NO: 1555675 - protein, 20 aa, Mycobacterium tuberculosis
AARIPVVPYAPYGPGSARAG

SEQ ID NO: 1555676 - protein, 26 aa, Mycobacterium tuberculosis
AATVHPMLVAANRNAFVQLVLSNLFG

SEQ ID NO: 1555677 - protein, 19 aa, Mycobacterium tuberculosis
AAVHAQFVEALSAGAGAYA

SEQ ID NO: 1555678 - protein, 23 aa, Mycobacterium tuberculosis
ADRYRRLHVIIGDANLAETSTYL

SEQ ID NO: 1555679 - protein, 20 aa, Mycobacterium tuberculosis
AGAAGLPGAAGLNGGDGSDG

SEQ ID NO: 1555680 - protein, 30 aa, Mycobacterium tuberculosis
AGDEVSAAIAALFGTHAQEYQALSARVATF

SEQ ID NO: 1555681 - protein, 20 aa, Mycobacterium tuberculosis
AGGAALLFGSGGAGGSGGAG

SEQ ID NO: 1555682 - protein, 24 aa, Mycobacterium tuberculosis
AGGNAGWLGFGGAGGVGGSAGLIG

SEQ ID NO: 1555683 - protein, 17 aa, Mycobacterium tuberculosis
AGRLDEFAHWAKSLTQR

SEQ ID NO: 1555684 - protein, 23 aa, Mycobacterium tuberculosis
AGRMLAIMHALDGALATVSPGAT

SEQ ID NO: 1555685 - protein, 18 aa, Mycobacterium tuberculosis
AIARQMAAFHDQFTLALT

SEQ ID NO: 1555686 - protein, 17 aa, Mycobacterium tuberculosis
AIEQLPIPYTAVATDLL

SEQ ID NO: 1555687 - protein, 28 aa, Mycobacterium tuberculosis
ALDVLNGPFQALFGRPLIGDGANGAPGQ

SEQ ID NO: 1555688 - protein, 32 aa, Mycobacterium tuberculosis
APARPARTADPWLAPIFARSTLRHSHHLGGIA

SEQ ID NO: 1555689 - protein, 36 aa, Mycobacterium tuberculosis; identical to SEQ ID NO: 236174

SEQ ID NO: 1555690 - protein, 26 aa, Mycobacterium tuberculosis
ARVFHRAFPCLGSLAYKAYSLSFETF

SEQ ID NO: 1555691 - protein, 26 aa, Mycobacterium tuberculosis
ASAQAAAFYAQFVQALSAGGGAYAAA

SEQ ID NO: 1555692 - protein, 23 aa, Mycobacterium tuberculosis
ATDHPDLFWALRGGGGGNFGVTT

SEQ ID NO: 1555693 - protein, 19 aa, Mycobacterium tuberculosis
AVAALFGMHGQAYQALSVQ

SEQ ID NO: 1555694 - protein, 21 aa, Mycobacterium tuberculosis
AVCLLTAFLLIAVFGEVRFGD

SEQ ID NO: 1555695 - protein, 34 aa, Mycobacterium tuberculosis; identical to SEQ ID NO: 236219

SEQ ID NO: 1555696 - protein, 26 aa, Mycobacterium tuberculosis
CGELGLPYLVLARPPWDPGTASRYRT

SEQ ID NO: 1555697 - protein, 20 aa, Mycobacterium tuberculosis
CGGEYEWTRAKAAYFMIVFS

SEQ ID NO: 1555698 - protein, 23 aa, Mycobacterium tuberculosis
DASPSLRLARLRPALDAQEIHGA

SEQ ID NO: 1555699 - protein, 24 aa, Mycobacterium tuberculosis
DEMRGMCLYFDELPVIVLNGSDHP

SEQ ID NO: 1555700 - protein, 19 aa, Mycobacterium tuberculosis
DFRDPAPFAVLRRVDRWFW

SEQ ID NO: 1555701 - protein, 21 aa, Mycobacterium tuberculosis
DGGGGLPPVPASPGGNGGGGD

SEQ ID NO: 1555702 - protein, 24 aa, Mycobacterium tuberculosis
DGPLTAQFYNQFDPKTAVLNWKGD

SEQ ID NO: 1555703 - protein, 30 aa, Mycobacterium tuberculosis; identical to SEQ ID NO: 217113

SEQ ID NO: 1555704 - protein, 21 aa, Mycobacterium tuberculosis
DRIDERLVVVGLDNTVTYKNG

SEQ ID NO: 1555705 - protein, 17 aa, Mycobacterium tuberculosis
DRIINLLSRARDSLQSH

SEQ ID NO: 1555706 - protein, 23 aa, Mycobacterium tuberculosis
DSSGFLSFPSTPAPAIWVVGVII

SEQ ID NO: 1555707 - protein, 21 aa, Mycobacterium tuberculosis
DTAVAAFPAGASNGLSAVGAG

SEQ ID NO: 1555708 - protein, 27 aa, Mycobacterium tuberculosis
DVGGPPLVFQLLWYPTTMADLSLPSFT

SEQ ID NO: 1555709 - protein, 46 aa, Mycobacterium tuberculosis
EAANASPLQALEQQVLGAINAPTQLWLGRPLIGDGVHGAPGTGQPG

SEQ ID NO: 1555710 - protein, 17 aa, Mycobacterium tuberculosis
EFLTAAAMDLASIGSTV

SEQ ID NO: 1555711 - protein, 25 aa, Mycobacterium tuberculosis
EMLAAAATDLAGIRSAISAATAAAA

SEQ ID NO: 1555712 - protein, 30 aa, Mycobacterium tuberculosis; identical to SEQ ID NO: 226132

SEQ ID NO: 1555713 - protein, 22 aa, Mycobacterium tuberculosis
EPGIYFPGRWGARIEDIVIVTE

SEQ ID NO: 1555714 - protein, 23 aa, Mycobacterium tuberculosis
ERTLASVALILTGGGIVNLDVIQ

SEQ ID NO: 1555715 - protein, 21 aa, Mycobacterium tuberculosis
ESRSMELFKTALRLARHRELV

SEQ ID NO: 1555716 - protein, 18 aa, Mycobacterium tuberculosis
EVSLAISALFGQHAQAYQ

SEQ ID NO: 1555717 - protein, 18 aa, Mycobacterium tuberculosis
EVYARRLALAAAATADAG

SEQ ID NO: 1555718 - protein, 23 aa, Mycobacterium tuberculosis
FAIGLAMMLAPMVAAPGLAAADP

SEQ ID NO: 1555719 - protein, 25 aa, Mycobacterium tuberculosis
FASGPYFKVLLANLVPGQILQPFVD

SEQ ID NO: 1555720 - protein, 28 aa, Mycobacterium tuberculosis
FSDDFIEWSVSFSQKPFPPPCDIAKELT

SEQ ID NO: 1555721 - protein, 17 aa, Mycobacterium tuberculosis
FVELSGSGARYGRQGIE

SEQ ID NO: 1555722 - protein, 17 aa, Mycobacterium tuberculosis
GAAWLIVDVRDVAALHA

SEQ ID NO: 1555723 - protein, 22 aa, Mycobacterium tuberculosis
GAGGAAGLWGGGGAGGVGGTGG

SEQ ID NO: 1555724 - protein, 23 aa, Mycobacterium tuberculosis
GAGGAGGWLLGDGGAGGIGGAST

SEQ ID NO: 1555725 - protein, 24 aa, Mycobacterium tuberculosis
GAGGAGVFSLFGSGGGPGGNGGVG

SEQ ID NO: 1555726 - protein, 18 aa, Mycobacterium tuberculosis
GAGGLLWGNGGNGGAGDA

SEQ ID NO: 1555727 - protein, 24 aa, Mycobacterium tuberculosis
GAGGRAGLFGVGGLGGAGGDAGDS

SEQ ID NO: 1555728 - protein, 23 aa, Mycobacterium tuberculosis
GASGAGGWLLGTGGAGGAGGNGG

SEQ ID NO: 1555729 - protein, 23 aa, Mycobacterium tuberculosis
GGAGGTGGWLYGGGGAAGSGGDG

SEQ ID NO: 1555730 - protein, 21 aa, Mycobacterium tuberculosis
GGAGLIAGLDGAGGAGGTRGL

SEQ ID NO: 1555731 - protein, 22 aa, Mycobacterium tuberculosis
GGAGMINGGLGGFGGAGGGGAV

SEQ ID NO: 1555732 - protein, 25 aa, Mycobacterium tuberculosis
GGAPGHGYFQQPAPQGLPIGTGGTG

SEQ ID NO: 1555733 - protein, 22 aa, Mycobacterium tuberculosis
GGDAGLLSLGASGGAGGSGGSS

SEQ ID NO: 1555734 - protein, 17 aa, Mycobacterium tuberculosis
GGGLLYGNGGAGGAGNS

SEQ ID NO: 1555735 - protein, 20 aa, Mycobacterium tuberculosis
GLAEYFVHRTGHGIGLCVHE

SEQ ID NO: 1555736 - protein, 19 aa, Mycobacterium tuberculosis
GLSGAFHIGGKGGVGGSAV

SEQ ID NO: 1555737 - protein, 24 aa, Mycobacterium tuberculosis
GRSDTRLYYTPEDPTYDPTVAQVW

SEQ ID NO: 1555738 - protein, 24 aa, Mycobacterium tuberculosis
GVINAPTQTLVGRPLIGDGTHGAP

SEQ ID NO: 1555739 - protein, 31 aa, Mycobacterium tuberculosis; identical to SEQ ID NO: 1513386

SEQ ID NO: 1555740 - protein, 17 aa, Mycobacterium tuberculosis
IAWLPATAQLAVLAAKK

SEQ ID NO: 1555741 - protein, 18 aa, Mycobacterium tuberculosis
IFHDQFVQALTSGGNLYA

SEQ ID NO: 1555742 - protein, 31 aa, Mycobacterium tuberculosis
IGLSIGSFKFNDPFISIANFGNPNPPAIGFF

SEQ ID NO: 1555743 - protein, 26 aa, Mycobacterium tuberculosis
INMVNDPFQTLTGRPLIGNGANGTPG

SEQ ID NO: 1555744 - protein, 20 aa, Mycobacterium tuberculosis
IPVRVYWPPVVRDNLPVVVY

SEQ ID NO: 1555745 - protein, 25 aa, Mycobacterium tuberculosis
KCPAAPFEAAFLIAAQLGDRYATGT

SEQ ID NO: 1555746 - protein, 23 aa, Mycobacterium tuberculosis
KDGIPEVWPFAPAKHRAMLANLH

SEQ ID NO: 1555747 - protein, 26 aa, Mycobacterium tuberculosis
LAAAPLVTLYKQYVVRFGLGYREEVH

SEQ ID NO: 1555748 - protein, 19 aa, Mycobacterium tuberculosis
LAAHWLSHGRWTDGWDPHR

SEQ ID NO: 1555749 - protein, 29 aa, Mycobacterium tuberculosis
LAAINAPTQTLLGRPLIGNGADGLPGQNG

SEQ ID NO: 1555750 - protein, 30 aa, Mycobacterium tuberculosis; identical to SEQ ID NO: 236573

SEQ ID NO: 1555751 - protein, 17 aa, Mycobacterium tuberculosis
LAALKQSAAAELGLRVC

SEQ ID NO: 1555752 - protein, 18 aa, Mycobacterium tuberculosis
LATVRPLASYIAARNWAV

SEQ ID NO: 1555753 - protein, 19 aa, Mycobacterium tuberculosis
LCERAELAAHWLSHGRWTD

SEQ ID NO: 1555754 - protein, 19 aa, Mycobacterium tuberculosis
LDFSTAVTGGLFFSPTIDF

SEQ ID NO: 1555755 - protein, 17 aa, Mycobacterium tuberculosis
LLALLALLALIVGLGAS

SEQ ID NO: 1555756 - protein, 17 aa, Mycobacterium tuberculosis
LLASWVGAVPQVGLAAS

SEQ ID NO: 1555757 - protein, 26 aa, Mycobacterium tuberculosis
LPGQNGGAGGLLWGNGGNGGAGDAAH

SEQ ID NO: 1555758 - protein, 19 aa, Mycobacterium tuberculosis
LSESGWIPVDPRTLSTSAD

SEQ ID NO: 1555759 - protein, 19 aa, Mycobacterium tuberculosis
LVACVPGLLMLATLGLGRL

SEQ ID NO: 1555760 - protein, 28 aa, Mycobacterium tuberculosis
MFQRTAQWVLPWPNPRYSKLARVFHRAF

SEQ ID NO: 1555761 - protein, 28 aa, Mycobacterium tuberculosis
MLDAVELELYKRLPGDLSILTPSPASDT

SEQ ID NO: 1555762 - protein, 25 aa, Mycobacterium tuberculosis
NAINAPTQTLFGRPLIGDGANGTAE

SEQ ID NO: 1555763 - protein, 23 aa, Mycobacterium tuberculosis
NDPFTFFPGGLTFPKASAGVINL

SEQ ID NO: 1555764 - protein, 17 aa, Mycobacterium tuberculosis
NGVAGTGLALNGGNGGN

SEQ ID NO: 1555765 - protein, 17 aa, Mycobacterium tuberculosis
NLLSRARDSLQSHGSIA

SEQ ID NO: 1555766 - protein, 26 aa, Mycobacterium tuberculosis
NRNAFVQLVLSNLFGQNAPAIAAAEA

SEQ ID NO: 1555767 - protein, 17 aa, Mycobacterium tuberculosis
NWRVTWNPSGMYFWLDY

SEQ ID NO: 1555768 - protein, 24 aa, Mycobacterium tuberculosis
NYSAVSLRLHPDIRLFTAIPEQRS

SEQ ID NO: 1555769 - protein, 24 aa, Mycobacterium tuberculosis
PASASPLHTLKQQALAAINAPTQT

SEQ ID NO: 1555770 - protein, 25 aa, Mycobacterium tuberculosis
PATLSVPFSAFPKPQNYPGLPTVSF

SEQ ID NO: 1555771 - protein, 22 aa, Mycobacterium tuberculosis
PAVTSFIAPLVAMVGGGQLARM

SEQ ID NO: 1555772 - protein, 27 aa, Mycobacterium tuberculosis
PEDFWRSAGLPAYRWPDPNGTRFPNGA

SEQ ID NO: 1555773 - protein, 30 aa, Mycobacterium tuberculosis; identical to SEQ ID NO: 237714

SEQ ID NO: 1555774 - protein, 18 aa, Mycobacterium tuberculosis
PGQPWPGRLPDPSPAVLF

SEQ ID NO: 1555775 - protein, 25 aa, Mycobacterium tuberculosis
PISIPNIAIPSIHLGIDPTFDVGPI

SEQ ID NO: 1555776 - protein, 17 aa, Mycobacterium tuberculosis
PLFGSKAIDLCNPTDPI

SEQ ID NO: 1555777 - protein, 25 aa, Mycobacterium tuberculosis
PPQSFAQVLVGWQNWLRTADRGSWA

SEQ ID NO: 1555778 - protein, 25 aa, Mycobacterium tuberculosis
PPTDTRAYFRGECLRRFGADIAAAS

SEQ ID NO: 1555779 - protein, 17 aa, Mycobacterium tuberculosis
PSFTLPQPATGATVSLD

SEQ ID NO: 1555780 - protein, 17 aa, Mycobacterium tuberculosis
QLLFFDRNIPLGSPTRN

SEQ ID NO: 1555781 - protein, 24 aa, Mycobacterium tuberculosis
QLVNTTEPVVFISLNGGQMVPVLL

SEQ ID NO: 1555782 - protein, 21 aa, Mycobacterium tuberculosis
QNGGAGGILWGNGGNGGSGAP

SEQ ID NO: 1555783 - protein, 26 aa, Mycobacterium tuberculosis
QQNPALHQVVIGNELPLPPVRSAVAD

SEQ ID NO: 1555784 - protein, 29 aa, Mycobacterium tuberculosis
QTVAIPGFPNFFMMLGPHSPVGNFPLTAV

SEQ ID NO: 1555785 - protein, 29 aa, Mycobacterium tuberculosis
RATHSRLATFALALAAAALPLAGCSSTAN

SEQ ID NO: 1555786 - protein, 20 aa, Mycobacterium tuberculosis
RFHQQFVQALTASVGSYAAA

SEQ ID NO: 1555787 - protein, 24 aa, Mycobacterium tuberculosis
RFNIKVIAGAGLFAAAIALSPDAA

SEQ ID NO: 1555788 - protein, 17 aa, Mycobacterium tuberculosis
RIRKALIEVSPLPIPVA

SEQ ID NO: 1555789 - protein, 18 aa, Mycobacterium tuberculosis
RKALIEVSPLPIPVASVD

SEQ ID NO: 1555790 - protein, 18 aa, Mycobacterium tuberculosis
RLELAALKQSAAAELGLR

SEQ ID NO: 1555791 - protein, 25 aa, Mycobacterium tuberculosis
RLLADGGILDPLPMAPIAGVNADLT

SEQ ID NO: 1555792 - protein, 28 aa, Mycobacterium tuberculosis
RNHPRHHRRPRPPVLSLASTGASAGAGT

SEQ ID NO: 1555793 - protein, 17 aa, Mycobacterium tuberculosis
RRHGLRVSLSPAPFAGS

SEQ ID NO: 1555794 - protein, 17 aa, Mycobacterium tuberculosis
RRIAVLAAVSIAATVVA

SEQ ID NO: 1555795 - protein, 20 aa, Mycobacterium tuberculosis
RVRDPRLRRALTPDYEPMCK

SEQ ID NO: 1555796 - protein, 19 aa, Mycobacterium tuberculosis
RVTWNPSGMYFWLDYADGI

SEQ ID NO: 1555797 - protein, 26 aa, Mycobacterium tuberculosis
SAAIAALFGAHARAYQALSAQAAMFH

SEQ ID NO: 1555798 - protein, 20 aa, Mycobacterium tuberculosis
SAAIAALFSSYARDYQTLSV

SEQ ID NO: 1555799 - protein, 23 aa, Mycobacterium tuberculosis
SAQMSAFHAQFMQALTGAGGAYA

SEQ ID NO: 1555800 - protein, 24 aa, Mycobacterium tuberculosis
SDGQTLLYSYTTTATNTPFVTSGG

SEQ ID NO: 1555801 - protein, 25 aa, Mycobacterium tuberculosis
SDHPRPRLFSLLHEFVHVVLHTEGL

SEQ ID NO: 1555802 - protein, 24 aa, Mycobacterium tuberculosis
SGEGGFGGPGLAGGLFGNPGNGGV

SEQ ID NO: 1555803 - protein, 19 aa, Mycobacterium tuberculosis
SIDAITLFPGGLTFPANSL

SEQ ID NO: 1555804 - protein, 20 aa, Mycobacterium tuberculosis
SKIRCALVPLIPKEDTAARR

SEQ ID NO: 1555805 - protein, 25 aa, Mycobacterium tuberculosis
SLRDLLKFEFLFSGRAQFEKDLANE

SEQ ID NO: 1555806 - protein, 22 aa, Mycobacterium tuberculosis
SMLAMSAPYVEWLERTAAQTKQ

SEQ ID NO: 1555807 - protein, 23 aa, Mycobacterium tuberculosis
SPGTLGNFLSRSGAVGVLGIGPN

SEQ ID NO: 1555808 - protein, 39 aa, Mycobacterium tuberculosis; identical to SEQ ID NO: 236930

SEQ ID NO: 1555809 - protein, 23 aa, Mycobacterium tuberculosis
STAIAALFGAQGQAYQAASAQAA

SEQ ID NO: 1555810 - protein, 26 aa, Mycobacterium tuberculosis
SVIARLTGMHWWGPASTSMLAMSAPY

SEQ ID NO: 1555811 - protein, 22 aa, Mycobacterium tuberculosis
TAIHILVDRAVAELALLAAAET

SEQ ID NO: 1555812 - protein, 19 aa, Mycobacterium tuberculosis
TFHEQFVRSLTAAGSAYAT

SEQ ID NO: 1555813 - protein, 27 aa, Mycobacterium tuberculosis
TGGAGGPGGLIWGGGGAGGVGGAGGGT

SEQ ID NO: 1555814 - protein, 32 aa, Mycobacterium tuberculosis; identical to SEQ ID NO: 236054

SEQ ID NO: 1555815 - protein, 22 aa, Mycobacterium tuberculosis
TGNLDPIIAFYPKHVLYEVFGP

SEQ ID NO: 1555816 - protein, 23 aa, Mycobacterium tuberculosis
TIPSALASLPSGGFVPAGTTISV

SEQ ID NO: 1555817 - protein, 21 aa, Mycobacterium tuberculosis
TLFRRLAVFVGCFFVDDAQAV

SEQ ID NO: 1555818 - protein, 17 aa, Mycobacterium tuberculosis
TLWGSGVLDLRYADFTS

SEQ ID NO: 1555819 - protein, 18 aa, Mycobacterium tuberculosis
TMALLAAGADEVSAAVAA

SEQ ID NO: 1555820 - protein, 36 aa, Mycobacterium tuberculosis
TNVEQQVLGLINAPTQALLGRPLIGNGADGTAANPN

SEQ ID NO: 1555821 - protein, 19 aa, Mycobacterium tuberculosis
TPPVLTYRCPTQDGPLTAQ

SEQ ID NO: 1555822 - protein, 22 aa, Mycobacterium tuberculosis
VANIISDKLFQRVGARPDSVTC

SEQ ID NO: 1555823 - protein, 23 aa, Mycobacterium tuberculosis
VFLLAVLLAPVVLTSCTWRGIAN

SEQ ID NO: 1555824 - protein, 17 aa, Mycobacterium tuberculosis
VGGNARLLGTGGAGGVG

SEQ ID NO: 1555825 - protein, 21 aa, Mycobacterium tuberculosis
VLQFAPGELKNLPGFQGSGDG

SEQ ID NO: 1555826 - protein, 27 aa, Mycobacterium tuberculosis
VTDSMPALHMLPLADALGVLPVLATDV

SEQ ID NO: 1555827 - protein, 19 aa, Mycobacterium tuberculosis
VVMLLVAAGLVVVFGDFRF

SEQ ID NO: 1555828 - protein, 26 aa, Mycobacterium tuberculosis
VYKRSLAVFFLSEPPEGFDTLRDFRR

SEQ ID NO: 1555829 - protein, 27 aa, Mycobacterium tuberculosis
WAKSLTQRTILRLLDPSISAAGILRAE

SEQ ID NO: 1555830 - protein, 20 aa, Mycobacterium tuberculosis
YSGPTTALTDVWRALRASMR

SEQ ID NO: 1555831 - protein, 25 aa, Mycobacterium tuberculosis
YTRRDLPIHYLLADTFTVCDGYFCS

SEQ ID NO: 1555832 - protein, 23 aa, Mycobacterium tuberculosis
AAAAALPAFSPPAQALGGGVGAF

SEQ ID NO: 1555833 - protein, 29 aa, Mycobacterium tuberculosis
AAAAMVVAAAPYAGWLAAAAARAGGAAVQ

SEQ ID NO: 1555834 - protein, 30 aa, Mycobacterium tuberculosis; identical to SEQ ID NO: 215429

SEQ ID NO: 1555835 - protein, 35 aa, Mycobacterium tuberculosis
AAAEAAAVSPLLDPINEFFLANTGRPLIGNGANGA

SEQ ID NO: 1555836 - protein, 20 aa, Mycobacterium tuberculosis
AAFHEQFVQALTAAAGRYAS

SEQ ID NO: 1555837 - protein, 19 aa, Mycobacterium tuberculosis
AAGAPGQAGGPGGPAGLWG

SEQ ID NO: 1555838 - protein, 34 aa, Mycobacterium tuberculosis; identical to SEQ ID NO: 237125

SEQ ID NO: 1555839 - protein, 24 aa, Mycobacterium tuberculosis
AAGKRLPVPLFPGFDTLGTLEYIT

SEQ ID NO: 1555840 - protein, 27 aa, Mycobacterium tuberculosis
AAINAPTQTLLGRPLIGNGADGLPGQN

SEQ ID NO: 1555841 - protein, 20 aa, Mycobacterium tuberculosis
AALIDDPMFAKSVAAAAITS

SEQ ID NO: 1555842 - protein, 27 aa, Mycobacterium tuberculosis
AAMAAAAAPYAGWLAAAAARAAGASAQ

SEQ ID NO: 1555843 - protein, 38 aa, Mycobacterium tuberculosis; identical to SEQ ID NO: 237489

SEQ ID NO: 1555844 - protein, 20 aa, Mycobacterium tuberculosis
AAPGWLVSPGVRTALPANGF

SEQ ID NO: 1555845 - protein, 25 aa, Mycobacterium tuberculosis
AAVLLLTPITVPAGYPGAVAPATAA

SEQ ID NO: 1555846 - protein, 35 aa, Mycobacterium tuberculosis
AAVYEAARAATVDPLLVAANRHQLVSLVLSNLFGQ

SEQ ID NO: 1555847 - protein, 22 aa, Mycobacterium tuberculosis
ADDSRLGWPLRPPPAVVRQFDA

SEQ ID NO: 1555848 - protein, 26 aa, Mycobacterium tuberculosis
ADIEFPAPALIYGYGAYEICEDPRFS

SEQ ID NO: 1555849 - protein, 18 aa, Mycobacterium tuberculosis
ADQYAQLSGLRLGKVISI

SEQ ID NO: 1555850 - protein, 32 aa, Mycobacterium tuberculosis; identical to SEQ ID NO: 1516304

SEQ ID NO: 1555851 - protein, 19 aa, Mycobacterium tuberculosis
AFHEQFVQALTAAAGRYAS

SEQ ID NO: 1555852 - protein, 20 aa, Mycobacterium tuberculosis
AFTIEARALTFQPKRIRRQL

SEQ ID NO: 1555853 - protein, 54 aa, Mycobacterium tuberculosis; identical to SEQ ID NO: 236090

SEQ ID NO: 1555854 - protein, 18 aa, Mycobacterium tuberculosis
AGDLTNLGSSISAANASA

SEQ ID NO: 1555855 - protein, 20 aa, Mycobacterium tuberculosis
AGGAGGVGGLLFGDGGNGGA

SEQ ID NO: 1555856 - protein, 21 aa, Mycobacterium tuberculosis
AGGDGGWLFGDGGAGGTGGNG

SEQ ID NO: 1555857 - protein, 17 aa, Mycobacterium tuberculosis
AGGKGAIPAMKGATGAD

SEQ ID NO: 1555858 - protein, 26 aa, Mycobacterium tuberculosis
AGGLGGNGGWLYGNGGAGGIGGAGTG

SEQ ID NO: 1555859 - protein, 20 aa, Mycobacterium tuberculosis
AGGNAGMLFGAAGVGGVGGF

SEQ ID NO: 1555860 - protein, 18 aa, Mycobacterium tuberculosis
AGGRLFGNGGAGGNGGTA

SEQ ID NO: 1555861 - protein, 22 aa, Mycobacterium tuberculosis
AGGWRLVTALPARGEVWWCEMA

SEQ ID NO: 1555862 - protein, 17 aa, Mycobacterium tuberculosis
AGLVPPIDQWSGSTFAN

SEQ ID NO: 1555863 - protein, 17 aa, Mycobacterium tuberculosis
AGQSWQGAAAAAMAAAA

SEQ ID NO: 1555864 - protein, 21 aa, Mycobacterium tuberculosis
AIVDALRILLSNPAVWEKTAL

SEQ ID NO: 1555865 - protein, 28 aa, Mycobacterium tuberculosis
AKHTTTPSVLFLLLKTIATSRSHRASTS

SEQ ID NO: 1555866 - protein, 21 aa, Mycobacterium tuberculosis
ALADTAWQGPAATAMAAAAAP

SEQ ID NO: 1555867 - protein, 20 aa, Mycobacterium tuberculosis
ALPDWVPFATLFTVAAGTLL

SEQ ID NO: 1555868 - protein, 24 aa, Mycobacterium tuberculosis
ALQQLVPRTPAALYWGARLTLVSR

SEQ ID NO: 1555869 - protein, 26 aa, Mycobacterium tuberculosis
ALSAAAAAFHDQFVRALAAGAGAYAG

SEQ ID NO: 1555870 - protein, 18 aa, Mycobacterium tuberculosis
AMVDPVVVAANRSAFVQL

SEQ ID NO: 1555871 - protein, 37 aa, Mycobacterium tuberculosis; identical to SEQ ID NO: 237158

SEQ ID NO: 1555872 - protein, 17 aa, Mycobacterium tuberculosis
APIQQMIDFMAARTAFF

SEQ ID NO: 1555873 - protein, 24 aa, Mycobacterium tuberculosis
APIRRASVTVMEWGLRGTRRAEAA

SEQ ID NO: 1555874 - protein, 21 aa, Mycobacterium tuberculosis
APTEALLGRPLIGNGADGTAP

SEQ ID NO: 1555875 - protein, 22 aa, Mycobacterium tuberculosis
AQFSVVLPRRDGVEYSVEHAVI

SEQ ID NO: 1555876 - protein, 17 aa, Mycobacterium tuberculosis
ARFGVPVPNLTAWRDAT

SEQ ID NO: 1555877 - protein, 26 aa, Mycobacterium tuberculosis
ASGLDSRAWRLPWPDGTVVYELDQPK

SEQ ID NO: 1555878 - protein, 19 aa, Mycobacterium tuberculosis
ASSQFVSGLLLSAASFTDG

SEQ ID NO: 1555879 - protein, 31 aa, Mycobacterium tuberculosis
ATDVLHYLYAHLRLLWMCRERLLAELGDISY

SEQ ID NO: 1555880 - protein, 24 aa, Mycobacterium tuberculosis
AVAAQLAPWAQAVRALPNPTAPAL

SEQ ID NO: 1555881 - protein, 43 aa, Mycobacterium tuberculosis
AVDLLAPPPDPLALPPALDPLAPPPPDPLAPPPPDPLAVPVAA

SEQ ID NO: 1555882 - protein, 33 aa, Mycobacterium tuberculosis; identical to SEQ ID NO: 162038

SEQ ID NO: 1555883 - protein, 19 aa, Mycobacterium tuberculosis
CGGEYEWTRAKAAYFMIVF

SEQ ID NO: 1555884 - protein, 21 aa, Mycobacterium tuberculosis
CRVREGFVMRLAIVGTAAAAA

SEQ ID NO: 1555885 - protein, 20 aa, Mycobacterium tuberculosis
DDIAWLPATAQLAVLAAKKV

SEQ ID NO: 1555886 - protein, 25 aa, Mycobacterium tuberculosis
DFMAARTAFFDEYFLATADAGVRQV

SEQ ID NO: 1555887 - protein, 23 aa, Mycobacterium tuberculosis
DGPLTAQFYNQFDPKTAVLNWKG

SEQ ID NO: 1555888 - protein, 22 aa, Mycobacterium tuberculosis
DGQDGGLLFGNGGAGYNSAATP

SEQ ID NO: 1555889 - protein, 18 aa, Mycobacterium tuberculosis
DGQLQWVSIPAWALCVAF

SEQ ID NO: 1555890 - protein, 18 aa, Mycobacterium tuberculosis
DIPIPAIHIDFDGAADAG

SEQ ID NO: 1555891 - protein, 19 aa, Mycobacterium tuberculosis
DPDVHYPYLYGSPGGRTRD

SEQ ID NO: 1555892 - protein, 19 aa, Mycobacterium tuberculosis
DPRFSIARLSLLDRGMVFV

SEQ ID NO: 1555893 - protein, 27 aa, Mycobacterium tuberculosis
DPRHTPPHAWYIAFAPAQAPKVAVAVL

SEQ ID NO: 1555894 - protein, 23 aa, Mycobacterium tuberculosis
DRPEDYWPEQWAHAYVDFAAGEK

SEQ ID NO: 1555895 - protein, 17 aa, Mycobacterium tuberculosis
DVLINNAFRVPSMKPLA

SEQ ID NO: 1555896 - protein, 26 aa, Mycobacterium tuberculosis
EATAIDPQHRLLLEVSWEAIEHAGVD

SEQ ID NO: 1555897 - protein, 26 aa, Mycobacterium tuberculosis
ELPTRYLGLVTAVEYGRRARLAVQAM

SEQ ID NO: 1555898 - protein, 23 aa, Mycobacterium tuberculosis
ERWKETAFQYGWLLATADSDRYG

SEQ ID NO: 1555899 - protein, 17 aa, Mycobacterium tuberculosis
ESLWKQLMLGYYVNEYQ

SEQ ID NO: 1555900 - protein, 21 aa, Mycobacterium tuberculosis
ETLNGLIQFDAAIQPGDSGGP

SEQ ID NO: 1555901 - protein, 21 aa, Mycobacterium tuberculosis
FASGRVAYTLGLHGPAVTVDT

SEQ ID NO: 1555902 - protein, 17 aa, Mycobacterium tuberculosis
FDHVVPPTPPPGTPGEF

SEQ ID NO: 1555903 - protein, 26 aa, Mycobacterium tuberculosis
FGQSGGFIWVDPKADLALVVLTARDF

SEQ ID NO: 1555904 - protein, 19 aa, Mycobacterium tuberculosis
FLAEPWWCRMVVMSAERIA

SEQ ID NO: 1555905 - protein, 18 aa, Mycobacterium tuberculosis
GADEVSAAIAALFGAHGQ

SEQ ID NO: 1555906 - protein, 28 aa, Mycobacterium tuberculosis
GADEVSAALASLFSGHAVSYQQVAAQAT

SEQ ID NO: 1555907 - protein, 53 aa, Mycobacterium tuberculosis
GADEVSARIAALFGGFGLEYQAISAQVAAYHQRFVQALSTGAGAYASAEAAAA

SEQ ID NO: 1555908 - protein, 17 aa, Mycobacterium tuberculosis
GADGGAGGWLFGNGGNG

SEQ ID NO: 1555909 - protein, 27 aa, Mycobacterium tuberculosis
GAGGAGGLLAGLLAGPGGAGGTGGRGF

SEQ ID NO: 1555910 - protein, 18 aa, Mycobacterium tuberculosis
GAGGAGGWLSGNGGAGGN

SEQ ID NO: 1555911 - protein, 18 aa, Mycobacterium tuberculosis
GAGGILFGTGGTGGSGGP

SEQ ID NO: 1555912 - protein, 23 aa, Mycobacterium tuberculosis
GAGGSGGWLYGNGGNGGIGGNAI

SEQ ID NO: 1555913 - protein, 18 aa, Mycobacterium tuberculosis
GAGGWLYGDAGAGGDGGV

SEQ ID NO: 1555914 - protein, 18 aa, Mycobacterium tuberculosis
GAIPAMKGATGADGTAPT

SEQ ID NO: 1555915 - protein, 27 aa, Mycobacterium tuberculosis
GANGGAGGNAWLFGAGGSGGAGTNGGV

SEQ ID NO: 1555916 - protein, 19 aa, Mycobacterium tuberculosis
GASGWLMGNGGNGGNGGTG

SEQ ID NO: 1555917 - protein, 25 aa, Mycobacterium tuberculosis
GATAFPWRRQSALVQWYVETSGSPS

SEQ ID NO: 1555918 - protein, 26 aa, Mycobacterium tuberculosis
GAVNAPTEALLGRPLIGNGADGTAPG

SEQ ID NO: 1555919 - protein, 23 aa, Mycobacterium tuberculosis
GDEFCLLDGLLAWYAMIGSINNI

SEQ ID NO: 1555920 - protein, 24 aa, Mycobacterium tuberculosis
GDPLHLPGFPVQFFVYKQIAANNA

SEQ ID NO: 1555921 - protein, 24 aa, Mycobacterium tuberculosis
GEKRSWLRARGLKIFPLVGWAERG

SEQ ID NO: 1555922 - protein, 19 aa, Mycobacterium tuberculosis
GFRVPCLVISPYSRGPLMV

SEQ ID NO: 1555923 - protein, 22 aa, Mycobacterium tuberculosis
GGAAFSINFTAGDGGAGGAGGS

SEQ ID NO: 1555924 - protein, 22 aa, Mycobacterium tuberculosis
GGAGGAAGLWGSGGSGGQGGNG

SEQ ID NO: 1555925 - protein, 25 aa, Mycobacterium tuberculosis
GGAGGNGAWLFGNGGAGGGGGKGGN

SEQ ID NO: 1555926 - protein, 24 aa, Mycobacterium tuberculosis
GGAGGSGAWLYGNGGAAGAGGNGG

SEQ ID NO: 1555927 - protein, 21 aa, Mycobacterium tuberculosis
GGAGGWLFGNGGAGGAGGLGV

SEQ ID NO: 1555928 - protein, 26 aa, Mycobacterium tuberculosis
GGGAAGPAGWLFGDGGAGGNGGAAAA

SEQ ID NO: 1555929 - protein, 31 aa, Mycobacterium tuberculosis
GGHGGVGGDGGWLAPGGAGGAGGQGGAGGAG

SEQ ID NO: 1555930 - protein, 25 aa, Mycobacterium tuberculosis
GGILGPHFSFSWYRGSPIGRERKTE

SEQ ID NO: 1555931 - protein, 21 aa, Mycobacterium tuberculosis
GGISGLLLGADGFNAPASASP

SEQ ID NO: 1555932 - protein, 18 aa, Mycobacterium tuberculosis
GGPGGAAGLFGNGGSGGS

SEQ ID NO: 1555933 - protein, 19 aa, Mycobacterium tuberculosis
GGRGGLLVGNGGAGGAGGV

SEQ ID NO: 1555934 - protein, 22 aa, Mycobacterium tuberculosis
GGSAARLFGGGGAGGAGGTGST

SEQ ID NO: 1555935 - protein, 22 aa, Mycobacterium tuberculosis
GGSARLIGAGGHGGDGGAGGNT

SEQ ID NO: 1555936 - protein, 32 aa, Mycobacterium tuberculosis; identical to SEQ ID NO: 1518339

SEQ ID NO: 1555937 - protein, 18 aa, Mycobacterium tuberculosis
GHAGLFGAGGTGGTGGIG

SEQ ID NO: 1555938 - protein, 21 aa, Mycobacterium tuberculosis
GHDYTWFVLNAKIIEKEFALS

SEQ ID NO: 1555939 - protein, 25 aa, Mycobacterium tuberculosis
GIDSPQRLWEALLRGDDLVGEIPAD

SEQ ID NO: 1555940 - protein, 17 aa, Mycobacterium tuberculosis
GLLAWYAMIGSINNINS

SEQ ID NO: 1555941 - protein, 18 aa, Mycobacterium tuberculosis
GLMGIVVALLVVAVGQSF

SEQ ID NO: 1555942 - protein, 21 aa, Mycobacterium tuberculosis
GLPGDLTFSWYAVDKTGQPWV

SEQ ID NO: 1555943 - protein, 17 aa, Mycobacterium tuberculosis
GMFFGSGGSGGAGGISR

SEQ ID NO: 1555944 - protein, 19 aa, Mycobacterium tuberculosis
GNAGLIGAGGHGGAGGAGG

SEQ ID NO: 1555945 - protein, 25 aa, Mycobacterium tuberculosis
GNFSNGVLWRGDYEGLWGLSGGSTI

SEQ ID NO: 1555946 - protein, 23 aa, Mycobacterium tuberculosis
GNGGAGGWLYGNGGAGGAGGTSV

SEQ ID NO: 1555947 - protein, 29 aa, Mycobacterium tuberculosis
GNGGGALNQAGFFGTGGKGGNGGNGGAGM

SEQ ID NO: 1555948 - protein, 17 aa, Mycobacterium tuberculosis
GPLVVPDIVIPAFGGGT

SEQ ID NO: 1555949 - protein, 25 aa, Mycobacterium tuberculosis
GQSFTSVPMLFAKPSYYGQFTDSGG

SEQ ID NO: 1555950 - protein, 27 aa, Mycobacterium tuberculosis
GSVTVTYPAHWGPAAVAALDSALRRAS

SEQ ID NO: 1555951 - protein, 29 aa, Mycobacterium tuberculosis
GTGGAGGPGGLIWGGGGAGGVGGAGGGTG

SEQ ID NO: 1555952 - protein, 18 aa, Mycobacterium tuberculosis
GVAALPDWVPFATLFTVA

SEQ ID NO: 1555953 - protein, 23 aa, Mycobacterium tuberculosis
GVGGPAGLWGHGGAGGAGGAGVA

SEQ ID NO: 1555954 - protein, 23 aa, Mycobacterium tuberculosis
GVVFLLLVWQALGSSPNSEDDSS

SEQ ID NO: 1555955 - protein, 29 aa, Mycobacterium tuberculosis
HGGAGGAGGRAWLWGTGGAGGAGGDGGWL

SEQ ID NO: 1555956 - protein, 26 aa, Mycobacterium tuberculosis
HGNSVPRFHITWGTGPALVDIFVRQL

SEQ ID NO: 1555957 - protein, 30 aa, Mycobacterium tuberculosis; identical to SEQ ID NO: 219144

SEQ ID NO: 1555958 - protein, 17 aa, Mycobacterium tuberculosis
HPPAAWRTAPPPLNMRP

SEQ ID NO: 1555959 - protein, 17 aa, Mycobacterium tuberculosis
HQQFVQALTASVGSYAA

SEQ ID NO: 1555960 - protein, 25 aa, Mycobacterium tuberculosis
HSITRKPVLTLYRQRPPEVGVPSEN

SEQ ID NO: 1555961 - protein, 25 aa, Mycobacterium tuberculosis
HSWFAGYRGDLAFASLIVGGGSSEY

SEQ ID NO: 1555962 - protein, 20 aa, Mycobacterium tuberculosis
HTVPLLGRRIAVIGTGSTGV

SEQ ID NO: 1555963 - protein, 26 aa, Mycobacterium tuberculosis
HYCGLYGHKSTWRSVPLVGHIPSAPG

SEQ ID NO: 1555964 - protein, 18 aa, Mycobacterium tuberculosis
HYSWRIMPENLEDAGVSW

SEQ ID NO: 1555965 - protein, 28 aa, Mycobacterium tuberculosis
IAIGGLYGDITYPVTSPLAITMGFAACE

SEQ ID NO: 1555966 - protein, 18 aa, Mycobacterium tuberculosis
IDAITLFPGGLTFPANSL

SEQ ID NO: 1555967 - protein, 23 aa, Mycobacterium tuberculosis
IEQFPLTYHAVGGIGPLHVAPVP

SEQ ID NO: 1555968 - protein, 24 aa, Mycobacterium tuberculosis
IGATAMLLASSCTWQLSLFIPDGV

SEQ ID NO: 1555969 - protein, 27 aa, Mycobacterium tuberculosis
IGGTGGVLLGLDGFTAPASTSPLHTLQ

SEQ ID NO: 1555970 - protein, 24 aa, Mycobacterium tuberculosis
IGNTQALRWRTSVGAAAISVAQRV

SEQ ID NO: 1555971 - protein, 18 aa, Mycobacterium tuberculosis
IHQTFSLGPLVVPDIVIP

SEQ ID NO: 1555972 - protein, 17 aa, Mycobacterium tuberculosis
IIPGPSSLWLDAAGKRL

SEQ ID NO: 1555973 - protein, 18 aa, Mycobacterium tuberculosis
IPARGIVAVCDFGGSGTG

SEQ ID NO: 1555974 - protein, 25 aa, Mycobacterium tuberculosis
IQTEFNVALPWRKEVSLSKSSLHPA

SEQ ID NO: 1555975 - protein, 24 aa, Mycobacterium tuberculosis
ISIPNIAIPSIHLGIDPTFDVGPI

SEQ ID NO: 1555976 - protein, 20 aa, Mycobacterium tuberculosis
ITEPLGYDTTYTWSGSAVGH

SEQ ID NO: 1555977 - protein, 17 aa, Mycobacterium tuberculosis
KFGLGQRTGVGLPGESA

SEQ ID NO: 1555978 - protein, 18 aa, Mycobacterium tuberculosis
KQFRGEFTPKTELTMVAF

SEQ ID NO: 1555979 - protein, 31 aa, Mycobacterium tuberculosis; identical to SEQ ID NO: 236576

SEQ ID NO: 1555980 - protein, 25 aa, Mycobacterium tuberculosis
LASGPAALAIPALGIGNTGIGNIFS

SEQ ID NO: 1555981 - protein, 20 aa, Mycobacterium tuberculosis
LAVLTRLPAQVLGRVAFQVL

SEQ ID NO: 1555982 - protein, 17 aa, Mycobacterium tuberculosis
LAWYAMIGSINNINSMG

SEQ ID NO: 1555983 - protein, 17 aa, Mycobacterium tuberculosis
LDAVELELYKRLPGDLS

SEQ ID NO: 1555984 - protein, 18 aa, Mycobacterium tuberculosis
LEHLGLRTRLFAAPGWLV

SEQ ID NO: 1555985 - protein, 17 aa, Mycobacterium tuberculosis
LEVEFALDPSGRSAPLR

SEQ ID NO: 1555986 - protein, 20 aa, Mycobacterium tuberculosis
LFAGILAQVPFVDPLTTILD

SEQ ID NO: 1555987 - protein, 18 aa, Mycobacterium tuberculosis
LFEPVLASLRDLGCRALL

SEQ ID NO: 1555988 - protein, 19 aa, Mycobacterium tuberculosis
LFGAHARQYQALSVQVAAF

SEQ ID NO: 1555989 - protein, 29 aa, Mycobacterium tuberculosis
LGAVNAPTEALLGRPLIGNGADGTAPGQP

SEQ ID NO: 1555990 - protein, 26 aa, Mycobacterium tuberculosis
LGLINAPTQALLGRPLIGNGADGTAA

SEQ ID NO: 1555991 - protein, 19 aa, Mycobacterium tuberculosis
LHWGAMWGPASGANYVDPL

SEQ ID NO: 1555992 - protein, 19 aa, Mycobacterium tuberculosis
LLETDQAFGWVAFEFGVHR

SEQ ID NO: 1555993 - protein, 23 aa, Mycobacterium tuberculosis
LPRPWDPLPCANLTQGPFGGPDF

SEQ ID NO: 1555994 - protein, 22 aa, Mycobacterium tuberculosis
LQALSPLLGSWAGRGAGKYPTI

SEQ ID NO: 1555995 - protein, 20 aa, Mycobacterium tuberculosis
LRTRLFAAPGWLVSPGVRTA

SEQ ID NO: 1555996 - protein, 30 aa, Mycobacterium tuberculosis
LSARVATFHEQFVRSLTAAGSAYATAEAAN

SEQ ID NO: 1555997 - protein, 17 aa, Mycobacterium tuberculosis
LTARDFGDWALDLWPAI

SEQ ID NO: 1555998 - protein, 20 aa, Mycobacterium tuberculosis
LTSATLGGLALPLQQTIDAI

SEQ ID NO: 1555999 - protein, 26 aa, Mycobacterium tuberculosis
LVDVINAPFRSALGRPLIGNGANGKP

SEQ ID NO: 1556000 - protein, 18 aa, Mycobacterium tuberculosis
MCNNGWTYPPFADTRRGE

SEQ ID NO: 1556001 - protein, 18 aa, Mycobacterium tuberculosis
MGPMQFISETWRLYGVAA

SEQ ID NO: 1556002 - protein, 25 aa, Mycobacterium tuberculosis
MHLSLALNRLPQVAALFLAGHLGAR

SEQ ID NO: 1556003 - protein, 18 aa, Mycobacterium tuberculosis
MLDAVELELYKRLPGDLS

SEQ ID NO: 1556004 - protein, 31 aa, Mycobacterium tuberculosis; identical to SEQ ID NO: 236664

SEQ ID NO: 1556005 - protein, 18 aa, Mycobacterium tuberculosis
MVPVLLDTGSTGLVMDSQ

SEQ ID NO: 1556006 - protein, 29 aa, Mycobacterium tuberculosis
NDSNGILWRGNFEGLFSAYLGFTIEQFPL

SEQ ID NO: 1556007 - protein, 22 aa, Mycobacterium tuberculosis
NDTRVYYVEPAKWVAALRHAKT

SEQ ID NO: 1556008 - protein, 23 aa, Mycobacterium tuberculosis
NFSNGVLWRGDYEGLWGLSGGST

SEQ ID NO: 1556009 - protein, 20 aa, Mycobacterium tuberculosis
NGGKAGFSPGPTNFGLNGAG

SEQ ID NO: 1556010 - protein, 32 aa, Mycobacterium tuberculosis
NVCWPTPRPPMRIWPRRFDAPPGPCRASRSMP

SEQ ID NO: 1556011 - protein, 40 aa, Mycobacterium tuberculosis; identical to SEQ ID NO: 237710

SEQ ID NO: 1556012 - protein, 24 aa, Mycobacterium tuberculosis
PEVNSALMFAGAGSGPTLAAAAAW

SEQ ID NO: 1556013 - protein, 19 aa, Mycobacterium tuberculosis
PGGWLIGNGGAGGSGAPGA

SEQ ID NO: 1556014 - protein, 28 aa, Mycobacterium tuberculosis
PGTGQPGGAGGLLWGNGGNGGSGAAGQV

SEQ ID NO: 1556015 - protein, 19 aa, Mycobacterium tuberculosis
PGYKVFPVLNLAVGGSGGG

SEQ ID NO: 1556016 - protein, 20 aa, Mycobacterium tuberculosis
PIREWPFNDPGYKVFPVLNL

SEQ ID NO: 1556017 - protein, 27 aa, Mycobacterium tuberculosis
PMLAAAAAWDGLAAELGLAAESFGLVT

SEQ ID NO: 1556018 - protein, 24 aa, Mycobacterium tuberculosis
PNPPAIGFFISNLSITGPQISGLS

SEQ ID NO: 1556019 - protein, 31 aa, Mycobacterium tuberculosis
PPALSQDRFADFPALPLDPSAMVAQVGPQVV

SEQ ID NO: 1556020 - protein, 19 aa, Mycobacterium tuberculosis
PPARYFGPNLSRLSAVRQK

SEQ ID NO: 1556021 - protein, 18 aa, Mycobacterium tuberculosis
PPVPASPGGNGGGGDAGG

SEQ ID NO: 1556022 - protein, 19 aa, Mycobacterium tuberculosis
PRRMGRIPKQLLSGVPAHV

SEQ ID NO: 1556023 - protein, 18 aa, Mycobacterium tuberculosis
PRRVLLLCDVSRSMQPYA

SEQ ID NO: 1556024 - protein, 26 aa, Mycobacterium tuberculosis
PSKPCAWLAEGLVRYLPARAQDLLFE

SEQ ID NO: 1556025 - protein, 20 aa, Mycobacterium tuberculosis
PSSLWLDAAGKRLPVPLFPG

SEQ ID NO: 1556026 - protein, 28 aa, Mycobacterium tuberculosis
PVAQSYLRNFLAAPPPQRAAMAAQLQAV

SEQ ID NO: 1556027 - protein, 19 aa, Mycobacterium tuberculosis
PVYFDYWSARGVDVTPFFA

SEQ ID NO: 1556028 - protein, 28 aa, Mycobacterium tuberculosis
PYAGRRETWLIMRLPVIGNTQALRWRTS

SEQ ID NO: 1556029 - protein, 27 aa, Mycobacterium tuberculosis
QALSAAAAAFHDQFVRALAAGAGAYAG

SEQ ID NO: 1556030 - protein, 30 aa, Mycobacterium tuberculosis; identical to SEQ ID NO: 237368

SEQ ID NO: 1556031 - protein, 19 aa, Mycobacterium tuberculosis
QLLATAALDLASIGSQVSA

SEQ ID NO: 1556032 - protein, 17 aa, Mycobacterium tuberculosis
QNWRGPVLGDLRSFMFV

SEQ ID NO: 1556033 - protein, 19 aa, Mycobacterium tuberculosis
QSGMAKFAAFLRGVNVGGV

SEQ ID NO: 1556034 - protein, 36 aa, Mycobacterium tuberculosis; identical to SEQ ID NO: 236796

SEQ ID NO: 1556035 - protein, 23 aa, Mycobacterium tuberculosis
QTLQAFLHWAIIDGNKASFLDQV

SEQ ID NO: 1556036 - protein, 31 aa, Mycobacterium tuberculosis
QVLGAINAPTQLWLGRPLIGDGVHGAPGTGQ

SEQ ID NO: 1556037 - protein, 20 aa, Mycobacterium tuberculosis
RAIKLKNWVATLTLSLKKDV

SEQ ID NO: 1556038 - protein, 17 aa, Mycobacterium tuberculosis
RATVAAAVRLATVCLVA

SEQ ID NO: 1556039 - protein, 22 aa, Mycobacterium tuberculosis
RDALFHWGVAMLPAGPAGRVSV

SEQ ID NO: 1556040 - protein, 23 aa, Mycobacterium tuberculosis
RDVIDAFLAWYVPGLDISDHTML

SEQ ID NO: 1556041 - protein, 28 aa, Mycobacterium tuberculosis
RGDYLNVFTTFDLTLRRIGETFFTTAYF

SEQ ID NO: 1556042 - protein, 27 aa, Mycobacterium tuberculosis
RGPVLGDLRSFMFVQMFSRALTEDELL

SEQ ID NO: 1556043 - protein, 17 aa, Mycobacterium tuberculosis
RILLSNPAVWEKTALIV

SEQ ID NO: 1556044 - protein, 24 aa, Mycobacterium tuberculosis
RLPKVSWVLPGFLLSEHPAFPVNV

SEQ ID NO: 1556045 - protein, 23 aa, Mycobacterium tuberculosis
RNRGREMLAFATAYRDAGVKPPR

SEQ ID NO: 1556046 - protein, 19 aa, Mycobacterium tuberculosis
RPRRVLLLCDVSRSMQPYA

SEQ ID NO: 1556047 - protein, 34 aa, Mycobacterium tuberculosis
RQRRRAMIGTLKRAWIPLLILVVVAIAGFTVQRI

SEQ ID NO: 1556048 - protein, 28 aa, Mycobacterium tuberculosis
RRVLSRSVLILCWSLLGAAPAHADDSRL

SEQ ID NO: 1556049 - protein, 18 aa, Mycobacterium tuberculosis
RVVAPHRLTDPKAGPLIA

SEQ ID NO: 1556050 - protein, 25 aa, Mycobacterium tuberculosis
SAAAYVAAHAPYLAWLMRASETSAE

SEQ ID NO: 1556051 - protein, 29 aa, Mycobacterium tuberculosis
SAAIASLFSGYARDYQALSAQMARFHQQF

SEQ ID NO: 1556052 - protein, 18 aa, Mycobacterium tuberculosis
SADDIFWLSNAYVAAYAD

SEQ ID NO: 1556053 - protein, 36 aa, Mycobacterium tuberculosis; identical to SEQ ID NO: 236880

SEQ ID NO: 1556054 - protein, 28 aa, Mycobacterium tuberculosis
SAPMLAASVAWDGLAAELAVAASSFGSV

SEQ ID NO: 1556055 - protein, 28 aa, Mycobacterium tuberculosis
SGALTMRRLVIAAAVSALLLTGCSGRDA

SEQ ID NO: 1556056 - protein, 18 aa, Mycobacterium tuberculosis
SGGWLLGTGGVGGVGGLG

SEQ ID NO: 1556057 - protein, 25 aa, Mycobacterium tuberculosis
SGGWRIDRLPNGVFLDWQQFQETYK

SEQ ID NO: 1556058 - protein, 37 aa, Mycobacterium tuberculosis
SGLPLRAMVMVLLFLGVVFLLLVWQALGSSPNSEDDS

SEQ ID NO: 1556059 - protein, 31 aa, Mycobacterium tuberculosis; identical to SEQ ID NO: 1529785

SEQ ID NO: 1556060 - protein, 20 aa, Mycobacterium tuberculosis
SIGAPPIVIGPLYAEKTIQL

SEQ ID NO: 1556061 - protein, 33 aa, Mycobacterium tuberculosis
SLALGTTTWTLFPNGWTIPAQTPVTLGLSGGND

SEQ ID NO: 1556062 - protein, 21 aa, Mycobacterium tuberculosis
SNRGFYPAEKFSRQALGLAGA

SEQ ID NO: 1556063 - protein, 17 aa, Mycobacterium tuberculosis
SPTVHIGPTAFLGLGVV

SEQ ID NO: 1556064 - protein, 24 aa, Mycobacterium tuberculosis
SSCTWQLSLFIPDGVPPPPGDPVP

SEQ ID NO: 1556065 - protein, 24 aa, Mycobacterium tuberculosis
STAQPLSLLPDAAAALYAIRADPG

SEQ ID NO: 1556066 - protein, 27 aa, Mycobacterium tuberculosis
STGLVMDSQFLTQNFGPVIGTGTAGYA

SEQ ID NO: 1556067 - protein, 27 aa, Mycobacterium tuberculosis
SVTVMALIVLLLLNATMTQVFTADGLR

SEQ ID NO: 1556068 - protein, 31 aa, Mycobacterium tuberculosis
TEATLRERFGYDAWALIYDVDTVRTIVTAYP

SEQ ID NO: 1556069 - protein, 17 aa, Mycobacterium tuberculosis
TGFIGVVLVTAGKASAD

SEQ ID NO: 1556070 - protein, 26 aa, Mycobacterium tuberculosis
TGGAGGAAGWLYGSGGAGGAGGAGGL

SEQ ID NO: 1556071 - protein, 17 aa, Mycobacterium tuberculosis
TGQFRFGPITVSNVQLN

SEQ ID NO: 1556072 - protein, 24 aa, Mycobacterium tuberculosis
TKTAIPYRVPFPQSMPTQETAPTR

SEQ ID NO: 1556073 - protein, 19 aa, Mycobacterium tuberculosis
TLAVSALVALFPAVAGCSD

SEQ ID NO: 1556074 - protein, 22 aa, Mycobacterium tuberculosis
TPFVGPPPFRPPTFNPVDGAMV

SEQ ID NO: 1556075 - protein, 18 aa, Mycobacterium tuberculosis
TPPVLTYRCPTQDGPLTA

SEQ ID NO: 1556076 - protein, 28 aa, Mycobacterium tuberculosis
TPVTSVTPNAWLPGAAHSALTAGAAPGA

SEQ ID NO: 1556077 - protein, 26 aa, Mycobacterium tuberculosis
TSGGWRIDRLPNGVFLDWQQFQETYK

SEQ ID NO: 1556078 - protein, 34 aa, Mycobacterium tuberculosis
VAADPYDAYLRLHLLSHRLVAPHGLNASGLFGVL

SEQ ID NO: 1556079 - protein, 25 aa, Mycobacterium tuberculosis
VAAQATALHDQFVQALTGAGGSYAL

SEQ ID NO: 1556080 - protein, 23 aa, Mycobacterium tuberculosis
VAVLQLRGAGGLPSAAIGGGVAV

SEQ ID NO: 1556081 - protein, 42 aa, Mycobacterium tuberculosis; identical to SEQ ID NO: 237024

SEQ ID NO: 1556082 - protein, 23 aa, Mycobacterium tuberculosis
VDTSPYSVAYLIDSHQDRTGADP

SEQ ID NO: 1556083 - protein, 24 aa, Mycobacterium tuberculosis
VDVDAKLYGLPFGDGAYGAQDISL

SEQ ID NO: 1556084 - protein, 23 aa, Mycobacterium tuberculosis
VELAPLLRHPLDLELDSISVVTF

SEQ ID NO: 1556085 - protein, 17 aa, Mycobacterium tuberculosis
VGGSGGWLNGNGGAGGA

SEQ ID NO: 1556086 - protein, 24 aa, Mycobacterium tuberculosis
VGPITISPITLFPAQNFNTTFPVG

SEQ ID NO: 1556087 - protein, 29 aa, Mycobacterium tuberculosis
VLGAINAPTQLWLGRPLIGDGVHGAPGTG

SEQ ID NO: 1556088 - protein, 18 aa, Mycobacterium tuberculosis
VPFVDPLTTILDPSLPLT

SEQ ID NO: 1556089 - protein, 17 aa, Mycobacterium tuberculosis
VQALTAAAGRYASTEAA

SEQ ID NO: 1556090 - protein, 23 aa, Mycobacterium tuberculosis
VREDWAALYKKAFAPLNELAGSL

SEQ ID NO: 1556091 - protein, 25 aa, Mycobacterium tuberculosis
VSAQASAFHAQFVQALTGGGGAYAA

SEQ ID NO: 1556092 - protein, 17 aa, Mycobacterium tuberculosis
VSISCRVREGFVMRLAI

SEQ ID NO: 1556093 - protein, 20 aa, Mycobacterium tuberculosis
VSRWGAFLDDVGGFDCDFFG

SEQ ID NO: 1556094 - protein, 17 aa, Mycobacterium tuberculosis
WTRAKAAYFMIVFSGPI

SEQ ID NO: 1556095 - protein, 18 aa, Mycobacterium tuberculosis
WWCRMVVMSAERIARRGG

SEQ ID NO: 1556096 - protein, 44 aa, Mycobacterium tuberculosis; identical to SEQ ID NO: 237815

SEQ ID NO: 1556097 - protein, 19 aa, Mycobacterium tuberculosis
YDPIWPRHGIRIIPGPSSL

SEQ ID NO: 1556098 - protein, 29 aa, Mycobacterium tuberculosis
YKADFDPYQFLLIPLARITGIEDPALRES

SEQ ID NO: 1556099 - protein, 17 aa, Mycobacterium tuberculosis
YRLRVIVHEDENGRMTG

SEQ ID NO: 1556100 - protein, 17 aa, Mycobacterium tuberculosis
YVAFVTDAYARRILGWR

SEQ ID NO: 1556101 - protein, 21 aa, Mycobacterium tuberculosis
AAAAAPYAGWLAAAAARAAGA

SEQ ID NO: 1556102 - protein, 22 aa, Mycobacterium tuberculosis
AAAAAPYASWLSTAATRALSAA

SEQ ID NO: 1556103 - protein, 36 aa, Mycobacterium tuberculosis; identical to SEQ ID NO: 224730

SEQ ID NO: 1556104 - protein, 24 aa, Mycobacterium tuberculosis
AAAKAGITALTLSAARALGRYGVC

SEQ ID NO: 1556105 - protein, 20 aa, Mycobacterium tuberculosis
AAALTSLPAVAAGTGVGPAA

SEQ ID NO: 1556106 - protein, 33 aa, Mycobacterium tuberculosis; identical to SEQ ID NO: 1520017

SEQ ID NO: 1556107 - protein, 19 aa, Mycobacterium tuberculosis
AAFHDQFVRALAAGAGAYA

SEQ ID NO: 1556108 - protein, 30 aa, Mycobacterium tuberculosis; identical to SEQ ID NO: 1520056

SEQ ID NO: 1556109 - protein, 25 aa, Mycobacterium tuberculosis
AAIAGLFGAHARQYQALSVQVAAFH

SEQ ID NO: 1556110 - protein, 17 aa, Mycobacterium tuberculosis
AAIPAVLSAQPVYFDYW

SEQ ID NO: 1556111 - protein, 23 aa, Mycobacterium tuberculosis
AALFAALALALTGGAWQWSASKN

SEQ ID NO: 1556112 - protein, 17 aa, Mycobacterium tuberculosis
AARARVSALSAAAARAA

SEQ ID NO: 1556113 - protein, 17 aa, Mycobacterium tuberculosis
AARFVRPAIPSALSVAL

SEQ ID NO: 1556114 - protein, 37 aa, Mycobacterium tuberculosis; identical to SEQ ID NO: 237492

SEQ ID NO: 1556115 - protein, 26 aa, Mycobacterium tuberculosis
AAVAAVAAVALLAAGAGAGGSAGSAG

SEQ ID NO: 1556116 - protein, 17 aa, Mycobacterium tuberculosis
ACLAAVVVIAGCTTVVD

SEQ ID NO: 1556117 - protein, 22 aa, Mycobacterium tuberculosis
ACTVLAVLAATLLLGACGGPTQ

SEQ ID NO: 1556118 - protein, 23 aa, Mycobacterium tuberculosis
ACTVLAVLAATLLLGACGGPTQP

SEQ ID NO: 1556119 - protein, 38 aa, Mycobacterium tuberculosis; identical to SEQ ID NO: 215638

SEQ ID NO: 1556120 - protein, 23 aa, Mycobacterium tuberculosis
ADQHAVLPLRPESLRRLDRVDAI

SEQ ID NO: 1556121 - protein, 25 aa, Mycobacterium tuberculosis
AEATYEQMWAADVAAMVGYHGGASA

SEQ ID NO: 1556122 - protein, 30 aa, Mycobacterium tuberculosis; identical to SEQ ID NO: 215712

SEQ ID NO: 1556123 - protein, 24 aa, Mycobacterium tuberculosis
AEVNGQVFIVYGPQVTLVSPPHME

SEQ ID NO: 1556124 - protein, 24 aa, Mycobacterium tuberculosis
AFGWVAFEFGVHRYGLQQRLAPHT

SEQ ID NO: 1556125 - protein, 18 aa, Mycobacterium tuberculosis
AFHAQFVQALTSGGGAYA

SEQ ID NO: 1556126 - protein, 18 aa, Mycobacterium tuberculosis
AFVQLVLSNLFGQNAPAI

SEQ ID NO: 1556127 - protein, 23 aa, Mycobacterium tuberculosis
AGGNAGLFSLGASGGAGGSGGSS

SEQ ID NO: 1556128 - protein, 24 aa, Mycobacterium tuberculosis
AGGNAGLLFGAAGVGGAGGFTNGS

SEQ ID NO: 1556129 - protein, 24 aa, Mycobacterium tuberculosis
AGGNAGMLALGAAGGAGGIGGDGG

SEQ ID NO: 1556130 - protein, 21 aa, Mycobacterium tuberculosis
AGGNAGMLFGAAGVGGVGGFS

SEQ ID NO: 1556131 - protein, 21 aa, Mycobacterium tuberculosis
AGGNGGWLWGNGGNGGVGGTS

SEQ ID NO: 1556132 - protein, 22 aa, Mycobacterium tuberculosis
AGGSGGWLYGNGGNGGIGGNAI

SEQ ID NO: 1556133 - protein, 32 aa, Mycobacterium tuberculosis; identical to SEQ ID NO: 224772

SEQ ID NO: 1556134 - protein, 17 aa, Mycobacterium tuberculosis
AGLAGCTFRAELAEVAV

SEQ ID NO: 1556135 - protein, 17 aa, Mycobacterium tuberculosis
AGQATAAALWLVAPCTE

SEQ ID NO: 1556136 - protein, 20 aa, Mycobacterium tuberculosis
AHIAALFSGHGEGYQAIARQ

SEQ ID NO: 1556137 - protein, 29 aa, Mycobacterium tuberculosis
AIAAAEAMYEQMWAADVAAMVGYHGGASA

SEQ ID NO: 1556138 - protein, 19 aa, Mycobacterium tuberculosis
AKTYRWTFADVKGSPPTIT

SEQ ID NO: 1556139 - protein, 27 aa, Mycobacterium tuberculosis
ALDVLNGPFQALFGRPLIGDGANGAPG

SEQ ID NO: 1556140 - protein, 25 aa, Mycobacterium tuberculosis
ALFHDRFVQILQEGAAAYAMAEAAN

SEQ ID NO: 1556141 - protein, 19 aa, Mycobacterium tuberculosis
ALLALLALLALIVGLGASG

SEQ ID NO: 1556142 - protein, 25 aa, Mycobacterium tuberculosis
ALSAQAAMFHEQFVRALAAGGNSYA

SEQ ID NO: 1556143 - protein, 26 aa, Mycobacterium tuberculosis
ALSAQAAMFHEQFVRALAAGGNSYAV

SEQ ID NO: 1556144 - protein, 32 aa, Mycobacterium tuberculosis
ALSVQVAAFHEQFVQALTAAAGRYASTEAAVE

SEQ ID NO: 1556145 - protein, 20 aa, Mycobacterium tuberculosis
AMGPMQFISETWRLYGVAAR

SEQ ID NO: 1556146 - protein, 21 aa, Mycobacterium tuberculosis
AMVIDLLLKRAASLGIQIRYE

SEQ ID NO: 1556147 - protein, 22 aa, Mycobacterium tuberculosis
APDRYVLVFNGEIYNYLELRDE

SEQ ID NO: 1556148 - protein, 23 aa, Mycobacterium tuberculosis
AQAGALPALFSGLARRPRRRQID

SEQ ID NO: 1556149 - protein, 25 aa, Mycobacterium tuberculosis
AQMARFHQQFVQALTASVGSYAAAE

SEQ ID NO: 1556150 - protein, 43 aa, Mycobacterium tuberculosis; identical to SEQ ID NO: 237529

SEQ ID NO: 1556151 - protein, 26 aa, Mycobacterium tuberculosis
ASTVPGTTPSIWTGSPAPSGLSGHDE

SEQ ID NO: 1556152 - protein, 18 aa, Mycobacterium tuberculosis
AVAGLFAQLSREYPPVRG

SEQ ID NO: 1556153 - protein, 18 aa, Mycobacterium tuberculosis
AVALLEWLQTTHPEPKVA

SEQ ID NO: 1556154 - protein, 23 aa, Mycobacterium tuberculosis
AVKRMWLLLAIVVVAVVGGLGIY

SEQ ID NO: 1556155 - protein, 34 aa, Mycobacterium tuberculosis
AVNNTGIFVTGVMSSGFFNFGTGNSGLLVSGNGL

SEQ ID NO: 1556156 - protein, 17 aa, Mycobacterium tuberculosis
AVPDMLSSAAGDLASIG

SEQ ID NO: 1556157 - protein, 17 aa, Mycobacterium tuberculosis
AVSFPRDLAITPIQCEA

SEQ ID NO: 1556158 - protein, 19 aa, Mycobacterium tuberculosis
AVVLLFVNQTITVGKDAPT

SEQ ID NO: 1556159 - protein, 22 aa, Mycobacterium tuberculosis
AYAIDMLLQPRTSHAAPAAAIG

SEQ ID NO: 1556160 - protein, 45 aa, Mycobacterium tuberculosis
AYASAEAAAAEQIVLGVINAPTQALLGRPLIGDGANATTPGGAGG

SEQ ID NO: 1556161 - protein, 25 aa, Mycobacterium tuberculosis
CAPAAFRFMSQARHIGKVVLTMPSA

SEQ ID NO: 1556162 - protein, 26 aa, Mycobacterium tuberculosis
CSTVAAFAAIAARPASPGGAAVGGAA

SEQ ID NO: 1556163 - protein, 17 aa, Mycobacterium tuberculosis
DAGMFFGSGGSGGAGGI

SEQ ID NO: 1556164 - protein, 19 aa, Mycobacterium tuberculosis
DAGVLPVLKHFPGHGRGSG

SEQ ID NO: 1556165 - protein, 23 aa, Mycobacterium tuberculosis
DASLRLLVRGGRFLEMGKTDIRD

SEQ ID NO: 1556166 - protein, 25 aa, Mycobacterium tuberculosis
DCSGLVLYSFAGVGIKLPHYSGSQY

SEQ ID NO: 1556167 - protein, 22 aa, Mycobacterium tuberculosis
DGGAGGIFFGTGGTGGAGGVGT

SEQ ID NO: 1556168 - protein, 21 aa, Mycobacterium tuberculosis
DGGAGGWLFGNGGNGGSGATG

SEQ ID NO: 1556169 - protein, 19 aa, Mycobacterium tuberculosis
DGGWLIGNGGAGGSGAAGV

SEQ ID NO: 1556170 - protein, 20 aa, Mycobacterium tuberculosis
DGIALGLWAGVAVSDLEFIQ

SEQ ID NO: 1556171 - protein, 17 aa, Mycobacterium tuberculosis
DGPMAHLPLIDLTPRQA

SEQ ID NO: 1556172 - protein, 24 aa, Mycobacterium tuberculosis
DIGAPPQFMDFRFTLHDRWHGEFH

SEQ ID NO: 1556173 - protein, 18 aa, Mycobacterium tuberculosis
DLAPPAPADLAPPAPADL

SEQ ID NO: 1556174 - protein, 17 aa, Mycobacterium tuberculosis
DLIMLTDGKPALIRAEN

SEQ ID NO: 1556175 - protein, 25 aa, Mycobacterium tuberculosis
DNGPWGAFDMSLGKAMYAGFTLGGL

SEQ ID NO: 1556176 - protein, 25 aa, Mycobacterium tuberculosis
DPDAHGLHLFATLLAAGERAFGAGP

SEQ ID NO: 1556177 - protein, 24 aa, Mycobacterium tuberculosis
DTNTGFGNAGFFNMGIGNAGNEDM

SEQ ID NO: 1556178 - protein, 18 aa, Mycobacterium tuberculosis
EALVAVASDLAGIGSALA

SEQ ID NO: 1556179 - protein, 25 aa, Mycobacterium tuberculosis
EDGWVRAQLLHYMRSAPDFYFDEMS

SEQ ID NO: 1556180 - protein, 18 aa, Mycobacterium tuberculosis
EFTPKTELTMVAFRAGLV

SEQ ID NO: 1556181 - protein, 17 aa, Mycobacterium tuberculosis
EFVTAAAGDLTNLGSSI

SEQ ID NO: 1556182 - protein, 19 aa, Mycobacterium tuberculosis
ELRRIAALCAAFDVDGMRA

SEQ ID NO: 1556183 - protein, 21 aa, Mycobacterium tuberculosis
ELTATLRDYFAGRDPEQSFSA

SEQ ID NO: 1556184 - protein, 19 aa, Mycobacterium tuberculosis
EMYKYLVAVSREPDHDKIR

SEQ ID NO: 1556185 - protein, 24 aa, Mycobacterium tuberculosis
EPALLSRALTACGLIAVAVARADA

SEQ ID NO: 1556186 - protein, 19 aa, Mycobacterium tuberculosis
EPYAVWLDDWYARESNNNS

SEQ ID NO: 1556187 - protein, 25 aa, Mycobacterium tuberculosis
EVCLQMHLLNLSFAIAVRKRAKADA

SEQ ID NO: 1556188 - protein, 18 aa, Mycobacterium tuberculosis
EVHLDRDFRVLDTEPADG

SEQ ID NO: 1556189 - protein, 25 aa, Mycobacterium tuberculosis
EVSAALASLFSGHAVSYQQVAAQAT

SEQ ID NO: 1556190 - protein, 19 aa, Mycobacterium tuberculosis
FAELSSRLPPRGLTQAARR

SEQ ID NO: 1556191 - protein, 17 aa, Mycobacterium tuberculosis
FAPLIGVRKAGLFTSSS

SEQ ID NO: 1556192 - protein, 22 aa, Mycobacterium tuberculosis
FDCSGLVRYAFAGVGVVIPRFS

SEQ ID NO: 1556193 - protein, 19 aa, Mycobacterium tuberculosis
FKGLQLDIGAPPQFMDFRF

SEQ ID NO: 1556194 - protein, 17 aa, Mycobacterium tuberculosis
FSKDPVFRERMKREARI

SEQ ID NO: 1556195 - protein, 25 aa, Mycobacterium tuberculosis
FTVPNFLELDYWQTWHYGDSTMAGV

SEQ ID NO: 1556196 - protein, 31 aa, Mycobacterium tuberculosis; identical to SEQ ID NO: 225031

SEQ ID NO: 1556197 - protein, 22 aa, Mycobacterium tuberculosis
GAAGFGYPYAIAPPGIGFGSGM

SEQ ID NO: 1556198 - protein, 52 aa, Mycobacterium tuberculosis; identical to SEQ ID NO: 237589

SEQ ID NO: 1556199 - protein, 24 aa, Mycobacterium tuberculosis
GADGGAGGWLFGNGANGTPGTGAA

SEQ ID NO: 1556200 - protein, 21 aa, Mycobacterium tuberculosis
GAGGAAGLWGSGGSGGQGGNG

SEQ ID NO: 1556201 - protein, 24 aa, Mycobacterium tuberculosis
GAGGAAGQLFSAGGAAGAVGVGGT

SEQ ID NO: 1556202 - protein, 18 aa, Mycobacterium tuberculosis
GAGGAGGWLYGDAGAGGD

SEQ ID NO: 1556203 - protein, 25 aa, Mycobacterium tuberculosis
GAGGNAGLLFGAAGVGGAGGFTNGS

SEQ ID NO: 1556204 - protein, 23 aa, Mycobacterium tuberculosis
GAGGNGGWLWGNGGNGGVGGTSV

SEQ ID NO: 1556205 - protein, 27 aa, Mycobacterium tuberculosis
GAGGSGGHALLWGAGGAGGNGGSGGTG

SEQ ID NO: 1556206 - protein, 26 aa, Mycobacterium tuberculosis
GAGGTGGLLFGAGGNGGPGGSGGAAD

SEQ ID NO: 1556207 - protein, 18 aa, Mycobacterium tuberculosis
GAGGWLFGNGGNGGQGTI

SEQ ID NO: 1556208 - protein, 24 aa, Mycobacterium tuberculosis
GATGSAGIGGAGGRGGDGGDGASG

SEQ ID NO: 1556209 - protein, 18 aa, Mycobacterium tuberculosis
GDAGLLFGAAGTGGHGAA

SEQ ID NO: 1556210 - protein, 29 aa, Mycobacterium tuberculosis
GDGGDGASGLGLGLSGFDGGQGGQGGAGG

SEQ ID NO: 1556211 - protein, 30 aa, Mycobacterium tuberculosis
GDGGDGASGLGLGLSGFDGGQGGQGGAGGS

SEQ ID NO: 1556212 - protein, 29 aa, Mycobacterium tuberculosis
GDGGEGASGLGLGLSGFDGGQGGQGGAGG

SEQ ID NO: 1556213 - protein, 28 aa, Mycobacterium tuberculosis
GDRVIPQWVKIRNVDRFNGSFWHGGVGN

SEQ ID NO: 1556214 - protein, 22 aa, Mycobacterium tuberculosis
GELRPQLLDRFGLTVDVQASRD

SEQ ID NO: 1556215 - protein, 32 aa, Mycobacterium tuberculosis; identical to SEQ ID NO: 225059

SEQ ID NO: 1556216 - protein, 25 aa, Mycobacterium tuberculosis
GERAFGAGPLRPWPDDVRRAIREGR

SEQ ID NO: 1556217 - protein, 29 aa, Mycobacterium tuberculosis
GESLPLASIFKLYVLHALAGAVQHNTVSW

SEQ ID NO: 1556218 - protein, 25 aa, Mycobacterium tuberculosis
GETRQLLERLQPTVPILLANLVSVG

SEQ ID NO: 1556219 - protein, 19 aa, Mycobacterium tuberculosis
GGAAFLMGSGGNGGSGGAG

SEQ ID NO: 1556220 - protein, 23 aa, Mycobacterium tuberculosis
GGAAGLIGNGGFGSGGGPGAAGG

SEQ ID NO: 1556221 - protein, 25 aa, Mycobacterium tuberculosis
GGAGGAGGLLFGNGGAGAAGAPGQA

SEQ ID NO: 1556222 - protein, 30 aa, Mycobacterium tuberculosis; identical to SEQ ID NO: 1516689

SEQ ID NO: 1556223 - protein, 31 aa, Mycobacterium tuberculosis
GGDGGDGASGLGLGLSGFDGGQGGQGGAGGS

SEQ ID NO: 1556224 - protein, 26 aa, Mycobacterium tuberculosis
GGFDCSGLVMWAFQQAGIALPHSSQA

SEQ ID NO: 1556225 - protein, 24 aa, Mycobacterium tuberculosis
GGGGTGGLLFGNGGAGGHGAAAGN

SEQ ID NO: 1556226 - protein, 18 aa, Mycobacterium tuberculosis
GGIDYLVNNAAIYGGMKL

SEQ ID NO: 1556227 - protein, 17 aa, Mycobacterium tuberculosis
GGLGGGSFGLPGLNGSC

SEQ ID NO: 1556228 - protein, 24 aa, Mycobacterium tuberculosis
GGLLRPQVLWDELLAECKAAPGGD

SEQ ID NO: 1556229 - protein, 25 aa, Mycobacterium tuberculosis
GGLVRTVHLPAPNVAGLLSAAGVPL

SEQ ID NO: 1556230 - protein, 23 aa, Mycobacterium tuberculosis
GGNAGLLGVGGAGGHGASGGAGD

SEQ ID NO: 1556231 - protein, 20 aa, Mycobacterium tuberculosis
GGNAGLLSLGASGGAGGSGG

SEQ ID NO: 1556232 - protein, 22 aa, Mycobacterium tuberculosis
GGNAGMLALGAAGGAGGIGGDG

SEQ ID NO: 1556233 - protein, 25 aa, Mycobacterium tuberculosis
GGNGATGPWLFGDGGAGGGGGAGGI

SEQ ID NO: 1556234 - protein, 22 aa, Mycobacterium tuberculosis
GGNGGLLFGSAGAGGAGGSGAN

SEQ ID NO: 1556235 - protein, 20 aa, Mycobacterium tuberculosis
GGPGGLLYGNGGNGGTSTTA

SEQ ID NO: 1556236 - protein, 18 aa, Mycobacterium tuberculosis
GGTGLMPGINGTGGAGGS

SEQ ID NO: 1556237 - protein, 17 aa, Mycobacterium tuberculosis
GGVAGLGGAGGAAGQLF

SEQ ID NO: 1556238 - protein, 25 aa, Mycobacterium tuberculosis
GGVGGAGGLLFGYGGAGGAGGYSNI

SEQ ID NO: 1556239 - protein, 30 aa, Mycobacterium tuberculosis
GKAGVGGVSGLLLGLDGFNAPASTSPLHTL

SEQ ID NO: 1556240 - protein, 21 aa, Mycobacterium tuberculosis
GKGGDAFATFAKAGNGGAGGN

SEQ ID NO: 1556241 - protein, 17 aa, Mycobacterium tuberculosis
GLALALTCGAGLLKWQD

SEQ ID NO: 1556242 - protein, 24 aa, Mycobacterium tuberculosis
GLMKTILALRHGVVPQNLHFCRLP

SEQ ID NO: 1556243 - protein, 19 aa, Mycobacterium tuberculosis
GLTDIPVRVYWPPVVRDNL

SEQ ID NO: 1556244 - protein, 18 aa, Mycobacterium tuberculosis
GMPMVPPGALGAGAEGAN

SEQ ID NO: 1556245 - protein, 22 aa, Mycobacterium tuberculosis
GNEKVWPFLELAVPAPRGHKVP

SEQ ID NO: 1556246 - protein, 22 aa, Mycobacterium tuberculosis
GNGATGGWLYGNGGAGGQGATA

SEQ ID NO: 1556247 - protein, 25 aa, Mycobacterium tuberculosis
GNGATGPWLFGDGGPTPGSTGAGAA

SEQ ID NO: 1556248 - protein, 20 aa, Mycobacterium tuberculosis
GNGGWLYGSGGNGGAGGAGP

SEQ ID NO: 1556249 - protein, 20 aa, Mycobacterium tuberculosis
GPKCLVKVIQKLSGLSINRF

SEQ ID NO: 1556250 - protein, 20 aa, Mycobacterium tuberculosis
GQDGGLLFGNGGAGYNSAAT

SEQ ID NO: 1556251 - protein, 22 aa, Mycobacterium tuberculosis
GQNGGAGGLLWGNGGNGGAGDA

SEQ ID NO: 1556252 - protein, 23 aa, Mycobacterium tuberculosis
GQNGGAGGLLWGNGGNGGAGDAA

SEQ ID NO: 1556253 - protein, 21 aa, Mycobacterium tuberculosis
GQVLVWQDMAGFSGAKTARFV

SEQ ID NO: 1556254 - protein, 19 aa, Mycobacterium tuberculosis
GSAQRWKAIRGEAGWMTTY

SEQ ID NO: 1556255 - protein, 18 aa, Mycobacterium tuberculosis
GSDSAVEALFRPMHDRLA

SEQ ID NO: 1556256 - protein, 24 aa, Mycobacterium tuberculosis
GTASLAAGTWLLRALHGTPAALGA

SEQ ID NO: 1556257 - protein, 19 aa, Mycobacterium tuberculosis
GVGGLLFGDGGNGGAGGLG

SEQ ID NO: 1556258 - protein, 21 aa, Mycobacterium tuberculosis
GVGGVAGLGGAGGAAGQLFSA

SEQ ID NO: 1556259 - protein, 17 aa, Mycobacterium tuberculosis
GVGIKLPHYSGSQYNLG

SEQ ID NO: 1556260 - protein, 24 aa, Mycobacterium tuberculosis
GVINAPTQALLGRPLIGDGANATT

SEQ ID NO: 1556261 - protein, 17 aa, Mycobacterium tuberculosis
GVPFYEESTFWNPSWTI

SEQ ID NO: 1556262 - protein, 17 aa, Mycobacterium tuberculosis
HAKPEDIRFGLYGALAH

SEQ ID NO: 1556263 - protein, 24 aa, Mycobacterium tuberculosis
HDDRGPVWVFSGQGSQWPGMGTEL

SEQ ID NO: 1556264 - protein, 37 aa, Mycobacterium tuberculosis
HGEGYQAIARQMAAFHDQFTLALTSSAGAYASAEATN

SEQ ID NO: 1556265 - protein, 20 aa, Mycobacterium tuberculosis
HIMGEVVDRSIFMWTAAPHA

SEQ ID NO: 1556266 - protein, 24 aa, Mycobacterium tuberculosis
HLLDATAALVLALVKACRGVRLLA

SEQ ID NO: 1556267 - protein, 25 aa, Mycobacterium tuberculosis
HLVKTFWGWRDQQLPDGTLILTSPS

SEQ ID NO: 1556268 - protein, 25 aa, Mycobacterium tuberculosis
HNDIEQLLVVFPMAIAAEQAGILAN

SEQ ID NO: 1556269 - protein, 17 aa, Mycobacterium tuberculosis
HPEFVDVFLAIGRVGRS

SEQ ID NO: 1556270 - protein, 24 aa, Mycobacterium tuberculosis
IAHSHQPLRWGPPEAPDRYVLVFN

SEQ ID NO: 1556271 - protein, 18 aa, Mycobacterium tuberculosis
IAMAKRTPVRKACTVLAV

SEQ ID NO: 1556272 - protein, 24 aa, Mycobacterium tuberculosis
IAPGAPPAALPPGAPPGDGPAPGV

SEQ ID NO: 1556273 - protein, 18 aa, Mycobacterium tuberculosis
IARFRDAFASDLAAHHRL

SEQ ID NO: 1556274 - protein, 20 aa, Mycobacterium tuberculosis
IDHPLAVATLLDRAALDARA

SEQ ID NO: 1556275 - protein, 27 aa, Mycobacterium tuberculosis
IDVRALELDLHYLPRLEGHGAPGVTVC

SEQ ID NO: 1556276 - protein, 18 aa, Mycobacterium tuberculosis
IEPQTSVLIGTQGGDGTP

SEQ ID NO: 1556277 - protein, 29 aa, Mycobacterium tuberculosis
IGPIIIPDTTILPPIHLGLTGQANYGFAV

SEQ ID NO: 1556278 - protein, 19 aa, Mycobacterium tuberculosis
INISIIDIPALPGFGNSTE

SEQ ID NO: 1556279 - protein, 17 aa, Mycobacterium tuberculosis
IPQLIASHTAFAAKAGL

SEQ ID NO: 1556280 - protein, 22 aa, Mycobacterium tuberculosis
IQLDRSVWPYIGAKAGGLPGDL

SEQ ID NO: 1556281 - protein, 18 aa, Mycobacterium tuberculosis
ISAILISPPQAPPGTQWT

SEQ ID NO: 1556282 - protein, 25 aa, Mycobacterium tuberculosis
ISGLSIGSPIPLSLALGTTTWTLFP

SEQ ID NO: 1556283 - protein, 20 aa, Mycobacterium tuberculosis
ISSATWPEPISYTALDRGDL

SEQ ID NO: 1556284 - protein, 18 aa, Mycobacterium tuberculosis
ITAPRGWELVRHAGPLPS

SEQ ID NO: 1556285 - protein, 17 aa, Mycobacterium tuberculosis
IVGTPRPAPRTTVGVVE

SEQ ID NO: 1556286 - protein, 20 aa, Mycobacterium tuberculosis
LAAAAAWDGLAAELGQAANS

SEQ ID NO: 1556287 - protein, 21 aa, Mycobacterium tuberculosis
LAAAAAWDGLAAELGQAANSF

SEQ ID NO: 1556288 - protein, 19 aa, Mycobacterium tuberculosis
LAGISLAWGLWEQPGGMTA

SEQ ID NO: 1556289 - protein, 25 aa, Mycobacterium tuberculosis
LAGKSVWFQRGPLDAAIRASIAIPG

SEQ ID NO: 1556290 - protein, 26 aa, Mycobacterium tuberculosis
LAGKSVWFQRGPLDAAIRASIAIPGV

SEQ ID NO: 1556291 - protein, 20 aa, Mycobacterium tuberculosis
LAGQSWQGAAAAAMAAAAAP

SEQ ID NO: 1556292 - protein, 30 aa, Mycobacterium tuberculosis
LAGVAAVAAFTAGTTAAACECTVAAGAAFA

SEQ ID NO: 1556293 - protein, 25 aa, Mycobacterium tuberculosis
LDVLNGPFQALFGRPLIGDGANGAP

SEQ ID NO: 1556294 - protein, 28 aa, Mycobacterium tuberculosis
LFCARDPFGIKPLFIATGAGGTAVASEK

SEQ ID NO: 1556295 - protein, 23 aa, Mycobacterium tuberculosis
LFDDDVFAWRGVLQSAAVHEFHE

SEQ ID NO: 1556296 - protein, 19 aa, Mycobacterium tuberculosis
LFRRLAVFVGCFFVDDAQA

SEQ ID NO: 1556297 - protein, 25 aa, Mycobacterium tuberculosis
LGARLFSIIAWRTYLVRDPHALSLL

SEQ ID NO: 1556298 - protein, 24 aa, Mycobacterium tuberculosis
LGVHRIFLITVALALLTASPASAI

SEQ ID NO: 1556299 - protein, 18 aa, Mycobacterium tuberculosis
LGVLELHPLLNPAGYVLA

SEQ ID NO: 1556300 - protein, 19 aa, Mycobacterium tuberculosis
LIGGPRMWERRPGAADFCR

SEQ ID NO: 1556301 - protein, 24 aa, Mycobacterium tuberculosis
LIRFQTAFVSGPLRRASPSAVHPV

SEQ ID NO: 1556302 - protein, 21 aa, Mycobacterium tuberculosis
LIVLAVPMPALPGMLAHIRKS

SEQ ID NO: 1556303 - protein, 21 aa, Mycobacterium tuberculosis
LLAGCALVMHKPHSAGSSNPW

SEQ ID NO: 1556304 - protein, 20 aa, Mycobacterium tuberculosis
LLALAYTATGGRALPGSVTV

SEQ ID NO: 1556305 - protein, 18 aa, Mycobacterium tuberculosis
LLDGLLAWYATIGSINNI

SEQ ID NO: 1556306 - protein, 31 aa, Mycobacterium tuberculosis
LLGAVNAPTEALLGRPLIGNGADGTAPGQPG

SEQ ID NO: 1556307 - protein, 19 aa, Mycobacterium tuberculosis
LLIANVVHEALLQRASRKL

SEQ ID NO: 1556308 - protein, 25 aa, Mycobacterium tuberculosis
LLPELLLIGQLIDRSGMAWCIQAFG

SEQ ID NO: 1556309 - protein, 23 aa, Mycobacterium tuberculosis
LLPGQFVQPFISAAFSDLGLDPA

SEQ ID NO: 1556310 - protein, 17 aa, Mycobacterium tuberculosis
LLVDFKGGATFLDLAGA

SEQ ID NO: 1556311 - protein, 17 aa, Mycobacterium tuberculosis
LNIYVRRWRTALHATVS

SEQ ID NO: 1556312 - protein, 24 aa, Mycobacterium tuberculosis
LNLPPPCTTGFLPAQQRRIPTFED

SEQ ID NO: 1556313 - protein, 23 aa, Mycobacterium tuberculosis
LNPPPMFRWMAPDPSAPMPGCTL

SEQ ID NO: 1556314 - protein, 26 aa, Mycobacterium tuberculosis
LQRLRGMFAFALWDTVTRELFCARDP

SEQ ID NO: 1556315 - protein, 24 aa, Mycobacterium tuberculosis
LSINRFIAIDFVGFARMVEALGGV

SEQ ID NO: 1556316 - protein, 21 aa, Mycobacterium tuberculosis
LTCFEIFLAIAEAGSLGGAAR

SEQ ID NO: 1556317 - protein, 17 aa, Mycobacterium tuberculosis
LTDIPVRVYWPPVVRDN

SEQ ID NO: 1556318 - protein, 29 aa, Mycobacterium tuberculosis
LTVVNAPTQALLGRPIIGNGANGLPNTGQ

SEQ ID NO: 1556319 - protein, 17 aa, Mycobacterium tuberculosis
LVATNFFGINTIPIALN

SEQ ID NO: 1556320 - protein, 28 aa, Mycobacterium tuberculosis
LVLVLGAIGIWIAIRPKPVQPPQPVAEE

SEQ ID NO: 1556321 - protein, 17 aa, Mycobacterium tuberculosis
MALLAAGADEVSAAVAA

SEQ ID NO: 1556322 - protein, 17 aa, Mycobacterium tuberculosis
MTGMPMVPPGALGAGAE

SEQ ID NO: 1556323 - protein, 37 aa, Mycobacterium tuberculosis; identical to SEQ ID NO: 220752

SEQ ID NO: 1556324 - protein, 29 aa, Mycobacterium tuberculosis
NAAVAALTPIAAGPRRARSGAGTGLAGVA

SEQ ID NO: 1556325 - protein, 17 aa, Mycobacterium tuberculosis
NASIGLGPFTIPEIHIP

SEQ ID NO: 1556326 - protein, 25 aa, Mycobacterium tuberculosis
NGGAAGLIGNGGFGGGGGPGAAGGN

SEQ ID NO: 1556327 - protein, 17 aa, Mycobacterium tuberculosis
NGGWLFGNGGAGGSGGD

SEQ ID NO: 1556328 - protein, 21 aa, Mycobacterium tuberculosis
NIEPQTSVLIGTQGGDGTPGG

SEQ ID NO: 1556329 - protein, 27 aa, Mycobacterium tuberculosis
NKVPIYPGYVCAIVASLLLDKPVKWME

SEQ ID NO: 1556330 - protein, 23 aa, Mycobacterium tuberculosis
NNPAFARIALTNAAAMLDSVETD

SEQ ID NO: 1556331 - protein, 17 aa, Mycobacterium tuberculosis
NRALVLAALAAAQGRGA

SEQ ID NO: 1556332 - protein, 34 aa, Mycobacterium tuberculosis
NVEQQVLGLINAPTQALWGRPLIGNGADGTAANP

SEQ ID NO: 1556333 - protein, 27 aa, Mycobacterium tuberculosis
NWTHPDPATLWTLIGGPRMWERRPGAA

SEQ ID NO: 1556334 - protein, 20 aa, Mycobacterium tuberculosis
PAPGVAPPPGGMPGLPFVQP

SEQ ID NO: 1556335 - protein, 17 aa, Mycobacterium tuberculosis
PAQVLGRVAFQVLAGLA

SEQ ID NO: 1556336 - protein, 21 aa, Mycobacterium tuberculosis
PASTGLTGGTGFAGGAGGVGG

SEQ ID NO: 1556337 - protein, 26 aa, Mycobacterium tuberculosis
PATLIAALPAILGFVPEKSLVLVSLA

SEQ ID NO: 1556338 - protein, 28 aa, Mycobacterium tuberculosis
PATRHPTFLAFPMMMLVSLVVTAVTGRG

SEQ ID NO: 1556339 - protein, 21 aa, Mycobacterium tuberculosis
PEVLNLLLVDFKGGATFLDLA

SEQ ID NO: 1556340 - protein, 18 aa, Mycobacterium tuberculosis
PFYEESTFWNPSWTITHG

SEQ ID NO: 1556341 - protein, 24 aa, Mycobacterium tuberculosis
PGQPGAAGGLLFGNGGNGAAGGFG

SEQ ID NO: 1556342 - protein, 19 aa, Mycobacterium tuberculosis
PGQPWPGRLPDPSPAVLFD

SEQ ID NO: 1556343 - protein, 22 aa, Mycobacterium tuberculosis
PGQYFHGITLHKNGVTANMSLA

SEQ ID NO: 1556344 - protein, 25 aa, Mycobacterium tuberculosis
PGRGTTFCTAGMVPPWNPAVGSSGG

SEQ ID NO: 1556345 - protein, 25 aa, Mycobacterium tuberculosis
PGTLNTGFFSAMTQAGPNSGFFNAG

SEQ ID NO: 1556346 - protein, 20 aa, Mycobacterium tuberculosis
PHIAMTAAMLRQAGVDIDDS

SEQ ID NO: 1556347 - protein, 24 aa, Mycobacterium tuberculosis
PLDEPPMLGALLRDAEPAQAELAV

SEQ ID NO: 1556348 - protein, 20 aa, Mycobacterium tuberculosis
PLGEPLPAAPAELAPPADLA

SEQ ID NO: 1556349 - protein, 17 aa, Mycobacterium tuberculosis
PLRRLDLKRGEPVLITA

SEQ ID NO: 1556350 - protein, 26 aa, Mycobacterium tuberculosis
PLSPQHVVSLVQFLASPAAAEVNGQV

SEQ ID NO: 1556351 - protein, 21 aa, Mycobacterium tuberculosis
PLTTILDPSLPLTVTEWDEWG

SEQ ID NO: 1556352 - protein, 18 aa, Mycobacterium tuberculosis
PNSFILATNFSFTGVTPF

SEQ ID NO: 1556353 - protein, 25 aa, Mycobacterium tuberculosis
PPEHLQWIGQWGIFDALRPGREVVR

SEQ ID NO: 1556354 - protein, 18 aa, Mycobacterium tuberculosis
PPPMFPWMAPDPSAPMPG

SEQ ID NO: 1556355 - protein, 34 aa, Mycobacterium tuberculosis
PPVGAPPFPPTAPPPPFLPAAPPPPDPLAGPPGD

SEQ ID NO: 1556356 - protein, 25 aa, Mycobacterium tuberculosis
PPYQGTVRMAFLLQGDHDAYFQHVR

SEQ ID NO: 1556357 - protein, 22 aa, Mycobacterium tuberculosis
PQQLLFFDRNIPLGSPTRNPKP

SEQ ID NO: 1556358 - protein, 22 aa, Mycobacterium tuberculosis
PRPWDPLPCANLTQGPFGGPDF

SEQ ID NO: 1556359 - protein, 21 aa, Mycobacterium tuberculosis
PSSLLATTVFFSPGNEQAAAT

SEQ ID NO: 1556360 - protein, 23 aa, Mycobacterium tuberculosis
PTPFVGPPPFRPPTFNPVDGAMV

SEQ ID NO: 1556361 - protein, 26 aa, Mycobacterium tuberculosis
PTPTITARLNFQLAFGARVGQRLADA

SEQ ID NO: 1556362 - protein, 17 aa, Mycobacterium tuberculosis
PVCVLGLGLIGGSIMRA

SEQ ID NO: 1556363 - protein, 25 aa, Mycobacterium tuberculosis
QALQQLVPRTPAALYWGARLTLVSR

SEQ ID NO: 1556364 - protein, 24 aa, Mycobacterium tuberculosis
QAVTPAARALPLTSLTSAAQTAPG

SEQ ID NO: 1556365 - protein, 18 aa, Mycobacterium tuberculosis
QDGLWLRIMNVPAALEAR

SEQ ID NO: 1556366 - protein, 23 aa, Mycobacterium tuberculosis
QEAGFTLSAPLRSLTRPSLAVNQ

SEQ ID NO: 1556367 - protein, 30 aa, Mycobacterium tuberculosis; identical to SEQ ID NO: 1519198

SEQ ID NO: 1556368 - protein, 20 aa, Mycobacterium tuberculosis
QLLATAALDLASIGSQVSAA

SEQ ID NO: 1556369 - protein, 27 aa, Mycobacterium tuberculosis
QLVDVINAPFRSALGRPLIGNGANGKP

SEQ ID NO: 1556370 - protein, 24 aa, Mycobacterium tuberculosis
QPVQRSVARFALIQALSAVLVGAG

SEQ ID NO: 1556371 - protein, 18 aa, Mycobacterium tuberculosis
QQRLWRTRESLAEVLGVY

SEQ ID NO: 1556372 - protein, 17 aa, Mycobacterium tuberculosis
QVLAAGADEVSARIAAL

SEQ ID NO: 1556373 - protein, 17 aa, Mycobacterium tuberculosis
QVRPIHRPPRKPADRHP

SEQ ID NO: 1556374 - protein, 24 aa, Mycobacterium tuberculosis
RAAPYLVGALKLILTQPFDVDTVP

SEQ ID NO: 1556375 - protein, 39 aa, Mycobacterium tuberculosis; identical to SEQ ID NO: 226768

SEQ ID NO: 1556376 - protein, 26 aa, Mycobacterium tuberculosis
RAENIVPLYRRNALTERQLLAVNEVA

SEQ ID NO: 1556377 - protein, 21 aa, Mycobacterium tuberculosis
RARVSALSAAAARAAAVAGGA

SEQ ID NO: 1556378 - protein, 17 aa, Mycobacterium tuberculosis
RDYRVLSAALLEVTFCG

SEQ ID NO: 1556379 - protein, 20 aa, Mycobacterium tuberculosis
REDWAALYKKAFAPLNELAG

SEQ ID NO: 1556380 - protein, 19 aa, Mycobacterium tuberculosis
RFVRPAIPSALSVALLVCT

SEQ ID NO: 1556381 - protein, 18 aa, Mycobacterium tuberculosis
RGFYPAEKFSRQALGLSG

SEQ ID NO: 1556382 - protein, 17 aa, Mycobacterium tuberculosis
RGGLLAGQHANSGNGGG

SEQ ID NO: 1556383 - protein, 30 aa, Mycobacterium tuberculosis
RHRAWQGLVLLVLALLLSSCGWRGISNVAI

SEQ ID NO: 1556384 - protein, 27 aa, Mycobacterium tuberculosis
RIKRQQLFLSSLLRSMISTDTLFNLSR

SEQ ID NO: 1556385 - protein, 17 aa, Mycobacterium tuberculosis
RITGWPRVSVQPADHIL

SEQ ID NO: 1556386 - protein, 22 aa, Mycobacterium tuberculosis
RLDNARFLLPVVGVPPDQATDF

SEQ ID NO: 1556387 - protein, 23 aa, Mycobacterium tuberculosis
RLDPLLPTRSGLLLNRFYGRGES

SEQ ID NO: 1556388 - protein, 17 aa, Mycobacterium tuberculosis
RLIVWELVARHSASRPA

SEQ ID NO: 1556389 - protein, 18 aa, Mycobacterium tuberculosis
RPTGTTAAALTSLPAVAA

SEQ ID NO: 1556390 - protein, 25 aa, Mycobacterium tuberculosis
RRAGRRMLALSAAAALIVALASGCS

SEQ ID NO: 1556391 - protein, 28 aa, Mycobacterium tuberculosis
RSTTDTVLRFLGGRPALVVLDNCEHLLD

SEQ ID NO: 1556392 - protein, 22 aa, Mycobacterium tuberculosis
RSVPLVGHIPSAPGNPGRWGQA

SEQ ID NO: 1556393 - protein, 18 aa, Mycobacterium tuberculosis
RSYRLHVPPAEPSGLVIS

SEQ ID NO: 1556394 - protein, 18 aa, Mycobacterium tuberculosis
RVLSIAQFWDRAAGHDRI

SEQ ID NO: 1556395 - protein, 19 aa, Mycobacterium tuberculosis
RVSISCRVREGFVMRLAIV

SEQ ID NO: 1556396 - protein, 31 aa, Mycobacterium tuberculosis; identical to SEQ ID NO: 1513470

SEQ ID NO: 1556397 - protein, 25 aa, Mycobacterium tuberculosis
SAAAAALPAFSPPAQALGGGVGAFL

SEQ ID NO: 1556398 - protein, 21 aa, Mycobacterium tuberculosis
SAFVQLVLSNVFGQNAPAIAA

SEQ ID NO: 1556399 - protein, 28 aa, Mycobacterium tuberculosis
SALLSFGLLLGGLPLAAPPLAGATEEPG

SEQ ID NO: 1556400 - protein, 18 aa, Mycobacterium tuberculosis
SAQAALFHDRFVQILQEG

SEQ ID NO: 1556401 - protein, 24 aa, Mycobacterium tuberculosis
SAQAALFHEQFVHAMTAGAGAYAG

SEQ ID NO: 1556402 - protein, 24 aa, Mycobacterium tuberculosis
SAQAQAFHAQFVQALTSGGGAYAA

SEQ ID NO: 1556403 - protein, 24 aa, Mycobacterium tuberculosis
SDDFIEWSVSFSQKPFPLPCDIAK

SEQ ID NO: 1556404 - protein, 18 aa, Mycobacterium tuberculosis
SDLDLSMFALCSSIAATV

SEQ ID NO: 1556405 - protein, 25 aa, Mycobacterium tuberculosis
SDLRVGQPVLAIGSPLGLEGTVTTG

SEQ ID NO: 1556406 - protein, 18 aa, Mycobacterium tuberculosis
SFSQKPFPLPCDIAKELT

SEQ ID NO: 1556407 - protein, 20 aa, Mycobacterium tuberculosis
SGMYFWLDYADGIEPYFSVP

SEQ ID NO: 1556408 - protein, 18 aa, Mycobacterium tuberculosis
SIPLMIGLAVPAHAGPSG

SEQ ID NO: 1556409 - protein, 17 aa, Mycobacterium tuberculosis
SLAAAARLPSGLAAACA

SEQ ID NO: 1556410 - protein, 20 aa, Mycobacterium tuberculosis
SMFGPYHLKRLLGRGGMGEV

SEQ ID NO: 1556411 - protein, 23 aa, Mycobacterium tuberculosis
SNPLANFAPGYLPTIEPAQPAVS

SEQ ID NO: 1556412 - protein, 19 aa, Mycobacterium tuberculosis
SRATLRRLYAHPQAGALVS

SEQ ID NO: 1556413 - protein, 17 aa, Mycobacterium tuberculosis
STGKIYFDVTGPSPTIV

SEQ ID NO: 1556414 - protein, 20 aa, Mycobacterium tuberculosis
STLPGAGWTAAAPQAAAGTF

SEQ ID NO: 1556415 - protein, 28 aa, Mycobacterium tuberculosis
STPGSALLFPSLCHFSGGIPAPEADPPY

SEQ ID NO: 1556416 - protein, 27 aa, Mycobacterium tuberculosis
STVPGPLQGINFGFGNIGSLNLGSGNT

SEQ ID NO: 1556417 - protein, 18 aa, Mycobacterium tuberculosis
SVAKIAFTGAVLGGGGIA

SEQ ID NO: 1556418 - protein, 25 aa, Mycobacterium tuberculosis
SVEHFNWLEGLGFQFERSYFPGKAV

SEQ ID NO: 1556419 - protein, 35 aa, Mycobacterium tuberculosis
SVQQDLLNLINAPTQALLGRPLIGNGANGLPGTGQ

SEQ ID NO: 1556420 - protein, 29 aa, Mycobacterium tuberculosis
SVQVAAFHEQFVQALTAAAGRYASTEAAV

SEQ ID NO: 1556421 - protein, 23 aa, Mycobacterium tuberculosis
SVRELAVFWTARSIGCSWCVDFG

SEQ ID NO: 1556422 - protein, 20 aa, Mycobacterium tuberculosis
TAAALWLVAPCTELYHDSRA

SEQ ID NO: 1556423 - protein, 23 aa, Mycobacterium tuberculosis
TADAHCALWRALIGLDSMERISI

SEQ ID NO: 1556424 - protein, 20 aa, Mycobacterium tuberculosis
TALHDQFVQALTGAGGSYAL

SEQ ID NO: 1556425 - protein, 25 aa, Mycobacterium tuberculosis
TCVMWTLALTRPPDVREAAVCNPPP

SEQ ID NO: 1556426 - protein, 31 aa, Mycobacterium tuberculosis
TDGRPPVIQLWARPRGVAPDALFALLCGDLS

SEQ ID NO: 1556427 - protein, 47 aa, Mycobacterium tuberculosis
TDPFTLLPNGFQITTVPVLWDGTVLFGPIQIPIINVPPTPGFGNTTT

SEQ ID NO: 1556428 - protein, 19 aa, Mycobacterium tuberculosis
TELPVMAEYQRRVGPAVLV

SEQ ID NO: 1556429 - protein, 18 aa, Mycobacterium tuberculosis
TFHEQFVRSLTAAGSAYA

SEQ ID NO: 1556430 - protein, 24 aa, Mycobacterium tuberculosis
TGAQLPCLPILFIVVDEFSELLSQ

SEQ ID NO: 1556431 - protein, 24 aa, Mycobacterium tuberculosis
TIFPNGISIPNNPLALLASASIGT

SEQ ID NO: 1556432 - protein, 18 aa, Mycobacterium tuberculosis
TLALTSSAGAYASAEATN

SEQ ID NO: 1556433 - protein, 23 aa, Mycobacterium tuberculosis
TLTLVAFWWWQRPRTNAVAADSL

SEQ ID NO: 1556434 - protein, 35 aa, Mycobacterium tuberculosis
TNVEQQVLGLINAPTQALLGRPLIGNGADGTAANP

SEQ ID NO: 1556435 - protein, 37 aa, Mycobacterium tuberculosis; identical to SEQ ID NO: 236981

SEQ ID NO: 1556436 - protein, 19 aa, Mycobacterium tuberculosis
TPNGLAINPGIGGNGGDTG

SEQ ID NO: 1556437 - protein, 20 aa, Mycobacterium tuberculosis
TPNGLAINPGIGGNGGDTGN

SEQ ID NO: 1556438 - protein, 25 aa, Mycobacterium tuberculosis
TPTGYLGPPPVPTSSPPTTPAGAPA

SEQ ID NO: 1556439 - protein, 18 aa, Mycobacterium tuberculosis
TPVRKACTVLAVLAATLL

SEQ ID NO: 1556440 - protein, 19 aa, Mycobacterium tuberculosis
TQVLAAGADEVSARIAALF

SEQ ID NO: 1556441 - protein, 22 aa, Mycobacterium tuberculosis
TRAAAAATTRLLPAAADEVSAH

SEQ ID NO: 1556442 - protein, 19 aa, Mycobacterium tuberculosis
TRAALRTCMHHKRFGELRE

SEQ ID NO: 1556443 - protein, 17 aa, Mycobacterium tuberculosis
TTVFFSPGNEQAAATVA

SEQ ID NO: 1556444 - protein, 22 aa, Mycobacterium tuberculosis
TTYPVWMMNAIGDISFHHATAE

SEQ ID NO: 1556445 - protein, 18 aa, Mycobacterium tuberculosis
TWQTGFIARFTITNSSTA

SEQ ID NO: 1556446 - protein, 20 aa, Mycobacterium tuberculosis
VADRAAVAGLFAQLSREYPP

SEQ ID NO: 1556447 - protein, 21 aa, Mycobacterium tuberculosis
VAITEFVVSPLFGSPPAAELV

SEQ ID NO: 1556448 - protein, 27 aa, Mycobacterium tuberculosis
VAPVALAVLACPLAGPAGPAAPGGPAG

SEQ ID NO: 1556449 - protein, 23 aa, Mycobacterium tuberculosis
VDHTEWAQWGSLPSLRVYPSQVG

SEQ ID NO: 1556450 - protein, 18 aa, Mycobacterium tuberculosis
VEALFRPMHDRLASAVVA

SEQ ID NO: 1556451 - protein, 26 aa, Mycobacterium tuberculosis
VENNFPLVNLLVNRGPTVPILLDTGS

SEQ ID NO: 1556452 - protein, 20 aa, Mycobacterium tuberculosis
VGGVAGLGGAGGAAGQLFSA

SEQ ID NO: 1556453 - protein, 28 aa, Mycobacterium tuberculosis
VIAVHLRGHFLLTRNAAAYWRDKAKDAE

SEQ ID NO: 1556454 - protein, 18 aa, Mycobacterium tuberculosis
VKVIQKLSGLSINRFIAI

SEQ ID NO: 1556455 - protein, 30 aa, Mycobacterium tuberculosis
VLGAINAPTQLWLGRPLIGDGVHGAPGTGQ

SEQ ID NO: 1556456 - protein, 22 aa, Mycobacterium tuberculosis
VMSFVVAVPEALAAAASDVANI

SEQ ID NO: 1556457 - protein, 18 aa, Mycobacterium tuberculosis
VQRLPLNVTWVNLTTGKS

SEQ ID NO: 1556458 - protein, 25 aa, Mycobacterium tuberculosis
VSAAIAALFGAHGQAYQTVSAQASA

SEQ ID NO: 1556459 - protein, 26 aa, Mycobacterium tuberculosis
VSGEGCVVLLLKRLPDAVRDGDRVLA

SEQ ID NO: 1556460 - protein, 27 aa, Mycobacterium tuberculosis
VSMESRARLFPRGLAAFIELRDQRCRT

SEQ ID NO: 1556461 - protein, 18 aa, Mycobacterium tuberculosis
VTSPLAITMGFAACEAAQ

SEQ ID NO: 1556462 - protein, 18 aa, Mycobacterium tuberculosis
VVAANRSAFVQLVLSNVF

SEQ ID NO: 1556463 - protein, 27 aa, Mycobacterium tuberculosis
VVFSQGVAIMIWTLMNARNSRDSLLTT

SEQ ID NO: 1556464 - protein, 23 aa, Mycobacterium tuberculosis
VVNEPFQTLTGRPLIGNGANGTP

SEQ ID NO: 1556465 - protein, 18 aa, Mycobacterium tuberculosis
WERRPGAADFCRIRVGVG

SEQ ID NO: 1556466 - protein, 27 aa, Mycobacterium tuberculosis
WESVLLARIRPRRRPRRVLLLCDVSRS

SEQ ID NO: 1556467 - protein, 23 aa, Mycobacterium tuberculosis
WHNWRVTWNPSGMYFWLDYADGI

SEQ ID NO: 1556468 - protein, 17 aa, Mycobacterium tuberculosis
WKNVRLPERTRYVLSIT

SEQ ID NO: 1556469 - protein, 17 aa, Mycobacterium tuberculosis
WLPPLDEPPMLGALLRD

SEQ ID NO: 1556470 - protein, 33 aa, Mycobacterium tuberculosis; identical to SEQ ID NO: 237814

SEQ ID NO: 1556471 - protein, 20 aa, Mycobacterium tuberculosis
YCRTHHLVKTFWGWRDQQLP

SEQ ID NO: 1556472 - protein, 19 aa, Mycobacterium tuberculosis
YGAPARLDNARFLLPVVGV

SEQ ID NO: 1556473 - protein, 21 aa, Mycobacterium tuberculosis
YPSAGIEQLIFAPQGSLAQSR

SEQ ID NO: 1556474 - protein, 18 aa, Mycobacterium tuberculosis
YQRLPFFNQGTRVSAYFA

SEQ ID NO: 1556475 - protein, 17 aa, Mycobacterium tuberculosis
YRQQLLSTDFRAGCPIA

SEQ ID NO: 1556476 - protein, 18 aa, Mycobacterium tuberculosis
YSDGRPVTCDDLVLAWAA

SEQ ID NO: 1556477 - protein, 25 aa, Mycobacterium tuberculosis
YTDAAQPIWWVVRAIEFSKDFETFV

SEQ ID NO: 1556478 - protein, 33 aa, Mycobacterium tuberculosis
AAAAALPSWQQALRGLPGLGQVASAISGGAARM

SEQ ID NO: 1556479 - protein, 21 aa, Mycobacterium tuberculosis
AAAAAPYAGWLGSVAAQAVAV

SEQ ID NO: 1556480 - protein, 23 aa, Mycobacterium tuberculosis
AAAAAPYASWLSTAATRALSAAA

SEQ ID NO: 1556481 - protein, 22 aa, Mycobacterium tuberculosis
AAAAAPYLSWLNAATARAEGAA

SEQ ID NO: 1556482 - protein, 27 aa, Mycobacterium tuberculosis
AAAALPSWQQALRGLPGLGQVASAISG

SEQ ID NO: 1556483 - protein, 20 aa, Mycobacterium tuberculosis
AAAAPVWPAPISGCRGFSTS

SEQ ID NO: 1556484 - protein, 19 aa, Mycobacterium tuberculosis
AAAAPYAGWLAAAAARAAG

SEQ ID NO: 1556485 - protein, 21 aa, Mycobacterium tuberculosis
AAAASPYVGWLSTVASQAQLA

SEQ ID NO: 1556486 - protein, 35 aa, Mycobacterium tuberculosis
AAAEAAATSPLLAPINEFFLANTGRPLIGNGTNGA

SEQ ID NO: 1556487 - protein, 24 aa, Mycobacterium tuberculosis
AAAEFDYELMWAQDVAAMLGYHTG

SEQ ID NO: 1556488 - protein, 28 aa, Mycobacterium tuberculosis
AAAEQLVPFQQALQQLPNLGIGNIGNAN

SEQ ID NO: 1556489 - protein, 25 aa, Mycobacterium tuberculosis
AAAFAAATLLLTPALAPPASARCPD

SEQ ID NO: 1556490 - protein, 19 aa, Mycobacterium tuberculosis
AAALAPTTALLAAGADEVS

SEQ ID NO: 1556491 - protein, 20 aa, Mycobacterium tuberculosis
AAALDVARIGSSIGAANAAA

SEQ ID NO: 1556492 - protein, 18 aa, Mycobacterium tuberculosis
AAALPALAAGGLPPGLPA

SEQ ID NO: 1556493 - protein, 25 aa, Mycobacterium tuberculosis
AAALPSWQQALRGLPGLGQVASAIS

SEQ ID NO: 1556494 - protein, 32 aa, Mycobacterium tuberculosis
AAAPAPASAAEWLPRVIIPEATISALPPASPE

SEQ ID NO: 1556495 - protein, 19 aa, Mycobacterium tuberculosis
AAASAWTGLAGDLGSAAAS

SEQ ID NO: 1556496 - protein, 18 aa, Mycobacterium tuberculosis
AADDFWYLWQQMVTQPGV

SEQ ID NO: 1556497 - protein, 53 aa, Mycobacterium tuberculosis
AADEVSAAIAGLFGAHARQYQALSVQVAAFHEQFVQALTAAAGRYASTEVAVE

SEQ ID NO: 1556498 - protein, 17 aa, Mycobacterium tuberculosis
AAEALAPFGSPLASLAA

SEQ ID NO: 1556499 - protein, 26 aa, Mycobacterium tuberculosis
AAFAVAGLILAGWAGSVGLAGADPEP

SEQ ID NO: 1556500 - protein, 19 aa, Mycobacterium tuberculosis
AAFHDQFVHTLTAAARWYT

SEQ ID NO: 1556501 - protein, 29 aa, Mycobacterium tuberculosis
AAGADAEWMLDSVRLGVPLGPAVRAGGCT

SEQ ID NO: 1556502 - protein, 23 aa, Mycobacterium tuberculosis
AAGFGYPYAIAPPGIGFGSGMSA

SEQ ID NO: 1556503 - protein, 17 aa, Mycobacterium tuberculosis
AAGLFGNGGSGGSGGAG

SEQ ID NO: 1556504 - protein, 19 aa, Mycobacterium tuberculosis
AAGLLGVGGHGGAGGHGAE

SEQ ID NO: 1556505 - protein, 18 aa, Mycobacterium tuberculosis
AAGQLFSASGAAGNAGVG

SEQ ID NO: 1556506 - protein, 24 aa, Mycobacterium tuberculosis
AAGSAIPGLPPGLPPGVVANLAAT

SEQ ID NO: 1556507 - protein, 26 aa, Mycobacterium tuberculosis
AAHLSSWSIGLQQALPAAPSALAAAI

SEQ ID NO: 1556508 - protein, 24 aa, Mycobacterium tuberculosis
AAHQSIVGNRLRLALDSDLCAAVT

SEQ ID NO: 1556509 - protein, 24 aa, Mycobacterium tuberculosis
AAIAALFGAHARAYQALSAQAAMF

SEQ ID NO: 1556510 - protein, 20 aa, Mycobacterium tuberculosis
AAIAALFSAHGRAYQVASAQ

SEQ ID NO: 1556511 - protein, 25 aa, Mycobacterium tuberculosis
AAIAFATDCARIARVRPCGAVGAVA

SEQ ID NO: 1556512 - protein, 18 aa, Mycobacterium tuberculosis
AAIASLFGAHGQAYQAVS

SEQ ID NO: 1556513 - protein, 27 aa, Mycobacterium tuberculosis
AAIASLFSGYARDYQALSAQMARFHQQ

SEQ ID NO: 1556514 - protein, 26 aa, Mycobacterium tuberculosis
AAINAPTQTLLGRPLIANGADGLPGQ

SEQ ID NO: 1556515 - protein, 24 aa, Mycobacterium tuberculosis
AAINAPTQTLTGRPLIGNGTPGGG

SEQ ID NO: 1556516 - protein, 25 aa, Mycobacterium tuberculosis
AAINARFERIFGRPLIGDGANGGPG

SEQ ID NO: 1556517 - protein, 17 aa, Mycobacterium tuberculosis
AAIPRRRTDRRAYSCWP

SEQ ID NO: 1556518 - protein, 21 aa, Mycobacterium tuberculosis
AALAIPALGVENIGVGNFLGI

SEQ ID NO: 1556519 - protein, 18 aa, Mycobacterium tuberculosis
AALAYAVDVKNAVIVAAA

SEQ ID NO: 1556520 - protein, 17 aa, Mycobacterium tuberculosis
AALFGMHGQAYQALSVQ

SEQ ID NO: 1556521 - protein, 19 aa, Mycobacterium tuberculosis
AALPLARLQFHCQPAGSYH

SEQ ID NO: 1556522 - protein, 20 aa, Mycobacterium tuberculosis
AALYWGARLTLVSRVDELAT

SEQ ID NO: 1556523 - protein, 25 aa, Mycobacterium tuberculosis
AAPATTALSLGWVATEVRAALAAMV

SEQ ID NO: 1556524 - protein, 25 aa, Mycobacterium tuberculosis
AAPEEMPIKIILLGATPPGAMVVPA

SEQ ID NO: 1556525 - protein, 24 aa, Mycobacterium tuberculosis
AAPPARARTPLPVPTPRGERPDDG

SEQ ID NO: 1556526 - protein, 22 aa, Mycobacterium tuberculosis
AAQGLAELTLNLGVGNIGSLNL

SEQ ID NO: 1556527 - protein, 20 aa, Mycobacterium tuberculosis
AAQPGSRLYRNGERGVWKAD

SEQ ID NO: 1556528 - protein, 18 aa, Mycobacterium tuberculosis
AAQPVAVPGPPPAPASGF

SEQ ID NO: 1556529 - protein, 24 aa, Mycobacterium tuberculosis
AAQTAPGHMLGGLPLGQLTNSGGG

SEQ ID NO: 1556530 - protein, 23 aa, Mycobacterium tuberculosis
AARVYRRLPPCPGWVRPAVSGLP

SEQ ID NO: 1556531 - protein, 18 aa, Mycobacterium tuberculosis
AASPLQALQLELLNAINA

SEQ ID NO: 1556532 - protein, 18 aa, Mycobacterium tuberculosis
AATAVVWAAAAELAALII

SEQ ID NO: 1556533 - protein, 17 aa, Mycobacterium tuberculosis
AATLGLAALGFAGTASA

SEQ ID NO: 1556534 - protein, 18 aa, Mycobacterium tuberculosis
AATLLALAGGLGAAGYFA

SEQ ID NO: 1556535 - protein, 17 aa, Mycobacterium tuberculosis
AATLLLITTAACSRPGT

SEQ ID NO: 1556536 - protein, 19 aa, Mycobacterium tuberculosis
AATLPYCDLFLPAHSLAGL

SEQ ID NO: 1556537 - protein, 24 aa, Mycobacterium tuberculosis
AATTTWPAHLRPALTTAGFATELR

SEQ ID NO: 1556538 - protein, 26 aa, Mycobacterium tuberculosis
AATVAPVARVVSVVTAPRGGPGGSGG

SEQ ID NO: 1556539 - protein, 26 aa, Mycobacterium tuberculosis
AATVGPFSMPVPPAPPARAVTAVLAG

SEQ ID NO: 1556540 - protein, 20 aa, Mycobacterium tuberculosis
AAVHAQFVEALSAGAGAYAS

SEQ ID NO: 1556541 - protein, 23 aa, Mycobacterium tuberculosis
AAVSALMPFTQQLKKLAGLSERL

SEQ ID NO: 1556542 - protein, 40 aa, Mycobacterium tuberculosis
AAVYEAARAATVDPLLVAANRHQLVSLVLSNLFGQNAPAI

SEQ ID NO: 1556543 - protein, 22 aa, Mycobacterium tuberculosis
AAWPPRVSVLVTLLGCWPASRW

SEQ ID NO: 1556544 - protein, 20 aa, Mycobacterium tuberculosis
ACEITLQPIRRYDVDAAILF

SEQ ID NO: 1556545 - protein, 19 aa, Mycobacterium tuberculosis
ACRSLMTVKAISLLPVCGV

SEQ ID NO: 1556546 - protein, 17 aa, Mycobacterium tuberculosis
ACTTHVPLSPAPSPRPP

SEQ ID NO: 1556547 - protein, 24 aa, Mycobacterium tuberculosis
ADAPASTGLTGGTGFAGGAGGVGG

SEQ ID NO: 1556548 - protein, 29 aa, Mycobacterium tuberculosis
ADASLSHPYLDTVLFLLGVTRGEIEAADA

SEQ ID NO: 1556549 - protein, 23 aa, Mycobacterium tuberculosis
ADDSRLGWPLRPPPAVVRQFDAA

SEQ ID NO: 1556550 - protein, 51 aa, Mycobacterium tuberculosis; identical to SEQ ID NO: 237495

SEQ ID NO: 1556551 - protein, 26 aa, Mycobacterium tuberculosis
ADFADLFPVPAKLWTIADLGGWGSVD

SEQ ID NO: 1556552 - protein, 22 aa, Mycobacterium tuberculosis
ADGINSRVLWQAAGPDTISGAT

SEQ ID NO: 1556553 - protein, 25 aa, Mycobacterium tuberculosis
ADGPMAHLPLIDLTPRQAALNPPTD

SEQ ID NO: 1556554 - protein, 29 aa, Mycobacterium tuberculosis
ADGVIWARYNVPWQPAFVFYRADGTSTFV

SEQ ID NO: 1556555 - protein, 24 aa, Mycobacterium tuberculosis
ADLQSLLVPPAPGPAPAPPAPGAG

SEQ ID NO: 1556556 - protein, 22 aa, Mycobacterium tuberculosis
ADNPVIFWTPEHGAFVVRGALN

SEQ ID NO: 1556557 - protein, 18 aa, Mycobacterium tuberculosis
ADPFRRPSWEEITEVLEW

SEQ ID NO: 1556558 - protein, 19 aa, Mycobacterium tuberculosis
ADTAGTPATTKPDERPSRP

SEQ ID NO: 1556559 - protein, 40 aa, Mycobacterium tuberculosis
AEAAAAEQIVLGVINAPTQALLGRPLIGDGANATTPGGAG

SEQ ID NO: 1556560 - protein, 17 aa, Mycobacterium tuberculosis
AEILKIITGGRVIWDPE

SEQ ID NO: 1556561 - protein, 27 aa, Mycobacterium tuberculosis
AELLRPGLLVLPVRGPARFFGSEQMAA

SEQ ID NO: 1556562 - protein, 18 aa, Mycobacterium tuberculosis
AELSSRLPPRGLTQAARR

SEQ ID NO: 1556563 - protein, 23 aa, Mycobacterium tuberculosis
AELVAWLEQLLSDSVLRDQLGAK

SEQ ID NO: 1556564 - protein, 24 aa, Mycobacterium tuberculosis
AENIVPLYRRNALTERKLLAVNEV

SEQ ID NO: 1556565 - protein, 24 aa, Mycobacterium tuberculosis
AENIVPLYRRNALTERQLLAVNEV

SEQ ID NO: 1556566 - protein, 32 aa, Mycobacterium tuberculosis; identical to SEQ ID NO: 215746

SEQ ID NO: 1556567 - protein, 20 aa, Mycobacterium tuberculosis
AERNGVPVRALWASSGQAPS

SEQ ID NO: 1556568 - protein, 18 aa, Mycobacterium tuberculosis
AFDKRRFSRRGFLGAGIA

SEQ ID NO: 1556569 - protein, 17 aa, Mycobacterium tuberculosis
AFFIGHSGLLNSGGGQH

SEQ ID NO: 1556570 - protein, 25 aa, Mycobacterium tuberculosis
AFGASFLARIFPPGSHIPIPFIEYT

SEQ ID NO: 1556571 - protein, 18 aa, Mycobacterium tuberculosis
AFHDQFTLALTSSAGAYA

SEQ ID NO: 1556572 - protein, 18 aa, Mycobacterium tuberculosis
AFHEQFVQALTAAAGRYA

SEQ ID NO: 1556573 - protein, 26 aa, Mycobacterium tuberculosis
AFLAGRIGFPAIVGIIADVLHAADQW

SEQ ID NO: 1556574 - protein, 25 aa, Mycobacterium tuberculosis
AFVNALPVFIASDPVWAKKFTDARV

SEQ ID NO: 1556575 - protein, 40 aa, Mycobacterium tuberculosis; identical to SEQ ID NO: 215804

SEQ ID NO: 1556576 - protein, 54 aa, Mycobacterium tuberculosis
AGADEVSARIAALFGGFGLEYQAISAQVAAYHQRFVQALSTGAGAYASAEAAAA

SEQ ID NO: 1556577 - protein, 19 aa, Mycobacterium tuberculosis
AGAGWVAPGAPAAPATRGP

SEQ ID NO: 1556578 - protein, 17 aa, Mycobacterium tuberculosis
AGAPGQAGGPGGPAGLW

SEQ ID NO: 1556579 - protein, 33 aa, Mycobacterium tuberculosis; identical to SEQ ID NO: 1520460

SEQ ID NO: 1556580 - protein, 34 aa, Mycobacterium tuberculosis; identical to SEQ ID NO: 161793

SEQ ID NO: 1556581 - protein, 20 aa, Mycobacterium tuberculosis
AGARLYRKLTTTTVVAYFSE

SEQ ID NO: 1556582 - protein, 18 aa, Mycobacterium tuberculosis
AGCLLFGNGGFGVAGASG

SEQ ID NO: 1556583 - protein, 22 aa, Mycobacterium tuberculosis
AGCYSVMAATVAPVARVVSVVT

SEQ ID NO: 1556584 - protein, 28 aa, Mycobacterium tuberculosis
AGDGGTGGRGGWLAGAGGAGGAGGVGGT

SEQ ID NO: 1556585 - protein, 18 aa, Mycobacterium tuberculosis
AGDLASIGSSINASTRAA

SEQ ID NO: 1556586 - protein, 21 aa, Mycobacterium tuberculosis
AGDLASIGSSINASTRAAAAA

SEQ ID NO: 1556587 - protein, 22 aa, Mycobacterium tuberculosis
AGGAAGQLFSASGAAGNAGVGG

SEQ ID NO: 1556588 - protein, 25 aa, Mycobacterium tuberculosis
AGGAGGLLAGLLAGPGGAGGTGGRG

SEQ ID NO: 1556589 - protein, 26 aa, Mycobacterium tuberculosis
AGGAGGSGGWLLGNGGVGGAGGQSLL

SEQ ID NO: 1556590 - protein, 17 aa, Mycobacterium tuberculosis
AGGAGGWLYGDAGAGGD

SEQ ID NO: 1556591 - protein, 23 aa, Mycobacterium tuberculosis
AGGISGLLLGADGFNAPASASPL

SEQ ID NO: 1556592 - protein, 25 aa, Mycobacterium tuberculosis
AGGISGLLLGADGFNTPASASPLHT

SEQ ID NO: 1556593 - protein, 18 aa, Mycobacterium tuberculosis
AGGLLAGLVGAGGGNGGA

SEQ ID NO: 1556594 - protein, 17 aa, Mycobacterium tuberculosis
AGGLTIPTNAIPLTIDA

SEQ ID NO: 1556595 - protein, 24 aa, Mycobacterium tuberculosis
AGGNAGLFGVGGTGGPGGPGGPGG

SEQ ID NO: 1556596 - protein, 23 aa, Mycobacterium tuberculosis
AGGNAGLLFGAAGVGGAGGFTNG

SEQ ID NO: 1556597 - protein, 24 aa, Mycobacterium tuberculosis
AGGNAGLLGVGGAGGHGASGGAGD

SEQ ID NO: 1556598 - protein, 23 aa, Mycobacterium tuberculosis
AGGNAGWLGFGGAGGIGGIGGNA

SEQ ID NO: 1556599 - protein, 22 aa, Mycobacterium tuberculosis
AGGNGAIVWYRWCRRRPRQPGR

SEQ ID NO: 1556600 - protein, 21 aa, Mycobacterium tuberculosis
AGGNGGWLFGNGGAGGSGGDG

SEQ ID NO: 1556601 - protein, 28 aa, Mycobacterium tuberculosis
AGGPGGAGGLISLLGGQGAGGAGGTGGA

SEQ ID NO: 1556602 - protein, 25 aa, Mycobacterium tuberculosis
AGGSGGHALLWGAGGAGGNGGSGGT

SEQ ID NO: 1556603 - protein, 20 aa, Mycobacterium tuberculosis
AGGSGGLLWGNGGAGGAGGN

SEQ ID NO: 1556604 - protein, 21 aa, Mycobacterium tuberculosis
AGGSGGWLYGNGGNGGIGGNA

SEQ ID NO: 1556605 - protein, 25 aa, Mycobacterium tuberculosis
AGGTGGLLFGAGGNGGPGGSGGAAD

SEQ ID NO: 1556606 - protein, 17 aa, Mycobacterium tuberculosis
AGGWLFGNGGNGGQGTI

SEQ ID NO: 1556607 - protein, 17 aa, Mycobacterium tuberculosis
AGKYMLVEFTDGLPPRL

SEQ ID NO: 1556608 - protein, 23 aa, Mycobacterium tuberculosis
AGLAANGAWLFGNGGAGGGGGKG

SEQ ID NO: 1556609 - protein, 18 aa, Mycobacterium tuberculosis
AGLGLVFLGADPLRSPVR

SEQ ID NO: 1556610 - protein, 24 aa, Mycobacterium tuberculosis
AGLIKTILCLKNKALPATLHYTSP

SEQ ID NO: 1556611 - protein, 17 aa, Mycobacterium tuberculosis
AGLLFGSGGAGGAGGFG

SEQ ID NO: 1556612 - protein, 18 aa, Mycobacterium tuberculosis
AGLPALPAGLPPLPAVPA

SEQ ID NO: 1556613 - protein, 32 aa, Mycobacterium tuberculosis
AGLPPLPAVPALPAPPPLPGPPPLPALPSRLC

SEQ ID NO: 1556614 - protein, 27 aa, Mycobacterium tuberculosis
AGNEPGFGVPWLYNYIGQPWKTQRDGR

SEQ ID NO: 1556615 - protein, 18 aa, Mycobacterium tuberculosis
AGPRYGFRVTVMSRPPFA

SEQ ID NO: 1556616 - protein, 17 aa, Mycobacterium tuberculosis
AGQLRPRVRKDPKIQMR

SEQ ID NO: 1556617 - protein, 32 aa, Mycobacterium tuberculosis
AGQPMMPVIADQPIITAIKPAARPAPHFCDVR

SEQ ID NO: 1556618 - protein, 22 aa, Mycobacterium tuberculosis
AGQQFLRPLHPPIASTRARVQR

SEQ ID NO: 1556619 - protein, 18 aa, Mycobacterium tuberculosis
AGQSWQGAAAAAMAAAAA

SEQ ID NO: 1556620 - protein, 28 aa, Mycobacterium tuberculosis
AGRGTRLPVWLTQWGYRRPAEDTVDIGI

SEQ ID NO: 1556621 - protein, 25 aa, Mycobacterium tuberculosis
AGRNYLYDAWAARFLVTARLNNSLP

SEQ ID NO: 1556622 - protein, 24 aa, Mycobacterium tuberculosis
AGVSVWLDDLSRDRLRSGNLQELI

SEQ ID NO: 1556623 - protein, 26 aa, Mycobacterium tuberculosis
AGVVSPGFIGAPLALAALGQMARGGT

SEQ ID NO: 1556624 - protein, 18 aa, Mycobacterium tuberculosis
AGWLSAAAARAAGAAAQA

SEQ ID NO: 1556625 - protein, 18 aa, Mycobacterium tuberculosis
AHAGQYQQLGARAALFHE

SEQ ID NO: 1556626 - protein, 36 aa, Mycobacterium tuberculosis
AHAQAYQALSAQAALFHEQFVHAMTAGAGAYAGAEA

SEQ ID NO: 1556627 - protein, 20 aa, Mycobacterium tuberculosis
AHCFDPADPFRRPSWEEITE

SEQ ID NO: 1556628 - protein, 25 aa, Mycobacterium tuberculosis
AHLDVNIPIDIPITGSFTDLVVDNF

SEQ ID NO: 1556629 - protein, 27 aa, Mycobacterium tuberculosis
AHPAASVAALAPAAWAAPAPAAAPTAT

SEQ ID NO: 1556630 - protein, 19 aa, Mycobacterium tuberculosis
AHQARILLAKNPAGWQEAL

SEQ ID NO: 1556631 - protein, 47 aa, Mycobacterium tuberculosis
AHTAIGTGRNPRWRRRIRFCRRRRYRPAPPLAADAAVDGAWAPPFPP

SEQ ID NO: 1556632 - protein, 17 aa, Mycobacterium tuberculosis
AIAALFSAHGRAYQVAS

SEQ ID NO: 1556633 - protein, 26 aa, Mycobacterium tuberculosis
AIAIDERALAQRPAWLAAAEALTTEG

SEQ ID NO: 1556634 - protein, 28 aa, Mycobacterium tuberculosis
AIAVKDPPRPRPPAQSPAPPSAPVADQG

SEQ ID NO: 1556635 - protein, 29 aa, Mycobacterium tuberculosis
AIGLGAALLIAALLLSTYTTSRIAEIPLD

SEQ ID NO: 1556636 - protein, 19 aa, Mycobacterium tuberculosis
AIGMLSVPPAWAGQATLVS

SEQ ID NO: 1556637 - protein, 20 aa, Mycobacterium tuberculosis
AIGMLSVPPAWAGQATLVST

SEQ ID NO: 1556638 - protein, 24 aa, Mycobacterium tuberculosis
AIKTKGLLGSKFLDVTPAGTADSI

SEQ ID NO: 1556639 - protein, 17 aa, Mycobacterium tuberculosis
AIMLGLAYVLATESLAD

SEQ ID NO: 1556640 - protein, 24 aa, Mycobacterium tuberculosis
AINAPTQTLLGRPLIGNGADGLPG

SEQ ID NO: 1556641 - protein, 25 aa, Mycobacterium tuberculosis
AINAPTQTLLGRPLIGNGADGLPGQ

SEQ ID NO: 1556642 - protein, 17 aa, Mycobacterium tuberculosis
AIPAMKGATGADGTAPT

SEQ ID NO: 1556643 - protein, 24 aa, Mycobacterium tuberculosis
AIRGNRVLIGFSLPGKTIGMQSRA

SEQ ID NO: 1556644 - protein, 18 aa, Mycobacterium tuberculosis
AISALVLPSAFRPIPDPN

SEQ ID NO: 1556645 - protein, 20 aa, Mycobacterium tuberculosis
AITLWLGMVAQFGQMITGGS

SEQ ID NO: 1556646 - protein, 20 aa, Mycobacterium tuberculosis
AIVDALRILLSNPAVWEKTA

SEQ ID NO: 1556647 - protein, 19 aa, Mycobacterium tuberculosis
AKAPPSPYPARALAGGLHT

SEQ ID NO: 1556648 - protein, 27 aa, Mycobacterium tuberculosis
AKAVDLLARIMGSSYQRLVAAGVAKFF

SEQ ID NO: 1556649 - protein, 19 aa, Mycobacterium tuberculosis
AKLRCRLTDGSKTYGISVI

SEQ ID NO: 1556650 - protein, 22 aa, Mycobacterium tuberculosis
AKSLGWRAAPIPRNAPGCRGCC

SEQ ID NO: 1556651 - protein, 23 aa, Mycobacterium tuberculosis
AKYAALGYLKYPKAVTVASVMDP

SEQ ID NO: 1556652 - protein, 26 aa, Mycobacterium tuberculosis
ALAALLAVAGLFVPFIVGVPTAYDGE

SEQ ID NO: 1556653 - protein, 26 aa, Mycobacterium tuberculosis
ALAHPSVHLLPRPLRSRVPIVLSRCW

SEQ ID NO: 1556654 - protein, 19 aa, Mycobacterium tuberculosis
ALAMGVVLGSGFFSDTLLS

SEQ ID NO: 1556655 - protein, 24 aa, Mycobacterium tuberculosis
ALATLLQHWGISPDFLIGHSVGEI

SEQ ID NO: 1556656 - protein, 24 aa, Mycobacterium tuberculosis
ALDMYFNLANYRNNWKRLGFTDDE

SEQ ID NO: 1556657 - protein, 18 aa, Mycobacterium tuberculosis
ALERTFPLALSALIQEAI

SEQ ID NO: 1556658 - protein, 17 aa, Mycobacterium tuberculosis
ALGIYPGAAELGAEGAG

SEQ ID NO: 1556659 - protein, 18 aa, Mycobacterium tuberculosis
ALHDQFVQALTGAGGSYA

SEQ ID NO: 1556660 - protein, 27 aa, Mycobacterium tuberculosis
ALHSCSPDLPWDLLQRSRISAVSVDAS

SEQ ID NO: 1556661 - protein, 18 aa, Mycobacterium tuberculosis
ALITAVVLLIALGAVWTP

SEQ ID NO: 1556662 - protein, 17 aa, Mycobacterium tuberculosis
ALLFGNGGAGGAGGAGG

SEQ ID NO: 1556663 - protein, 23 aa, Mycobacterium tuberculosis
ALMRPRIASRVLGKWARTRLSGQ

SEQ ID NO: 1556664 - protein, 24 aa, Mycobacterium tuberculosis
ALPPAPPCPPVWLPCPPSPPAPPA

SEQ ID NO: 1556665 - protein, 20 aa, Mycobacterium tuberculosis
ALPTARRPWRFGRHDQRVAH

SEQ ID NO: 1556666 - protein, 17 aa, Mycobacterium tuberculosis
ALQLELLNAINAPTLAL

SEQ ID NO: 1556667 - protein, 20 aa, Mycobacterium tuberculosis
ALQRRWWAARGRGAFASVDG

SEQ ID NO: 1556668 - protein, 26 aa, Mycobacterium tuberculosis
ALRGDRTMFLFVFRAEHDNPGVAPKD

SEQ ID NO: 1556669 - protein, 18 aa, Mycobacterium tuberculosis
ALRLLATDAIVVLVSAQQ

SEQ ID NO: 1556670 - protein, 27 aa, Mycobacterium tuberculosis
ALSAQAALFHEQFVHAMTAGAGAYAGA

SEQ ID NO: 1556671 - protein, 25 aa, Mycobacterium tuberculosis
ALSAQAALFHEQFVRALTAGAGSYA

SEQ ID NO: 1556672 - protein, 31 aa, Mycobacterium tuberculosis
ALSAQATIFHDQFVQALTSGGNLYAAAESHT

SEQ ID NO: 1556673 - protein, 27 aa, Mycobacterium tuberculosis
ALSAQMARFHQQFVHALTASVGSYAAA

SEQ ID NO: 1556674 - protein, 29 aa, Mycobacterium tuberculosis
ALSAQMARFHQQFVQALTASVGSYAAAEA

SEQ ID NO: 1556675 - protein, 31 aa, Mycobacterium tuberculosis
ALSARVATFHEQFVRSLTAAGSAYATAEAAN

SEQ ID NO: 1556676 - protein, 27 aa, Mycobacterium tuberculosis
ALSASPTVIRRYFRYHRRLRQRRRWRR

SEQ ID NO: 1556677 - protein, 25 aa, Mycobacterium tuberculosis
ALSRAVAVAWRRSLQLRVVALTLGL

SEQ ID NO: 1556678 - protein, 26 aa, Mycobacterium tuberculosis
ALSRAVAVAWRRSLQLRVVALTLGLS

SEQ ID NO: 1556679 - protein, 32 aa, Mycobacterium tuberculosis; identical to SEQ ID NO: 216144

SEQ ID NO: 1556680 - protein, 21 aa, Mycobacterium tuberculosis
ALTSPGLTPTLPGSLAAPGTT

SEQ ID NO: 1556681 - protein, 19 aa, Mycobacterium tuberculosis
ALYWGARLTLVSRVDELAT

SEQ ID NO: 1556682 - protein, 23 aa, Mycobacterium tuberculosis
AMAAAAAPYAGWLAAAAARAAGA

SEQ ID NO: 1556683 - protein, 25 aa, Mycobacterium tuberculosis
AMAAAAAPYAGWLGSVAAAAEAVAG

SEQ ID NO: 1556684 - protein, 29 aa, Mycobacterium tuberculosis
AMAAIATFAAPVALAAYLITGKLGSELTM

SEQ ID NO: 1556685 - protein, 25 aa, Mycobacterium tuberculosis
AMAGAAAPYVGWLSAAAGQAELSAG

SEQ ID NO: 1556686 - protein, 21 aa, Mycobacterium tuberculosis
AMEANWALLLLDDDGAGERAR

SEQ ID NO: 1556687 - protein, 17 aa, Mycobacterium tuberculosis
AMGVVLGSGFFSDTLLS

SEQ ID NO: 1556688 - protein, 18 aa, Mycobacterium tuberculosis
AMHDMFVNTLGISAGTYG

SEQ ID NO: 1556689 - protein, 24 aa, Mycobacterium tuberculosis
AMIAAASLLPKSWIAVGTGRADDV

SEQ ID NO: 1556690 - protein, 17 aa, Mycobacterium tuberculosis
AMPFIVLATDNPIEYEG

SEQ ID NO: 1556691 - protein, 17 aa, Mycobacterium tuberculosis
AMPLGIWVFSPLRRRAT

SEQ ID NO: 1556692 - protein, 20 aa, Mycobacterium tuberculosis
AMQSGWMTWSRRGMMRWARG

SEQ ID NO: 1556693 - protein, 17 aa, Mycobacterium tuberculosis
AMTASAEYLRLLRRHNV

SEQ ID NO: 1556694 - protein, 25 aa, Mycobacterium tuberculosis
AMTVPPAEVAANRALLAALVATNVL

SEQ ID NO: 1556695 - protein, 21 aa, Mycobacterium tuberculosis
AMVARWVVPAGRAVPAAPVAP

SEQ ID NO: 1556696 - protein, 17 aa, Mycobacterium tuberculosis
AMYEQMWAADVAAMVGY

SEQ ID NO: 1556697 - protein, 17 aa, Mycobacterium tuberculosis
ANGAMVLDLRQLPGDIN

SEQ ID NO: 1556698 - protein, 21 aa, Mycobacterium tuberculosis
ANGAPGGWLLGNGGAGGSAAA

SEQ ID NO: 1556699 - protein, 28 aa, Mycobacterium tuberculosis
ANLDQLIGFFINIVVLRNDLRGNPTLRE

SEQ ID NO: 1556700 - protein, 32 aa, Mycobacterium tuberculosis
ANLRSDPFVAILRFPFIPQAMREHYAELEIKA

SEQ ID NO: 1556701 - protein, 24 aa, Mycobacterium tuberculosis
ANRGRLRSLVASNLLGQNAPAIAA

SEQ ID NO: 1556702 - protein, 21 aa, Mycobacterium tuberculosis
ANTGIFDIGLANLGSYNIGLA

SEQ ID NO: 1556703 - protein, 21 aa, Mycobacterium tuberculosis
APAAAPYAGWLGSVAAQAVAV

SEQ ID NO: 1556704 - protein, 18 aa, Mycobacterium tuberculosis
APADLITEYGPHVALPPT

SEQ ID NO: 1556705 - protein, 20 aa, Mycobacterium tuberculosis
APADLITEYGPHVALPPTEL

SEQ ID NO: 1556706 - protein, 23 aa, Mycobacterium tuberculosis
APALLALPAAESAWRLAAGGGGT

SEQ ID NO: 1556707 - protein, 26 aa, Mycobacterium tuberculosis
APASASPLHTLKQQALAAINAPTQTL

SEQ ID NO: 1556708 - protein, 19 aa, Mycobacterium tuberculosis
APEIPYYSATLWDPRERPS

SEQ ID NO: 1556709 - protein, 27 aa, Mycobacterium tuberculosis
APGAPPFAPLPPVFPFTPNAAPGTTCC

SEQ ID NO: 1556710 - protein, 17 aa, Mycobacterium tuberculosis
APGLVPRPGVPAAAAVP

SEQ ID NO: 1556711 - protein, 25 aa, Mycobacterium tuberculosis
APINAQFVAATRRPLIGNGANGAPG

SEQ ID NO: 1556712 - protein, 17 aa, Mycobacterium tuberculosis
APPPIAHSTVLVAPVSP

SEQ ID NO: 1556713 - protein, 21 aa, Mycobacterium tuberculosis
APTETLLGRPLIGDGAPGTAT

SEQ ID NO: 1556714 - protein, 19 aa, Mycobacterium tuberculosis
APTLLTLNTPRQFRVSLYA

SEQ ID NO: 1556715 - protein, 20 aa, Mycobacterium tuberculosis
APTQTLLGRPLIGDGAHGTA

SEQ ID NO: 1556716 - protein, 21 aa, Mycobacterium tuberculosis
APTQTLLGRPLIGNGADGLPG

SEQ ID NO: 1556717 - protein, 19 aa, Mycobacterium tuberculosis
APTQTLVGRPLIGDGTHGA

SEQ ID NO: 1556718 - protein, 24 aa, Mycobacterium tuberculosis
APTTSLLFKYNPECTCFLQGAKWY

SEQ ID NO: 1556719 - protein, 25 aa, Mycobacterium tuberculosis
APVALAVLACPLAGPAGPAAPGGPA

SEQ ID NO: 1556720 - protein, 18 aa, Mycobacterium tuberculosis
APVTGFYSLRYSSTALER

SEQ ID NO: 1556721 - protein, 22 aa, Mycobacterium tuberculosis
AQAAAFYAQFVQALSAGGGAYA

SEQ ID NO: 1556722 - protein, 28 aa, Mycobacterium tuberculosis
AQAAAVPVVFLTAWYGLADLAEIKAGES

SEQ ID NO: 1556723 - protein, 17 aa, Mycobacterium tuberculosis
AQATALHDQFVQALTGA

SEQ ID NO: 1556724 - protein, 18 aa, Mycobacterium tuberculosis
AQDKLVMRQRLAAAGVAV

SEQ ID NO: 1556725 - protein, 23 aa, Mycobacterium tuberculosis
AQLADLDQVWRLTRGAGQRVAVI

SEQ ID NO: 1556726 - protein, 17 aa, Mycobacterium tuberculosis
AQLLAALGRRYDGDERL

SEQ ID NO: 1556727 - protein, 18 aa, Mycobacterium tuberculosis
AQLVAVPGPPPVPPAPRA

SEQ ID NO: 1556728 - protein, 24 aa, Mycobacterium tuberculosis
AQMARFHQQFVQALTASVGSYAAA

SEQ ID NO: 1556729 - protein, 26 aa, Mycobacterium tuberculosis
AQSFTSVPMLFATPTYYAQFADTGGI

SEQ ID NO: 1556730 - protein, 22 aa, Mycobacterium tuberculosis
AQTAPGHMLGGLPLGHSVNAGS

SEQ ID NO: 1556731 - protein, 26 aa, Mycobacterium tuberculosis
AQTVARWLVLYLRRPGGQTQFAAPVW

SEQ ID NO: 1556732 - protein, 17 aa, Mycobacterium tuberculosis
ARAALFHEQFVQALTGA

SEQ ID NO: 1556733 - protein, 24 aa, Mycobacterium tuberculosis
ARATPFTMRTWARLLSEVGAPDQR

SEQ ID NO: 1556734 - protein, 24 aa, Mycobacterium tuberculosis
ARERRRGQRGQRPSVKRWQRDRRK

SEQ ID NO: 1556735 - protein, 18 aa, Mycobacterium tuberculosis
ARFCLATAGLAGAVPPVA

SEQ ID NO: 1556736 - protein, 23 aa, Mycobacterium tuberculosis
ARFGNMLSVSLIFVLETMVQQAE

SEQ ID NO: 1556737 - protein, 20 aa, Mycobacterium tuberculosis
ARHRAMIQAFVQWRAQSRSE

SEQ ID NO: 1556738 - protein, 24 aa, Mycobacterium tuberculosis
ARHSSRRPGWPCPPIWNSPSPDPP

SEQ ID NO: 1556739 - protein, 17 aa, Mycobacterium tuberculosis
ARIVLRLLLDRTSVIEA

SEQ ID NO: 1556740 - protein, 23 aa, Mycobacterium tuberculosis
ARRHRAATAAACRAAAGPRGHGG

SEQ ID NO: 1556741 - protein, 22 aa, Mycobacterium tuberculosis
ARSPRLRSPLALMVATRGARSP

SEQ ID NO: 1556742 - protein, 23 aa, Mycobacterium tuberculosis
ARSPRLRSPLALMVATRGARSPR

SEQ ID NO: 1556743 - protein, 20 aa, Mycobacterium tuberculosis
ARVARLVFGAWEPKTGAVGS

SEQ ID NO: 1556744 - protein, 27 aa, Mycobacterium tuberculosis
ARYGPRAPQLWLPPLDETIPLSAALAR

SEQ ID NO: 1556745 - protein, 51 aa, Mycobacterium tuberculosis
ASAFEAARAATVHPLLVAANRNAFAQLVMSNWFGLNAPLIAAVEGAYEQMW

SEQ ID NO: 1556746 - protein, 21 aa, Mycobacterium tuberculosis
ASAMASVFHRDDPEWRSTVDD

SEQ ID NO: 1556747 - protein, 38 aa, Mycobacterium tuberculosis
ASGCCDLAGCVLAAWGWVVMSFVVAVPEALAAAASDVA

SEQ ID NO: 1556748 - protein, 24 aa, Mycobacterium tuberculosis
ASGPYFKVLLANLVPGQILQPFVD

SEQ ID NO: 1556749 - protein, 31 aa, Mycobacterium tuberculosis; identical to SEQ ID NO: 216420

SEQ ID NO: 1556750 - protein, 23 aa, Mycobacterium tuberculosis
ASMVAAVTPYVAWLSATAGQAEQ

SEQ ID NO: 1556751 - protein, 25 aa, Mycobacterium tuberculosis
ASTNHILGFPFTSHGLRLGVEASLR

SEQ ID NO: 1556752 - protein, 21 aa, Mycobacterium tuberculosis
ATAAVLITAPAVHSALRSGAS

SEQ ID NO: 1556753 - protein, 17 aa, Mycobacterium tuberculosis
ATAEALERTFPLALSAL

SEQ ID NO: 1556754 - protein, 24 aa, Mycobacterium tuberculosis
ATAFRNFQYTVQAQKLWAQAGFRP

SEQ ID NO: 1556755 - protein, 27 aa, Mycobacterium tuberculosis
ATAGLGPITIPIIDIPAAPGIGNSTTS

SEQ ID NO: 1556756 - protein, 25 aa, Mycobacterium tuberculosis
ATAVTVALAVLPAVRVGPEGSSAVP

SEQ ID NO: 1556757 - protein, 20 aa, Mycobacterium tuberculosis
ATFHEQFVRSLTAAGSAYAT

SEQ ID NO: 1556758 - protein, 17 aa, Mycobacterium tuberculosis
ATGAKYLYGPLLDKYES

SEQ ID NO: 1556759 - protein, 21 aa, Mycobacterium tuberculosis
ATGAKYLYGPLLDKYESLGGA

SEQ ID NO: 1556760 - protein, 24 aa, Mycobacterium tuberculosis
ATGLPELGAWLAGGRPVHRCYPCC

SEQ ID NO: 1556761 - protein, 20 aa, Mycobacterium tuberculosis
ATGLYAMHQVLAAAGRGIPT

SEQ ID NO: 1556762 - protein, 21 aa, Mycobacterium tuberculosis
ATGSAGIGGAGGRGGDGGDGA

SEQ ID NO: 1556763 - protein, 25 aa, Mycobacterium tuberculosis
ATGVFPVDLPPITGPPPPLGDAHLE

SEQ ID NO: 1556764 - protein, 32 aa, Mycobacterium tuberculosis
ATPGGAVIIAGFPFLDLGNVTIGGFNLASGNL

SEQ ID NO: 1556765 - protein, 29 aa, Mycobacterium tuberculosis
ATQRVKANLFYRGLRFHRFPAVGDTLYTR

SEQ ID NO: 1556766 - protein, 26 aa, Mycobacterium tuberculosis
ATRGSAWLGSPRRWRRAGLARCLPAG

SEQ ID NO: 1556767 - protein, 20 aa, Mycobacterium tuberculosis
ATRVARPDLLALGALLHDIG

SEQ ID NO: 1556768 - protein, 32 aa, Mycobacterium tuberculosis
ATTTTYLVPVNHLPLTLPLRYLGMSDAEVDQI

SEQ ID NO: 1556769 - protein, 19 aa, Mycobacterium tuberculosis
ATVQPAVVAANRGLMQLLA

SEQ ID NO: 1556770 - protein, 27 aa, Mycobacterium tuberculosis
ATVVVAGWWTPPAWAIGPPVVDAAAQP

SEQ ID NO: 1556771 - protein, 19 aa, Mycobacterium tuberculosis
AVAAFAPGVCKVGGRTLRG

SEQ ID NO: 1556772 - protein, 20 aa, Mycobacterium tuberculosis
AVAVTYLVLAVNALESSGHP

SEQ ID NO: 1556773 - protein, 28 aa, Mycobacterium tuberculosis
AVCRGPNLGWRVVRGRRDRQRHVGTRSA

SEQ ID NO: 1556774 - protein, 17 aa, Mycobacterium tuberculosis
AVDIPALNLRRQLRAIW

SEQ ID NO: 1556775 - protein, 22 aa, Mycobacterium tuberculosis
AVEPRARWERLYHLCESCLGAS

SEQ ID NO: 1556776 - protein, 24 aa, Mycobacterium tuberculosis
AVEPRARWERLYHLVNHVLEHHGD

SEQ ID NO: 1556777 - protein, 17 aa, Mycobacterium tuberculosis
AVGDAVMGFLGGAGPLA

SEQ ID NO: 1556778 - protein, 22 aa, Mycobacterium tuberculosis
AVGGLYVHWIVTGIAPGSGSTA

SEQ ID NO: 1556779 - protein, 25 aa, Mycobacterium tuberculosis
AVGRAVRWRLSGLGLRVIAHDPYRD

SEQ ID NO: 1556780 - protein, 18 aa, Mycobacterium tuberculosis
AVHAQFVEALSAGAGAYA

SEQ ID NO: 1556781 - protein, 32 aa, Mycobacterium tuberculosis
AVKWALAARVGPAVLARTPALNGSAGANGTAP

SEQ ID NO: 1556782 - protein, 20 aa, Mycobacterium tuberculosis
AVLAGPVRPAGKAGPAVAAA

SEQ ID NO: 1556783 - protein, 19 aa, Mycobacterium tuberculosis
AVLGLGFGGAAGAGGAATG

SEQ ID NO: 1556784 - protein, 18 aa, Mycobacterium tuberculosis
AVLQLRGAGGLPSAAIGG

SEQ ID NO: 1556785 - protein, 19 aa, Mycobacterium tuberculosis
AVLVFPHAGGAAAAYRWLA

SEQ ID NO: 1556786 - protein, 17 aa, Mycobacterium tuberculosis
AVNAPTEALLGRPLIGN

SEQ ID NO: 1556787 - protein, 25 aa, Mycobacterium tuberculosis
AVNAPTEALLGRPLIGNGADGTAPG

SEQ ID NO: 1556788 - protein, 25 aa, Mycobacterium tuberculosis
AVNRPTPLMLPSVAVRAAFGEFADE

SEQ ID NO: 1556789 - protein, 33 aa, Mycobacterium tuberculosis; identical to SEQ ID NO: 225996

SEQ ID NO: 1556790 - protein, 22 aa, Mycobacterium tuberculosis
AVPLNSQYRWPAMAGAAVAVTR

SEQ ID NO: 1556791 - protein, 19 aa, Mycobacterium tuberculosis
AVPPLQPIPGVASVSPANG

SEQ ID NO: 1556792 - protein, 17 aa, Mycobacterium tuberculosis
AVPPPRTTQPPAAPPRG

SEQ ID NO: 1556793 - protein, 19 aa, Mycobacterium tuberculosis
AVQLARLWGLEVFATASRG

SEQ ID NO: 1556794 - protein, 23 aa, Mycobacterium tuberculosis
AVSAWVELHARFGRLPFETLFEP

SEQ ID NO: 1556795 - protein, 22 aa, Mycobacterium tuberculosis
AVSFTTLRLIYQEMLANYRVGQ

SEQ ID NO: 1556796 - protein, 30 aa, Mycobacterium tuberculosis; identical to SEQ ID NO: 1391625

SEQ ID NO: 1556797 - protein, 31 aa, Mycobacterium tuberculosis; identical to SEQ ID NO: 216597

SEQ ID NO: 1556798 - protein, 20 aa, Mycobacterium tuberculosis
AVVMLLVAAGLVVVFGDFRF

SEQ ID NO: 1556799 - protein, 25 aa, Mycobacterium tuberculosis
AWAAAIGLMVPIGLAPPAMAAPCSG

SEQ ID NO: 1556800 - protein, 18 aa, Mycobacterium tuberculosis
AWAAQSGRFPGFDAATQA

SEQ ID NO: 1556801 - protein, 21 aa, Mycobacterium tuberculosis
AWLVWFGGGFIPLVPGAPTPP

SEQ ID NO: 1556802 - protein, 18 aa, Mycobacterium tuberculosis
AYAVLRKAAQRAGDALPR

SEQ ID NO: 1556803 - protein, 18 aa, Mycobacterium tuberculosis
AYDRAATIGTLNVYRRNS

SEQ ID NO: 1556804 - protein, 18 aa, Mycobacterium tuberculosis
AYEQMWALDVAAMAGYHF

SEQ ID NO: 1556805 - protein, 24 aa, Mycobacterium tuberculosis
AYHQRFVQALSTGAVGYCLGRGRR

SEQ ID NO: 1556806 - protein, 19 aa, Mycobacterium tuberculosis
AYPASMLIGPMMQLAQMGT

SEQ ID NO: 1556807 - protein, 27 aa, Mycobacterium tuberculosis
CAASPAGWLFVSRWTAGGNSLHIRAGD

SEQ ID NO: 1556808 - protein, 30 aa, Mycobacterium tuberculosis
CALMGAFPMRLILATMLVAGRLLATLMAAP

SEQ ID NO: 1556809 - protein, 22 aa, Mycobacterium tuberculosis
CAMCRGELRAGLRSERRGQRAA

SEQ ID NO: 1556810 - protein, 25 aa, Mycobacterium tuberculosis
CGAIGAGRTLHGWNGALAAGPTLAG

SEQ ID NO: 1556811 - protein, 29 aa, Mycobacterium tuberculosis
CGDTDRVTLFRAWYSRRNFGQLSGSVQIS

SEQ ID NO: 1556812 - protein, 26 aa, Mycobacterium tuberculosis
CGELGLPYLVLARPPWDPGTAIIAVS

SEQ ID NO: 1556813 - protein, 18 aa, Mycobacterium tuberculosis
CHAARLWMDAQPGSGESL

SEQ ID NO: 1556814 - protein, 19 aa, Mycobacterium tuberculosis
CHRLDGIPLAIELAASRVR

SEQ ID NO: 1556815 - protein, 23 aa, Mycobacterium tuberculosis
CKQNPIFDPLQPDDPRAWNAVTT

SEQ ID NO: 1556816 - protein, 17 aa, Mycobacterium tuberculosis
CLLMFARRDLTAAEASA

SEQ ID NO: 1556817 - protein, 17 aa, Mycobacterium tuberculosis
CLVPMCRVWIAGSPRMA

SEQ ID NO: 1556818 - protein, 18 aa, Mycobacterium tuberculosis
CRCLFKKKKKTNKKKKKK

SEQ ID NO: 1556819 - protein, 26 aa, Mycobacterium tuberculosis
CRGPNLGWRVVRGRRDRQRHVGTRSA

SEQ ID NO: 1556820 - protein, 24 aa, Mycobacterium tuberculosis
CSLVVSFLVPQCVWYARADPPAPA

SEQ ID NO: 1556821 - protein, 17 aa, Mycobacterium tuberculosis
CVFWLPAVNRPGGPGGP

SEQ ID NO: 1556822 - protein, 28 aa, Mycobacterium tuberculosis
CVGNNGMNFPGWAFWCPSTGFEAAVGRM

SEQ ID NO: 1556823 - protein, 22 aa, Mycobacterium tuberculosis
DAAAPLLRPRKPWGNGRGGNAW

SEQ ID NO: 1556824 - protein, 21 aa, Mycobacterium tuberculosis
DAAQPVAVPGPPPAPPAPRAA

SEQ ID NO: 1556825 - protein, 22 aa, Mycobacterium tuberculosis
DAAQPVAVPGPPPAPPAPRAAA

SEQ ID NO: 1556826 - protein, 25 aa, Mycobacterium tuberculosis
DAENTLGSWLPPGPAAVADYPTVLL

SEQ ID NO: 1556827 - protein, 27 aa, Mycobacterium tuberculosis
DAEPGRITVILALHDLINGGYVGHYGT

SEQ ID NO: 1556828 - protein, 23 aa, Mycobacterium tuberculosis
DAFVQLVMTNLFGQNAPLIAAAE

SEQ ID NO: 1556829 - protein, 22 aa, Mycobacterium tuberculosis
DAGGRRILVCARSATSRRAQRL

SEQ ID NO: 1556830 - protein, 17 aa, Mycobacterium tuberculosis
DAGGRWSAGWSGGGGSG

SEQ ID NO: 1556831 - protein, 17 aa, Mycobacterium tuberculosis
DAHFTGAFRPGGRPAHP

SEQ ID NO: 1556832 - protein, 19 aa, Mycobacterium tuberculosis
DAIVGWRQAGGNLATLLAS

SEQ ID NO: 1556833 - protein, 28 aa, Mycobacterium tuberculosis
DAKPAQVALAWLISLPGVVAIPGASSVE

SEQ ID NO: 1556834 - protein, 23 aa, Mycobacterium tuberculosis
DAPASTGLTGGTGFAGGAGGVGG

SEQ ID NO: 1556835 - protein, 23 aa, Mycobacterium tuberculosis
DASGLIQYAYAGAGLKLPRSSGQ

SEQ ID NO: 1556836 - protein, 24 aa, Mycobacterium tuberculosis
DASGLIQYAYAGAGLKLPRSSGQM

SEQ ID NO: 1556837 - protein, 20 aa, Mycobacterium tuberculosis
DASLRLLPRGGRFIEMGKTE

SEQ ID NO: 1556838 - protein, 27 aa, Mycobacterium tuberculosis
DAYTNPGTLMWWIARSLELLQDFQEFA

SEQ ID NO: 1556839 - protein, 21 aa, Mycobacterium tuberculosis
DCSTRSTSRYRTPAGCTRAPT

SEQ ID NO: 1556840 - protein, 18 aa, Mycobacterium tuberculosis
DDLPIIRQPSTHTIFVLG

SEQ ID NO: 1556841 - protein, 21 aa, Mycobacterium tuberculosis
DDVGFLVALAAKLVHDFDIAP

SEQ ID NO: 1556842 - protein, 24 aa, Mycobacterium tuberculosis
DDVNLRRLLSLFEQLREQSQIIII

SEQ ID NO: 1556843 - protein, 19 aa, Mycobacterium tuberculosis
DEFCLLDGLLAWYATIGSI

SEQ ID NO: 1556844 - protein, 23 aa, Mycobacterium tuberculosis
DEFCLLDGLLAWYATIGSINNIN

SEQ ID NO: 1556845 - protein, 17 aa, Mycobacterium tuberculosis
DEPVADPALVPLFFVAR

SEQ ID NO: 1556846 - protein, 26 aa, Mycobacterium tuberculosis
DEVNLLHDHLVDILLDAAAMGRVHVE

SEQ ID NO: 1556847 - protein, 28 aa, Mycobacterium tuberculosis
DEVSAAIAALFSSYARDYQTLSVQVTAF

SEQ ID NO: 1556848 - protein, 21 aa, Mycobacterium tuberculosis
DEVSLAISALFGQHAQAYQAL

SEQ ID NO: 1556849 - protein, 24 aa, Mycobacterium tuberculosis
DEVSVLIAALFEAYAQEYQALSAQ

SEQ ID NO: 1556850 - protein, 25 aa, Mycobacterium tuberculosis
DEVSVLIAALFEAYAQEYQALSAQA

SEQ ID NO: 1556851 - protein, 24 aa, Mycobacterium tuberculosis
DEYRGHVIYRTELYERATAQRFAD

SEQ ID NO: 1556852 - protein, 18 aa, Mycobacterium tuberculosis
DFEHYLGCKVAACVVDGY

SEQ ID NO: 1556853 - protein, 17 aa, Mycobacterium tuberculosis
DFVAITRSLALFVSALY

SEQ ID NO: 1556854 - protein, 23 aa, Mycobacterium tuberculosis
DGAEWIHLVDLDAAFGRGSNHEL

SEQ ID NO: 1556855 - protein, 29 aa, Mycobacterium tuberculosis
DGCRFACDYALLAVPYLTLRELAKSAHVK

SEQ ID NO: 1556856 - protein, 24 aa, Mycobacterium tuberculosis
DGGAGPLLIGNGGVGGLGGAGAAG

SEQ ID NO: 1556857 - protein, 22 aa, Mycobacterium tuberculosis
DGGPGGLLFGNGGNGGSGGVDQ

SEQ ID NO: 1556858 - protein, 19 aa, Mycobacterium tuberculosis
DGGPGMFGGPGGAGGSGGT

SEQ ID NO: 1556859 - protein, 17 aa, Mycobacterium tuberculosis
DGGWLFGDGGAGGTGGN

SEQ ID NO: 1556860 - protein, 19 aa, Mycobacterium tuberculosis
DGHPMCVCGRIGAFTQHLK

SEQ ID NO: 1556861 - protein, 21 aa, Mycobacterium tuberculosis
DGKVHRHWGFGGGPHRCLGSH

SEQ ID NO: 1556862 - protein, 17 aa, Mycobacterium tuberculosis
DGLAAELGMAAASFSLL

SEQ ID NO: 1556863 - protein, 25 aa, Mycobacterium tuberculosis
DGLVITATPLRPGIWPAYADHRMAM

SEQ ID NO: 1556864 - protein, 18 aa, Mycobacterium tuberculosis
DGQMFLEMRLVEGTDLDS

SEQ ID NO: 1556865 - protein, 23 aa, Mycobacterium tuberculosis
DGRLVDAPLPSWTHRTLMLSRED

SEQ ID NO: 1556866 - protein, 24 aa, Mycobacterium tuberculosis
DGRQRGLGVRQRRPRRSRRGRARR

SEQ ID NO: 1556867 - protein, 21 aa, Mycobacterium tuberculosis
DGVPVLYRPSDLATLTDGAGP

SEQ ID NO: 1556868 - protein, 20 aa, Mycobacterium tuberculosis
DHGYPARIIVPALPGVHNTK

SEQ ID NO: 1556869 - protein, 21 aa, Mycobacterium tuberculosis
DHTVPLLGRRIAVIGIGSTGV

SEQ ID NO: 1556870 - protein, 19 aa, Mycobacterium tuberculosis
DIEILLTATMLRCGRPTAC

SEQ ID NO: 1556871 - protein, 17 aa, Mycobacterium tuberculosis
DIGLANLGSYNIGFGNF

SEQ ID NO: 1556872 - protein, 17 aa, Mycobacterium tuberculosis
DIGLANLGSYNIGLANL

SEQ ID NO: 1556873 - protein, 18 aa, Mycobacterium tuberculosis
DILAPTTSLLLKYNPEYT

SEQ ID NO: 1556874 - protein, 17 aa, Mycobacterium tuberculosis
DIPIHIPINIDAGVVTL

SEQ ID NO: 1556875 - protein, 19 aa, Mycobacterium tuberculosis
DIPRVPVTLNYLFGSQPGG

SEQ ID NO: 1556876 - protein, 18 aa, Mycobacterium tuberculosis
DIRLEPDSILRVLAMHRF

SEQ ID NO: 1556877 - protein, 23 aa, Mycobacterium tuberculosis
DISLRNWIATLTLELEPTVRLPA

SEQ ID NO: 1556878 - protein, 18 aa, Mycobacterium tuberculosis
DLAALRRVAAGADVLTFD

SEQ ID NO: 1556879 - protein, 17 aa, Mycobacterium tuberculosis
DLAEVWFGTGRNAQVDA

SEQ ID NO: 1556880 - protein, 19 aa, Mycobacterium tuberculosis
DLGYTLSCRRAHRPVRTVV

SEQ ID NO: 1556881 - protein, 20 aa, Mycobacterium tuberculosis
DLGYTLSCRRAHRPVRTVVT

SEQ ID NO: 1556882 - protein, 22 aa, Mycobacterium tuberculosis
DLHKMRRLIIASEPVHAEGMRR

SEQ ID NO: 1556883 - protein, 19 aa, Mycobacterium tuberculosis
DLPPIVDLRTRLLPSSPRV

SEQ ID NO: 1556884 - protein, 23 aa, Mycobacterium tuberculosis
DLPRRYYRAIAKMADTAWFVIRE

SEQ ID NO: 1556885 - protein, 26 aa, Mycobacterium tuberculosis
DLRAQLQRLTALLQPTRPGGVSTLGA

SEQ ID NO: 1556886 - protein, 25 aa, Mycobacterium tuberculosis
DLVCDDLVPYRTLVTQAPVGVMVGH

SEQ ID NO: 1556887 - protein, 25 aa, Mycobacterium tuberculosis
DLVFVADGILGGAISFGGHVWDHAA

SEQ ID NO: 1556888 - protein, 28 aa, Mycobacterium tuberculosis
DLVVDNFTIPIIGFESFAFSFHIHTEPD

SEQ ID NO: 1556889 - protein, 17 aa, Mycobacterium tuberculosis
DLYFDVVSQIRMDRWSR

SEQ ID NO: 1556890 - protein, 24 aa, Mycobacterium tuberculosis
DMPIATLAAMRRGEQLPFGLRGFV

SEQ ID NO: 1556891 - protein, 23 aa, Mycobacterium tuberculosis
DNPYPVVVNGRIVWIVDAYTTLD

SEQ ID NO: 1556892 - protein, 20 aa, Mycobacterium tuberculosis
DPARAARVLGFRAAVDPGEG

SEQ ID NO: 1556893 - protein, 45 aa, Mycobacterium tuberculosis
DPFTLLPNGFQITTVPVLWDGTVLFGPIQIPIINVPPTPGFGNTT

SEQ ID NO: 1556894 - protein, 46 aa, Mycobacterium tuberculosis
DPFTLLPNGFQITTVPVLWDGTVLFGPIQIPIINVPPTPGFGNTTT

SEQ ID NO: 1556895 - protein, 18 aa, Mycobacterium tuberculosis
DPLRSPVRVNPGARYRAM

SEQ ID NO: 1556896 - protein, 31 aa, Mycobacterium tuberculosis
DPPAPAPRPILPPLAPGQVLRIGPTAGTGTP

SEQ ID NO: 1556897 - protein, 25 aa, Mycobacterium tuberculosis
DPTPSTVICLLQPANGRQPMPPSRP

SEQ ID NO: 1556898 - protein, 24 aa, Mycobacterium tuberculosis
DPTVAAFTTVLATLARGGGIGTLG

SEQ ID NO: 1556899 - protein, 21 aa, Mycobacterium tuberculosis
DPVLVGERLIGPLYAHGVAGA

SEQ ID NO: 1556900 - protein, 25 aa, Mycobacterium tuberculosis
DQLRTELLRRGIVFAMARVKQDLRE

SEQ ID NO: 1556901 - protein, 21 aa, Mycobacterium tuberculosis
DRGPVWVFSGQGSQWAGMGAD

SEQ ID NO: 1556902 - protein, 26 aa, Mycobacterium tuberculosis
DRNRAHWDWLKWLPHNQHPNACDALG

SEQ ID NO: 1556903 - protein, 25 aa, Mycobacterium tuberculosis
DRQRHASLLPLLHNYREPAKPICGS

SEQ ID NO: 1556904 - protein, 20 aa, Mycobacterium tuberculosis
DRTYFLNFDTIGSPELIMLE

SEQ ID NO: 1556905 - protein, 17 aa, Mycobacterium tuberculosis
DRYWGPPSKPGIILFRR

SEQ ID NO: 1556906 - protein, 27 aa, Mycobacterium tuberculosis
DSEAMLLAAIYVAALRSYGFAAHAETA

SEQ ID NO: 1556907 - protein, 19 aa, Mycobacterium tuberculosis
DSMRAGLQALAWIAHQPEA

SEQ ID NO: 1556908 - protein, 17 aa, Mycobacterium tuberculosis
DSPAALRLLATDAIVVL

SEQ ID NO: 1556909 - protein, 19 aa, Mycobacterium tuberculosis
DTAWFVIREQNLRFDWMKD

SEQ ID NO: 1556910 - protein, 25 aa, Mycobacterium tuberculosis
DTDAALVGALAWAAFTAARRIGTWI

SEQ ID NO: 1556911 - protein, 19 aa, Mycobacterium tuberculosis
DTFYTCLYRSLLHPNTFND

SEQ ID NO: 1556912 - protein, 22 aa, Mycobacterium tuberculosis
DTIAPGLVPRPGVPAAAAVPRV

SEQ ID NO: 1556913 - protein, 18 aa, Mycobacterium tuberculosis
DTPYSGVAAIFRSAVEKG

SEQ ID NO: 1556914 - protein, 18 aa, Mycobacterium tuberculosis
DTSPYSVAYLIDSHQDRT

SEQ ID NO: 1556915 - protein, 28 aa, Mycobacterium tuberculosis
DVDKKRPFYFGVLTWYMDRVLELVHDDL

SEQ ID NO: 1556916 - protein, 18 aa, Mycobacterium tuberculosis
DVDYPLLAKMRSASRRAL

SEQ ID NO: 1556917 - protein, 24 aa, Mycobacterium tuberculosis
DVLGIPFYVWDFAEKFKEDVINDF

SEQ ID NO: 1556918 - protein, 21 aa, Mycobacterium tuberculosis
DVMVSWLPCFHDMGMVGFLTI

SEQ ID NO: 1556919 - protein, 18 aa, Mycobacterium tuberculosis
DVNGGLAGIGGNAGFVGN

SEQ ID NO: 1556920 - protein, 26 aa, Mycobacterium tuberculosis
DVPPLPPLPPLPISPAPPPAPPAPPV

SEQ ID NO: 1556921 - protein, 20 aa, Mycobacterium tuberculosis
DWADEVYVFGYPRVPMTAEM

SEQ ID NO: 1556922 - protein, 17 aa, Mycobacterium tuberculosis
DYPTVLLSGAWLSQEQT

SEQ ID NO: 1556923 - protein, 22 aa, Mycobacterium tuberculosis
DYSDPIVWAFNCALNVVSTTPQ

SEQ ID NO: 1556924 - protein, 23 aa, Mycobacterium tuberculosis
DYYWCPGQPFDPAWGPNWDPYTC

SEQ ID NO: 1556925 - protein, 25 aa, Mycobacterium tuberculosis
EAAFYRLSSLRLWPDRRLSRRGVEI

SEQ ID NO: 1556926 - protein, 23 aa, Mycobacterium tuberculosis
EAAKPFVRWLTDLCVQLSEVERQ

SEQ ID NO: 1556927 - protein, 21 aa, Mycobacterium tuberculosis
EALAPFGSPLASLAAAAEPAK

SEQ ID NO: 1556928 - protein, 31 aa, Mycobacterium tuberculosis
EALDRTGLWGRLLPEWEPIRDLPPRDVAHKW

SEQ ID NO: 1556929 - protein, 17 aa, Mycobacterium tuberculosis
EALTMAASDLANIGSTI

SEQ ID NO: 1556930 - protein, 19 aa, Mycobacterium tuberculosis
EALVAVASDLAGIGSALAE

SEQ ID NO: 1556931 - protein, 24 aa, Mycobacterium tuberculosis
EARPIRIDRFELLAARRRDQLIDI

SEQ ID NO: 1556932 - protein, 27 aa, Mycobacterium tuberculosis
EASAVALSLTPFTPSPSAAATPGGAVI

SEQ ID NO: 1556933 - protein, 17 aa, Mycobacterium tuberculosis
EASWTHSPKHPPDLHLS

SEQ ID NO: 1556934 - protein, 23 aa, Mycobacterium tuberculosis
EATYEQMWAADVAAMVGYHGGAS

SEQ ID NO: 1556935 - protein, 23 aa, Mycobacterium tuberculosis
EAVYEQMWAADVAAMLGYHGEAS

SEQ ID NO: 1556936 - protein, 20 aa, Mycobacterium tuberculosis
ECQLRRRSGRFRAVSHLRGL

SEQ ID NO: 1556937 - protein, 26 aa, Mycobacterium tuberculosis
EDFWRSAGLPAYRWPDPNGSRFPNGA

SEQ ID NO: 1556938 - protein, 25 aa, Mycobacterium tuberculosis
EDFWRSAGLPAYRWPDPNGTRFPNG

SEQ ID NO: 1556939 - protein, 20 aa, Mycobacterium tuberculosis
EDHWYSTGADFKRPAPHWWF

SEQ ID NO: 1556940 - protein, 20 aa, Mycobacterium tuberculosis
EDIRFGLYGALAHPMESAAL

SEQ ID NO: 1556941 - protein, 33 aa, Mycobacterium tuberculosis
EDRSALHQPWPRATWPWLATTYALELGVDIAGL

SEQ ID NO: 1556942 - protein, 51 aa, Mycobacterium tuberculosis
EDSCPNHATYRTWLTRLLRDGKKNKKIFFFFFFFFLKKKKKKKKKKKKKKK

SEQ ID NO: 1556943 - protein, 24 aa, Mycobacterium tuberculosis
EELDRHLRLPLRNVLWEGDEALLT

SEQ ID NO: 1556944 - protein, 23 aa, Mycobacterium tuberculosis
EELRKMFNSLGIQYGPAFSGLVA

SEQ ID NO: 1556945 - protein, 34 aa, Mycobacterium tuberculosis
EESLQVVAPVRRRGLFRLDAGVVAAIEQQRPRLD

SEQ ID NO: 1556946 - protein, 17 aa, Mycobacterium tuberculosis
EETLRYEPPFRGHYRHV

SEQ ID NO: 1556947 - protein, 17 aa, Mycobacterium tuberculosis
EFCLLDGLLAWYATIGS

SEQ ID NO: 1556948 - protein, 23 aa, Mycobacterium tuberculosis
EFDSLFPGLLHDMVAAGVPMLEN

SEQ ID NO: 1556949 - protein, 17 aa, Mycobacterium tuberculosis
EFMLLQAAVAVVLHKAG

SEQ ID NO: 1556950 - protein, 17 aa, Mycobacterium tuberculosis
EFTPKTELTMVAFRAGL

SEQ ID NO: 1556951 - protein, 23 aa, Mycobacterium tuberculosis
EGAYEQMWAADVAAMVGYHSGAS

SEQ ID NO: 1556952 - protein, 17 aa, Mycobacterium tuberculosis
EGKYIPRLGGMAFRDPD

SEQ ID NO: 1556953 - protein, 24 aa, Mycobacterium tuberculosis
EGNLVIFVVDAFRIDGCSGTGWLR

SEQ ID NO: 1556954 - protein, 21 aa, Mycobacterium tuberculosis
EHAVPAPFEPVADTIAPGLVP

SEQ ID NO: 1556955 - protein, 23 aa, Mycobacterium tuberculosis
EHGRTPWRDLFGPAVTLADGGFD

SEQ ID NO: 1556956 - protein, 25 aa, Mycobacterium tuberculosis
EIDWVIKRKLFQRYQDRYDMELSHP

SEQ ID NO: 1556957 - protein, 18 aa, Mycobacterium tuberculosis
EIGVRLFISPRTVHSHLT

SEQ ID NO: 1556958 - protein, 18 aa, Mycobacterium tuberculosis
EILDIDRYRIDGELQDYI

SEQ ID NO: 1556959 - protein, 18 aa, Mycobacterium tuberculosis
EISPLQPEIPYYSATSFD

SEQ ID NO: 1556960 - protein, 36 aa, Mycobacterium tuberculosis
EKTIQQAIELWKIVDRPNLFIKIRDPDHLAGHRQPD

SEQ ID NO: 1556961 - protein, 22 aa, Mycobacterium tuberculosis
ELDRSVWPYIGAKAGGLPGDLT

SEQ ID NO: 1556962 - protein, 27 aa, Mycobacterium tuberculosis
ELKMARCRPWLWRQLELAGRDWAHRVD

SEQ ID NO: 1556963 - protein, 17 aa, Mycobacterium tuberculosis
ELLLPAMAGLVASLTFN

SEQ ID NO: 1556964 - protein, 24 aa, Mycobacterium tuberculosis
ELPADSHLLLLWGAANRDPAQFEA

SEQ ID NO: 1556965 - protein, 17 aa, Mycobacterium tuberculosis
ELPDIKCVYWAGGNPFH

SEQ ID NO: 1556966 - protein, 25 aa, Mycobacterium tuberculosis
ELPTRYLGLVTAVEYGRRARLAVQA

SEQ ID NO: 1556967 - protein, 18 aa, Mycobacterium tuberculosis
ELPVMSEYQRRVGPAVLV

SEQ ID NO: 1556968 - protein, 21 aa, Mycobacterium tuberculosis
ELRPQLLDRFGLTVDVQASRD

SEQ ID NO: 1556969 - protein, 21 aa, Mycobacterium tuberculosis
ELRRIAALCAAFRRGRHAGRS

SEQ ID NO: 1556970 - protein, 26 aa, Mycobacterium tuberculosis
ELSALGTLRLIQAFTPALAQSHGAIV

SEQ ID NO: 1556971 - protein, 26 aa, Mycobacterium tuberculosis
ELVKVTPMDFLRDTLLWAKLIDKYQG

SEQ ID NO: 1556972 - protein, 31 aa, Mycobacterium tuberculosis; identical to SEQ ID NO: 217697

SEQ ID NO: 1556973 - protein, 19 aa, Mycobacterium tuberculosis
EPDVACEITLQPIRRYDVD

SEQ ID NO: 1556974 - protein, 24 aa, Mycobacterium tuberculosis
EPELTLFRRLAVFVGCFFVDDAQA

SEQ ID NO: 1556975 - protein, 26 aa, Mycobacterium tuberculosis
EPGAYICVYPFVRSYEWYLLPDEERR

SEQ ID NO: 1556976 - protein, 29 aa, Mycobacterium tuberculosis
EPRGYDRATLKLVFSMDLGMCLNRFTYDS

SEQ ID NO: 1556977 - protein, 25 aa, Mycobacterium tuberculosis
EPRVLQIRALVLGGALDWLKDNKAS

SEQ ID NO: 1556978 - protein, 18 aa, Mycobacterium tuberculosis
EPVIWQLVDEDAPLRPRS

SEQ ID NO: 1556979 - protein, 48 aa, Mycobacterium tuberculosis
EPWVQYGFNFTAWAVGWLPYIGILAPQINFFYYLGEPIVQAVLFNAID

SEQ ID NO: 1556980 - protein, 24 aa, Mycobacterium tuberculosis
EQAATMLPFSWQGVSLHAAGASRV

SEQ ID NO: 1556981 - protein, 31 aa, Mycobacterium tuberculosis
EQQLLNAINAPTLALLGRPLIGNGADGAAGT

SEQ ID NO: 1556982 - protein, 30 aa, Mycobacterium tuberculosis
EQQVLGLINAPTQALWGRPLIGNGADGTAA

SEQ ID NO: 1556983 - protein, 24 aa, Mycobacterium tuberculosis
ERANRVFDERLLTIEWERGELPEV

SEQ ID NO: 1556984 - protein, 19 aa, Mycobacterium tuberculosis
ERIWEIRANLSAYDASYVA

SEQ ID NO: 1556985 - protein, 34 aa, Mycobacterium tuberculosis
ERLGPVLRRLTVNYPPIMFHPLNTITAYKGQIIY

SEQ ID NO: 1556986 - protein, 26 aa, Mycobacterium tuberculosis
ESEWPRPRPDLRPPSRLRSVRALAGS

SEQ ID NO: 1556987 - protein, 18 aa, Mycobacterium tuberculosis
ESIPIRIPVDIPASVIDG

SEQ ID NO: 1556988 - protein, 24 aa, Mycobacterium tuberculosis
ESRLNRLLAQQIPPARKVLAGADD

SEQ ID NO: 1556989 - protein, 17 aa, Mycobacterium tuberculosis
ETFFTTAYFDPNMAHMD

SEQ ID NO: 1556990 - protein, 24 aa, Mycobacterium tuberculosis
ETVRRDEFSRWLSAKPDYLVTTEQ

SEQ ID NO: 1556991 - protein, 30 aa, Mycobacterium tuberculosis
EVEDQLFRFSRILDVQPRLAILLGECAVPA

SEQ ID NO: 1556992 - protein, 30 aa, Mycobacterium tuberculosis
EVGAVHYPWLPLRRLLLDHYPSIERIASVH

SEQ ID NO: 1556993 - protein, 24 aa, Mycobacterium tuberculosis
EVNLLHDHLVDILLDAAAMGRVHV

SEQ ID NO: 1556994 - protein, 25 aa, Mycobacterium tuberculosis
EVNLLHDHLVDILLDAAAMGRVHVE

SEQ ID NO: 1556995 - protein, 26 aa, Mycobacterium tuberculosis
EVSAAIAALFGAHGQAYQTVSAQASA

SEQ ID NO: 1556996 - protein, 18 aa, Mycobacterium tuberculosis
EWLVRQGVPFRSAHEAAG

SEQ ID NO: 1556997 - protein, 23 aa, Mycobacterium tuberculosis
EYLRELTIWSGRYGSVAGVPARN

SEQ ID NO: 1556998 - protein, 21 aa, Mycobacterium tuberculosis
EYLRQRATLIDPKRAMPAATG

SEQ ID NO: 1556999 - protein, 17 aa, Mycobacterium tuberculosis
EYYQACHAARLWMDAQP

SEQ ID NO: 1557000 - protein, 24 aa, Mycobacterium tuberculosis
FAAACLPYLSWLTQASADCAAAAA

SEQ ID NO: 1557001 - protein, 22 aa, Mycobacterium tuberculosis
FAAPVWMPRAKRTSIRRVQEAI

SEQ ID NO: 1557002 - protein, 25 aa, Mycobacterium tuberculosis
FAQPYPAWRELFTDILPAHIVKDIP

SEQ ID NO: 1557003 - protein, 17 aa, Mycobacterium tuberculosis
FASPPLHGPTAAGVYAV

SEQ ID NO: 1557004 - protein, 20 aa, Mycobacterium tuberculosis
FAVWLVGWAGGFGTAIAASE

SEQ ID NO: 1557005 - protein, 26 aa, Mycobacterium tuberculosis
FDRDDPVLRTWMRAFPGTVKSEDQIP

SEQ ID NO: 1557006 - protein, 25 aa, Mycobacterium tuberculosis
FEAGDWHLTAPLTLFGHCMGAIVAF

SEQ ID NO: 1557007 - protein, 21 aa, Mycobacterium tuberculosis
FFGINTIPIALTEMDYFIRMW

SEQ ID NO: 1557008 - protein, 25 aa, Mycobacterium tuberculosis
FGDGAPVPMLPGSWGPDLVGVAGDG

SEQ ID NO: 1557009 - protein, 21 aa, Mycobacterium tuberculosis
FGDLLVEVLGGDAPPSGPGSR

SEQ ID NO: 1557010 - protein, 26 aa, Mycobacterium tuberculosis
FGFAAAAHRVVRVWPLRPDDRRKANR

SEQ ID NO: 1557011 - protein, 29 aa, Mycobacterium tuberculosis
FGFAVIVYLVWRFIVPLVGRLMSARQDTV

SEQ ID NO: 1557012 - protein, 17 aa, Mycobacterium tuberculosis
FGFLGGDGGAGGNAGLL

SEQ ID NO: 1557013 - protein, 25 aa, Mycobacterium tuberculosis
FGGNGGWLYGNWGSDGILGAGLLNR

SEQ ID NO: 1557014 - protein, 27 aa, Mycobacterium tuberculosis
FGNAGNINTGFWNAGNLNTGFGSAGNG

SEQ ID NO: 1557015 - protein, 20 aa, Mycobacterium tuberculosis
FGPERDFEHYLGCKVAACVV

SEQ ID NO: 1557016 - protein, 17 aa, Mycobacterium tuberculosis
FGPITIPNITVVGPTTT

SEQ ID NO: 1557017 - protein, 17 aa, Mycobacterium tuberculosis
FGRLLAVDIPALNLRRQ

SEQ ID NO: 1557018 - protein, 17 aa, Mycobacterium tuberculosis
FGSDPNWGRVLAAVGMA

SEQ ID NO: 1557019 - protein, 17 aa, Mycobacterium tuberculosis
FHEQFVQALTGAASAYA

SEQ ID NO: 1557020 - protein, 17 aa, Mycobacterium tuberculosis
FHEQFVRSLTAAGSAYA

SEQ ID NO: 1557021 - protein, 18 aa, Mycobacterium tuberculosis
FKVDMAAQYRIRLGGTWK

SEQ ID NO: 1557022 - protein, 19 aa, Mycobacterium tuberculosis
FLCPNYVFPYEPHFNIPTF

SEQ ID NO: 1557023 - protein, 18 aa, Mycobacterium tuberculosis
FLDQAHFQPLPPAVVKLS

SEQ ID NO: 1557024 - protein, 17 aa, Mycobacterium tuberculosis
FLPPLPPISPPGFPSLP

SEQ ID NO: 1557025 - protein, 19 aa, Mycobacterium tuberculosis
FLVAIPILEQKGMQVLTVA

SEQ ID NO: 1557026 - protein, 27 aa, Mycobacterium tuberculosis
FMSVGQTLFLFDFRDGIELNPIVIPGS

SEQ ID NO: 1557027 - protein, 19 aa, Mycobacterium tuberculosis
FMTRLGPLLRHHRVLICTP

SEQ ID NO: 1557028 - protein, 18 aa, Mycobacterium tuberculosis
FPEVDRVSWFPVARARTK

SEQ ID NO: 1557029 - protein, 19 aa, Mycobacterium tuberculosis
FPVPSFAEFWRTGRLELPT

SEQ ID NO: 1557030 - protein, 23 aa, Mycobacterium tuberculosis
FQAKYPMHAIIRQQLTDAAVRPA

SEQ ID NO: 1557031 - protein, 19 aa, Mycobacterium tuberculosis
FQEFLSRQQLRPPRTPLLS

SEQ ID NO: 1557032 - protein, 17 aa, Mycobacterium tuberculosis
FRALDMLASLWSSTGMS

SEQ ID NO: 1557033 - protein, 24 aa, Mycobacterium tuberculosis
FRPGLLDLPAPAPVDLRRLLPSGQ

SEQ ID NO: 1557034 - protein, 18 aa, Mycobacterium tuberculosis
FRVPCLVISPYSRGPLMV

SEQ ID NO: 1557035 - protein, 18 aa, Mycobacterium tuberculosis
FSILESALPQVHRIRKSY

SEQ ID NO: 1557036 - protein, 17 aa, Mycobacterium tuberculosis
FSLPAITLPSLTIPAAT

SEQ ID NO: 1557037 - protein, 21 aa, Mycobacterium tuberculosis
FSMPGPWVGIAAPGENIASVS

SEQ ID NO: 1557038 - protein, 26 aa, Mycobacterium tuberculosis
FSNAGPAMLPGFNSGFANIGSFNAGI

SEQ ID NO: 1557039 - protein, 18 aa, Mycobacterium tuberculosis
FTELTPHPLLTHAVDQTA

SEQ ID NO: 1557040 - protein, 19 aa, Mycobacterium tuberculosis
FTIPGFSVPAQPLPLSIDI

SEQ ID NO: 1557041 - protein, 17 aa, Mycobacterium tuberculosis
FTTFLDAAGGAGGAGGA

SEQ ID NO: 1557042 - protein, 18 aa, Mycobacterium tuberculosis
FTVPDIPIPAIHIGINGV

SEQ ID NO: 1557043 - protein, 23 aa, Mycobacterium tuberculosis
FWSQIHGFVMLELAGFYGDRGAD

SEQ ID NO: 1557044 - protein, 19 aa, Mycobacterium tuberculosis
GAAGQLFSASGAAGNAGVG

SEQ ID NO: 1557045 - protein, 18 aa, Mycobacterium tuberculosis
GAAIPAVLSAQPVYFDYW

SEQ ID NO: 1557046 - protein, 18 aa, Mycobacterium tuberculosis
GAAIWHMAWSDKDDAIDW

SEQ ID NO: 1557047 - protein, 52 aa, Mycobacterium tuberculosis; identical to SEQ ID NO: 236349

SEQ ID NO: 1557048 - protein, 52 aa, Mycobacterium tuberculosis
GADEVSARIAALFGGLGLEYQAISAQVAAYHQRFVQALSTGAGAYASAEAAA

SEQ ID NO: 1557049 - protein, 27 aa, Mycobacterium tuberculosis
GADEVSLAISALFGQHAQAYQALSAQA

SEQ ID NO: 1557050 - protein, 30 aa, Mycobacterium tuberculosis; identical to SEQ ID NO: 218171

SEQ ID NO: 1557051 - protein, 25 aa, Mycobacterium tuberculosis
GAGGAAGQLFSAGGAAGAVGVGGTG

SEQ ID NO: 1557052 - protein, 21 aa, Mycobacterium tuberculosis
GAGGAGGWLLGDGGAGGIGGA

SEQ ID NO: 1557053 - protein, 17 aa, Mycobacterium tuberculosis
GAGGAGGWLSGHSGAHG

SEQ ID NO: 1557054 - protein, 17 aa, Mycobacterium tuberculosis
GAGGAGGWLSGNGGAGG

SEQ ID NO: 1557055 - protein, 21 aa, Mycobacterium tuberculosis
GAGGAGGWLYGDAGAGGDGGV

SEQ ID NO: 1557056 - protein, 17 aa, Mycobacterium tuberculosis
GAGGAGWLVGNGGAGGF

SEQ ID NO: 1557057 - protein, 28 aa, Mycobacterium tuberculosis
GAGGDAPLIGWGGNGGPGGFAAFGNGGA

SEQ ID NO: 1557058 - protein, 21 aa, Mycobacterium tuberculosis
GAGGKAGLYGNGGDGGAGGDG

SEQ ID NO: 1557059 - protein, 24 aa, Mycobacterium tuberculosis
GAGGLGGTLYGAGGHGGAGGPGPI

SEQ ID NO: 1557060 - protein, 18 aa, Mycobacterium tuberculosis
GAGGLIWGTAGTGATRLG

SEQ ID NO: 1557061 - protein, 25 aa, Mycobacterium tuberculosis
GAGGNVWHTCKYSRRGPLSHILLSN

SEQ ID NO: 1557062 - protein, 22 aa, Mycobacterium tuberculosis
GAGGSGAWLYGNGGAAGAGGNG

SEQ ID NO: 1557063 - protein, 19 aa, Mycobacterium tuberculosis
GAGGWLFGNGGNGGQGTIG

SEQ ID NO: 1557064 - protein, 22 aa, Mycobacterium tuberculosis
GAGLKPRARDCTPTRRLGRTTA

SEQ ID NO: 1557065 - protein, 29 aa, Mycobacterium tuberculosis
GAGRSYRLYKPVGLPSSAPLVVMLHGGFG

SEQ ID NO: 1557066 - protein, 18 aa, Mycobacterium tuberculosis
GAGTARVYLLDDALKPVP

SEQ ID NO: 1557067 - protein, 18 aa, Mycobacterium tuberculosis
GAKYLYGPLLDKYESLGG

SEQ ID NO: 1557068 - protein, 17 aa, Mycobacterium tuberculosis
GAMVLDLRQLPGDINYD

SEQ ID NO: 1557069 - protein, 20 aa, Mycobacterium tuberculosis
GANDLLPPGGLIPLSRTSPA

SEQ ID NO: 1557070 - protein, 18 aa, Mycobacterium tuberculosis
GANGGPGGWLIGNGGAGG

SEQ ID NO: 1557071 - protein, 30 aa, Mycobacterium tuberculosis
GAPGTGQPGGAGGLLWGNGGNGGSGAAGQV

SEQ ID NO: 1557072 - protein, 32 aa, Mycobacterium tuberculosis
GAPMGWEAVFTRPFQAFWVELPACNNWVDIGL

SEQ ID NO: 1557073 - protein, 17 aa, Mycobacterium tuberculosis
GARLMTVAASHAGGAAG

SEQ ID NO: 1557074 - protein, 19 aa, Mycobacterium tuberculosis
GARLYRKLTTTTVVAYFSE

SEQ ID NO: 1557075 - protein, 24 aa, Mycobacterium tuberculosis
GASIYNVSVLLDPNKGLANLLANL

SEQ ID NO: 1557076 - protein, 28 aa, Mycobacterium tuberculosis
GASPIPPLPPLPPLPISPAPPPAPPAPP

SEQ ID NO: 1557077 - protein, 25 aa, Mycobacterium tuberculosis
GASSKIRCALVPLIPKEDTAARRGR

SEQ ID NO: 1557078 - protein, 26 aa, Mycobacterium tuberculosis
GATAFPWRRQSALVQWYVETSGSPPE

SEQ ID NO: 1557079 - protein, 28 aa, Mycobacterium tuberculosis
GATGLPELGAWLAGAARFTVVTHAALAR

SEQ ID NO: 1557080 - protein, 23 aa, Mycobacterium tuberculosis
GATGSAGIGGAGGRGGDGGDGAS

SEQ ID NO: 1557081 - protein, 18 aa, Mycobacterium tuberculosis
GDAFATFAKAGNGGAGGN

SEQ ID NO: 1557082 - protein, 20 aa, Mycobacterium tuberculosis
GDAMPWLMASAKTLSYAVNM

SEQ ID NO: 1557083 - protein, 30 aa, Mycobacterium tuberculosis
GDGGEGASGLGLGLSGFDGGQGGQGGAGGS

SEQ ID NO: 1557084 - protein, 32 aa, Mycobacterium tuberculosis; identical to SEQ ID NO: 1511948

SEQ ID NO: 1557085 - protein, 23 aa, Mycobacterium tuberculosis
GDPLHLPGFPVQFFVYKQIAANN

SEQ ID NO: 1557086 - protein, 22 aa, Mycobacterium tuberculosis
GDTTIVVNGMLAPSTLGYGGNG

SEQ ID NO: 1557087 - protein, 24 aa, Mycobacterium tuberculosis
GDVPLIGFAGAPFTLASYLVEGGP

SEQ ID NO: 1557088 - protein, 20 aa, Mycobacterium tuberculosis
GEGPDKLFMKHRRLGTQRLI

SEQ ID NO: 1557089 - protein, 24 aa, Mycobacterium tuberculosis
GELGKQVEILPGLQAINAGWFNGK

SEQ ID NO: 1557090 - protein, 18 aa, Mycobacterium tuberculosis
GELLGALPMLHAAFERAG

SEQ ID NO: 1557091 - protein, 30 aa, Mycobacterium tuberculosis
GEPTPLDYLVAEILRIISGGRLIWDPAEGT

SEQ ID NO: 1557092 - protein, 17 aa, Mycobacterium tuberculosis
GFARLRRVSAGAGGHRP

SEQ ID NO: 1557093 - protein, 24 aa, Mycobacterium tuberculosis
GFGNGGAINLGFGNSGQLNAGSFN

SEQ ID NO: 1557094 - protein, 25 aa, Mycobacterium tuberculosis
GFIGKWPTELGGQPGLWIPSSSISA

SEQ ID NO: 1557095 - protein, 32 aa, Mycobacterium tuberculosis; identical to SEQ ID NO: 218359

SEQ ID NO: 1557096 - protein, 18 aa, Mycobacterium tuberculosis
GFTIGQRRGLGIAGPGPN

SEQ ID NO: 1557097 - protein, 18 aa, Mycobacterium tuberculosis
GFTTFLDAAGGAGGAGGA

SEQ ID NO: 1557098 - protein, 22 aa, Mycobacterium tuberculosis
GGAARMFAAPAAATAAVTPPAL

SEQ ID NO: 1557099 - protein, 29 aa, Mycobacterium tuberculosis
GGAGAGIANFLGFSVLHGGAGGAGGTATG

SEQ ID NO: 1557100 - protein, 24 aa, Mycobacterium tuberculosis
GGAGGAAGLFGTGGAGGAGGAGAA

SEQ ID NO: 1557101 - protein, 26 aa, Mycobacterium tuberculosis
GGAGGAAGQLFSAGGAAGAVGVGGTG

SEQ ID NO: 1557102 - protein, 25 aa, Mycobacterium tuberculosis
GGAGGAAGWLYGSGGAGGAGGAGGL

SEQ ID NO: 1557103 - protein, 17 aa, Mycobacterium tuberculosis
GGAGGAGGGRHRRHRRG

SEQ ID NO: 1557104 - protein, 27 aa, Mycobacterium tuberculosis
GGAGGAGGRAWLWGTGGAGGAGGDGGW

SEQ ID NO: 1557105 - protein, 24 aa, Mycobacterium tuberculosis
GGAGGAGGWLLGNGGAGGPGGPTD

SEQ ID NO: 1557106 - protein, 28 aa, Mycobacterium tuberculosis
GGAGGAGRGLFLGLGGDGGAGGTSNNNG

SEQ ID NO: 1557107 - protein, 23 aa, Mycobacterium tuberculosis
GGAGGFGAVLFGNGGAGGSGAPG

SEQ ID NO: 1557108 - protein, 24 aa, Mycobacterium tuberculosis
GGAGGFGDHRWGPAGLAGPAGCSA

SEQ ID NO: 1557109 - protein, 18 aa, Mycobacterium tuberculosis
GGAGGIGGLIGSGGGGGD

SEQ ID NO: 1557110 - protein, 21 aa, Mycobacterium tuberculosis
GGAGGLLFGNGGPGGAGGIGT

SEQ ID NO: 1557111 - protein, 27 aa, Mycobacterium tuberculosis
GGAGGRGALLLGAGGQGGLGGAGGQGG

SEQ ID NO: 1557112 - protein, 28 aa, Mycobacterium tuberculosis
GGAGGRGALLLGAGGQGGLGGAGGQGGM

SEQ ID NO: 1557113 - protein, 24 aa, Mycobacterium tuberculosis
GGAGGSAGLFYGSGGAGGNGGYSL

SEQ ID NO: 1557114 - protein, 28 aa, Mycobacterium tuberculosis
GGAGGSGGHALLWGAGGAGGNGGSGGTG

SEQ ID NO: 1557115 - protein, 17 aa, Mycobacterium tuberculosis
GGANLYGGTGGTGGTGG

SEQ ID NO: 1557116 - protein, 24 aa, Mycobacterium tuberculosis
GGAPASLVGFNRAPAGPSGGPVAA

SEQ ID NO: 1557117 - protein, 26 aa, Mycobacterium tuberculosis
GGASALGALLMLPGVRGLGPGPVTTG

SEQ ID NO: 1557118 - protein, 27 aa, Mycobacterium tuberculosis
GGASALGALLMLPGVRGLGPGPVTTGA

SEQ ID NO: 1557119 - protein, 19 aa, Mycobacterium tuberculosis
GGDAGMFFGSGGSGGAGGI

SEQ ID NO: 1557120 - protein, 24 aa, Mycobacterium tuberculosis
GGDARFLSLLSIRQLATEPSLSGP

SEQ ID NO: 1557121 - protein, 31 aa, Mycobacterium tuberculosis
GGDGGEGASGLGLGLSGFDGGQGGQGGAGGN

SEQ ID NO: 1557122 - protein, 22 aa, Mycobacterium tuberculosis
GGDPRRPVPALAIATGPDGGDP

SEQ ID NO: 1557123 - protein, 18 aa, Mycobacterium tuberculosis
GGDPRRPVPALAIATRLG

SEQ ID NO: 1557124 - protein, 52 aa, Mycobacterium tuberculosis
GGEGPPAPPPAPPPPTPNPPAPPPTPPPPARVQVRGWRSPDDGAAPVPEHAA

SEQ ID NO: 1557125 - protein, 20 aa, Mycobacterium tuberculosis
GGFGIPVGSGGAGGSRGVLF

SEQ ID NO: 1557126 - protein, 24 aa, Mycobacterium tuberculosis
GGGSFGLPGLNGSCGDGGDGGNGA

SEQ ID NO: 1557127 - protein, 23 aa, Mycobacterium tuberculosis
GGGSFGLPGLNGSGGDGGDGGNG

SEQ ID NO: 1557128 - protein, 22 aa, Mycobacterium tuberculosis
GGGTGGLLFGNGGAGGHGAAAG

SEQ ID NO: 1557129 - protein, 25 aa, Mycobacterium tuberculosis
GGGVGAFLTALFASPAKALSLNAGL

SEQ ID NO: 1557130 - protein, 21 aa, Mycobacterium tuberculosis
GGGVSCQFVQALNAGVNSYAS

SEQ ID NO: 1557131 - protein, 24 aa, Mycobacterium tuberculosis
GGHEAVLPSAFFFEIAQWADGDGE

SEQ ID NO: 1557132 - protein, 30 aa, Mycobacterium tuberculosis; identical to SEQ ID NO: 237618

SEQ ID NO: 1557133 - protein, 20 aa, Mycobacterium tuberculosis
GGISGLLLGADGFNAPASAS

SEQ ID NO: 1557134 - protein, 17 aa, Mycobacterium tuberculosis
GGKALAATHQDGSMGAG

SEQ ID NO: 1557135 - protein, 24 aa, Mycobacterium tuberculosis
GGKVMLFGAERLLASSGSPTAASA

SEQ ID NO: 1557136 - protein, 19 aa, Mycobacterium tuberculosis
GGLAGIGGNAGFVGNGGAG

SEQ ID NO: 1557137 - protein, 25 aa, Mycobacterium tuberculosis
GGLGGNGGWLYGNGGAGGIGGAGTG

SEQ ID NO: 1557138 - protein, 18 aa, Mycobacterium tuberculosis
GGLIQPDIVWFGEPLPEE

SEQ ID NO: 1557139 - protein, 19 aa, Mycobacterium tuberculosis
GGLLAGLIGAGGGHGGTGG

SEQ ID NO: 1557140 - protein, 17 aa, Mycobacterium tuberculosis
GGLLFGSGGAGGSGGFS

SEQ ID NO: 1557141 - protein, 22 aa, Mycobacterium tuberculosis
GGMLRRMRPLFSVGLGARLGSG

SEQ ID NO: 1557142 - protein, 22 aa, Mycobacterium tuberculosis
GGNAGLLFGAAGVGGAGGFALA

SEQ ID NO: 1557143 - protein, 19 aa, Mycobacterium tuberculosis
GGNAIAGGINGSGGAGGTG

SEQ ID NO: 1557144 - protein, 18 aa, Mycobacterium tuberculosis
GGNAWLFGAGGSGGAGTN

SEQ ID NO: 1557145 - protein, 22 aa, Mycobacterium tuberculosis
GGNGGLGGFGGNGAAGANGVAV

SEQ ID NO: 1557146 - protein, 19 aa, Mycobacterium tuberculosis
GGNGGWLWGNGGNGGVGGT

SEQ ID NO: 1557147 - protein, 23 aa, Mycobacterium tuberculosis
GGPAVAGVLGGMPGAGGNGGNAN

SEQ ID NO: 1557148 - protein, 20 aa, Mycobacterium tuberculosis
GGPGGAAGLFGNGGSGGSGG

SEQ ID NO: 1557149 - protein, 17 aa, Mycobacterium tuberculosis
GGPGNQAFNAGAGGAGG

SEQ ID NO: 1557150 - protein, 18 aa, Mycobacterium tuberculosis
GGPGPIGGVGGHGGVGGA

SEQ ID NO: 1557151 - protein, 23 aa, Mycobacterium tuberculosis
GGQGAALIGLGAGGAGGAGGATV

SEQ ID NO: 1557152 - protein, 21 aa, Mycobacterium tuberculosis
GGRAGLLLGVGGMGGNGGATS

SEQ ID NO: 1557153 - protein, 24 aa, Mycobacterium tuberculosis
GGRAVLVLSDWPAPQAPQSASGEM

SEQ ID NO: 1557154 - protein, 17 aa, Mycobacterium tuberculosis
GGRGGLLVGNGGAGGAG

SEQ ID NO: 1557155 - protein, 30 aa, Mycobacterium tuberculosis
GGRGRRPRRVAVRRWRGWRERRGRGRRRRR

SEQ ID NO: 1557156 - protein, 18 aa, Mycobacterium tuberculosis
GGRLTGVTALSPVAPLDE

SEQ ID NO: 1557157 - protein, 19 aa, Mycobacterium tuberculosis
GGRVSRAVCRGPNLGWRVV

SEQ ID NO: 1557158 - protein, 18 aa, Mycobacterium tuberculosis
GGRWSAGWSGGGGSGDAG

SEQ ID NO: 1557159 - protein, 24 aa, Mycobacterium tuberculosis
GGRWVRWVNMVAFLPSIPVVEDLR

SEQ ID NO: 1557160 - protein, 21 aa, Mycobacterium tuberculosis
GGSAARLFGGGGAGGAGGTGS

SEQ ID NO: 1557161 - protein, 25 aa, Mycobacterium tuberculosis
GGTGGNGALLFGFGGAGGAGGHGGA

SEQ ID NO: 1557162 - protein, 17 aa, Mycobacterium tuberculosis
GGVFGNGGFGGAGGLGA

SEQ ID NO: 1557163 - protein, 24 aa, Mycobacterium tuberculosis
GGVGGPAGLWGHGGAGGAGGAGVA

SEQ ID NO: 1557164 - protein, 25 aa, Mycobacterium tuberculosis
GGVGGRGGWLLGNGGTGGAGGAAGA

SEQ ID NO: 1557165 - protein, 34 aa, Mycobacterium tuberculosis; identical to SEQ ID NO: 1523886

SEQ ID NO: 1557166 - protein, 17 aa, Mycobacterium tuberculosis
GGWLLGTGGVGGVGGLG

SEQ ID NO: 1557167 - protein, 32 aa, Mycobacterium tuberculosis
GGYTIYREPLSLRPFDYLPKPLRRSMGKVSKP

SEQ ID NO: 1557168 - protein, 20 aa, Mycobacterium tuberculosis
GHAIELRVYRFGGSLHLDWW

SEQ ID NO: 1557169 - protein, 24 aa, Mycobacterium tuberculosis
GHEWDLVVIAGLQDGLWPNTVPRG

SEQ ID NO: 1557170 - protein, 24 aa, Mycobacterium tuberculosis
GHPRLGHNLALHPATMLAGLFDDD

SEQ ID NO: 1557171 - protein, 30 aa, Mycobacterium tuberculosis
GIGPIIIPDTTILPPIHLGLTGQANYGFAV

SEQ ID NO: 1557172 - protein, 24 aa, Mycobacterium tuberculosis
GISHPASIAALRRGRGALVTQQRG

SEQ ID NO: 1557173 - protein, 18 aa, Mycobacterium tuberculosis
GIWVFSPLRRRATAALAV

SEQ ID NO: 1557174 - protein, 23 aa, Mycobacterium tuberculosis
GKGGDAFATFAKAGNGGAGGNGG

SEQ ID NO: 1557175 - protein, 28 aa, Mycobacterium tuberculosis
GKSTFVALTLAPLLPGIVFVNADEIAKQ

SEQ ID NO: 1557176 - protein, 18 aa, Mycobacterium tuberculosis
GKWWLRLPDEVSGGDCGV

SEQ ID NO: 1557177 - protein, 27 aa, Mycobacterium tuberculosis
GLAGFSFGYPIPLFPAVGADVTGDIGP

SEQ ID NO: 1557178 - protein, 21 aa, Mycobacterium tuberculosis
GLAMMLAPMVAAPGLAAADPA

SEQ ID NO: 1557179 - protein, 20 aa, Mycobacterium tuberculosis
GLCPLDWCAWRHAGYPPSDG

SEQ ID NO: 1557180 - protein, 27 aa, Mycobacterium tuberculosis
GLGVGALSGMWGIPAVVAVATVGVVTV

SEQ ID NO: 1557181 - protein, 19 aa, Mycobacterium tuberculosis
GLPALAQLSPIIQQAAMNP

SEQ ID NO: 1557182 - protein, 17 aa, Mycobacterium tuberculosis
GLPALPAGLPTLPPVPA

SEQ ID NO: 1557183 - protein, 17 aa, Mycobacterium tuberculosis
GLPPLPAVPALPAPPPL

SEQ ID NO: 1557184 - protein, 18 aa, Mycobacterium tuberculosis
GLPPLPAVPALPAPPPLP

SEQ ID NO: 1557185 - protein, 17 aa, Mycobacterium tuberculosis
GLQDFIRKSADPAKPIA

SEQ ID NO: 1557186 - protein, 30 aa, Mycobacterium tuberculosis; identical to SEQ ID NO: 218597

SEQ ID NO: 1557187 - protein, 31 aa, Mycobacterium tuberculosis
GLSLRQDFAFRFHWLLRVGFADCVDSRQSAN

SEQ ID NO: 1557188 - protein, 22 aa, Mycobacterium tuberculosis
GLSSPVILGIGIGGAGGDGGGA

SEQ ID NO: 1557189 - protein, 18 aa, Mycobacterium tuberculosis
GLTDIPVRVYWPPVVRDN

SEQ ID NO: 1557190 - protein, 24 aa, Mycobacterium tuberculosis
GLVLSLVCWGGHQAAALLGFAVPP

SEQ ID NO: 1557191 - protein, 21 aa, Mycobacterium tuberculosis
GLWPLLMEQFSVRPNAADVER

SEQ ID NO: 1557192 - protein, 26 aa, Mycobacterium tuberculosis
GMGAQLYAELPLFALAFDAVAEELDR

SEQ ID NO: 1557193 - protein, 26 aa, Mycobacterium tuberculosis
GMVGGVSIPLIKIPAAPGFGNSTTSP

SEQ ID NO: 1557194 - protein, 40 aa, Mycobacterium tuberculosis
GNAGLLFGAGGHRWIRRKPGLGWGTVGPVGPAATPGCGCF

SEQ ID NO: 1557195 - protein, 19 aa, Mycobacterium tuberculosis
GNAGNVNTGFWNGGSTNTG

SEQ ID NO: 1557196 - protein, 17 aa, Mycobacterium tuberculosis
GNAIAGGINGSGGAGGT

SEQ ID NO: 1557197 - protein, 20 aa, Mycobacterium tuberculosis
GNALWARLQPCVNWISQHWT

SEQ ID NO: 1557198 - protein, 17 aa, Mycobacterium tuberculosis
GNDLPWSVLKQLHAGDS

SEQ ID NO: 1557199 - protein, 25 aa, Mycobacterium tuberculosis
GNFNNGVLWVGDYQGLFGVSAGSSI

SEQ ID NO: 1557200 - protein, 24 aa, Mycobacterium tuberculosis
GNGGWLYCIGGIGGAGLSLRQDFA

SEQ ID NO: 1557201 - protein, 18 aa, Mycobacterium tuberculosis
GNGGWLYGNGGAGGIGGA

SEQ ID NO: 1557202 - protein, 28 aa, Mycobacterium tuberculosis
GNGVAVMPVCCWMFGIGGPRRPPGGDRR

SEQ ID NO: 1557203 - protein, 23 aa, Mycobacterium tuberculosis
GNGYLGGLQFTQSTWAAHGGGRV

SEQ ID NO: 1557204 - protein, 25 aa, Mycobacterium tuberculosis
GNKRTIVGYFTSAVGLYPGDQVRVL

SEQ ID NO: 1557205 - protein, 20 aa, Mycobacterium tuberculosis
GNLDPIIAFYPKHVLYEVFG

SEQ ID NO: 1557206 - protein, 19 aa, Mycobacterium tuberculosis
GNLGFANLGLTAGAAGVGN

SEQ ID NO: 1557207 - protein, 48 aa, Mycobacterium tuberculosis; identical to SEQ ID NO: 1515054

SEQ ID NO: 1557208 - protein, 32 aa, Mycobacterium tuberculosis; identical to SEQ ID NO: 218659

SEQ ID NO: 1557209 - protein, 26 aa, Mycobacterium tuberculosis
GNYSNGVLWRGDYQGLIGADIALEIP

SEQ ID NO: 1557210 - protein, 24 aa, Mycobacterium tuberculosis
GPAIAAIADIPAAAALAAVTAVAA

SEQ ID NO: 1557211 - protein, 24 aa, Mycobacterium tuberculosis
GPALPPPPALPNLAAPSVPGVGIP

SEQ ID NO: 1557212 - protein, 27 aa, Mycobacterium tuberculosis
GPAVDSRWVWVLDPIDGTINYAAGSPL

SEQ ID NO: 1557213 - protein, 26 aa, Mycobacterium tuberculosis
GPFTVPDIPIPAINFGLDGNVNVSFN

SEQ ID NO: 1557214 - protein, 26 aa, Mycobacterium tuberculosis
GPGGLAGNLFGQNGIQGVGGSGGKGG

SEQ ID NO: 1557215 - protein, 19 aa, Mycobacterium tuberculosis
GPGGLLLGNGGNGGSGAPG

SEQ ID NO: 1557216 - protein, 19 aa, Mycobacterium tuberculosis
GPGGLLYGNGGHGGAGAAG

SEQ ID NO: 1557217 - protein, 19 aa, Mycobacterium tuberculosis
GPGGLLYGNGGNGGTSTTA

SEQ ID NO: 1557218 - protein, 20 aa, Mycobacterium tuberculosis
GPGGWLIGNGGAGGSGAPGA

SEQ ID NO: 1557219 - protein, 20 aa, Mycobacterium tuberculosis
GPHAVYLLDAFNAGPDVSNW

SEQ ID NO: 1557220 - protein, 20 aa, Mycobacterium tuberculosis
GPIGGVGGHGGVGGAAGLLG

SEQ ID NO: 1557221 - protein, 30 aa, Mycobacterium tuberculosis; identical to SEQ ID NO: 162510

SEQ ID NO: 1557222 - protein, 18 aa, Mycobacterium tuberculosis
GPPASWKPGGRPVTIEPS

SEQ ID NO: 1557223 - protein, 17 aa, Mycobacterium tuberculosis
GPRRFRNARRRQRRLRR

SEQ ID NO: 1557224 - protein, 27 aa, Mycobacterium tuberculosis
GPTVMEDYFYRPFRDLVIRAAERADAP

SEQ ID NO: 1557225 - protein, 28 aa, Mycobacterium tuberculosis
GPVAAALPAPLGVVTPSVAAAVTAAMVA

SEQ ID NO: 1557226 - protein, 23 aa, Mycobacterium tuberculosis
GPVIPASAYLMKSPPEQLPDDIA

SEQ ID NO: 1557227 - protein, 27 aa, Mycobacterium tuberculosis
GPVVYQMQPVVFGAPLPLDPASAPDVP

SEQ ID NO: 1557228 - protein, 29 aa, Mycobacterium tuberculosis
GQAGGPGGPAGLWGNGGPGGAGGSGGGTG

SEQ ID NO: 1557229 - protein, 17 aa, Mycobacterium tuberculosis
GQMVPVLLDTGSTGLVM

SEQ ID NO: 1557230 - protein, 20 aa, Mycobacterium tuberculosis
GQMVPVLLDTGSTGLVMDSQ

SEQ ID NO: 1557231 - protein, 23 aa, Mycobacterium tuberculosis
GQNGGAGGILWGNGGNGGSGAPG

SEQ ID NO: 1557232 - protein, 24 aa, Mycobacterium tuberculosis
GQPGGPGGLLWGNGGNGGSGVAGV

SEQ ID NO: 1557233 - protein, 20 aa, Mycobacterium tuberculosis
GQSGLLFGNAGAGGAGGAGG

SEQ ID NO: 1557234 - protein, 19 aa, Mycobacterium tuberculosis
GQVVLGWKVSDLKSSTAVI

SEQ ID NO: 1557235 - protein, 21 aa, Mycobacterium tuberculosis
GRAVPAAPVAPAVAAHCCWAL

SEQ ID NO: 1557236 - protein, 19 aa, Mycobacterium tuberculosis
GRGAAWLIVDVRDVVALHA

SEQ ID NO: 1557237 - protein, 41 aa, Mycobacterium tuberculosis
GRGGNAWVLLGMFATRPRWHPPVTIPPLPHHSHTASPKLPE

SEQ ID NO: 1557238 - protein, 45 aa, Mycobacterium tuberculosis
GRPSPPLPLPPPPLPPFFFFFFFFIFFFFFLKKKKRKKKKKKKKK

SEQ ID NO: 1557239 - protein, 26 aa, Mycobacterium tuberculosis
GRPTQLPYLPLQVPQQLSLPADLPAL

SEQ ID NO: 1557240 - protein, 25 aa, Mycobacterium tuberculosis
GRRCRVSYVSVLPATLATAATEVAR

SEQ ID NO: 1557241 - protein, 17 aa, Mycobacterium tuberculosis
GRRGGRVALRQRRRRRC

SEQ ID NO: 1557242 - protein, 26 aa, Mycobacterium tuberculosis
GRRRPGKLAWPTAAGWTSSCRRPSSP

SEQ ID NO: 1557243 - protein, 23 aa, Mycobacterium tuberculosis
GRRRRRRPSRRWRRERRQWRQRR

SEQ ID NO: 1557244 - protein, 27 aa, Mycobacterium tuberculosis
GRRRSQHSGRWWPIGASARCGRCAARR

SEQ ID NO: 1557245 - protein, 19 aa, Mycobacterium tuberculosis
GRVLAAVGMAPITLDPDRI

SEQ ID NO: 1557246 - protein, 23 aa, Mycobacterium tuberculosis
GRVTAGWQEGRRGWRGHGRPAPV

SEQ ID NO: 1557247 - protein, 25 aa, Mycobacterium tuberculosis
GRWALQTWRRLAVTRYPVVGLFERI

SEQ ID NO: 1557248 - protein, 23 aa, Mycobacterium tuberculosis
GSAGSLNTSFWNAGMQNAALGSA

SEQ ID NO: 1557249 - protein, 18 aa, Mycobacterium tuberculosis
GSASKDVQQQLPAGSPVK

SEQ ID NO: 1557250 - protein, 23 aa, Mycobacterium tuberculosis
GSGDDLMIIPTMDTTYPVDVDDF

SEQ ID NO: 1557251 - protein, 19 aa, Mycobacterium tuberculosis
GSGGLLFGSGGAGGIGGAG

SEQ ID NO: 1557252 - protein, 19 aa, Mycobacterium tuberculosis
GSLLALRSKAFHKTTFQDR

SEQ ID NO: 1557253 - protein, 27 aa, Mycobacterium tuberculosis
GSPRRHAAMLLPVGRYPPTSRHGIGRR

SEQ ID NO: 1557254 - protein, 25 aa, Mycobacterium tuberculosis
GSPVAALAALLTNADRDALSGPAVA

SEQ ID NO: 1557255 - protein, 27 aa, Mycobacterium tuberculosis
GSQMGGALFVGWWLASGPQQGRGLGGQ

SEQ ID NO: 1557256 - protein, 29 aa, Mycobacterium tuberculosis
GSRTPWRLNQNYLRDIRLIRRGKIDDEGL

SEQ ID NO: 1557257 - protein, 18 aa, Mycobacterium tuberculosis
GSTFANLPIGQGLSMTLL

SEQ ID NO: 1557258 - protein, 21 aa, Mycobacterium tuberculosis
GSWLPLHHDMGLVGSLFAALF

SEQ ID NO: 1557259 - protein, 21 aa, Mycobacterium tuberculosis
GTAIQPIYGPTLDGTLPGNEI

SEQ ID NO: 1557260 - protein, 24 aa, Mycobacterium tuberculosis
GTALNQIPILNIGLADVGNFNVGF

SEQ ID NO: 1557261 - protein, 18 aa, Mycobacterium tuberculosis
GTDLDSVLKRFGPLTPPR

SEQ ID NO: 1557262 - protein, 24 aa, Mycobacterium tuberculosis
GTDLDSVLKRFGPLTPPRAVAIIT

SEQ ID NO: 1557263 - protein, 27 aa, Mycobacterium tuberculosis
GTGGAGGAGFSRALIVAGDNGGDGGNG

SEQ ID NO: 1557264 - protein, 27 aa, Mycobacterium tuberculosis
GTGGAGGLLAGLLAGPGGAGGTGGRGF

SEQ ID NO: 1557265 - protein, 25 aa, Mycobacterium tuberculosis
GTGGAGQITGLRSGFGGAGGAGGAS

SEQ ID NO: 1557266 - protein, 19 aa, Mycobacterium tuberculosis
GTGGLLFGAGGNGGPGGSG

SEQ ID NO: 1557267 - protein, 18 aa, Mycobacterium tuberculosis
GTGGLLFGNGGAGGHGAA

SEQ ID NO: 1557268 - protein, 26 aa, Mycobacterium tuberculosis
GTGGNGALLFGFRGAGGAGGHGGAAL

SEQ ID NO: 1557269 - protein, 28 aa, Mycobacterium tuberculosis
GTGKSLAYLVPAIIRALCDDAPVVVSTA

SEQ ID NO: 1557270 - protein, 28 aa, Mycobacterium tuberculosis
GTHHYRFTLYHLPVALQLPPGATGVQAA

SEQ ID NO: 1557271 - protein, 23 aa, Mycobacterium tuberculosis
GTHSWEYWGAQLNRYEARPATGT

SEQ ID NO: 1557272 - protein, 23 aa, Mycobacterium tuberculosis
GTITAFLANLPFSTPVVTIDEIP

SEQ ID NO: 1557273 - protein, 17 aa, Mycobacterium tuberculosis
GTMTLNLGLANLGSNNA

SEQ ID NO: 1557274 - protein, 22 aa, Mycobacterium tuberculosis
GTNIAGLLRDGAGTAAINLGLA

SEQ ID NO: 1557275 - protein, 21 aa, Mycobacterium tuberculosis
GTPATTKPDERPSRPAVAADT

SEQ ID NO: 1557276 - protein, 27 aa, Mycobacterium tuberculosis
GTTATSTLVAAIPAVTTSASETPAAGI

SEQ ID NO: 1557277 - protein, 28 aa, Mycobacterium tuberculosis
GVAASIGAYLWVPDILECLASVMADAGS

SEQ ID NO: 1557278 - protein, 22 aa, Mycobacterium tuberculosis
GVDGLIINLAPHGYLPGVITTA

SEQ ID NO: 1557279 - protein, 18 aa, Mycobacterium tuberculosis
GVGGLLFGDGGNGGAGGL

SEQ ID NO: 1557280 - protein, 24 aa, Mycobacterium tuberculosis
GVINAPTEFMFGRSLIGDGADGTA

SEQ ID NO: 1557281 - protein, 18 aa, Mycobacterium tuberculosis
GVLNSGFFNSGVHNSGGF

SEQ ID NO: 1557282 - protein, 25 aa, Mycobacterium tuberculosis
GVPVAGLTWMPFTDQRYTAVAGGPL

SEQ ID NO: 1557283 - protein, 19 aa, Mycobacterium tuberculosis
GVQCGAGGAGISFSNVSNG

SEQ ID NO: 1557284 - protein, 25 aa, Mycobacterium tuberculosis
GVQTPQPYWYWALDRESIGGSVSAA

SEQ ID NO: 1557285 - protein, 25 aa, Mycobacterium tuberculosis
GVQYRWPQGTYLAWLDCRELGFDDA

SEQ ID NO: 1557286 - protein, 19 aa, Mycobacterium tuberculosis
GVRELLLTHIPPWTSREDV

SEQ ID NO: 1557287 - protein, 19 aa, Mycobacterium tuberculosis
GVVITYRNLLSNMRAMAVG

SEQ ID NO: 1557288 - protein, 19 aa, Mycobacterium tuberculosis
GVVLLAGAAFVELALRAAD

SEQ ID NO: 1557289 - protein, 24 aa, Mycobacterium tuberculosis
GVVNVYAIAVLKRTSQPALARQFV

SEQ ID NO: 1557290 - protein, 23 aa, Mycobacterium tuberculosis
GVWRSLNWITVPKVKRFAAKDAT

SEQ ID NO: 1557291 - protein, 26 aa, Mycobacterium tuberculosis
GWDWFGLQFYNGTALMLFQIRQADGS

SEQ ID NO: 1557292 - protein, 17 aa, Mycobacterium tuberculosis
GWLLGDGGAGGIGGAST

SEQ ID NO: 1557293 - protein, 23 aa, Mycobacterium tuberculosis
GWPFVARLLYGRRSLVLVHHCHR

SEQ ID NO: 1557294 - protein, 18 aa, Mycobacterium tuberculosis
GWWNQAPSALLGAGSGVG

SEQ ID NO: 1557295 - protein, 25 aa, Mycobacterium tuberculosis
GYGRALEFIAYRYALATGIIDETGF

SEQ ID NO: 1557296 - protein, 17 aa, Mycobacterium tuberculosis
GYQLTFFRRALAPPGEG

SEQ ID NO: 1557297 - protein, 22 aa, Mycobacterium tuberculosis
HAPVCAGVDWRRRGVCGCRGRQ

SEQ ID NO: 1557298 - protein, 27 aa, Mycobacterium tuberculosis
HASVPPSWAWPKPAVAPPVLFGCRPSA

SEQ ID NO: 1557299 - protein, 24 aa, Mycobacterium tuberculosis
HATGLVVVPVMFDRIMDLPAEIRN

SEQ ID NO: 1557300 - protein, 18 aa, Mycobacterium tuberculosis
HAVPAPFEPVADTIAPGL

SEQ ID NO: 1557301 - protein, 35 aa, Mycobacterium tuberculosis
HAYRNVTLAEGPPGLISSRIPPAGRPIGLAPAVIA

SEQ ID NO: 1557302 - protein, 21 aa, Mycobacterium tuberculosis
HDGRTWYRTGDLARYWHDGTL

SEQ ID NO: 1557303 - protein, 25 aa, Mycobacterium tuberculosis
HEVVGVHMALWTAPGTLRTGSRGCC

SEQ ID NO: 1557304 - protein, 17 aa, Mycobacterium tuberculosis
HFTGAFRPGGRPAHPGS

SEQ ID NO: 1557305 - protein, 23 aa, Mycobacterium tuberculosis
HGGNGGWLLGNGGNGGLGGDGDG

SEQ ID NO: 1557306 - protein, 37 aa, Mycobacterium tuberculosis; identical to SEQ ID NO: 236492

SEQ ID NO: 1557307 - protein, 18 aa, Mycobacterium tuberculosis
HGGVGGAAGLLGVGGHGG

SEQ ID NO: 1557308 - protein, 35 aa, Mycobacterium tuberculosis
HGSWPPRAPSRPRSWLLRPIGSLGCCALRVSAPRP

SEQ ID NO: 1557309 - protein, 24 aa, Mycobacterium tuberculosis
HHPGDVISVTWKPVGRHAYRNVTL

SEQ ID NO: 1557310 - protein, 37 aa, Mycobacterium tuberculosis
HISDTNLLAWYQRSHRDLPWREPGVSPWQILVSEFML

SEQ ID NO: 1557311 - protein, 18 aa, Mycobacterium tuberculosis
HKDVVLSAGWDEDLFRRM

SEQ ID NO: 1557312 - protein, 17 aa, Mycobacterium tuberculosis
HLGVRPPVEADWLLLVE

SEQ ID NO: 1557313 - protein, 22 aa, Mycobacterium tuberculosis
HLHHRFRARGLLRDRRRGGFGR

SEQ ID NO: 1557314 - protein, 17 aa, Mycobacterium tuberculosis
HLHIMGEVVDRSIFMWT

SEQ ID NO: 1557315 - protein, 21 aa, Mycobacterium tuberculosis
HLLMTSPLLRRFNDLQATTLM

SEQ ID NO: 1557316 - protein, 17 aa, Mycobacterium tuberculosis
HMLMARGAQEFDSLFPG

SEQ ID NO: 1557317 - protein, 20 aa, Mycobacterium tuberculosis
HPQPSLRRRARITRGSASSG

SEQ ID NO: 1557318 - protein, 17 aa, Mycobacterium tuberculosis
HPYRQRATPIPILEQAI

SEQ ID NO: 1557319 - protein, 17 aa, Mycobacterium tuberculosis
HQQFVQALTGAGGAYCG

SEQ ID NO: 1557320 - protein, 23 aa, Mycobacterium tuberculosis
HQYPDFRGFLAEVARVLRPGGHF

SEQ ID NO: 1557321 - protein, 25 aa, Mycobacterium tuberculosis
HRGNPLMVLLEYLPHARDLGFTSGG

SEQ ID NO: 1557322 - protein, 27 aa, Mycobacterium tuberculosis
HRPAVWHGVAWGGSGRWYRAPGPPTVV

SEQ ID NO: 1557323 - protein, 25 aa, Mycobacterium tuberculosis
HRPRRHRLRRHRRAAGLPRSLRPPL

SEQ ID NO: 1557324 - protein, 18 aa, Mycobacterium tuberculosis
HRTLYALVAGLPKHKIRV

SEQ ID NO: 1557325 - protein, 24 aa, Mycobacterium tuberculosis
HSRLATFALALAAAALPLARLQFH

SEQ ID NO: 1557326 - protein, 26 aa, Mycobacterium tuberculosis
HSTLGPVHILIDLPAVPGFGNTTGAP

SEQ ID NO: 1557327 - protein, 17 aa, Mycobacterium tuberculosis
HSWRRNIALSADDVLAA

SEQ ID NO: 1557328 - protein, 22 aa, Mycobacterium tuberculosis
HTNLEFLSCFLGLMLHGAVPVP

SEQ ID NO: 1557329 - protein, 17 aa, Mycobacterium tuberculosis
HVGWLDDRKWAYVRLEG

SEQ ID NO: 1557330 - protein, 28 aa, Mycobacterium tuberculosis
IAAAEAMYEQMWAADVAAMVGYHGGASA

SEQ ID NO: 1557331 - protein, 17 aa, Mycobacterium tuberculosis
IAATEFDYLEMWAQDVA

SEQ ID NO: 1557332 - protein, 17 aa, Mycobacterium tuberculosis
IAAYLRLGYGPQTAEFR

SEQ ID NO: 1557333 - protein, 24 aa, Mycobacterium tuberculosis
IAEQLMPHWMLSCGPSTCARGGTV

SEQ ID NO: 1557334 - protein, 33 aa, Mycobacterium tuberculosis
IAIAPTRPAFPRDLPCVSPVRLGTFQPGSARSA

SEQ ID NO: 1557335 - protein, 22 aa, Mycobacterium tuberculosis
IALEIPAIPINAQLFSMPIHQV

SEQ ID NO: 1557336 - protein, 21 aa, Mycobacterium tuberculosis
IAQLDLAYHDIKRGRGIFDLL

SEQ ID NO: 1557337 - protein, 26 aa, Mycobacterium tuberculosis
IARDSLVKTALFGSDPNWGRVLAAVG

SEQ ID NO: 1557338 - protein, 19 aa, Mycobacterium tuberculosis
IARNDRYWGPPSKPGIILF

SEQ ID NO: 1557339 - protein, 18 aa, Mycobacterium tuberculosis
IARSFAAALGLDFTRVQF

SEQ ID NO: 1557340 - protein, 29 aa, Mycobacterium tuberculosis
IARVIMRSAIGFFASFTVSSGVLAANVLA

SEQ ID NO: 1557341 - protein, 22 aa, Mycobacterium tuberculosis
IATTRFLLDVNISGGLPAFTLF

SEQ ID NO: 1557342 - protein, 18 aa, Mycobacterium tuberculosis
IDAFQVVAGVLFLENIIV

SEQ ID NO: 1557343 - protein, 18 aa, Mycobacterium tuberculosis
IDIPAFDIQITGGFIGIR

SEQ ID NO: 1557344 - protein, 25 aa, Mycobacterium tuberculosis
IDSMHLGRYLGISDLMVAAPRQESN

SEQ ID NO: 1557345 - protein, 17 aa, Mycobacterium tuberculosis
IDVFNAPIQAATGRPLI

SEQ ID NO: 1557346 - protein, 39 aa, Mycobacterium tuberculosis; identical to SEQ ID NO: 1515807

SEQ ID NO: 1557347 - protein, 29 aa, Mycobacterium tuberculosis
IEPQPLRAKISFWFDRKYRVPADAAAAIL

SEQ ID NO: 1557348 - protein, 19 aa, Mycobacterium tuberculosis
IEPQTSVLIGTQGGDGTPG

SEQ ID NO: 1557349 - protein, 24 aa, Mycobacterium tuberculosis
IEQFPLTYHAVGGIGPLHVAPVPI

SEQ ID NO: 1557350 - protein, 25 aa, Mycobacterium tuberculosis
IERSRVMATRPPIIAPAPRPVTRDA

SEQ ID NO: 1557351 - protein, 18 aa, Mycobacterium tuberculosis
IFLAIAEAGSLGGAAREL

SEQ ID NO: 1557352 - protein, 28 aa, Mycobacterium tuberculosis
IFLRQVQDVWIWVRPYFDDRATAAAKQL

SEQ ID NO: 1557353 - protein, 28 aa, Mycobacterium tuberculosis
IFPGGFTIDPLPLSLALNISVPDSSVPI

SEQ ID NO: 1557354 - protein, 18 aa, Mycobacterium tuberculosis
IGAGLGVGALSGMWGIPA

SEQ ID NO: 1557355 - protein, 19 aa, Mycobacterium tuberculosis
IGAPPIVIGPLYAEKTIQL

SEQ ID NO: 1557356 - protein, 19 aa, Mycobacterium tuberculosis
IGDIPIPIIDVPAVPGFGN

SEQ ID NO: 1557357 - protein, 29 aa, Mycobacterium tuberculosis
IGEPGLDWRWLVLWWKSHAPHIANNLMND

SEQ ID NO: 1557358 - protein, 17 aa, Mycobacterium tuberculosis
IGFHTASSRLALWCVAV

SEQ ID NO: 1557359 - protein, 24 aa, Mycobacterium tuberculosis
IGGFTIPPGPFPRSRFASTQSSTS

SEQ ID NO: 1557360 - protein, 28 aa, Mycobacterium tuberculosis
IGGTGGVLLGLDGFTAPASTSPLHTLQQ

SEQ ID NO: 1557361 - protein, 17 aa, Mycobacterium tuberculosis
IGHQGPPASWKPGGRPV

SEQ ID NO: 1557362 - protein, 47 aa, Mycobacterium tuberculosis; identical to SEQ ID NO: 1512615

SEQ ID NO: 1557363 - protein, 17 aa, Mycobacterium tuberculosis
IGKARLIVWPPSRWGVV

SEQ ID NO: 1557364 - protein, 17 aa, Mycobacterium tuberculosis
IGKLSLPPNWAGASPSL

SEQ ID NO: 1557365 - protein, 17 aa, Mycobacterium tuberculosis
IGKRFGVPVPNLTPWRA

SEQ ID NO: 1557366 - protein, 25 aa, Mycobacterium tuberculosis
IGPIVIPDTTILPPLHLQITGDADY

SEQ ID NO: 1557367 - protein, 17 aa, Mycobacterium tuberculosis
IGRTLLGLAATAVTAVL

SEQ ID NO: 1557368 - protein, 23 aa, Mycobacterium tuberculosis
IGSITIPIIDIPATSGFGNSTTS

SEQ ID NO: 1557369 - protein, 27 aa, Mycobacterium tuberculosis
IGTLGFTIPGFTIPAAPLPLTIDIDGQ

SEQ ID NO: 1557370 - protein, 21 aa, Mycobacterium tuberculosis
IGYATNYYMLQHSLVLQPANQ

SEQ ID NO: 1557371 - protein, 20 aa, Mycobacterium tuberculosis
IHQTFSLGPLVVPDIVIPAF

SEQ ID NO: 1557372 - protein, 28 aa, Mycobacterium tuberculosis
IIAVDTKPVTVFLGATPIGDATSRATVE

SEQ ID NO: 1557373 - protein, 18 aa, Mycobacterium tuberculosis
IISDKLFQRVGARPDSVT

SEQ ID NO: 1557374 - protein, 18 aa, Mycobacterium tuberculosis
IITTPSWLEVPLAMRDGL

SEQ ID NO: 1557375 - protein, 17 aa, Mycobacterium tuberculosis
IKKVTERLPLPPNARRV

SEQ ID NO: 1557376 - protein, 19 aa, Mycobacterium tuberculosis
IKLAWITAVVAGLMVGVAT

SEQ ID NO: 1557377 - protein, 20 aa, Mycobacterium tuberculosis
ILAPLTPAAIFLVATIGADG

SEQ ID NO: 1557378 - protein, 17 aa, Mycobacterium tuberculosis
ILFMDDDIRLEPDSILR

SEQ ID NO: 1557379 - protein, 19 aa, Mycobacterium tuberculosis
ILVAVTRWTVRLQQTGWDH

SEQ ID NO: 1557380 - protein, 29 aa, Mycobacterium tuberculosis
IMATEALYAEMWAQDALAMYGYAAASGAA

SEQ ID NO: 1557381 - protein, 20 aa, Mycobacterium tuberculosis
INLAGFYDLAQTLGGVDVCL

SEQ ID NO: 1557382 - protein, 26 aa, Mycobacterium tuberculosis
IPDDLLNALIDFLAAVRNGLVPIIEN

SEQ ID NO: 1557383 - protein, 24 aa, Mycobacterium tuberculosis
IPGFSIPEQPLPLAINVIGHINAL

SEQ ID NO: 1557384 - protein, 17 aa, Mycobacterium tuberculosis
IPIIDVPAVPGFGNTTT

SEQ ID NO: 1557385 - protein, 37 aa, Mycobacterium tuberculosis; identical to SEQ ID NO: 1516838

SEQ ID NO: 1557386 - protein, 18 aa, Mycobacterium tuberculosis
IPTNAIPLTIDASGALDP

SEQ ID NO: 1557387 - protein, 18 aa, Mycobacterium tuberculosis
IPTVFYGAHVRPGAYNET

SEQ ID NO: 1557388 - protein, 21 aa, Mycobacterium tuberculosis
IPVRVYWPPVVRDNLPVVVYY

SEQ ID NO: 1557389 - protein, 19 aa, Mycobacterium tuberculosis
IPVVMGVRVGPVVLVGGCL

SEQ ID NO: 1557390 - protein, 18 aa, Mycobacterium tuberculosis
IQPVLVAASLLVAELGDV

SEQ ID NO: 1557391 - protein, 23 aa, Mycobacterium tuberculosis
IRGRLTLGVLVSCPLDVADGTAL

SEQ ID NO: 1557392 - protein, 19 aa, Mycobacterium tuberculosis
IRLKNWVATLTLSLKKDVT

SEQ ID NO: 1557393 - protein, 23 aa, Mycobacterium tuberculosis
IRRMLGLLAATLLLGGCTGQHTT

SEQ ID NO: 1557394 - protein, 18 aa, Mycobacterium tuberculosis
IRRYDVDAAILFSDIVVP

SEQ ID NO: 1557395 - protein, 24 aa, Mycobacterium tuberculosis
IRVNSVAPGYIWGDTLKSYFDYQA

SEQ ID NO: 1557396 - protein, 25 aa, Mycobacterium tuberculosis
ISGIELINQWYYNPEFFAIMSDCAN

SEQ ID NO: 1557397 - protein, 26 aa, Mycobacterium tuberculosis
ISGLSIGSPIPLSLALGTTTWTLFPN

SEQ ID NO: 1557398 - protein, 18 aa, Mycobacterium tuberculosis
ISGLVRAIGFRDPTKHLS

SEQ ID NO: 1557399 - protein, 27 aa, Mycobacterium tuberculosis
ISGSYSNGFLWSGNYQGLIGLHAALAI

SEQ ID NO: 1557400 - protein, 26 aa, Mycobacterium tuberculosis
ISIGPIKINPITLWPAQNFNQTITLA

SEQ ID NO: 1557401 - protein, 31 aa, Mycobacterium tuberculosis
ISSGLMNTGFLPFRFQPVYIDYSPSGIGTTV

SEQ ID NO: 1557402 - protein, 25 aa, Mycobacterium tuberculosis
ISTQVAAFHDRFGHTLSAAVGSYVS

SEQ ID NO: 1557403 - protein, 18 aa, Mycobacterium tuberculosis
ITEYGPHVALPPTELEMA

SEQ ID NO: 1557404 - protein, 27 aa, Mycobacterium tuberculosis
ITFLHFVRLPAMLFGVGRYTVTMELVE

SEQ ID NO: 1557405 - protein, 29 aa, Mycobacterium tuberculosis
ITITGGGAIRIPLISIPAAPGFGNSTTNP

SEQ ID NO: 1557406 - protein, 23 aa, Mycobacterium tuberculosis
ITQAPLNALWQLTKAVRAELSDP

SEQ ID NO: 1557407 - protein, 19 aa, Mycobacterium tuberculosis
IVAGWHGRPWAHHVPVMRE

SEQ ID NO: 1557408 - protein, 17 aa, Mycobacterium tuberculosis
IVGIIADVLHAADQWAV

SEQ ID NO: 1557409 - protein, 19 aa, Mycobacterium tuberculosis
IVIAVIGYQRISTSAVTGS

SEQ ID NO: 1557410 - protein, 22 aa, Mycobacterium tuberculosis
IVTPRVMQFTLRANVPKLADTQ

SEQ ID NO: 1557411 - protein, 19 aa, Mycobacterium tuberculosis
IWCMDWPAVATAAAAGLSA

SEQ ID NO: 1557412 - protein, 18 aa, Mycobacterium tuberculosis
IYQEMLANYRVGQANSVL

SEQ ID NO: 1557413 - protein, 27 aa, Mycobacterium tuberculosis
KADFDPYQFLLIPLARITGIEDPALRE

SEQ ID NO: 1557414 - protein, 20 aa, Mycobacterium tuberculosis
KALAATHQDGSMGAGGAGGN

SEQ ID NO: 1557415 - protein, 20 aa, Mycobacterium tuberculosis
KARLIVWPPSRWGVVRSVNP

SEQ ID NO: 1557416 - protein, 23 aa, Mycobacterium tuberculosis
KARLVGAMSVPPTWEGSVPARMA

SEQ ID NO: 1557417 - protein, 19 aa, Mycobacterium tuberculosis
KDPVFRERMKREARIAGRL

SEQ ID NO: 1557418 - protein, 20 aa, Mycobacterium tuberculosis
KDPVFRERMKREARIAGRLQ

SEQ ID NO: 1557419 - protein, 24 aa, Mycobacterium tuberculosis
KDVQQQLPAGSPVKKKKKKKKKKK

SEQ ID NO: 1557420 - protein, 17 aa, Mycobacterium tuberculosis
KGGDAFATFAKAGNGGA

SEQ ID NO: 1557421 - protein, 20 aa, Mycobacterium tuberculosis
KGMMLSGIPNMAYTVGYTNA

SEQ ID NO: 1557422 - protein, 23 aa, Mycobacterium tuberculosis
KGRSFRIHILFASQTLDVGKIKD

SEQ ID NO: 1557423 - protein, 28 aa, Mycobacterium tuberculosis
KKKKKNKTKKKKKKRVVLSAARTCGSPR

SEQ ID NO: 1557424 - protein, 42 aa, Mycobacterium tuberculosis
KKKREGGGGGWGGPPPSRTGSNPLDLKPATVQPPTQEVAAAP

SEQ ID NO: 1557425 - protein, 28 aa, Mycobacterium tuberculosis
KKQGGQWGGLCVWPRPLEPGVLGGGGEE

SEQ ID NO: 1557426 - protein, 18 aa, Mycobacterium tuberculosis
KLAAMRALWAAEPVHYEG

SEQ ID NO: 1557427 - protein, 17 aa, Mycobacterium tuberculosis
KLAMPFIVLATDNPIEY

SEQ ID NO: 1557428 - protein, 20 aa, Mycobacterium tuberculosis
KLCVQYLAPIVKNRQYNYPP

SEQ ID NO: 1557429 - protein, 25 aa, Mycobacterium tuberculosis
KLNDQAQRTVLCKDPFRAVDERVKR

SEQ ID NO: 1557430 - protein, 18 aa, Mycobacterium tuberculosis
KLRTMPGALSAALAAAAP

SEQ ID NO: 1557431 - protein, 25 aa, Mycobacterium tuberculosis
KLSINPSFVLVLRSRCQAYPRAAHL

SEQ ID NO: 1557432 - protein, 20 aa, Mycobacterium tuberculosis
KLVMRQRLAAAGVAVPRYAG

SEQ ID NO: 1557433 - protein, 23 aa, Mycobacterium tuberculosis
KNLYTVYFAMKFSQPFSSYGTWD

SEQ ID NO: 1557434 - protein, 17 aa, Mycobacterium tuberculosis
KPLIKSAMAAGLVTASM

SEQ ID NO: 1557435 - protein, 19 aa, Mycobacterium tuberculosis
KQFTATAILLLVEAGKLTL

SEQ ID NO: 1557436 - protein, 17 aa, Mycobacterium tuberculosis
KRLQVILDRQIMRKLAG

SEQ ID NO: 1557437 - protein, 17 aa, Mycobacterium tuberculosis
KSCLRNVDRFRPGLLDL

SEQ ID NO: 1557438 - protein, 23 aa, Mycobacterium tuberculosis
KSTIAAALALTLAAGGRKVLLVE

SEQ ID NO: 1557439 - protein, 26 aa, Mycobacterium tuberculosis
KSYPLASFGAALLPPELGGPLPAQFV

SEQ ID NO: 1557440 - protein, 17 aa, Mycobacterium tuberculosis
KVTERLPLPPNARRVED

SEQ ID NO: 1557441 - protein, 19 aa, Mycobacterium tuberculosis
KVVQLSTGAWFDPADPRDP

SEQ ID NO: 1557442 - protein, 38 aa, Mycobacterium tuberculosis
KYMLVEFTDGLPPRLWRNFLAKPPLPALFGKTTNATQV

SEQ ID NO: 1557443 - protein, 26 aa, Mycobacterium tuberculosis
LAAAPLVTLYKQYVVRFGLGYCEEVH

SEQ ID NO: 1557444 - protein, 23 aa, Mycobacterium tuberculosis
LAAATPMVVWLQTASTQAKTRAM

SEQ ID NO: 1557445 - protein, 25 aa, Mycobacterium tuberculosis
LAADRRRRGVDGYRGAVRRECAGIP

SEQ ID NO: 1557446 - protein, 31 aa, Mycobacterium tuberculosis
LAAINAPTQTLTGRPLIGNGTPGAVGSGATG

SEQ ID NO: 1557447 - protein, 17 aa, Mycobacterium tuberculosis
LAALRETGFITYQPRDR

SEQ ID NO: 1557448 - protein, 19 aa, Mycobacterium tuberculosis
LAAQLAVYLAPPGYGEMFS

SEQ ID NO: 1557449 - protein, 25 aa, Mycobacterium tuberculosis
LAATVDPFVIAANRSRLVSLALSNL

SEQ ID NO: 1557450 - protein, 17 aa, Mycobacterium tuberculosis
LAATVVVAGWWTPPAWA

SEQ ID NO: 1557451 - protein, 26 aa, Mycobacterium tuberculosis
LAELPGEPPRLFVVTRSAASVLPSDL

SEQ ID NO: 1557452 - protein, 18 aa, Mycobacterium tuberculosis
LAEQRRHLLQRLGQLLHR

SEQ ID NO: 1557453 - protein, 21 aa, Mycobacterium tuberculosis
LAERPALSLSLDEACLLMFAR

SEQ ID NO: 1557454 - protein, 21 aa, Mycobacterium tuberculosis
LAESIRPLVAPPPAPAPAPAE

SEQ ID NO: 1557455 - protein, 22 aa, Mycobacterium tuberculosis
LAGGRPVHRCYPCCPGPPGRSG

SEQ ID NO: 1557456 - protein, 18 aa, Mycobacterium tuberculosis
LAGLFDDDVFAWRGVLQS

SEQ ID NO: 1557457 - protein, 19 aa, Mycobacterium tuberculosis
LAGQSWQGAAAAAMAAAAA

SEQ ID NO: 1557458 - protein, 22 aa, Mycobacterium tuberculosis
LAGRRVVINLWAHWCAPCMTEL

SEQ ID NO: 1557459 - protein, 34 aa, Mycobacterium tuberculosis; identical to SEQ ID NO: 219875

SEQ ID NO: 1557460 - protein, 19 aa, Mycobacterium tuberculosis
LAITWAHPELPQRAFDLGA

SEQ ID NO: 1557461 - protein, 31 aa, Mycobacterium tuberculosis
LALGTTTWTLFPNGWTIPAQTPVTLGLSGGN

SEQ ID NO: 1557462 - protein, 18 aa, Mycobacterium tuberculosis
LALLLIGAHAFFVGAEFA

SEQ ID NO: 1557463 - protein, 18 aa, Mycobacterium tuberculosis
LAMGVVLGSGFFSDTLLS

SEQ ID NO: 1557464 - protein, 18 aa, Mycobacterium tuberculosis
LAMRDTPWLVKDGQPFIP

SEQ ID NO: 1557465 - protein, 17 aa, Mycobacterium tuberculosis
LAPPAPADLAPPAPADL

SEQ ID NO: 1557466 - protein, 18 aa, Mycobacterium tuberculosis
LAQLNPRLPQLGYDVRRL

SEQ ID NO: 1557467 - protein, 28 aa, Mycobacterium tuberculosis
LASGGVGLLGWAWVVAGAVDLLTTGDIS

SEQ ID NO: 1557468 - protein, 18 aa, Mycobacterium tuberculosis
LASIGSSINASTRAAAAA

SEQ ID NO: 1557469 - protein, 26 aa, Mycobacterium tuberculosis
LASSCTWQLSLFIPDGVPPPPGDPVP

SEQ ID NO: 1557470 - protein, 19 aa, Mycobacterium tuberculosis
LATPGFLSGIGNFGTNLAG

SEQ ID NO: 1557471 - protein, 18 aa, Mycobacterium tuberculosis
LAVASPCAYFLVYESTET

SEQ ID NO: 1557472 - protein, 20 aa, Mycobacterium tuberculosis
LAVFLAPRLIPRGPRGDLAS

SEQ ID NO: 1557473 - protein, 17 aa, Mycobacterium tuberculosis
LAWAETYPGTLSYYLAS

SEQ ID NO: 1557474 - protein, 22 aa, Mycobacterium tuberculosis
LAWRTKRLIVFDVDSTLVQGEV

SEQ ID NO: 1557475 - protein, 20 aa, Mycobacterium tuberculosis
LCEFVEFPSQLLQVCGDSFA

SEQ ID NO: 1557476 - protein, 17 aa, Mycobacterium tuberculosis
LDDLAERPALSLSLDEA

SEQ ID NO: 1557477 - protein, 25 aa, Mycobacterium tuberculosis
LDDVNLRRLLSLFEQLREQSQIIII

SEQ ID NO: 1557478 - protein, 18 aa, Mycobacterium tuberculosis
LDKPVKWMEDRSENLTST

SEQ ID NO: 1557479 - protein, 31 aa, Mycobacterium tuberculosis
LDTGSSSLVIPFWKIGWAEPGLAHRVRCRSL

SEQ ID NO: 1557480 - protein, 26 aa, Mycobacterium tuberculosis
LEGRDWNWLKWLPHVDIPGRLDALGP

SEQ ID NO: 1557481 - protein, 21 aa, Mycobacterium tuberculosis
LENRIKAMPPSSVVGLWTFDG

SEQ ID NO: 1557482 - protein, 17 aa, Mycobacterium tuberculosis
LEQGLLGAINAPAAALS

SEQ ID NO: 1557483 - protein, 24 aa, Mycobacterium tuberculosis
LEVNTLFQSLIDLLHKIDPLETNA

SEQ ID NO: 1557484 - protein, 17 aa, Mycobacterium tuberculosis
LFCAQDLAYQEASALAA

SEQ ID NO: 1557485 - protein, 17 aa, Mycobacterium tuberculosis
LFGAHGQAYQAVSAQMS

SEQ ID NO: 1557486 - protein, 17 aa, Mycobacterium tuberculosis
LFGMLSVAFMHSIGAPP

SEQ ID NO: 1557487 - protein, 19 aa, Mycobacterium tuberculosis
LFGTLSLWQGVDVPGPSLS

SEQ ID NO: 1557488 - protein, 19 aa, Mycobacterium tuberculosis
LFLENIIVPGLTVSGQILV

SEQ ID NO: 1557489 - protein, 19 aa, Mycobacterium tuberculosis
LFSAHGRAYQVASAQAAAV

SEQ ID NO: 1557490 - protein, 20 aa, Mycobacterium tuberculosis
LFSAYLGFTIEQFPLTYHAV

SEQ ID NO: 1557491 - protein, 20 aa, Mycobacterium tuberculosis
LFVMDHFYQLPMLGTPDQPM

SEQ ID NO: 1557492 - protein, 31 aa, Mycobacterium tuberculosis; identical to SEQ ID NO: 1525928

SEQ ID NO: 1557493 - protein, 20 aa, Mycobacterium tuberculosis
LGALPMLHAAFERAGRDPAT

SEQ ID NO: 1557494 - protein, 26 aa, Mycobacterium tuberculosis
LGARLFSIIAWRTYLVRDPHALSLLD

SEQ ID NO: 1557495 - protein, 17 aa, Mycobacterium tuberculosis
LGCCALRVSAPRPTCRR

SEQ ID NO: 1557496 - protein, 21 aa, Mycobacterium tuberculosis
LGCWPASRWEIAPTAQALWMR

SEQ ID NO: 1557497 - protein, 23 aa, Mycobacterium tuberculosis
LGDYEWILAFEAPELDRIVDLMR

SEQ ID NO: 1557498 - protein, 17 aa, Mycobacterium tuberculosis
LGEPLPAAPAELAPPAD

SEQ ID NO: 1557499 - protein, 25 aa, Mycobacterium tuberculosis
LGGGSFGLPGLNGSCGDGGDGGNGA

SEQ ID NO: 1557500 - protein, 25 aa, Mycobacterium tuberculosis
LGLINAPTQALLGRPLIGNGADGTA

SEQ ID NO: 1557501 - protein, 25 aa, Mycobacterium tuberculosis
LGLINAPTQALWGRPLIGNGADGTA

SEQ ID NO: 1557502 - protein, 26 aa, Mycobacterium tuberculosis
LGLINAPTQALWGRPLIGNGADGTAA

SEQ ID NO: 1557503 - protein, 25 aa, Mycobacterium tuberculosis
LGLSLLWVLRGWRRPDDVRVRPTAA

SEQ ID NO: 1557504 - protein, 25 aa, Mycobacterium tuberculosis
LGMAAASFSLLISGLTAGPGSAWQG

SEQ ID NO: 1557505 - protein, 24 aa, Mycobacterium tuberculosis
LGNSGLLNFGALQSGLANLGNTIS

SEQ ID NO: 1557506 - protein, 18 aa, Mycobacterium tuberculosis
LGPFTIPEIHIPKIPIDV

SEQ ID NO: 1557507 - protein, 18 aa, Mycobacterium tuberculosis
LGPLVVPDIVIPAFGGGI

SEQ ID NO: 1557508 - protein, 19 aa, Mycobacterium tuberculosis
LGPTMIAIAANSPMLGGRF

SEQ ID NO: 1557509 - protein, 26 aa, Mycobacterium tuberculosis
LGVHRIFLITVALALLTASPASAITP

SEQ ID NO: 1557510 - protein, 26 aa, Mycobacterium tuberculosis
LGVINAPTQTLVGRPLIGDGTHGAPG

SEQ ID NO: 1557511 - protein, 19 aa, Mycobacterium tuberculosis
LGYRELGHWQLGQQIKRPR

SEQ ID NO: 1557512 - protein, 23 aa, Mycobacterium tuberculosis
LHAPTRLALLTGLAPHQVTDDDV

SEQ ID NO: 1557513 - protein, 37 aa, Mycobacterium tuberculosis
LHCDRILFCAKEATYKAWFPLTKRWLGFEDAHITFET

SEQ ID NO: 1557514 - protein, 21 aa, Mycobacterium tuberculosis
LHIVAPVVVGWPVGQLYANMT

SEQ ID NO: 1557515 - protein, 19 aa, Mycobacterium tuberculosis
LHKMRRLIIASEPVHAEGM

SEQ ID NO: 1557516 - protein, 18 aa, Mycobacterium tuberculosis
LIFYFAQGELLPSFVGAC

SEQ ID NO: 1557517 - protein, 17 aa, Mycobacterium tuberculosis
LIKSAMAAGLVTASMSL

SEQ ID NO: 1557518 - protein, 24 aa, Mycobacterium tuberculosis
LIPPPPIVAPPPRRPAPPQQPPPP

SEQ ID NO: 1557519 - protein, 22 aa, Mycobacterium tuberculosis
LIRARFPTLTARQVMQRIESTA

SEQ ID NO: 1557520 - protein, 17 aa, Mycobacterium tuberculosis
LITAVVLLIALGAVWTP

SEQ ID NO: 1557521 - protein, 19 aa, Mycobacterium tuberculosis
LIVLMVCLAGCGGDQLLAR

SEQ ID NO: 1557522 - protein, 27 aa, Mycobacterium tuberculosis
LKIGPITGLFNTPIGLTPLALSQIVIG

SEQ ID NO: 1557523 - protein, 20 aa, Mycobacterium tuberculosis
LKNFFSFAEILDIDRYRIDG

SEQ ID NO: 1557524 - protein, 24 aa, Mycobacterium tuberculosis
LKYNPEYTCFLQGAKWYLDNGGYA

SEQ ID NO: 1557525 - protein, 27 aa, Mycobacterium tuberculosis
LLAELDRVWGHLPFGAQWYSANELARH

SEQ ID NO: 1557526 - protein, 19 aa, Mycobacterium tuberculosis
LLALAYTATGGRALPGSVT

SEQ ID NO: 1557527 - protein, 18 aa, Mycobacterium tuberculosis
LLALLALLALIVGLGASG

SEQ ID NO: 1557528 - protein, 19 aa, Mycobacterium tuberculosis
LLDKPVKWMEDRSENLTST

SEQ ID NO: 1557529 - protein, 35 aa, Mycobacterium tuberculosis
LLFTNPVKAFQFLVDLILFDWPTHMLQLATWLAEN

SEQ ID NO: 1557530 - protein, 19 aa, Mycobacterium tuberculosis
LLLAVLLAVSGVAGCSADS

SEQ ID NO: 1557531 - protein, 20 aa, Mycobacterium tuberculosis
LLLVLAFAGGDAVAACKTVT

SEQ ID NO: 1557532 - protein, 20 aa, Mycobacterium tuberculosis
LLLVLAFAGGYAVAACKTVT

SEQ ID NO: 1557533 - protein, 26 aa, Mycobacterium tuberculosis
LLNAINAPTLALLGRPLIGDGTDAAP

SEQ ID NO: 1557534 - protein, 25 aa, Mycobacterium tuberculosis
LLNAINAPTLALLVTPRLIRAREPM

SEQ ID NO: 1557535 - protein, 28 aa, Mycobacterium tuberculosis
LLNAINAPTQALLGRPLIGDGAVGTASS

SEQ ID NO: 1557536 - protein, 30 aa, Mycobacterium tuberculosis
LLNAINAPTQALLGRPLIGDGAVGTASSPD

SEQ ID NO: 1557537 - protein, 28 aa, Mycobacterium tuberculosis
LLNLINAPTQALLGRPLIGNGANGLPGT

SEQ ID NO: 1557538 - protein, 22 aa, Mycobacterium tuberculosis
LLPGQFVQPFISGAFSDLGLEP

SEQ ID NO: 1557539 - protein, 19 aa, Mycobacterium tuberculosis
LLQMTGMYQAIANDGVRVP

SEQ ID NO: 1557540 - protein, 18 aa, Mycobacterium tuberculosis
LLVAMAMLVSVTGCARHA

SEQ ID NO: 1557541 - protein, 17 aa, Mycobacterium tuberculosis
LLVVSALATLSGLGTPV

SEQ ID NO: 1557542 - protein, 19 aa, Mycobacterium tuberculosis
LMFHRGTFVGTATPRAYPF

SEQ ID NO: 1557543 - protein, 21 aa, Mycobacterium tuberculosis
LMKTILALRHGVVPQNLHFCR

SEQ ID NO: 1557544 - protein, 23 aa, Mycobacterium tuberculosis
LMKTILALRHGVVPQNLHFCRLP

SEQ ID NO: 1557545 - protein, 32 aa, Mycobacterium tuberculosis
LMSRAAGLPRLSWFAGLTWFAGGSTGAGCAAH

SEQ ID NO: 1557546 - protein, 25 aa, Mycobacterium tuberculosis
LNAINAPTLALLGRPLIGNGADGAA

SEQ ID NO: 1557547 - protein, 27 aa, Mycobacterium tuberculosis
LNAINAPTQALLGRPLIGDGAVGTASS

SEQ ID NO: 1557548 - protein, 26 aa, Mycobacterium tuberculosis
LNIVNTPTQLLLGRPLIGNGANGAPG

SEQ ID NO: 1557549 - protein, 18 aa, Mycobacterium tuberculosis
LNLEYKLEVWDSPNSAGV

SEQ ID NO: 1557550 - protein, 17 aa, Mycobacterium tuberculosis
LNWRPRFDLNAVAARLA

SEQ ID NO: 1557551 - protein, 35 aa, Mycobacterium tuberculosis
LPAGLPTLPPVPALPAPPPLPGPPPLPALPSRLCT

SEQ ID NO: 1557552 - protein, 31 aa, Mycobacterium tuberculosis
LPCFHDMGMVGFLTIPMFFGAELVKVTPMDF

SEQ ID NO: 1557553 - protein, 23 aa, Mycobacterium tuberculosis
LPEIVWYLDEPVADPALVPLFFV

SEQ ID NO: 1557554 - protein, 21 aa, Mycobacterium tuberculosis
LPGAAIWHMAWSDKDDAIDWQ

SEQ ID NO: 1557555 - protein, 18 aa, Mycobacterium tuberculosis
LPGEQLLRPDELARLIHI

SEQ ID NO: 1557556 - protein, 18 aa, Mycobacterium tuberculosis
LPGLKPPVLVLPALKLPV

SEQ ID NO: 1557557 - protein, 21 aa, Mycobacterium tuberculosis
LPPVAEPPPPAAPPVAEPPPP

SEQ ID NO: 1557558 - protein, 21 aa, Mycobacterium tuberculosis
LPQLVVHPYTLTGPIVIGSFF

SEQ ID NO: 1557559 - protein, 18 aa, Mycobacterium tuberculosis
LPVCTPQVISRHPVSPRA

SEQ ID NO: 1557560 - protein, 38 aa, Mycobacterium tuberculosis
LQALEQQVLGAINAPTQLWLGRPLIGDGVHGAPGTGQP

SEQ ID NO: 1557561 - protein, 20 aa, Mycobacterium tuberculosis
LQALQLELLNAINAPTLALL

SEQ ID NO: 1557562 - protein, 18 aa, Mycobacterium tuberculosis
LQMGGWGAGARRGKAAVR

SEQ ID NO: 1557563 - protein, 30 aa, Mycobacterium tuberculosis; identical to SEQ ID NO: 220341

SEQ ID NO: 1557564 - protein, 31 aa, Mycobacterium tuberculosis
LQQTPAARVLAIWPDWVRRWPTPSATATAST

SEQ ID NO: 1557565 - protein, 18 aa, Mycobacterium tuberculosis
LQRRVATLAGLPATVIDD

SEQ ID NO: 1557566 - protein, 17 aa, Mycobacterium tuberculosis
LQVGDCLADLPPADLSR

SEQ ID NO: 1557567 - protein, 24 aa, Mycobacterium tuberculosis
LRDGSYLPMTFAANDIAWSDNKPS

SEQ ID NO: 1557568 - protein, 19 aa, Mycobacterium tuberculosis
LRGLMRVIDSEHPHLGATA

SEQ ID NO: 1557569 - protein, 17 aa, Mycobacterium tuberculosis
LRIVLGHELFHYAARAD

SEQ ID NO: 1557570 - protein, 19 aa, Mycobacterium tuberculosis
LRLIVWELVARHSASRPAA

SEQ ID NO: 1557571 - protein, 33 aa, Mycobacterium tuberculosis
LRRCPHPAEVTWHWWWLGAADLGGLLVVTEALG

SEQ ID NO: 1557572 - protein, 18 aa, Mycobacterium tuberculosis
LSAAAAAFHDQFVRALAA

SEQ ID NO: 1557573 - protein, 17 aa, Mycobacterium tuberculosis
LSAQAAMFHEQFVRALA

SEQ ID NO: 1557574 - protein, 23 aa, Mycobacterium tuberculosis
LSAQAAMFHEQFVRALAAGGNSY

SEQ ID NO: 1557575 - protein, 24 aa, Mycobacterium tuberculosis
LSAQALAFHDQFVQALNMGAVCYA

SEQ ID NO: 1557576 - protein, 25 aa, Mycobacterium tuberculosis
LSAQALAFHDQFVQALNMGAVCYAA

SEQ ID NO: 1557577 - protein, 28 aa, Mycobacterium tuberculosis
LSDGFRVPGLPMPSLPVIGGDAAAACIA

SEQ ID NO: 1557578 - protein, 20 aa, Mycobacterium tuberculosis
LSGLGLTMTGPRPGGFGALD

SEQ ID NO: 1557579 - protein, 27 aa, Mycobacterium tuberculosis
LSGVSTPFGWTFPYAGPRMHILATNVV

SEQ ID NO: 1557580 - protein, 19 aa, Mycobacterium tuberculosis
LSGWWNQAASALAGSGSGV

SEQ ID NO: 1557581 - protein, 21 aa, Mycobacterium tuberculosis
LSLSLDEACLLMFARRDLTAA

SEQ ID NO: 1557582 - protein, 17 aa, Mycobacterium tuberculosis
LSPANWNRIIAPGGSAT

SEQ ID NO: 1557583 - protein, 23 aa, Mycobacterium tuberculosis
LSPIDYRQYVLPHSARVFAALGE

SEQ ID NO: 1557584 - protein, 22 aa, Mycobacterium tuberculosis
LSQFGINIPPVPSLTGSGDAST

SEQ ID NO: 1557585 - protein, 19 aa, Mycobacterium tuberculosis
LSRRLRIPAALAGVGAGLA

SEQ ID NO: 1557586 - protein, 18 aa, Mycobacterium tuberculosis
LSVPPAWAAANQAVTPAA

SEQ ID NO: 1557587 - protein, 30 aa, Mycobacterium tuberculosis; identical to SEQ ID NO: 237336

SEQ ID NO: 1557588 - protein, 20 aa, Mycobacterium tuberculosis
LSVQVTAFHVQFAQTLTNAG

SEQ ID NO: 1557589 - protein, 18 aa, Mycobacterium tuberculosis
LTAGVWPGAAAAAMAAAA

SEQ ID NO: 1557590 - protein, 28 aa, Mycobacterium tuberculosis
LTAVAMLVAIFRARPSPFYIMDEVEAAL

SEQ ID NO: 1557591 - protein, 24 aa, Mycobacterium tuberculosis
LTEMDYFIRMWNQAALAMEVYQAE

SEQ ID NO: 1557592 - protein, 25 aa, Mycobacterium tuberculosis
LTLGLSLAVILALGFVLTSQVTNRV

SEQ ID NO: 1557593 - protein, 31 aa, Mycobacterium tuberculosis; identical to SEQ ID NO: 1512018

SEQ ID NO: 1557594 - protein, 24 aa, Mycobacterium tuberculosis
LTLPPLQIPGISVPAFSLPAITLP

SEQ ID NO: 1557595 - protein, 28 aa, Mycobacterium tuberculosis
LTPDNRMTIVRLLGISYFDEGLLQFEAS

SEQ ID NO: 1557596 - protein, 17 aa, Mycobacterium tuberculosis
LTTGPWTGPASMSMAAA

SEQ ID NO: 1557597 - protein, 20 aa, Mycobacterium tuberculosis
LTTILDPSLPLTVTEWDEWG

SEQ ID NO: 1557598 - protein, 17 aa, Mycobacterium tuberculosis
LTWVRMASSWPAKTVQL

SEQ ID NO: 1557599 - protein, 24 aa, Mycobacterium tuberculosis
LVATALVLVAILLGVTAVLLGLSA

SEQ ID NO: 1557600 - protein, 29 aa, Mycobacterium tuberculosis
LVDRNPTLDFVARFPLLKPLDMSDAICRT

SEQ ID NO: 1557601 - protein, 17 aa, Mycobacterium tuberculosis
LVGHIPSAPGNPGRWGQ

SEQ ID NO: 1557602 - protein, 20 aa, Mycobacterium tuberculosis
LVGRLSVPAAWSTAAPATTA

SEQ ID NO: 1557603 - protein, 25 aa, Mycobacterium tuberculosis
LVHRERAGLLILPGPAPMVARTIVE

SEQ ID NO: 1557604 - protein, 19 aa, Mycobacterium tuberculosis
LVLDFYRCAMLPASPDWKP

SEQ ID NO: 1557605 - protein, 18 aa, Mycobacterium tuberculosis
LVQLSRARALLLGRDYVI

SEQ ID NO: 1557606 - protein, 23 aa, Mycobacterium tuberculosis
LVRTVHLPAPNVAGLLSAAGVPL

SEQ ID NO: 1557607 - protein, 19 aa, Mycobacterium tuberculosis
LVSEFVCRLLNYMDDNGFD

SEQ ID NO: 1557608 - protein, 18 aa, Mycobacterium tuberculosis
LVTAMGRARRRLLVTAVD

SEQ ID NO: 1557609 - protein, 18 aa, Mycobacterium tuberculosis
LVTCVVIIVSYARKPARP

SEQ ID NO: 1557610 - protein, 21 aa, Mycobacterium tuberculosis
LVVPTVALAVPWLTQLQRLFI

SEQ ID NO: 1557611 - protein, 23 aa, Mycobacterium tuberculosis
LYYVMLTFVARPYLIPSESMEPT

SEQ ID NO: 1557612 - protein, 23 aa, Mycobacterium tuberculosis
MAAQYRIRLGGTWKKPGTSDIEI

SEQ ID NO: 1557613 - protein, 30 aa, Mycobacterium tuberculosis
MADQPGRPAGTPGLANRPGTAIAAIAVKDP

SEQ ID NO: 1557614 - protein, 22 aa, Mycobacterium tuberculosis
MASTFTIVAIGTYCPAVIAPLM

SEQ ID NO: 1557615 - protein, 21 aa, Mycobacterium tuberculosis
MAWRTWVWAILGLPTPARATS

SEQ ID NO: 1557616 - protein, 23 aa, Mycobacterium tuberculosis
MDRAGLLALLAGALEGAGAGIVW

SEQ ID NO: 1557617 - protein, 18 aa, Mycobacterium tuberculosis
MFGPYHLKRLLGRGGMGE

SEQ ID NO: 1557618 - protein, 19 aa, Mycobacterium tuberculosis
MFSVFLVSPGALGDQRDAI

SEQ ID NO: 1557619 - protein, 20 aa, Mycobacterium tuberculosis
MGPIPQPSAIRPGIPKAFDA

SEQ ID NO: 1557620 - protein, 18 aa, Mycobacterium tuberculosis
MGPMQFLPGTWARYATDG

SEQ ID NO: 1557621 - protein, 24 aa, Mycobacterium tuberculosis
MGRGRRMRMSWLRSAAPCRPVTDG

SEQ ID NO: 1557622 - protein, 20 aa, Mycobacterium tuberculosis
MHHFKVVTYLKMGCPLSTEE

SEQ ID NO: 1557623 - protein, 19 aa, Mycobacterium tuberculosis
MIAIAANSPMLGGRFSGWQ

SEQ ID NO: 1557624 - protein, 17 aa, Mycobacterium tuberculosis
MIDPLKLNAVLTAVADA

SEQ ID NO: 1557625 - protein, 19 aa, Mycobacterium tuberculosis
MLAGLFDDDVFAWRGVLQS

SEQ ID NO: 1557626 - protein, 21 aa, Mycobacterium tuberculosis
MLVSSWQMPGGIYAPMMHPWS

SEQ ID NO: 1557627 - protein, 27 aa, Mycobacterium tuberculosis
MPDPYQAFVLMAAWLAMRYGELTELRR

SEQ ID NO: 1557628 - protein, 17 aa, Mycobacterium tuberculosis
MPGIPWYEYTNQAGSQY

SEQ ID NO: 1557629 - protein, 20 aa, Mycobacterium tuberculosis
MPNFALEWLINAYHRRGADI

SEQ ID NO: 1557630 - protein, 18 aa, Mycobacterium tuberculosis
MQPAAIPALAPVAAAPPT

SEQ ID NO: 1557631 - protein, 24 aa, Mycobacterium tuberculosis
MRALADKLLPARFTAALAQAQPDR

SEQ ID NO: 1557632 - protein, 21 aa, Mycobacterium tuberculosis
MRSWQARRRRWRPTAADEVSM

SEQ ID NO: 1557633 - protein, 18 aa, Mycobacterium tuberculosis
MSMAAAASPYVGWLSTVA

SEQ ID NO: 1557634 - protein, 29 aa, Mycobacterium tuberculosis
MSPNLVAARFIQLTPVYTGGAVLPDNGRI

SEQ ID NO: 1557635 - protein, 30 aa, Mycobacterium tuberculosis
MSRAAGLPRLSWFAGLTWFAGGSTGAGCAA

SEQ ID NO: 1557636 - protein, 31 aa, Mycobacterium tuberculosis
MSRAAGLPRLSWFAGLTWFAGGSTGAGCAAH

SEQ ID NO: 1557637 - protein, 20 aa, Mycobacterium tuberculosis
MTEAEVVAHLLELVTRRSEA

SEQ ID NO: 1557638 - protein, 24 aa, Mycobacterium tuberculosis
MTLPLISMRFEGEDWILGSTAAIP

SEQ ID NO: 1557639 - protein, 17 aa, Mycobacterium tuberculosis
MVDYLGLLDSRADETVR

SEQ ID NO: 1557640 - protein, 18 aa, Mycobacterium tuberculosis
MVGIVVSAALGITAGPLA

SEQ ID NO: 1557641 - protein, 41 aa, Mycobacterium tuberculosis
MVMPGSVMTIPGMRLPFTSIVPFVVYYGPVELPQSTLTLPT

SEQ ID NO: 1557642 - protein, 18 aa, Mycobacterium tuberculosis
MVPPWNPAVGSSGGGGGT

SEQ ID NO: 1557643 - protein, 17 aa, Mycobacterium tuberculosis
NAALLFGNGGAGGAGGA

SEQ ID NO: 1557644 - protein, 26 aa, Mycobacterium tuberculosis
NAAPRTQILVPPAPWSLASDDAQVIL

SEQ ID NO: 1557645 - protein, 29 aa, Mycobacterium tuberculosis
NAFDKRRFSRRGFLGAGIASGFALAACAS

SEQ ID NO: 1557646 - protein, 20 aa, Mycobacterium tuberculosis
NAFVQLVLSNLFGQNAPAIA

SEQ ID NO: 1557647 - protein, 27 aa, Mycobacterium tuberculosis
NAGDINTGFGNAGFFNMGIGNAGNEDM

SEQ ID NO: 1557648 - protein, 18 aa, Mycobacterium tuberculosis
NAGNVNTGFWNGGSTNTG

SEQ ID NO: 1557649 - protein, 28 aa, Mycobacterium tuberculosis
NAGTSISGFFNFGSLMSGFANFDDEVSG

SEQ ID NO: 1557650 - protein, 23 aa, Mycobacterium tuberculosis
NAINAPTLALLGRPLIDDGTDAA

SEQ ID NO: 1557651 - protein, 18 aa, Mycobacterium tuberculosis
NAINAPTLALLGRPLIGD

SEQ ID NO: 1557652 - protein, 21 aa, Mycobacterium tuberculosis
NAPTLALLGRPLIGDGTDAAP

SEQ ID NO: 1557653 - protein, 22 aa, Mycobacterium tuberculosis
NAPTQTLLGRPLIGNGADGLPG

SEQ ID NO: 1557654 - protein, 40 aa, Mycobacterium tuberculosis; identical to SEQ ID NO: 164470

SEQ ID NO: 1557655 - protein, 28 aa, Mycobacterium tuberculosis
NDSNGILWRGNFEGLFSAYLGFTIEQFP

SEQ ID NO: 1557656 - protein, 24 aa, Mycobacterium tuberculosis
NEAFVAMLAPARILTRLPKPPTSL

SEQ ID NO: 1557657 - protein, 25 aa, Mycobacterium tuberculosis
NELRPRWRWVKPRRRLPAVPDRRRL

SEQ ID NO: 1557658 - protein, 18 aa, Mycobacterium tuberculosis
NEPFQTLTGRPLIGNGAN

SEQ ID NO: 1557659 - protein, 17 aa, Mycobacterium tuberculosis
NFGGANSGFWNLASATS

SEQ ID NO: 1557660 - protein, 20 aa, Mycobacterium tuberculosis
NFGGGASGFWNLASATSGLS

SEQ ID NO: 1557661 - protein, 23 aa, Mycobacterium tuberculosis
NFNQTITLAWPVSSITIPQIQQV

SEQ ID NO: 1557662 - protein, 21 aa, Mycobacterium tuberculosis
NFRDVLVALGIYPGAAELGAE

SEQ ID NO: 1557663 - protein, 18 aa, Mycobacterium tuberculosis
NGALWTGDYHGLVGFSFS

SEQ ID NO: 1557664 - protein, 21 aa, Mycobacterium tuberculosis
NGATGGWLYGNGGAGGQGATA

SEQ ID NO: 1557665 - protein, 24 aa, Mycobacterium tuberculosis
NGDPLTFAWVNHMKIFFNNKGVVA

SEQ ID NO: 1557666 - protein, 22 aa, Mycobacterium tuberculosis
NGGGAGLFYGFGGAGGNGGMGG

SEQ ID NO: 1557667 - protein, 28 aa, Mycobacterium tuberculosis
NGGGALNQAGFFGTGGKGGNGGNGGAGM

SEQ ID NO: 1557668 - protein, 31 aa, Mycobacterium tuberculosis
NGGGGGVGVFFLFFCVSARPTRSARPARPRL

SEQ ID NO: 1557669 - protein, 21 aa, Mycobacterium tuberculosis
NGGKAGFSPGPTNFGLNGAGG

SEQ ID NO: 1557670 - protein, 25 aa, Mycobacterium tuberculosis
NGGNAGVIANGSFAPSFVGFGGNGG

SEQ ID NO: 1557671 - protein, 24 aa, Mycobacterium tuberculosis
NGGRAGLLLGVGGTGGSGGAGGAG

SEQ ID NO: 1557672 - protein, 17 aa, Mycobacterium tuberculosis
NGLIQFDAAIQPGDSGG

SEQ ID NO: 1557673 - protein, 17 aa, Mycobacterium tuberculosis
NGMLWRGDHEGLFGLSY

SEQ ID NO: 1557674 - protein, 18 aa, Mycobacterium tuberculosis
NGVAGTGLALNGGNGGNG

SEQ ID NO: 1557675 - protein, 22 aa, Mycobacterium tuberculosis
NGYLGGLQFTQSTWAAHGGGEF

SEQ ID NO: 1557676 - protein, 20 aa, Mycobacterium tuberculosis
NHRAYYCLKYLVRVGYCYPA

SEQ ID NO: 1557677 - protein, 20 aa, Mycobacterium tuberculosis
NINSIRWVPASLGPRRIWGS

SEQ ID NO: 1557678 - protein, 31 aa, Mycobacterium tuberculosis; identical to SEQ ID NO: 1535162

SEQ ID NO: 1557679 - protein, 25 aa, Mycobacterium tuberculosis
NLLPGQFVQPFISAAFSDLGLDPAT

SEQ ID NO: 1557680 - protein, 26 aa, Mycobacterium tuberculosis
NLPDMFTRLMLSLAATGIAPGSFYEL

SEQ ID NO: 1557681 - protein, 20 aa, Mycobacterium tuberculosis
NLPGYIFSGVAPVVTEMLWD

SEQ ID NO: 1557682 - protein, 23 aa, Mycobacterium tuberculosis
NLRCSYCMPERGLRWLPGEQLLR

SEQ ID NO: 1557683 - protein, 17 aa, Mycobacterium tuberculosis
NNAAIYGGMKLDLLLTV

SEQ ID NO: 1557684 - protein, 21 aa, Mycobacterium tuberculosis
NNAFRVPSMKPLAGTTFEHIR

SEQ ID NO: 1557685 - protein, 29 aa, Mycobacterium tuberculosis
NNELGHPWTVLRATRRTDYLILEMAARHH

SEQ ID NO: 1557686 - protein, 25 aa, Mycobacterium tuberculosis
NNGMNFPGWAFWCPLPVLRPRSVGW

SEQ ID NO: 1557687 - protein, 26 aa, Mycobacterium tuberculosis
NPLVGKLTTKYFLPLGTRQVGDHVVF

SEQ ID NO: 1557688 - protein, 25 aa, Mycobacterium tuberculosis
NPNPPAIGFFISNLSITGPQISGLS

SEQ ID NO: 1557689 - protein, 33 aa, Mycobacterium tuberculosis; identical to SEQ ID NO: 220932

SEQ ID NO: 1557690 - protein, 20 aa, Mycobacterium tuberculosis
NRRGPRNPEKGWSTPGANIR

SEQ ID NO: 1557691 - protein, 18 aa, Mycobacterium tuberculosis
NSCRPRGSPRRHAAMLLP

SEQ ID NO: 1557692 - protein, 20 aa, Mycobacterium tuberculosis
NTKAFLGERIGVRRGVVVDA

SEQ ID NO: 1557693 - protein, 24 aa, Mycobacterium tuberculosis
NTPAIAATEFDYVEMWAQDVGAMV

SEQ ID NO: 1557694 - protein, 17 aa, Mycobacterium tuberculosis
NTRVWVWSPTNPGASDP

SEQ ID NO: 1557695 - protein, 25 aa, Mycobacterium tuberculosis
NVADGDAALALLRAELRPGDVVLVK

SEQ ID NO: 1557696 - protein, 23 aa, Mycobacterium tuberculosis
NVEPICAKLFAAAATISGVANTY

SEQ ID NO: 1557697 - protein, 32 aa, Mycobacterium tuberculosis
NVLARWSASSRFLLNLPLFSRQALHPDVDLLV

SEQ ID NO: 1557698 - protein, 23 aa, Mycobacterium tuberculosis
NVPGTPLPIPHESRPLPACGFLE

SEQ ID NO: 1557699 - protein, 36 aa, Mycobacterium tuberculosis
NVQQNLLNAINAPTQALLGRPLIGDGAVGTASSPDG

SEQ ID NO: 1557700 - protein, 27 aa, Mycobacterium tuberculosis
NVQTVVTPAWYAPLVLSVGGIGQTGMP

SEQ ID NO: 1557701 - protein, 17 aa, Mycobacterium tuberculosis
NVRRLAGPYAWSNALSA

SEQ ID NO: 1557702 - protein, 18 aa, Mycobacterium tuberculosis
NYGSLNWGSGNTGTGNAG

SEQ ID NO: 1557703 - protein, 28 aa, Mycobacterium tuberculosis
PAAAFAVAGLILAGWAGSVGLAGADPEP

SEQ ID NO: 1557704 - protein, 18 aa, Mycobacterium tuberculosis
PAAALPPPDPVPAVTSRP

SEQ ID NO: 1557705 - protein, 22 aa, Mycobacterium tuberculosis
PAADLSVWPPLGAAPVDVDGAY

SEQ ID NO: 1557706 - protein, 18 aa, Mycobacterium tuberculosis
PAALTGEWFGALAVIAPS

SEQ ID NO: 1557707 - protein, 18 aa, Mycobacterium tuberculosis
PAAPVLQVAALGAPAATA

SEQ ID NO: 1557708 - protein, 25 aa, Mycobacterium tuberculosis
PADGLPRPWDPLPSANLTQGPFGGP

SEQ ID NO: 1557709 - protein, 25 aa, Mycobacterium tuberculosis
PADKAGWGVLAGPAPITPPASAAPA

SEQ ID NO: 1557710 - protein, 19 aa, Mycobacterium tuberculosis
PAEIRNRYDGRSLRFAAAS

SEQ ID NO: 1557711 - protein, 17 aa, Mycobacterium tuberculosis
PAFSLPAITLPSLTIPA

SEQ ID NO: 1557712 - protein, 34 aa, Mycobacterium tuberculosis
PAGLPPLPAVPALPAPPPLPGPPPLPALPSRLCT

SEQ ID NO: 1557713 - protein, 27 aa, Mycobacterium tuberculosis
PAHMIPRHVTLLDRIPFTDSGKIDRAE

SEQ ID NO: 1557714 - protein, 18 aa, Mycobacterium tuberculosis
PAKYPAGFFGVFTGSYDI

SEQ ID NO: 1557715 - protein, 20 aa, Mycobacterium tuberculosis
PALAVVLSATAALAAPIVEP

SEQ ID NO: 1557716 - protein, 18 aa, Mycobacterium tuberculosis
PALLSPRDKLAQLLVVGV

SEQ ID NO: 1557717 - protein, 19 aa, Mycobacterium tuberculosis
PALPGLAEFGFDVDTYDGA

SEQ ID NO: 1557718 - protein, 30 aa, Mycobacterium tuberculosis
PALSQDRFADFPALPLDPSAMVAQVGPQVV

SEQ ID NO: 1557719 - protein, 20 aa, Mycobacterium tuberculosis
PALTLFPVGLSIPTGGPLTL

SEQ ID NO: 1557720 - protein, 19 aa, Mycobacterium tuberculosis
PANLAPLLSGLQVSGRTSQ

SEQ ID NO: 1557721 - protein, 29 aa, Mycobacterium tuberculosis
PAPGAAGFGYPYAIAPPGIGFGSGMSASA

SEQ ID NO: 1557722 - protein, 27 aa, Mycobacterium tuberculosis
PAQNFNTTFPVGPFFGLGVVNISGIEI

SEQ ID NO: 1557723 - protein, 17 aa, Mycobacterium tuberculosis
PARPAATAGCSTATAAS

SEQ ID NO: 1557724 - protein, 31 aa, Mycobacterium tuberculosis
PARPARTADPWLAPIFARSTLRHSHHLGGIA

SEQ ID NO: 1557725 - protein, 28 aa, Mycobacterium tuberculosis
PARRCRAGPGGFRRGRSALAFGSGGVGG

SEQ ID NO: 1557726 - protein, 18 aa, Mycobacterium tuberculosis
PARYFGPNLSRLSAVRQK

SEQ ID NO: 1557727 - protein, 27 aa, Mycobacterium tuberculosis
PASAAMTGVAASYARWLTTAAAQAEQA

SEQ ID NO: 1557728 - protein, 31 aa, Mycobacterium tuberculosis
PASLPPIGVFTLFRHRRRVRRFAPAAPAPPT

SEQ ID NO: 1557729 - protein, 21 aa, Mycobacterium tuberculosis
PASTGLTGGTGFAGGAGGAGG

SEQ ID NO: 1557730 - protein, 24 aa, Mycobacterium tuberculosis
PASVALGVWVGPVVLVGCCSVTAA

SEQ ID NO: 1557731 - protein, 17 aa, Mycobacterium tuberculosis
PATATPPVLTYRCPTQD

SEQ ID NO: 1557732 - protein, 22 aa, Mycobacterium tuberculosis
PATVLPAIPLNVDVTIPVGPIN

SEQ ID NO: 1557733 - protein, 17 aa, Mycobacterium tuberculosis
PATVQPPTQEVAAAPNI

SEQ ID NO: 1557734 - protein, 22 aa, Mycobacterium tuberculosis
PAVPHLVSLPGYPFARQRHWVE

SEQ ID NO: 1557735 - protein, 34 aa, Mycobacterium tuberculosis
PCGAMVMVLLFLGVVFLLLGWQALGSSPNSEDDS

SEQ ID NO: 1557736 - protein, 26 aa, Mycobacterium tuberculosis
PCLPHRPCRTWPRRAYLASASRGIGI

SEQ ID NO: 1557737 - protein, 26 aa, Mycobacterium tuberculosis
PCQVRVPVPTLLLADVLAAAPAEFVP

SEQ ID NO: 1557738 - protein, 23 aa, Mycobacterium tuberculosis
PCRKRWPRFGTRSAMHLDSLVAP

SEQ ID NO: 1557739 - protein, 18 aa, Mycobacterium tuberculosis
PDEATAVRAALAQLAPDS

SEQ ID NO: 1557740 - protein, 25 aa, Mycobacterium tuberculosis
PDGEDLSWLWDVRFEHFEKTRVVAA

SEQ ID NO: 1557741 - protein, 30 aa, Mycobacterium tuberculosis; identical to SEQ ID NO: 221114

SEQ ID NO: 1557742 - protein, 19 aa, Mycobacterium tuberculosis
PDIPGLPDFKWPPTPGSPL

SEQ ID NO: 1557743 - protein, 21 aa, Mycobacterium tuberculosis
PDLPTPWPQEALDDLLVVLSA

SEQ ID NO: 1557744 - protein, 23 aa, Mycobacterium tuberculosis
PDPGGEPAGFRRKPTGGTRAVPA

SEQ ID NO: 1557745 - protein, 26 aa, Mycobacterium tuberculosis
PDSILRVLAMHRFAKAPMLVGGQMLN

SEQ ID NO: 1557746 - protein, 17 aa, Mycobacterium tuberculosis
PDWAARARWANPAAWRL

SEQ ID NO: 1557747 - protein, 21 aa, Mycobacterium tuberculosis
PEDIRFGLYGALAHPMESAAL

SEQ ID NO: 1557748 - protein, 17 aa, Mycobacterium tuberculosis
PEIPYYSATLWDPRERP

SEQ ID NO: 1557749 - protein, 18 aa, Mycobacterium tuberculosis
PEKGWSTPGANIRWAQRH

SEQ ID NO: 1557750 - protein, 17 aa, Mycobacterium tuberculosis
PELFLRRRGSVVASSPI

SEQ ID NO: 1557751 - protein, 17 aa, Mycobacterium tuberculosis
PELPDLAEVWFGTGRNA

SEQ ID NO: 1557752 - protein, 36 aa, Mycobacterium tuberculosis
PERTAMLLVPPYLVYVRLARPFIAFYNICANAILQA

SEQ ID NO: 1557753 - protein, 19 aa, Mycobacterium tuberculosis
PETMAYTAVRWKNVLRQAA

SEQ ID NO: 1557754 - protein, 29 aa, Mycobacterium tuberculosis
PETTAPVWITMLWPLADRPPVGPRGHPVA

SEQ ID NO: 1557755 - protein, 34 aa, Mycobacterium tuberculosis; identical to SEQ ID NO: 1390301

SEQ ID NO: 1557756 - protein, 17 aa, Mycobacterium tuberculosis
PETVAAAALDVARIGSS

SEQ ID NO: 1557757 - protein, 17 aa, Mycobacterium tuberculosis
PEVDRVSWFPVARARTK

SEQ ID NO: 1557758 - protein, 29 aa, Mycobacterium tuberculosis
PFSKPLQNLAGLPAWLASGAPAAAMTAAA

SEQ ID NO: 1557759 - protein, 21 aa, Mycobacterium tuberculosis
PFVGPPPFRPPTFNPVDGAMV

SEQ ID NO: 1557760 - protein, 21 aa, Mycobacterium tuberculosis
PFWGGPLLGALAAAVVPGVAG

SEQ ID NO: 1557761 - protein, 20 aa, Mycobacterium tuberculosis
PFYIMDEVEAALDDVNLRRL

SEQ ID NO: 1557762 - protein, 34 aa, Mycobacterium tuberculosis
PGAAQLPLAPAINYPPPCLTGFLPASEWRSPADT

SEQ ID NO: 1557763 - protein, 19 aa, Mycobacterium tuberculosis
PGAKGAHGFTPTSGGDGGD

SEQ ID NO: 1557764 - protein, 26 aa, Mycobacterium tuberculosis
PGGAGGAGGLLFGNGGAGAAGAPGQA

SEQ ID NO: 1557765 - protein, 30 aa, Mycobacterium tuberculosis; identical to SEQ ID NO: 1511252

SEQ ID NO: 1557766 - protein, 18 aa, Mycobacterium tuberculosis
PGGLIPLSRTSPALDLDA

SEQ ID NO: 1557767 - protein, 17 aa, Mycobacterium tuberculosis
PGGLIWGGGGAGGVGGA

SEQ ID NO: 1557768 - protein, 18 aa, Mycobacterium tuberculosis
PGGLLYGNGGNGGTSTTV

SEQ ID NO: 1557769 - protein, 18 aa, Mycobacterium tuberculosis
PGGLNIPQNAIPLTIDAS

SEQ ID NO: 1557770 - protein, 24 aa, Mycobacterium tuberculosis
PGGTGGFPGNGNAGGNGGPGGASE

SEQ ID NO: 1557771 - protein, 20 aa, Mycobacterium tuberculosis
PGGTPGDWGTGGTGGTGGTG

SEQ ID NO: 1557772 - protein, 27 aa, Mycobacterium tuberculosis
PGIGHPCWANYFPVTRTVPEPPSIRQC

SEQ ID NO: 1557773 - protein, 23 aa, Mycobacterium tuberculosis
PGITATFPGLTPAAPAAAAAPAL

SEQ ID NO: 1557774 - protein, 22 aa, Mycobacterium tuberculosis
PGKKITRLSLLSGGEKALTAVA

SEQ ID NO: 1557775 - protein, 25 aa, Mycobacterium tuberculosis
PGMAAPPVRLLPTNLAPHAVGELYR

SEQ ID NO: 1557776 - protein, 42 aa, Mycobacterium tuberculosis
PGPPTVVPPRRRPGWVAPGGQWRFAPGLLLGCGVAMGGNGRV

SEQ ID NO: 1557777 - protein, 22 aa, Mycobacterium tuberculosis
PGQLSRRRGASARRLRLRSRRA

SEQ ID NO: 1557778 - protein, 20 aa, Mycobacterium tuberculosis
PGRPPLMFRAVRRTDSTGTR

SEQ ID NO: 1557779 - protein, 24 aa, Mycobacterium tuberculosis
PGSGIPKSNFYLSPDRESAYASPR

SEQ ID NO: 1557780 - protein, 29 aa, Mycobacterium tuberculosis
PGTNWNYAPTNYLLLGLALEKAAGQDMPT

SEQ ID NO: 1557781 - protein, 24 aa, Mycobacterium tuberculosis
PHAGGAAAAYRWLAKSLVANDVDT

SEQ ID NO: 1557782 - protein, 19 aa, Mycobacterium tuberculosis
PHAKPEDIRFGLYGALAHP

SEQ ID NO: 1557783 - protein, 24 aa, Mycobacterium tuberculosis
PHEVSFYCLDYGGGQLRALQDLAH

SEQ ID NO: 1557784 - protein, 17 aa, Mycobacterium tuberculosis
PHLTAAIIAKYISNLRL

SEQ ID NO: 1557785 - protein, 29 aa, Mycobacterium tuberculosis
PIALSPWPARAFVMLLVALAVAVTVDTLL

SEQ ID NO: 1557786 - protein, 17 aa, Mycobacterium tuberculosis
PIAPLLDALRELGVAVD

SEQ ID NO: 1557787 - protein, 22 aa, Mycobacterium tuberculosis
PILALLALLALIVGLGASGCAW

SEQ ID NO: 1557788 - protein, 18 aa, Mycobacterium tuberculosis
PILALLALLALLALIVGL

SEQ ID NO: 1557789 - protein, 26 aa, Mycobacterium tuberculosis
PINAQLFSMPIHQVMVMPGSVMTIPG

SEQ ID NO: 1557790 - protein, 20 aa, Mycobacterium tuberculosis
PINISIIDIPALPGFGNSTE

SEQ ID NO: 1557791 - protein, 19 aa, Mycobacterium tuberculosis
PIPGRLFAGPGLSQPSDVL

SEQ ID NO: 1557792 - protein, 19 aa, Mycobacterium tuberculosis
PIPLASPNIYRGDASRLAV

SEQ ID NO: 1557793 - protein, 25 aa, Mycobacterium tuberculosis
PIPPLPPLPPLPISPAPPPAPPAPP

SEQ ID NO: 1557794 - protein, 17 aa, Mycobacterium tuberculosis
PITIDRIPLNLGASVTV

SEQ ID NO: 1557795 - protein, 26 aa, Mycobacterium tuberculosis
PKFRTGGYMIDFWGVGYQVAKRMGIT

SEQ ID NO: 1557796 - protein, 47 aa, Mycobacterium tuberculosis; identical to SEQ ID NO: 237717

SEQ ID NO: 1557797 - protein, 24 aa, Mycobacterium tuberculosis
PLAPLTTLRVGPIARRVITCTSAE

SEQ ID NO: 1557798 - protein, 21 aa, Mycobacterium tuberculosis
PLDPQAIQPVLVAASLLVAEL

SEQ ID NO: 1557799 - protein, 25 aa, Mycobacterium tuberculosis
PLGRGLLEVAVARRAARPGRPAVTA

SEQ ID NO: 1557800 - protein, 22 aa, Mycobacterium tuberculosis
PLIPNPPPIPVPPPAAQTLIPP

SEQ ID NO: 1557801 - protein, 19 aa, Mycobacterium tuberculosis
PLLFVFFTSFKDQPDIYAQ

SEQ ID NO: 1557802 - protein, 21 aa, Mycobacterium tuberculosis
PLMGSLIQRVPLDGAALSTLL

SEQ ID NO: 1557803 - protein, 27 aa, Mycobacterium tuberculosis
PLPAVPALPAPPPLPGPPPLPALPSRL

SEQ ID NO: 1557804 - protein, 28 aa, Mycobacterium tuberculosis
PLPAVPALPAPPPLPGPPPLPALPSRLC

SEQ ID NO: 1557805 - protein, 17 aa, Mycobacterium tuberculosis
PLPSANLTQGPFGGPDF

SEQ ID NO: 1557806 - protein, 19 aa, Mycobacterium tuberculosis
PLQPEIPYYSATSFDPREE

SEQ ID NO: 1557807 - protein, 22 aa, Mycobacterium tuberculosis
PLTSATLGGLALPLQQTIDAIE

SEQ ID NO: 1557808 - protein, 34 aa, Mycobacterium tuberculosis
PMHGYELRKRLTGLLGAFRAFSYGSLYPALRRMQ

SEQ ID NO: 1557809 - protein, 20 aa, Mycobacterium tuberculosis
PNVPGTPVPIPRGSPRGTHA

SEQ ID NO: 1557810 - protein, 25 aa, Mycobacterium tuberculosis
PPAAPPVAEPPPPVAAPAPPGAPEP

SEQ ID NO: 1557811 - protein, 17 aa, Mycobacterium tuberculosis
PPAPRAAAPAPASAAEW

SEQ ID NO: 1557812 - protein, 19 aa, Mycobacterium tuberculosis
PPITIDRIPLNLGASVTVG

SEQ ID NO: 1557813 - protein, 34 aa, Mycobacterium tuberculosis; identical to SEQ ID NO: 1510723

SEQ ID NO: 1557814 - protein, 17 aa, Mycobacterium tuberculosis
PPLPMPYPRTGQGGEPR

SEQ ID NO: 1557815 - protein, 17 aa, Mycobacterium tuberculosis
PPNVPGTPLPIPHESRP

SEQ ID NO: 1557816 - protein, 20 aa, Mycobacterium tuberculosis
PPPIDERWLPESALPAPPRP

SEQ ID NO: 1557817 - protein, 22 aa, Mycobacterium tuberculosis
PPRLARVLRRTADLLALRADPN

SEQ ID NO: 1557818 - protein, 24 aa, Mycobacterium tuberculosis
PQAACDGPRFRWVNGMRVSFENGF

SEQ ID NO: 1557819 - protein, 18 aa, Mycobacterium tuberculosis
PQDRHLHMLMARGAQEFD

SEQ ID NO: 1557820 - protein, 23 aa, Mycobacterium tuberculosis
PRARASFYGYGFNVGVTSSGRTE

SEQ ID NO: 1557821 - protein, 20 aa, Mycobacterium tuberculosis
PRAVRLPRALAAAGVPVAPP

SEQ ID NO: 1557822 - protein, 25 aa, Mycobacterium tuberculosis
PRHTLWAAWQRSGLQRRWLAASEHG

SEQ ID NO: 1557823 - protein, 21 aa, Mycobacterium tuberculosis
PRKRPYHTIIPGFVTRDGAPV

SEQ ID NO: 1557824 - protein, 17 aa, Mycobacterium tuberculosis
PRKSCLRNVDRFRPGLL

SEQ ID NO: 1557825 - protein, 21 aa, Mycobacterium tuberculosis
PRLTRPNRRGPRNPEKGWSTP

SEQ ID NO: 1557826 - protein, 18 aa, Mycobacterium tuberculosis
PRPTAPWCSTYVSYLGTS

SEQ ID NO: 1557827 - protein, 22 aa, Mycobacterium tuberculosis
PRRMRKMFLSLIQRQLPEGYDV

SEQ ID NO: 1557828 - protein, 22 aa, Mycobacterium tuberculosis
PSKPGIILFRRAGAPAALADSV

SEQ ID NO: 1557829 - protein, 26 aa, Mycobacterium tuberculosis
PSLSLVLIDRIPFPRPDDPLLSARQR

SEQ ID NO: 1557830 - protein, 24 aa, Mycobacterium tuberculosis
PSRVPVWFMRQAGRSLPEYRALRE

SEQ ID NO: 1557831 - protein, 25 aa, Mycobacterium tuberculosis
PSRVPVWFMRQAGRSLPEYRALRER

SEQ ID NO: 1557832 - protein, 20 aa, Mycobacterium tuberculosis
PSTGPSMGILPAGGVGGPGG

SEQ ID NO: 1557833 - protein, 23 aa, Mycobacterium tuberculosis
PSTGPSMGILPAGGVGGPGGSGG

SEQ ID NO: 1557834 - protein, 26 aa, Mycobacterium tuberculosis
PSWEEITEVLEWLSPLPGGSVVSVEP

SEQ ID NO: 1557835 - protein, 23 aa, Mycobacterium tuberculosis
PSWEEITEVLEWLSRLPGGSVVS

SEQ ID NO: 1557836 - protein, 20 aa, Mycobacterium tuberculosis
PSWLEVPLAMRDGLGLRLEL

SEQ ID NO: 1557837 - protein, 22 aa, Mycobacterium tuberculosis
PTETAYWASGRMWGRMPSAGPA

SEQ ID NO: 1557838 - protein, 20 aa, Mycobacterium tuberculosis
PTGITLPYRINITGGPNGVG

SEQ ID NO: 1557839 - protein, 22 aa, Mycobacterium tuberculosis
PTPSTVICLLQPANGQLLTGSA

SEQ ID NO: 1557840 - protein, 20 aa, Mycobacterium tuberculosis
PTQPRSITLTFIRNAQSQAN

SEQ ID NO: 1557841 - protein, 22 aa, Mycobacterium tuberculosis
PTTLGGYPWPVGSTGWRWPSDR

SEQ ID NO: 1557842 - protein, 26 aa, Mycobacterium tuberculosis
PTTPYRTLSPWPRHARTPSWSWAAIR

SEQ ID NO: 1557843 - protein, 40 aa, Mycobacterium tuberculosis; identical to SEQ ID NO: 237720

SEQ ID NO: 1557844 - protein, 34 aa, Mycobacterium tuberculosis
PTYVHPADRFMLTDPIYGLGPRIAQLVAGAFFRE

SEQ ID NO: 1557845 - protein, 20 aa, Mycobacterium tuberculosis
PVAAQQFQFALPAGVASEEG

SEQ ID NO: 1557846 - protein, 17 aa, Mycobacterium tuberculosis
PVFRERMKREARIAGRL

SEQ ID NO: 1557847 - protein, 26 aa, Mycobacterium tuberculosis
PVGILCLEFLVHAWDFAIATGSQVIA

SEQ ID NO: 1557848 - protein, 18 aa, Mycobacterium tuberculosis
PVHAECAGLLYLVSELDG

SEQ ID NO: 1557849 - protein, 19 aa, Mycobacterium tuberculosis
PVHAECAGLLYLVSELDGH

SEQ ID NO: 1557850 - protein, 17 aa, Mycobacterium tuberculosis
PVHPQPSLRRRARITRG

SEQ ID NO: 1557851 - protein, 17 aa, Mycobacterium tuberculosis
PVIPASAYLMKSPPEQL

SEQ ID NO: 1557852 - protein, 20 aa, Mycobacterium tuberculosis
PVLAVPLLPIPVLKRPEFPM

SEQ ID NO: 1557853 - protein, 17 aa, Mycobacterium tuberculosis
PVLPQLSARHHVLVAAV

SEQ ID NO: 1557854 - protein, 17 aa, Mycobacterium tuberculosis
PVVFLTAYYALRVLAQV

SEQ ID NO: 1557855 - protein, 28 aa, Mycobacterium tuberculosis
PVVLPDPFITIDHYGPPLGPPGAKFPSG

SEQ ID NO: 1557856 - protein, 18 aa, Mycobacterium tuberculosis
PWCMPACWRKTTLRVWVW

SEQ ID NO: 1557857 - protein, 18 aa, Mycobacterium tuberculosis
PYAGWLTAAAAQSAGAAG

SEQ ID NO: 1557858 - protein, 18 aa, Mycobacterium tuberculosis
PYAVWLDDWYARESNNNS

SEQ ID NO: 1557859 - protein, 28 aa, Mycobacterium tuberculosis
PYIGQRPWTPLIGLLAQAGDLGLRVIVT

SEQ ID NO: 1557860 - protein, 21 aa, Mycobacterium tuberculosis
PYQGTVRMAFLLQGDHDAYFQ

SEQ ID NO: 1557861 - protein, 19 aa, Mycobacterium tuberculosis
PYQRFRGAEIAGLTAGLVG

SEQ ID NO: 1557862 - protein, 22 aa, Mycobacterium tuberculosis
PYVPLGTNPWFGDPNQILTCPA

SEQ ID NO: 1557863 - protein, 27 aa, Mycobacterium tuberculosis
QAAAVPVVFLTAWYGLADLAEIKAGES

SEQ ID NO: 1557864 - protein, 18 aa, Mycobacterium tuberculosis
QADTDPLPVVFPIVQGEL

SEQ ID NO: 1557865 - protein, 17 aa, Mycobacterium tuberculosis
QAFVQWRAQSRSELTEV

SEQ ID NO: 1557866 - protein, 20 aa, Mycobacterium tuberculosis
QALAIITFSTVVHGWDLAVA

SEQ ID NO: 1557867 - protein, 17 aa, Mycobacterium tuberculosis
QALFRSVTAPMADRAKT

SEQ ID NO: 1557868 - protein, 18 aa, Mycobacterium tuberculosis
QALQLELLNAINAPTLAL

SEQ ID NO: 1557869 - protein, 17 aa, Mycobacterium tuberculosis
QALRPVIALHGLGGSAS

SEQ ID NO: 1557870 - protein, 17 aa, Mycobacterium tuberculosis
QALTGAGGAYCGCRSRQ

SEQ ID NO: 1557871 - protein, 27 aa, Mycobacterium tuberculosis
QAREKLFPLICRYAVAYHVVFIPSAEV

SEQ ID NO: 1557872 - protein, 24 aa, Mycobacterium tuberculosis
QCGEVHLVFRHPNPIRPVVSQRCD

SEQ ID NO: 1557873 - protein, 17 aa, Mycobacterium tuberculosis
QCRQCAHPGIVGRPLIG

SEQ ID NO: 1557874 - protein, 17 aa, Mycobacterium tuberculosis
QCRQRQLWCLQPGPCAT

SEQ ID NO: 1557875 - protein, 17 aa, Mycobacterium tuberculosis
QDFIRKSADPAKPIAVN

SEQ ID NO: 1557876 - protein, 23 aa, Mycobacterium tuberculosis
QDIEAVLNALWNAGAEAIQMQDQ

SEQ ID NO: 1557877 - protein, 18 aa, Mycobacterium tuberculosis
QFKPGTRFDYSNSNYLLL

SEQ ID NO: 1557878 - protein, 25 aa, Mycobacterium tuberculosis
QFKTLKYRPDFPKRFESIEAARVHC

SEQ ID NO: 1557879 - protein, 25 aa, Mycobacterium tuberculosis
QFRVSLYAAFWPPCALIFFSNLRCV

SEQ ID NO: 1557880 - protein, 20 aa, Mycobacterium tuberculosis
QFVHTLTAAARWYTATEIAN

SEQ ID NO: 1557881 - protein, 17 aa, Mycobacterium tuberculosis
QFYCLDFGGGALAQVDE

SEQ ID NO: 1557882 - protein, 31 aa, Mycobacterium tuberculosis; identical to SEQ ID NO: 221647

SEQ ID NO: 1557883 - protein, 20 aa, Mycobacterium tuberculosis
QGGNAIAGGINGSGGAGGTG

SEQ ID NO: 1557884 - protein, 21 aa, Mycobacterium tuberculosis
QGGNAIAGGINGSGGAGGTGG

SEQ ID NO: 1557885 - protein, 17 aa, Mycobacterium tuberculosis
QGRIPRVYGRQASEYVI

SEQ ID NO: 1557886 - protein, 20 aa, Mycobacterium tuberculosis
QHAQAYQALSAQATIFHDQF

SEQ ID NO: 1557887 - protein, 19 aa, Mycobacterium tuberculosis
QHARYFLSASAAVSRRRRV

SEQ ID NO: 1557888 - protein, 18 aa, Mycobacterium tuberculosis
QIARLWNSTWDLKPGRSH

SEQ ID NO: 1557889 - protein, 19 aa, Mycobacterium tuberculosis
QIDAGSWLLLSASEADPLT

SEQ ID NO: 1557890 - protein, 27 aa, Mycobacterium tuberculosis
QISGLSIGSPIPLSLALGTTTWTLFPN

SEQ ID NO: 1557891 - protein, 23 aa, Mycobacterium tuberculosis
QISSRPLLYDPGTNWNYAPTNYL

SEQ ID NO: 1557892 - protein, 18 aa, Mycobacterium tuberculosis
QKAMAFAAANNLKVAPRG

SEQ ID NO: 1557893 - protein, 18 aa, Mycobacterium tuberculosis
QLLATAALDLASIGSQVS

SEQ ID NO: 1557894 - protein, 20 aa, Mycobacterium tuberculosis
QLLSLVLSNLFGQNLPAIAA

SEQ ID NO: 1557895 - protein, 24 aa, Mycobacterium tuberculosis
QLQPKYMEMLNLNEAWQFGRGDGV

SEQ ID NO: 1557896 - protein, 17 aa, Mycobacterium tuberculosis
QLRNLLLAELPEPSCPK

SEQ ID NO: 1557897 - protein, 20 aa, Mycobacterium tuberculosis
QLRPPRTPLLSNLTGSWMSD

SEQ ID NO: 1557898 - protein, 17 aa, Mycobacterium tuberculosis
QLVLTESGLRPGWHRVP

SEQ ID NO: 1557899 - protein, 18 aa, Mycobacterium tuberculosis
QLVLTESGLRPGWHRVPG

SEQ ID NO: 1557900 - protein, 18 aa, Mycobacterium tuberculosis
QLVVYRLIGDFDPAEAIT

SEQ ID NO: 1557901 - protein, 24 aa, Mycobacterium tuberculosis
QNFNTTFPVGPFFGLGVVNISGIE

SEQ ID NO: 1557902 - protein, 25 aa, Mycobacterium tuberculosis
QNFNTTFPVGPFFGLGVVNISGIEI

SEQ ID NO: 1557903 - protein, 33 aa, Mycobacterium tuberculosis
QNVLTVVNAPTQALLGRPIIGNGANGLPNTGQD

SEQ ID NO: 1557904 - protein, 19 aa, Mycobacterium tuberculosis
QPDIVWFGEPLPEEPWRSA

SEQ ID NO: 1557905 - protein, 17 aa, Mycobacterium tuberculosis
QPGAAGGLLFGNGGNGA

SEQ ID NO: 1557906 - protein, 23 aa, Mycobacterium tuberculosis
QPGGPGGLLYGNGGHGGAGAAGQ

SEQ ID NO: 1557907 - protein, 17 aa, Mycobacterium tuberculosis
QPLLRRLLEDRIGTAAT

SEQ ID NO: 1557908 - protein, 21 aa, Mycobacterium tuberculosis
QPRQPQPRRWQPRRAEPGVGQ

SEQ ID NO: 1557909 - protein, 27 aa, Mycobacterium tuberculosis
QQLGARAALFHEQFVQALTGAASAYAS

SEQ ID NO: 1557910 - protein, 20 aa, Mycobacterium tuberculosis
QQLLFFDRNIPLGSPTRNPK

SEQ ID NO: 1557911 - protein, 29 aa, Mycobacterium tuberculosis
QQLVDVINAPFRSALGRPLIGNGANGKPG

SEQ ID NO: 1557912 - protein, 25 aa, Mycobacterium tuberculosis
QQNPALHQVVIGNELPLPPVRSAVA

SEQ ID NO: 1557913 - protein, 20 aa, Mycobacterium tuberculosis
QQRYPPWPASYDASLRVSWR

SEQ ID NO: 1557914 - protein, 27 aa, Mycobacterium tuberculosis
QQVAAELVPVLRPRGLFAHDVDLAGEA

SEQ ID NO: 1557915 - protein, 23 aa, Mycobacterium tuberculosis
QQVDGYIRVYPQMKDLIGTLQAH

SEQ ID NO: 1557916 - protein, 32 aa, Mycobacterium tuberculosis
QQVLGLINGPAQTLLGRPLIGNGADGAPGTGQ

SEQ ID NO: 1557917 - protein, 19 aa, Mycobacterium tuberculosis
QRCESLRDNLWQLVDSKVA

SEQ ID NO: 1557918 - protein, 25 aa, Mycobacterium tuberculosis
QRFRRLRLPSVRRFTTPDRAALIAS

SEQ ID NO: 1557919 - protein, 19 aa, Mycobacterium tuberculosis
QRPEILVRNWAASATHVRA

SEQ ID NO: 1557920 - protein, 21 aa, Mycobacterium tuberculosis
QRWLADHVIAGVVLLAGAAFV

SEQ ID NO: 1557921 - protein, 30 aa, Mycobacterium tuberculosis; identical to SEQ ID NO: 1519235

SEQ ID NO: 1557922 - protein, 23 aa, Mycobacterium tuberculosis
QSFTSVPMLFAKPSYYGQFTDSG

SEQ ID NO: 1557923 - protein, 20 aa, Mycobacterium tuberculosis
QSGRFEFRAGPIFTNLLLAD

SEQ ID NO: 1557924 - protein, 21 aa, Mycobacterium tuberculosis
QSMTGHHLAMALATRARIAVA

SEQ ID NO: 1557925 - protein, 34 aa, Mycobacterium tuberculosis; identical to SEQ ID NO: 1519238

SEQ ID NO: 1557926 - protein, 17 aa, Mycobacterium tuberculosis
QTEFNVALPWRKEVSLS

SEQ ID NO: 1557927 - protein, 28 aa, Mycobacterium tuberculosis
QTIAEQLMPHWMLSLRAADMRRGGTVPE

SEQ ID NO: 1557928 - protein, 17 aa, Mycobacterium tuberculosis
QTLLLDERTVVSSAATI

SEQ ID NO: 1557929 - protein, 41 aa, Mycobacterium tuberculosis
QTYTIPLDTPPAPAPPPFRLPLLFVNALGDNWIVGASNSTG

SEQ ID NO: 1557930 - protein, 21 aa, Mycobacterium tuberculosis
QVAAFHDRFAQTLSAAVGSYV

SEQ ID NO: 1557931 - protein, 20 aa, Mycobacterium tuberculosis
QVAAFQTLFVRTLTGGCGVF

SEQ ID NO: 1557932 - protein, 19 aa, Mycobacterium tuberculosis
QVADWLAARQPKLVTSAHW

SEQ ID NO: 1557933 - protein, 22 aa, Mycobacterium tuberculosis
QVDLIRAQLTRQLRLELGHESV

SEQ ID NO: 1557934 - protein, 24 aa, Mycobacterium tuberculosis
QVHDADTIVLRRSRPLQISLDGHD

SEQ ID NO: 1557935 - protein, 18 aa, Mycobacterium tuberculosis
QVLAAGADEVSARIAALF

SEQ ID NO: 1557936 - protein, 21 aa, Mycobacterium tuberculosis
QVLVVGSGYLCRGRRLRPGCG

SEQ ID NO: 1557937 - protein, 17 aa, Mycobacterium tuberculosis
QVPVGLLAVPVARAGCY

SEQ ID NO: 1557938 - protein, 22 aa, Mycobacterium tuberculosis
QVSNIAYKKKLWQAIRAQDVCG

SEQ ID NO: 1557939 - protein, 22 aa, Mycobacterium tuberculosis
QVVAGIRRWLDSPSLMVADMFA

SEQ ID NO: 1557940 - protein, 18 aa, Mycobacterium tuberculosis
QWDPTLPALVSAGAPGDP

SEQ ID NO: 1557941 - protein, 23 aa, Mycobacterium tuberculosis
QYGQRLAAFVVLKPGVSATPETL

SEQ ID NO: 1557942 - protein, 18 aa, Mycobacterium tuberculosis
RAGIELLAFGGRFVEIGK

SEQ ID NO: 1557943 - protein, 18 aa, Mycobacterium tuberculosis
RAGPIFTNLLLADEINRT

SEQ ID NO: 1557944 - protein, 25 aa, Mycobacterium tuberculosis
RAIDPGFFSARKLPDGLSFDPANCA

SEQ ID NO: 1557945 - protein, 18 aa, Mycobacterium tuberculosis
RALWIAALSFGLGGVAVA

SEQ ID NO: 1557946 - protein, 22 aa, Mycobacterium tuberculosis
RARASFYGYGFNVGVTSSGRTE

SEQ ID NO: 1557947 - protein, 17 aa, Mycobacterium tuberculosis
RARRPLVVVLTDGRATA

SEQ ID NO: 1557948 - protein, 17 aa, Mycobacterium tuberculosis
RARWANPAAWRLPGDDV

SEQ ID NO: 1557949 - protein, 39 aa, Mycobacterium tuberculosis
RASSTWADSPRAWPIRAPSRLQVWRTRATTARECSIRVI

SEQ ID NO: 1557950 - protein, 28 aa, Mycobacterium tuberculosis
RASVLAYPRVVWIAGGLLKGASLHAEVA

SEQ ID NO: 1557951 - protein, 26 aa, Mycobacterium tuberculosis
RCLTPSLGFGFWIGARVRCVGYPRAT

SEQ ID NO: 1557952 - protein, 18 aa, Mycobacterium tuberculosis
RCPSGRRLVRLRPRRRQA

SEQ ID NO: 1557953 - protein, 21 aa, Mycobacterium tuberculosis
RCRRWRVGTPTRYGWCPATST

SEQ ID NO: 1557954 - protein, 18 aa, Mycobacterium tuberculosis
RDIRFEQMLLLDDETPIG

SEQ ID NO: 1557955 - protein, 17 aa, Mycobacterium tuberculosis
RDLPPRDVAHKWTVDRH

SEQ ID NO: 1557956 - protein, 24 aa, Mycobacterium tuberculosis
RECSIRVIISRVSSTGAPPPKKVG

SEQ ID NO: 1557957 - protein, 22 aa, Mycobacterium tuberculosis
REDWAALYKKAFAPLNELAGSL

SEQ ID NO: 1557958 - protein, 24 aa, Mycobacterium tuberculosis
REEPYCDAYYWVDNLRHTVRFAAA

SEQ ID NO: 1557959 - protein, 17 aa, Mycobacterium tuberculosis
REHLGVRPPVEADWLLL

SEQ ID NO: 1557960 - protein, 19 aa, Mycobacterium tuberculosis
REHLGVRPPVEADWLLLVE

SEQ ID NO: 1557961 - protein, 18 aa, Mycobacterium tuberculosis
RESATRFFGASAAAIIND

SEQ ID NO: 1557962 - protein, 27 aa, Mycobacterium tuberculosis
RETAAAPGLFLRFSAAPGGNGRDGAGV

SEQ ID NO: 1557963 - protein, 26 aa, Mycobacterium tuberculosis
RFGDYQVIVIANPLVIPGRPVARVDT

SEQ ID NO: 1557964 - protein, 17 aa, Mycobacterium tuberculosis
RFGRLPFETLFEPAISY

SEQ ID NO: 1557965 - protein, 27 aa, Mycobacterium tuberculosis
RFSAADKPVIFWTPDHGAFVVRGAMVA

SEQ ID NO: 1557966 - protein, 26 aa, Mycobacterium tuberculosis
RGAMHRSRLEHLVAPKFFKDTAFTYD

SEQ ID NO: 1557967 - protein, 38 aa, Mycobacterium tuberculosis
RGASPTAPGPLAFPAPKAWPARPASAGRRRACRSRGAG

SEQ ID NO: 1557968 - protein, 18 aa, Mycobacterium tuberculosis
RGERFARLPAGRAILLTD

SEQ ID NO: 1557969 - protein, 17 aa, Mycobacterium tuberculosis
RGGLLVGNGGAGGAGGV

SEQ ID NO: 1557970 - protein, 19 aa, Mycobacterium tuberculosis
RGGPMMLLAAPTLPGRGLS

SEQ ID NO: 1557971 - protein, 23 aa, Mycobacterium tuberculosis
RGPARAGHLLNVSLASFAPSAAA

SEQ ID NO: 1557972 - protein, 19 aa, Mycobacterium tuberculosis
RGPVWVFSGQGSQWPGMGT

SEQ ID NO: 1557973 - protein, 19 aa, Mycobacterium tuberculosis
RGRSALAFGSGGVGGAGGL

SEQ ID NO: 1557974 - protein, 23 aa, Mycobacterium tuberculosis
RGRWYRRGRRCRWERGVVVGQRR

SEQ ID NO: 1557975 - protein, 17 aa, Mycobacterium tuberculosis
RGTQVLAPVVFTSALGL

SEQ ID NO: 1557976 - protein, 20 aa, Mycobacterium tuberculosis
RHDHKRHLTPLFRGRGLTAR

SEQ ID NO: 1557977 - protein, 17 aa, Mycobacterium tuberculosis
RHHGNIAALAEIAPPSI

SEQ ID NO: 1557978 - protein, 20 aa, Mycobacterium tuberculosis
RHLAPSALYRMFYKARKAAG

SEQ ID NO: 1557979 - protein, 18 aa, Mycobacterium tuberculosis
RHLLQRLGQLLHRAAHLT

SEQ ID NO: 1557980 - protein, 29 aa, Mycobacterium tuberculosis
RHNTPVRSFLLQLGGIRALGYSPELVTAV

SEQ ID NO: 1557981 - protein, 17 aa, Mycobacterium tuberculosis
RIAQLVAGAFFREPKQV

SEQ ID NO: 1557982 - protein, 26 aa, Mycobacterium tuberculosis
RIDTQLPNWWGPILAPALAGVGALRG

SEQ ID NO: 1557983 - protein, 22 aa, Mycobacterium tuberculosis
RIHYGNLLSLPIADGGVLYVEP

SEQ ID NO: 1557984 - protein, 23 aa, Mycobacterium tuberculosis
RIKKVTERLPLPPNARRVEDPEM

SEQ ID NO: 1557985 - protein, 18 aa, Mycobacterium tuberculosis
RITGWPRVSVQPADHILA

SEQ ID NO: 1557986 - protein, 17 aa, Mycobacterium tuberculosis
RKPFPRTVSTGQAIAMA

SEQ ID NO: 1557987 - protein, 25 aa, Mycobacterium tuberculosis
RLAGMTTWVASIALLAAALSGCGAG

SEQ ID NO: 1557988 - protein, 19 aa, Mycobacterium tuberculosis
RLAGPYAWSNALSAGYTAE

SEQ ID NO: 1557989 - protein, 21 aa, Mycobacterium tuberculosis
RLAIADDLAFGRLLAVDIPAL

SEQ ID NO: 1557990 - protein, 22 aa, Mycobacterium tuberculosis
RLAIADDLAFGRLLAVDIPALN

SEQ ID NO: 1557991 - protein, 28 aa, Mycobacterium tuberculosis
RLLTVSRLLAPILTPVIYRAAMAARGLI

SEQ ID NO: 1557992 - protein, 21 aa, Mycobacterium tuberculosis
RLMVYRRPHTRRWAGPAFLLN

SEQ ID NO: 1557993 - protein, 24 aa, Mycobacterium tuberculosis
RLPEPLAMLSPDEGLLTAGWATLR

SEQ ID NO: 1557994 - protein, 23 aa, Mycobacterium tuberculosis
RLPKVSWVLPGFLLSEHPAFPVN

SEQ ID NO: 1557995 - protein, 19 aa, Mycobacterium tuberculosis
RLQSNPLVGKLTTKYFLPL

SEQ ID NO: 1557996 - protein, 19 aa, Mycobacterium tuberculosis
RLRCRPVHPQPSLRRRARI

SEQ ID NO: 1557997 - protein, 17 aa, Mycobacterium tuberculosis
RLRSRRAGDIGLCHLTP

SEQ ID NO: 1557998 - protein, 31 aa, Mycobacterium tuberculosis
RLVARRLCPRILLACLFVAELIGAAALSGNP

SEQ ID NO: 1557999 - protein, 18 aa, Mycobacterium tuberculosis
RLVFRRRAPVDPKRRPLI

SEQ ID NO: 1558000 - protein, 17 aa, Mycobacterium tuberculosis
RMAFLLQGDHDAYFQHV

SEQ ID NO: 1558001 - protein, 32 aa, Mycobacterium tuberculosis
RMATARYGEFLRASLPPFWQTTNATQVRAALR

SEQ ID NO: 1558002 - protein, 18 aa, Mycobacterium tuberculosis
RMKAWRPWAITASSVIRT

SEQ ID NO: 1558003 - protein, 18 aa, Mycobacterium tuberculosis
RNDWLTTMRSTTAGVAAS

SEQ ID NO: 1558004 - protein, 18 aa, Mycobacterium tuberculosis
RNVDRFRPGLLDLPAPAP

SEQ ID NO: 1558005 - protein, 22 aa, Mycobacterium tuberculosis
RPALQQVAAWYWTLKHPEQSGS

SEQ ID NO: 1558006 - protein, 20 aa, Mycobacterium tuberculosis
RPFIAFYNNCANAILRLVGV

SEQ ID NO: 1558007 - protein, 19 aa, Mycobacterium tuberculosis
RPFMEFTPGYVLRSLDELP

SEQ ID NO: 1558008 - protein, 22 aa, Mycobacterium tuberculosis
RPGIWPAYADHRMAMAGAIIGL

SEQ ID NO: 1558009 - protein, 22 aa, Mycobacterium tuberculosis
RPHLEWQLRRRVLQLSNVQIVR

SEQ ID NO: 1558010 - protein, 29 aa, Mycobacterium tuberculosis
RPHTRRWAGPAFLLNQMLVWGFTGQVISA

SEQ ID NO: 1558011 - protein, 22 aa, Mycobacterium tuberculosis
RPILPPLAPGQVLRIGPTAGTG

SEQ ID NO: 1558012 - protein, 19 aa, Mycobacterium tuberculosis
RPIVVVLFLSAEIAAFENA

SEQ ID NO: 1558013 - protein, 17 aa, Mycobacterium tuberculosis
RPMRSWQARRRRWRPTA

SEQ ID NO: 1558014 - protein, 18 aa, Mycobacterium tuberculosis
RPNPGQPPMGNLHINWPG

SEQ ID NO: 1558015 - protein, 30 aa, Mycobacterium tuberculosis
RPPSRLTGCYWWNWPPTTIRPTGSPTCSAV

SEQ ID NO: 1558016 - protein, 28 aa, Mycobacterium tuberculosis
RPQPQPVELLLRAITPPRAPAASPNVGF

SEQ ID NO: 1558017 - protein, 20 aa, Mycobacterium tuberculosis
RPQVLDLLHHTPDYGPPGGP

SEQ ID NO: 1558018 - protein, 20 aa, Mycobacterium tuberculosis
RPRGVAPAALFALLCGDLSA

SEQ ID NO: 1558019 - protein, 18 aa, Mycobacterium tuberculosis
RPRKPWGNGRGGNAWVLL

SEQ ID NO: 1558020 - protein, 17 aa, Mycobacterium tuberculosis
RPRSLYAASKTAQEHYA

SEQ ID NO: 1558021 - protein, 24 aa, Mycobacterium tuberculosis
RQCPPGLCHLPGGLRRQRSLSVPQ

SEQ ID NO: 1558022 - protein, 26 aa, Mycobacterium tuberculosis
RQGIAQLFDVPPLPYQELKIATAERG

SEQ ID NO: 1558023 - protein, 17 aa, Mycobacterium tuberculosis
RQHEATLLLSPTSSAHI

SEQ ID NO: 1558024 - protein, 22 aa, Mycobacterium tuberculosis
RQLDAFLKWHHGVREFLQSAID

SEQ ID NO: 1558025 - protein, 27 aa, Mycobacterium tuberculosis
RQPSTHTIFVLGRPITAGAFSAVARGV

SEQ ID NO: 1558026 - protein, 24 aa, Mycobacterium tuberculosis
RQRRAVWRRRGRRARWLRQCCRRR

SEQ ID NO: 1558027 - protein, 32 aa, Mycobacterium tuberculosis
RRAAGLPRSLRPPLPPLPNAELPAPPSPPAPP

SEQ ID NO: 1558028 - protein, 17 aa, Mycobacterium tuberculosis
RRFAVAVAGVATAAATT

SEQ ID NO: 1558029 - protein, 22 aa, Mycobacterium tuberculosis
RRGRARRPATAVWAATLSDCSA

SEQ ID NO: 1558030 - protein, 26 aa, Mycobacterium tuberculosis
RRHRHCPTANRRFPPAPPVEAVAAGS

SEQ ID NO: 1558031 - protein, 24 aa, Mycobacterium tuberculosis
RRHRWPRWRRRHGARRWRHRRRRR

SEQ ID NO: 1558032 - protein, 28 aa, Mycobacterium tuberculosis
RRIELPTYAFQRQRYWLPPTSAGSADIS

SEQ ID NO: 1558033 - protein, 20 aa, Mycobacterium tuberculosis
RRLSPRVVAAPFDPAVGAAL

SEQ ID NO: 1558034 - protein, 40 aa, Mycobacterium tuberculosis
RRRCGRRRRCRWSRRVAGRQRWQRWQRWQRCRRRQRRHRR

SEQ ID NO: 1558035 - protein, 26 aa, Mycobacterium tuberculosis
RRRFRRSIQTILLAALGRTIAQTVGE

SEQ ID NO: 1558036 - protein, 18 aa, Mycobacterium tuberculosis
RRRRRVTRRGYGDEFMDM

SEQ ID NO: 1558037 - protein, 28 aa, Mycobacterium tuberculosis
RRRSAWRFSVPLVCLLAGLLLAATHGVS

SEQ ID NO: 1558038 - protein, 20 aa, Mycobacterium tuberculosis
RRRWYWRHSWHRRRQLNDRR

SEQ ID NO: 1558039 - protein, 25 aa, Mycobacterium tuberculosis
RRVASHCPVLRYPRPRLGAGFDRPV

SEQ ID NO: 1558040 - protein, 30 aa, Mycobacterium tuberculosis
RRVSISCRVREGFVMRLAIVGTAAAAAIGG

SEQ ID NO: 1558041 - protein, 28 aa, Mycobacterium tuberculosis
RRYRRSRRLWSVAVRQRRGRRGRRQRRQ

SEQ ID NO: 1558042 - protein, 17 aa, Mycobacterium tuberculosis
RSARPARPRLTRPNRRG

SEQ ID NO: 1558043 - protein, 21 aa, Mycobacterium tuberculosis
RSGDPVAPPIPLLPARVDYDS

SEQ ID NO: 1558044 - protein, 18 aa, Mycobacterium tuberculosis
RSGRFRAVSHLRGLPTAV

SEQ ID NO: 1558045 - protein, 18 aa, Mycobacterium tuberculosis
RSIFMWTAAPHAEYDHDF

SEQ ID NO: 1558046 - protein, 17 aa, Mycobacterium tuberculosis
RSLTGVPIDYFAEINLA

SEQ ID NO: 1558047 - protein, 17 aa, Mycobacterium tuberculosis
RSPVYLVLAARKTVRKW

SEQ ID NO: 1558048 - protein, 17 aa, Mycobacterium tuberculosis
RSVPLVGHIPSAPGNPG

SEQ ID NO: 1558049 - protein, 23 aa, Mycobacterium tuberculosis
RTGKFNRPYLCRSRCVHTSSSHH

SEQ ID NO: 1558050 - protein, 25 aa, Mycobacterium tuberculosis
RTLVHRTCVTPLPFAQADLDALQRV

SEQ ID NO: 1558051 - protein, 25 aa, Mycobacterium tuberculosis
RTNGMTPYLVRVLGTQPTPVQQAPV

SEQ ID NO: 1558052 - protein, 27 aa, Mycobacterium tuberculosis
RTQRSVRALLTGYLLYTLGGDKTYRRF

SEQ ID NO: 1558053 - protein, 26 aa, Mycobacterium tuberculosis
RTVSGQLTLLVPFIDRVRARVDLRER

SEQ ID NO: 1558054 - protein, 17 aa, Mycobacterium tuberculosis
RVFAALWIGEMATYDAF

SEQ ID NO: 1558055 - protein, 31 aa, Mycobacterium tuberculosis
RVISPQTLFFPFVLLLAATALYRGNDKKMRT

SEQ ID NO: 1558056 - protein, 25 aa, Mycobacterium tuberculosis
RVITRTLFVVRLLPAIDHFLDLLRK

SEQ ID NO: 1558057 - protein, 26 aa, Mycobacterium tuberculosis
RVLAAALRLRRTHPESFLGGAYHPVF

SEQ ID NO: 1558058 - protein, 17 aa, Mycobacterium tuberculosis
RVLQLSNVQIVRRLVTE

SEQ ID NO: 1558059 - protein, 19 aa, Mycobacterium tuberculosis
RVRAYGDFLSYCLVAEGAV

SEQ ID NO: 1558060 - protein, 20 aa, Mycobacterium tuberculosis
RVRHLLHRIFAHANGDRADA

SEQ ID NO: 1558061 - protein, 28 aa, Mycobacterium tuberculosis
RVTWNPSGMYFWLDYADAFEPYFSVPAT

SEQ ID NO: 1558062 - protein, 18 aa, Mycobacterium tuberculosis
RVTWNPSGMYFWLDYADG

SEQ ID NO: 1558063 - protein, 19 aa, Mycobacterium tuberculosis
RVWVWSPTNPGASDPAAMI

SEQ ID NO: 1558064 - protein, 27 aa, Mycobacterium tuberculosis
RVYRFGGSLHLDWWYDTRRIPAATAEA

SEQ ID NO: 1558065 - protein, 17 aa, Mycobacterium tuberculosis
RWLSAKPDYLVTTEQSV

SEQ ID NO: 1558066 - protein, 25 aa, Mycobacterium tuberculosis
RWQRRGSPPFLMPLGGAGGGGDRRV

SEQ ID NO: 1558067 - protein, 29 aa, Mycobacterium tuberculosis
RYPMFTARIRALAGMSLLASAIGLAAFGA

SEQ ID NO: 1558068 - protein, 18 aa, Mycobacterium tuberculosis
RYPYRPEPPAPPPGGPPP

SEQ ID NO: 1558069 - protein, 22 aa, Mycobacterium tuberculosis
RYPYRPEPPAPPPGGRRPARPR

SEQ ID NO: 1558070 - protein, 22 aa, Mycobacterium tuberculosis
RYYDMLRKFGLGQRTGVGLPGE

SEQ ID NO: 1558071 - protein, 25 aa, Mycobacterium tuberculosis
RYYDMLRKFGLGQRTGVGLPGESAG

SEQ ID NO: 1558072 - protein, 30 aa, Mycobacterium tuberculosis
SAAAAALAPWQQAVPGLSGLLGGAANAPAA

SEQ ID NO: 1558073 - protein, 25 aa, Mycobacterium tuberculosis
SAAIAALFSAHGRAYQVASAQAAAV

SEQ ID NO: 1558074 - protein, 18 aa, Mycobacterium tuberculosis
SAALASLFSGHAVSYQQV

SEQ ID NO: 1558075 - protein, 37 aa, Mycobacterium tuberculosis; identical to SEQ ID NO: 1529539

SEQ ID NO: 1558076 - protein, 24 aa, Mycobacterium tuberculosis
SAAPVITAVVPPAADPVSLQTAAG

SEQ ID NO: 1558077 - protein, 20 aa, Mycobacterium tuberculosis
SAFNLVHQGVTAAKVGCYTA

SEQ ID NO: 1558078 - protein, 20 aa, Mycobacterium tuberculosis
SAFVQLVLSNVFGQNAPAIA

SEQ ID NO: 1558079 - protein, 19 aa, Mycobacterium tuberculosis
SAGKLSFPTSAAPGWSAFS

SEQ ID NO: 1558080 - protein, 19 aa, Mycobacterium tuberculosis
SAGLVPPIDQWSGSTFANL

SEQ ID NO: 1558081 - protein, 36 aa, Mycobacterium tuberculosis
SAHAGQYQQLGARAALFHEQFVQALTGAASAYASAK

SEQ ID NO: 1558082 - protein, 31 aa, Mycobacterium tuberculosis; identical to SEQ ID NO: 222781

SEQ ID NO: 1558083 - protein, 36 aa, Mycobacterium tuberculosis; identical to SEQ ID NO: 236882

SEQ ID NO: 1558084 - protein, 25 aa, Mycobacterium tuberculosis
SALANAGLGLVFLGADPLRSPVRVN

SEQ ID NO: 1558085 - protein, 20 aa, Mycobacterium tuberculosis
SALLAGCQFGGLNSLPLPGT

SEQ ID NO: 1558086 - protein, 17 aa, Mycobacterium tuberculosis
SALYRMFYKARKAAGRP

SEQ ID NO: 1558087 - protein, 17 aa, Mycobacterium tuberculosis
SAMATGAAWNVGSFNFG

SEQ ID NO: 1558088 - protein, 20 aa, Mycobacterium tuberculosis
SARRLRLRSRRAGDIGLCHL

SEQ ID NO: 1558089 - protein, 25 aa, Mycobacterium tuberculosis
SARVATFHEQFVRSLTAAGSAYATA

SEQ ID NO: 1558090 - protein, 17 aa, Mycobacterium tuberculosis
SARVITRTLFVVRLLPA

SEQ ID NO: 1558091 - protein, 31 aa, Mycobacterium tuberculosis
SAVFTTPHRFLYDPLGFLRLLTSSGATHTFM

SEQ ID NO: 1558092 - protein, 20 aa, Mycobacterium tuberculosis
SAWEGLAADLWASASSFESV

SEQ ID NO: 1558093 - protein, 17 aa, Mycobacterium tuberculosis
SAYLGFTIEQFPLTYHA

SEQ ID NO: 1558094 - protein, 22 aa, Mycobacterium tuberculosis
SCRVREGFVMRLAIVGTAAAAA

SEQ ID NO: 1558095 - protein, 25 aa, Mycobacterium tuberculosis
SCRVREGFVMRLAIVGTAAAAAIGG

SEQ ID NO: 1558096 - protein, 24 aa, Mycobacterium tuberculosis
SDDFIEWSVSFSQKPFPPPCDIAK

SEQ ID NO: 1558097 - protein, 18 aa, Mycobacterium tuberculosis
SDPFITIDAFQVVAGVLF

SEQ ID NO: 1558098 - protein, 20 aa, Mycobacterium tuberculosis
SDYMRPAVRLAALMDIDTIY

SEQ ID NO: 1558099 - protein, 25 aa, Mycobacterium tuberculosis
SEGTLGFITALDLRLHPTPSHRVTA

SEQ ID NO: 1558100 - protein, 25 aa, Mycobacterium tuberculosis
SETATRFVADPFAAQPGSRLYRNGE

SEQ ID NO: 1558101 - protein, 22 aa, Mycobacterium tuberculosis
SETPVPELTWVPAGGGAPVGNP

SEQ ID NO: 1558102 - protein, 20 aa, Mycobacterium tuberculosis
SFAAAYVSGLAALLRQRFPD

SEQ ID NO: 1558103 - protein, 18 aa, Mycobacterium tuberculosis
SFSQKPFPPPCDIAKELT

SEQ ID NO: 1558104 - protein, 18 aa, Mycobacterium tuberculosis
SFVIAAPEVIAAAATDLA

SEQ ID NO: 1558105 - protein, 36 aa, Mycobacterium tuberculosis; identical to SEQ ID NO: 238093

SEQ ID NO: 1558106 - protein, 24 aa, Mycobacterium tuberculosis
SGDGQWRLRQQRHFGCGGQPEFRQ

SEQ ID NO: 1558107 - protein, 29 aa, Mycobacterium tuberculosis
SGDRVIPQWVKIRNVDRFNGSFWHGGVGN

SEQ ID NO: 1558108 - protein, 17 aa, Mycobacterium tuberculosis
SGGAGGSRGVLFGTPGA

SEQ ID NO: 1558109 - protein, 25 aa, Mycobacterium tuberculosis
SGGDRFYPPRWKTAGDRRGLVWGNG

SEQ ID NO: 1558110 - protein, 19 aa, Mycobacterium tuberculosis
SGGWLLGTGGVGGVGGLGA

SEQ ID NO: 1558111 - protein, 22 aa, Mycobacterium tuberculosis
SGLAALLRQRFPDLTPAQIIHR

SEQ ID NO: 1558112 - protein, 21 aa, Mycobacterium tuberculosis
SGLLHHSVGTMTLNFGLANVG

SEQ ID NO: 1558113 - protein, 17 aa, Mycobacterium tuberculosis
SGLPFRRQHRRNLWDRR

SEQ ID NO: 1558114 - protein, 37 aa, Mycobacterium tuberculosis
SGLPLRAMVMVLLFLGVVFLLLGWQALGSSPNSEDDS

SEQ ID NO: 1558115 - protein, 21 aa, Mycobacterium tuberculosis
SGLTAGVWQGAAAAAMAAAAA

SEQ ID NO: 1558116 - protein, 18 aa, Mycobacterium tuberculosis
SGMYFWLDYADGIEPYFS

SEQ ID NO: 1558117 - protein, 28 aa, Mycobacterium tuberculosis
SGNYSNGFFWRGDYQGLIGLSTTITIPE

SEQ ID NO: 1558118 - protein, 29 aa, Mycobacterium tuberculosis
SGNYSNGILWRGDYQGLIGYSYALTIPEI

SEQ ID NO: 1558119 - protein, 17 aa, Mycobacterium tuberculosis
SGRVAYTLGLHGPAVTV

SEQ ID NO: 1558120 - protein, 24 aa, Mycobacterium tuberculosis
SGSGLGGQPGFAGGAGGKGGAGGN

SEQ ID NO: 1558121 - protein, 24 aa, Mycobacterium tuberculosis
SGSGLGGQPGFAGGAGGKGGAGGS

SEQ ID NO: 1558122 - protein, 24 aa, Mycobacterium tuberculosis
SGSGLGGQPGFAGGPGGKGGAGGN

SEQ ID NO: 1558123 - protein, 25 aa, Mycobacterium tuberculosis
SGSGLGGQPGFAGGPGGKGGAGGNA

SEQ ID NO: 1558124 - protein, 25 aa, Mycobacterium tuberculosis
SHAFHSLLMEPMLAEFTRIAAGISV

SEQ ID NO: 1558125 - protein, 24 aa, Mycobacterium tuberculosis
SHGWNMTKTWPPRTVIRKSGGLRG

SEQ ID NO: 1558126 - protein, 24 aa, Mycobacterium tuberculosis
SIDGLIAILTFPPAESVFDQIIDA

SEQ ID NO: 1558127 - protein, 17 aa, Mycobacterium tuberculosis
SIQFPAIPLDLSATGHI

SEQ ID NO: 1558128 - protein, 20 aa, Mycobacterium tuberculosis
SKLTPWKAPPPIAHSTVLVA

SEQ ID NO: 1558129 - protein, 20 aa, Mycobacterium tuberculosis
SLFGLIAVPGQSAYNAAKFA

SEQ ID NO: 1558130 - protein, 21 aa, Mycobacterium tuberculosis
SLFGLIAVPGQSAYNAAKFAV

SEQ ID NO: 1558131 - protein, 20 aa, Mycobacterium tuberculosis
SLGPLVVPDIVIPAFGGGTA

SEQ ID NO: 1558132 - protein, 20 aa, Mycobacterium tuberculosis
SLPPIPTLFVVADEFTLMLA

SEQ ID NO: 1558133 - protein, 18 aa, Mycobacterium tuberculosis
SLPPNWAGASPSLAPTVG

SEQ ID NO: 1558134 - protein, 28 aa, Mycobacterium tuberculosis
SLQGKPAVLWFWTPWCPFCNAEAPSLSQ

SEQ ID NO: 1558135 - protein, 17 aa, Mycobacterium tuberculosis
SLQLRVVALTLGLSLAV

SEQ ID NO: 1558136 - protein, 21 aa, Mycobacterium tuberculosis
SLRAASLLDKIGEDHIFMTLP

SEQ ID NO: 1558137 - protein, 23 aa, Mycobacterium tuberculosis
SLSSLSPLFGSKAIDLCNPTDPI

SEQ ID NO: 1558138 - protein, 39 aa, Mycobacterium tuberculosis
SMARLRKQILRLDQRWLIARVIMRSAIGFFASFTVSSGV

SEQ ID NO: 1558139 - protein, 18 aa, Mycobacterium tuberculosis
SMGILPAGGVGGPGGSGG

SEQ ID NO: 1558140 - protein, 31 aa, Mycobacterium tuberculosis
SMNCRNGFQWSAHFDPRYGSASKDVQQQLPA

SEQ ID NO: 1558141 - protein, 22 aa, Mycobacterium tuberculosis
SNGLLWRGDNQGLIDLAIGVDI

SEQ ID NO: 1558142 - protein, 20 aa, Mycobacterium tuberculosis
SNIAYTKKLWQAIRATGRLR

SEQ ID NO: 1558143 - protein, 31 aa, Mycobacterium tuberculosis; identical to SEQ ID NO: 223052

SEQ ID NO: 1558144 - protein, 23 aa, Mycobacterium tuberculosis
SNPLANFAPGYPPTIEPAQPAVS

SEQ ID NO: 1558145 - protein, 27 aa, Mycobacterium tuberculosis
SPALDLDALIGGFKPVFRALDPAKVNN

SEQ ID NO: 1558146 - protein, 18 aa, Mycobacterium tuberculosis
SPALWLSAGSVAPGSFDG

SEQ ID NO: 1558147 - protein, 25 aa, Mycobacterium tuberculosis
SPATGAELLRWLDRAPQIATFGAMV

SEQ ID NO: 1558148 - protein, 19 aa, Mycobacterium tuberculosis
SPEIRAPTLLTLNTPRQFR

SEQ ID NO: 1558149 - protein, 32 aa, Mycobacterium tuberculosis
SPGGSMIIQFFVKTLVAMLDWGLNPQQAVSLV

SEQ ID NO: 1558150 - protein, 25 aa, Mycobacterium tuberculosis
SPLAAILLGLLHDGVPVAGLTWMPF

SEQ ID NO: 1558151 - protein, 26 aa, Mycobacterium tuberculosis
SPMTTMITLRRRFAVAVAGVATAAAT

SEQ ID NO: 1558152 - protein, 32 aa, Mycobacterium tuberculosis; identical to SEQ ID NO: 163746

SEQ ID NO: 1558153 - protein, 19 aa, Mycobacterium tuberculosis
SPSMGRDIPVAFLAGGPHA

SEQ ID NO: 1558154 - protein, 19 aa, Mycobacterium tuberculosis
SPVRVNPGARYRAMEQFFA

SEQ ID NO: 1558155 - protein, 23 aa, Mycobacterium tuberculosis
SQAIDLLKGVLMPSIMQAVQNGG

SEQ ID NO: 1558156 - protein, 25 aa, Mycobacterium tuberculosis
SQMSFVIAVPEALTMAASDLANIGS

SEQ ID NO: 1558157 - protein, 22 aa, Mycobacterium tuberculosis
SQVPWLWAKFIGHAQAIAPAPD

SEQ ID NO: 1558158 - protein, 23 aa, Mycobacterium tuberculosis
SRALRRVRAVLTAAARCHRSGSL

SEQ ID NO: 1558159 - protein, 17 aa, Mycobacterium tuberculosis
SRTSRFPPWDSTPQPVS

SEQ ID NO: 1558160 - protein, 19 aa, Mycobacterium tuberculosis
SSCPPDQPAGSAAAAGGPA

SEQ ID NO: 1558161 - protein, 17 aa, Mycobacterium tuberculosis
SSIPPVPGKFYWMSPTQ

SEQ ID NO: 1558162 - protein, 35 aa, Mycobacterium tuberculosis
SSIPPVPGKFYWMSPTQVRWRPFEFLAANGVRSRS

SEQ ID NO: 1558163 - protein, 19 aa, Mycobacterium tuberculosis
SSYFALIETQAHHIIRCLK

SEQ ID NO: 1558164 - protein, 33 aa, Mycobacterium tuberculosis
STDQRLLDLINGPTQALLGRPLIGDGANGGPGQ

SEQ ID NO: 1558165 - protein, 25 aa, Mycobacterium tuberculosis
STGKDVYFNLSLWSAYNVMLMHTVL

SEQ ID NO: 1558166 - protein, 28 aa, Mycobacterium tuberculosis
STGLVMDSQFLTQNFGPVIGTGTAGYAG

SEQ ID NO: 1558167 - protein, 27 aa, Mycobacterium tuberculosis
STKLEPRFPSRDLLGIALLSNADPAAP

SEQ ID NO: 1558168 - protein, 17 aa, Mycobacterium tuberculosis
STLIGRTLLGLAATAVT

SEQ ID NO: 1558169 - protein, 21 aa, Mycobacterium tuberculosis
STLIGRTLLGLAATAVTAVLL

SEQ ID NO: 1558170 - protein, 26 aa, Mycobacterium tuberculosis
STLLNQPFQALPPFPPVFGGSDSLGD

SEQ ID NO: 1558171 - protein, 23 aa, Mycobacterium tuberculosis
STQVAAFHDRFAQTLSAAVGSYV

SEQ ID NO: 1558172 - protein, 23 aa, Mycobacterium tuberculosis
STVKSMILHEILPIDVSINLEDA

SEQ ID NO: 1558173 - protein, 20 aa, Mycobacterium tuberculosis
SVAQLELLLPAMAGLVASLT

SEQ ID NO: 1558174 - protein, 23 aa, Mycobacterium tuberculosis
SVGLQHQLSRLTNQAWPVSMTGG

SEQ ID NO: 1558175 - protein, 18 aa, Mycobacterium tuberculosis
SVGTMTLNFGLANVGGNN

SEQ ID NO: 1558176 - protein, 24 aa, Mycobacterium tuberculosis
SVHRFDLFVPVFRNHLVELSAEFP

SEQ ID NO: 1558177 - protein, 26 aa, Mycobacterium tuberculosis
SVIASLTGWQWLGPSSVRMGAAVTPY

SEQ ID NO: 1558178 - protein, 27 aa, Mycobacterium tuberculosis
SVIASLTGWQWLGPSSVRMGAAVTPYV

SEQ ID NO: 1558179 - protein, 23 aa, Mycobacterium tuberculosis
SVNVTLILLRAAVPRGDGRLPDR

SEQ ID NO: 1558180 - protein, 27 aa, Mycobacterium tuberculosis
SVPGLVRVLPPFLSRKHLPSRLGKLRE

SEQ ID NO: 1558181 - protein, 36 aa, Mycobacterium tuberculosis
SVQQDLLNLINAPTQALLGRPLIGNGANGLPGTGQN

SEQ ID NO: 1558182 - protein, 27 aa, Mycobacterium tuberculosis
SVRCSHGITFATYPGSAAATPQPSDNA

SEQ ID NO: 1558183 - protein, 23 aa, Mycobacterium tuberculosis
SVRSPVYLVLAARRRCVSGCARR

SEQ ID NO: 1558184 - protein, 26 aa, Mycobacterium tuberculosis
SVTVMALIVLLLLNATMTQVFTADGL

SEQ ID NO: 1558185 - protein, 34 aa, Mycobacterium tuberculosis; identical to SEQ ID NO: 1530146

SEQ ID NO: 1558186 - protein, 17 aa, Mycobacterium tuberculosis
SYAYAVLRKAAQRAGDA

SEQ ID NO: 1558187 - protein, 27 aa, Mycobacterium tuberculosis
SYSLDVPRITILDAHFTGAFRPGGRPA

SEQ ID NO: 1558188 - protein, 43 aa, Mycobacterium tuberculosis; identical to SEQ ID NO: 223250

SEQ ID NO: 1558189 - protein, 22 aa, Mycobacterium tuberculosis
TAAEVPLAFALAAGSFRDATRV

SEQ ID NO: 1558190 - protein, 22 aa, Mycobacterium tuberculosis
TAAPNFAYALLAKRLRRQAKPG

SEQ ID NO: 1558191 - protein, 19 aa, Mycobacterium tuberculosis
TAARWNLKTIADLAPHSAD

SEQ ID NO: 1558192 - protein, 19 aa, Mycobacterium tuberculosis
TAATLGLAALGFAGTASAS

SEQ ID NO: 1558193 - protein, 25 aa, Mycobacterium tuberculosis
TADVLRAWGKLGYPRRAKRLHECAT

SEQ ID NO: 1558194 - protein, 20 aa, Mycobacterium tuberculosis
TAELLRLALTGKRKPYIYTS

SEQ ID NO: 1558195 - protein, 20 aa, Mycobacterium tuberculosis
TAFHVQFAQTLTNAGQLYAV

SEQ ID NO: 1558196 - protein, 17 aa, Mycobacterium tuberculosis
TAGLFGHGGAGGAGGIG

SEQ ID NO: 1558197 - protein, 23 aa, Mycobacterium tuberculosis
TAGNAGIGGAGGRGGDGGAGDSG

SEQ ID NO: 1558198 - protein, 18 aa, Mycobacterium tuberculosis
TAISIPRDSYVAAPGLVK

SEQ ID NO: 1558199 - protein, 21 aa, Mycobacterium tuberculosis
TALVPGLTWRTDMDTWTGCGG

SEQ ID NO: 1558200 - protein, 21 aa, Mycobacterium tuberculosis
TAPWCSTYVSYLGTSTTTPPP

SEQ ID NO: 1558201 - protein, 20 aa, Mycobacterium tuberculosis
TARVYLLDDALKPVPVGVVG

SEQ ID NO: 1558202 - protein, 27 aa, Mycobacterium tuberculosis
TASAEYLRLLRRHNVAAALSGAGPSLI

SEQ ID NO: 1558203 - protein, 19 aa, Mycobacterium tuberculosis
TATNYVRAHPAMKALVVCI

SEQ ID NO: 1558204 - protein, 29 aa, Mycobacterium tuberculosis
TAVQFHFIARLVLVLLDETFLPGGPRAQQ

SEQ ID NO: 1558205 - protein, 22 aa, Mycobacterium tuberculosis
TAVVLLIALGAVWTPVAFADGC

SEQ ID NO: 1558206 - protein, 23 aa, Mycobacterium tuberculosis
TDAAQPIWWVVRAIEFSKDFETF

SEQ ID NO: 1558207 - protein, 25 aa, Mycobacterium tuberculosis
TDGRPPVIQLWARPRGVAPAALFAL

SEQ ID NO: 1558208 - protein, 23 aa, Mycobacterium tuberculosis
TDLDSVLKRFGPLTPPRAVAIIT

SEQ ID NO: 1558209 - protein, 25 aa, Mycobacterium tuberculosis
TDQRAGGRVSRAVCRGPNLGWRVVR

SEQ ID NO: 1558210 - protein, 31 aa, Mycobacterium tuberculosis
TDQRLLDLINGPTQALLGRPLIGDGANGGPG

SEQ ID NO: 1558211 - protein, 25 aa, Mycobacterium tuberculosis
TDSMPALHMLPLADALGVLPVLATD

SEQ ID NO: 1558212 - protein, 24 aa, Mycobacterium tuberculosis
TDSPAALRLLATDAIVVLVSAQQK

SEQ ID NO: 1558213 - protein, 19 aa, Mycobacterium tuberculosis
TDYVPFTDWVDGRVLLDGR

SEQ ID NO: 1558214 - protein, 30 aa, Mycobacterium tuberculosis
TEATLRERFGYDAWALIYDVDTVRTIVAAY

SEQ ID NO: 1558215 - protein, 17 aa, Mycobacterium tuberculosis
TERFMTRLGPLLRHHRV

SEQ ID NO: 1558216 - protein, 22 aa, Mycobacterium tuberculosis
TERFMTRLGPLLRHHRVLICTP

SEQ ID NO: 1558217 - protein, 18 aa, Mycobacterium tuberculosis
TERLPLPPNARRVEDPEM

SEQ ID NO: 1558218 - protein, 23 aa, Mycobacterium tuberculosis
TFAEFFDRRLALHSPEMAAKTIV

SEQ ID NO: 1558219 - protein, 18 aa, Mycobacterium tuberculosis
TFHEDPVAGVWAVGGVGG

SEQ ID NO: 1558220 - protein, 20 aa, Mycobacterium tuberculosis
TFVALTLAPLLPGIVFVNAD

SEQ ID NO: 1558221 - protein, 56 aa, Mycobacterium tuberculosis; identical to SEQ ID NO: 1515352

SEQ ID NO: 1558222 - protein, 28 aa, Mycobacterium tuberculosis
TGANGGAGGNAWLFGAGGSGGAGTNGGV

SEQ ID NO: 1558223 - protein, 17 aa, Mycobacterium tuberculosis
TGARWRRRRATGAAGGG

SEQ ID NO: 1558224 - protein, 22 aa, Mycobacterium tuberculosis
TGDYSNGLLWRGGYEGLVGVRV

SEQ ID NO: 1558225 - protein, 28 aa, Mycobacterium tuberculosis
TGESLPLASIFKLYVLHALGRCGSSTTR

SEQ ID NO: 1558226 - protein, 21 aa, Mycobacterium tuberculosis
TGGAAGLLGWGANGGAGGLGD

SEQ ID NO: 1558227 - protein, 28 aa, Mycobacterium tuberculosis
TGGAGGPGGLIWGGGGAGGVGGAGGGTG

SEQ ID NO: 1558228 - protein, 27 aa, Mycobacterium tuberculosis
TGKSLAYLVPAIIRALCDDAPVVVSTA

SEQ ID NO: 1558229 - protein, 25 aa, Mycobacterium tuberculosis
TGNGYYGGLRFTAGTWRANGGSGSA

SEQ ID NO: 1558230 - protein, 23 aa, Mycobacterium tuberculosis
TGNNINVLAPFTPGTLFTISEIP

SEQ ID NO: 1558231 - protein, 26 aa, Mycobacterium tuberculosis
TGQAGGAGGILWGNGGAGGSGAPGQV

SEQ ID NO: 1558232 - protein, 24 aa, Mycobacterium tuberculosis
TGQPGGAGGLLWGNGGNGGSGAAG

SEQ ID NO: 1558233 - protein, 19 aa, Mycobacterium tuberculosis
TGQPGTPPLPMPYPRTGQG

SEQ ID NO: 1558234 - protein, 28 aa, Mycobacterium tuberculosis
TGSRGLRYATVIALVAALVGGVYVLSST

SEQ ID NO: 1558235 - protein, 24 aa, Mycobacterium tuberculosis
TGSTFTLALPALIEAYHDDERPEQ

SEQ ID NO: 1558236 - protein, 25 aa, Mycobacterium tuberculosis
TGSTFTLALPALIEAYHDDERPEQA

SEQ ID NO: 1558237 - protein, 20 aa, Mycobacterium tuberculosis
TGTMVLNLGLANHGTLNVGI

SEQ ID NO: 1558238 - protein, 24 aa, Mycobacterium tuberculosis
TGTRWECHLTQLELQWGRTIGQFP

SEQ ID NO: 1558239 - protein, 28 aa, Mycobacterium tuberculosis
TGVGRFRYPRNGWPALFHVRSGASLAGN

SEQ ID NO: 1558240 - protein, 18 aa, Mycobacterium tuberculosis
TGWTGRFVSRILIDGSTL

SEQ ID NO: 1558241 - protein, 22 aa, Mycobacterium tuberculosis
THPPSSMWSMPAASADWPARSP

SEQ ID NO: 1558242 - protein, 18 aa, Mycobacterium tuberculosis
THSPKHPPDLHLSGTEAG

SEQ ID NO: 1558243 - protein, 18 aa, Mycobacterium tuberculosis
TIAKVRLLDPHILSRTFT

SEQ ID NO: 1558244 - protein, 17 aa, Mycobacterium tuberculosis
TIALQRQLVDRDLPQLV

SEQ ID NO: 1558245 - protein, 22 aa, Mycobacterium tuberculosis
TIATGLIGALRQAGHTVAPFKV

SEQ ID NO: 1558246 - protein, 20 aa, Mycobacterium tuberculosis
TICHVIPGLLCWVGEYAGQV

SEQ ID NO: 1558247 - protein, 20 aa, Mycobacterium tuberculosis
TIFHDQFVQALTSGGNLYAA

SEQ ID NO: 1558248 - protein, 31 aa, Mycobacterium tuberculosis; identical to SEQ ID NO: 1510215

SEQ ID NO: 1558249 - protein, 23 aa, Mycobacterium tuberculosis
TIFPNGISIPNNPLALLASASIG

SEQ ID NO: 1558250 - protein, 36 aa, Mycobacterium tuberculosis
TIQQAIELWKIVDRPNLFIKIPATKAGLPAISAVLA

SEQ ID NO: 1558251 - protein, 37 aa, Mycobacterium tuberculosis; identical to SEQ ID NO: 223485

SEQ ID NO: 1558252 - protein, 20 aa, Mycobacterium tuberculosis
TKILGLLTAAPKSYAATIRL

SEQ ID NO: 1558253 - protein, 23 aa, Mycobacterium tuberculosis
TLGLSLAVILALGFVLTSQVTNR

SEQ ID NO: 1558254 - protein, 19 aa, Mycobacterium tuberculosis
TLGVVVCLALVLGGPLNGC

SEQ ID NO: 1558255 - protein, 17 aa, Mycobacterium tuberculosis
TLGWCDIAYNALVDKYG

SEQ ID NO: 1558256 - protein, 18 aa, Mycobacterium tuberculosis
TLGYVDPALKIAFTAGHC

SEQ ID NO: 1558257 - protein, 33 aa, Mycobacterium tuberculosis; identical to SEQ ID NO: 223529

SEQ ID NO: 1558258 - protein, 21 aa, Mycobacterium tuberculosis
TLLGRLLVYDALEMSYRTITT

SEQ ID NO: 1558259 - protein, 29 aa, Mycobacterium tuberculosis
TLMGLRCPPWSWRWSLRWIRRAAAHRCAT

SEQ ID NO: 1558260 - protein, 23 aa, Mycobacterium tuberculosis
TLPLLWRRLTTAGVKYADQGHFV

SEQ ID NO: 1558261 - protein, 20 aa, Mycobacterium tuberculosis
TLQAFLHWAITDGNKASFLD

SEQ ID NO: 1558262 - protein, 23 aa, Mycobacterium tuberculosis
TLSGFGIHPLVLDAALHAMGMVG

SEQ ID NO: 1558263 - protein, 25 aa, Mycobacterium tuberculosis
TLSRRFCVPVVRTPRPAIDGRFSAA

SEQ ID NO: 1558264 - protein, 20 aa, Mycobacterium tuberculosis
TMTWPTRWNGSTTFSAPSES

SEQ ID NO: 1558265 - protein, 44 aa, Mycobacterium tuberculosis; identical to SEQ ID NO: 236979

SEQ ID NO: 1558266 - protein, 18 aa, Mycobacterium tuberculosis
TNALPRRPKFALLKGRRN

SEQ ID NO: 1558267 - protein, 19 aa, Mycobacterium tuberculosis
TNALPRRPKFALLKGRRNY

SEQ ID NO: 1558268 - protein, 23 aa, Mycobacterium tuberculosis
TNDIEILLTATMLRCGRPTACYP

SEQ ID NO: 1558269 - protein, 24 aa, Mycobacterium tuberculosis
TNGMTPYLVRVLGTQPTPVQQAPV

SEQ ID NO: 1558270 - protein, 18 aa, Mycobacterium tuberculosis
TNIFGYRQDPLKWHPNGL

SEQ ID NO: 1558271 - protein, 21 aa, Mycobacterium tuberculosis
TNLEFLSCFLGLMLHGAVPVP

SEQ ID NO: 1558272 - protein, 26 aa, Mycobacterium tuberculosis
TNSGYPEHTFTWETGLRLRAAVERIG

SEQ ID NO: 1558273 - protein, 25 aa, Mycobacterium tuberculosis
TPASASPLHTLKQQALAAINAPTQT

SEQ ID NO: 1558274 - protein, 26 aa, Mycobacterium tuberculosis
TPAVTSFIAPLVAMVGGGQLARMTHQ

SEQ ID NO: 1558275 - protein, 20 aa, Mycobacterium tuberculosis
TPHPRLPRLIPGGDYVMAGG

SEQ ID NO: 1558276 - protein, 17 aa, Mycobacterium tuberculosis
TPPLTVPGIHLPSTTIG

SEQ ID NO: 1558277 - protein, 24 aa, Mycobacterium tuberculosis
TPRPLAHIALASGCCDLAGCVLAA

SEQ ID NO: 1558278 - protein, 18 aa, Mycobacterium tuberculosis
TPTPGAAQLPLAPAINYP

SEQ ID NO: 1558279 - protein, 17 aa, Mycobacterium tuberculosis
TPVPIPRGSPRGTHAAP

SEQ ID NO: 1558280 - protein, 29 aa, Mycobacterium tuberculosis
TQASTSVMVLWFIPPPTVFRCGWCRWTRR

SEQ ID NO: 1558281 - protein, 21 aa, Mycobacterium tuberculosis
TQDARWFLLCTVDGATVTTAD

SEQ ID NO: 1558282 - protein, 20 aa, Mycobacterium tuberculosis
TQVLAAGADEVSARIAALFG

SEQ ID NO: 1558283 - protein, 23 aa, Mycobacterium tuberculosis
TQVLAPVVFTSALGLGDLFCPDV

SEQ ID NO: 1558284 - protein, 27 aa, Mycobacterium tuberculosis
TRGLRTYVQLFVLIAAANDVRCDVASN

SEQ ID NO: 1558285 - protein, 17 aa, Mycobacterium tuberculosis
TRIAGLRVVGTATLVAA

SEQ ID NO: 1558286 - protein, 21 aa, Mycobacterium tuberculosis
TRLFVSPLQWQTHLTHVLHQT

SEQ ID NO: 1558287 - protein, 25 aa, Mycobacterium tuberculosis
TSAGPLNIPIIDIPAAPGFGNSTQM

SEQ ID NO: 1558288 - protein, 20 aa, Mycobacterium tuberculosis
TSASATWAWATSGSAIPAPT

SEQ ID NO: 1558289 - protein, 18 aa, Mycobacterium tuberculosis
TSGWPTPAPATSGSGWWG

SEQ ID NO: 1558290 - protein, 17 aa, Mycobacterium tuberculosis
TSPLAITMGFAACEAAQ

SEQ ID NO: 1558291 - protein, 21 aa, Mycobacterium tuberculosis
TTHVPLSPAPSPRPPATSTEG

SEQ ID NO: 1558292 - protein, 30 aa, Mycobacterium tuberculosis; identical to SEQ ID NO: 1516185

SEQ ID NO: 1558293 - protein, 31 aa, Mycobacterium tuberculosis; identical to SEQ ID NO: 223696

SEQ ID NO: 1558294 - protein, 21 aa, Mycobacterium tuberculosis
TTQVLAAGADEVSARIAALFG

SEQ ID NO: 1558295 - protein, 22 aa, Mycobacterium tuberculosis
TTSAPCPAGMSGLPLACIRAPR

SEQ ID NO: 1558296 - protein, 27 aa, Mycobacterium tuberculosis
TTSVLAAALLFCGLLGPGTAPPATGGG

SEQ ID NO: 1558297 - protein, 18 aa, Mycobacterium tuberculosis
TVAFYVFVSTLGLKRRTS

SEQ ID NO: 1558298 - protein, 28 aa, Mycobacterium tuberculosis
TVGLGPFTVPPISIPSLPIASITGSVDL

SEQ ID NO: 1558299 - protein, 18 aa, Mycobacterium tuberculosis
TVGYHQRGGPRWLDRLEQ

SEQ ID NO: 1558300 - protein, 18 aa, Mycobacterium tuberculosis
TVHSYAYAVLRKAAQRAG

SEQ ID NO: 1558301 - protein, 36 aa, Mycobacterium tuberculosis; identical to SEQ ID NO: 1388843

SEQ ID NO: 1558302 - protein, 25 aa, Mycobacterium tuberculosis
TVVVAGWWTPPAWAIGPPVVDAAAQ

SEQ ID NO: 1558303 - protein, 29 aa, Mycobacterium tuberculosis
TYASNFSNLYYPLHSSLVGQFVFPNFANP

SEQ ID NO: 1558304 - protein, 28 aa, Mycobacterium tuberculosis
TYEVTALNFMPGWLDMLLEVGGGRLSSL

SEQ ID NO: 1558305 - protein, 26 aa, Mycobacterium tuberculosis
TYGDFQNFYLCDLQIKWNGFQAGGPV

SEQ ID NO: 1558306 - protein, 20 aa, Mycobacterium tuberculosis
TYHSKTLGWCDIAYNALVDK

SEQ ID NO: 1558307 - protein, 20 aa, Mycobacterium tuberculosis
TYLTRVMLTAAEWTAVLINM

SEQ ID NO: 1558308 - protein, 27 aa, Mycobacterium tuberculosis
TYPSIYDPAMRTLIAFGGKYPTSVIPS

SEQ ID NO: 1558309 - protein, 17 aa, Mycobacterium tuberculosis
VAAAIAFATDCARIARV

SEQ ID NO: 1558310 - protein, 17 aa, Mycobacterium tuberculosis
VAADLTRGCGPAGAAIT

SEQ ID NO: 1558311 - protein, 18 aa, Mycobacterium tuberculosis
VAAYFYVRVIVSMFFTEE

SEQ ID NO: 1558312 - protein, 21 aa, Mycobacterium tuberculosis
VADRRRYYLGSISGKKVIVAM

SEQ ID NO: 1558313 - protein, 17 aa, Mycobacterium tuberculosis
VAENLSIASLRREKDDV

SEQ ID NO: 1558314 - protein, 26 aa, Mycobacterium tuberculosis
VAETLTPFSVPPLDLAGLASQAGAQL

SEQ ID NO: 1558315 - protein, 18 aa, Mycobacterium tuberculosis
VAFMHSIGAPPIVIGPLY

SEQ ID NO: 1558316 - protein, 24 aa, Mycobacterium tuberculosis
VAGRYRTVRIGAHQARILLAKNPA

SEQ ID NO: 1558317 - protein, 24 aa, Mycobacterium tuberculosis
VAGTWTYLPPWAPAPTTPSPWTRR

SEQ ID NO: 1558318 - protein, 27 aa, Mycobacterium tuberculosis
VAIPGGQFRWLTVDLPPIVDLRTRLLP

SEQ ID NO: 1558319 - protein, 17 aa, Mycobacterium tuberculosis
VALAAKLVHDFDIAPGH

SEQ ID NO: 1558320 - protein, 26 aa, Mycobacterium tuberculosis
VAMVLRRLLRLCARYSAHPTVIFASA

SEQ ID NO: 1558321 - protein, 26 aa, Mycobacterium tuberculosis
VAPVALAVLACPLAGPAGPAAPGGPA

SEQ ID NO: 1558322 - protein, 18 aa, Mycobacterium tuberculosis
VARDRAGRRRLAEIAVLR

SEQ ID NO: 1558323 - protein, 17 aa, Mycobacterium tuberculosis
VARFAAALAPRGVWHAA

SEQ ID NO: 1558324 - protein, 19 aa, Mycobacterium tuberculosis
VARPYLIPSESMEPTLHGC

SEQ ID NO: 1558325 - protein, 26 aa, Mycobacterium tuberculosis
VARSPFGQVRRGRWSRRCNVTARVCW

SEQ ID NO: 1558326 - protein, 28 aa, Mycobacterium tuberculosis
VASCPNTRIVLGWLFAGCDGSSICPPRR

SEQ ID NO: 1558327 - protein, 26 aa, Mycobacterium tuberculosis
VASNVVRWVPHRYWPPHTRVSVGVQE

SEQ ID NO: 1558328 - protein, 29 aa, Mycobacterium tuberculosis
VASQLTPWQQLLSVLPPVVTAAPAGAVGV

SEQ ID NO: 1558329 - protein, 25 aa, Mycobacterium tuberculosis
VAVPGPPPVPPAPRAAAPAPASAAP

SEQ ID NO: 1558330 - protein, 20 aa, Mycobacterium tuberculosis
VCLLTAFLLIAVFGEVRFGD

SEQ ID NO: 1558331 - protein, 23 aa, Mycobacterium tuberculosis
VDASLLLCNGGRRRFRGQVRDAW

SEQ ID NO: 1558332 - protein, 23 aa, Mycobacterium tuberculosis
VDEPREFFTTNAFWSVPSDPTND

SEQ ID NO: 1558333 - protein, 21 aa, Mycobacterium tuberculosis
VDGQMFLEMRLVEGTDLDSVL

SEQ ID NO: 1558334 - protein, 22 aa, Mycobacterium tuberculosis
VDGQMFLEMRLVEGTDLDSVLK

SEQ ID NO: 1558335 - protein, 33 aa, Mycobacterium tuberculosis; identical to SEQ ID NO: 1511398

SEQ ID NO: 1558336 - protein, 17 aa, Mycobacterium tuberculosis
VDLLNMIDPLKLNAVLT

SEQ ID NO: 1558337 - protein, 31 aa, Mycobacterium tuberculosis; identical to SEQ ID NO: 1517419

SEQ ID NO: 1558338 - protein, 17 aa, Mycobacterium tuberculosis
VDRSIFMWTAAPHAEYD

SEQ ID NO: 1558339 - protein, 31 aa, Mycobacterium tuberculosis
VDTVKTTMEALWWDRPFALAGVDIGASVAAL

SEQ ID NO: 1558340 - protein, 23 aa, Mycobacterium tuberculosis
VDVDAKLYGLPFGDGAYGAQDMS

SEQ ID NO: 1558341 - protein, 30 aa, Mycobacterium tuberculosis; identical to SEQ ID NO: 871372

SEQ ID NO: 1558342 - protein, 23 aa, Mycobacterium tuberculosis
VELCALWAVHLHFDPSPEPWSIV

SEQ ID NO: 1558343 - protein, 24 aa, Mycobacterium tuberculosis
VELELYKRLPGDLSILTPSPASDT

SEQ ID NO: 1558344 - protein, 19 aa, Mycobacterium tuberculosis
VELGKQVEILPGLQAINAG

SEQ ID NO: 1558345 - protein, 49 aa, Mycobacterium tuberculosis
VEPWVQYGFNLTAWAVGWLPYIGILAPQINFFYYLGEPIVQAVLFNAID

SEQ ID NO: 1558346 - protein, 25 aa, Mycobacterium tuberculosis
VERTLASVALILTGGGIVNLDVIQT

SEQ ID NO: 1558347 - protein, 24 aa, Mycobacterium tuberculosis
VETFIRHFELGAADRWLALATLEC

SEQ ID NO: 1558348 - protein, 22 aa, Mycobacterium tuberculosis
VFGVLLAVVTVPFVALGPGPTF

SEQ ID NO: 1558349 - protein, 25 aa, Mycobacterium tuberculosis
VFGVLLAVVTVPFVALGPGPTVDTL

SEQ ID NO: 1558350 - protein, 18 aa, Mycobacterium tuberculosis
VFIASDPVWAKKFTDAGV

SEQ ID NO: 1558351 - protein, 23 aa, Mycobacterium tuberculosis
VGALVLVLVYKQFRGEFTPKTEL

SEQ ID NO: 1558352 - protein, 17 aa, Mycobacterium tuberculosis
VGFASLGGFNFGGATIG

SEQ ID NO: 1558353 - protein, 28 aa, Mycobacterium tuberculosis
VGFLTLGLLVPVLTWPVSAPLLVIPVAL

SEQ ID NO: 1558354 - protein, 25 aa, Mycobacterium tuberculosis
VGGATGLIGSGGFGGAGGAAAGVGT

SEQ ID NO: 1558355 - protein, 17 aa, Mycobacterium tuberculosis
VGGLWGAGGAGGAGGTG

SEQ ID NO: 1558356 - protein, 19 aa, Mycobacterium tuberculosis
VGGVAGLGGAGGAAGQLFS

SEQ ID NO: 1558357 - protein, 25 aa, Mycobacterium tuberculosis
VGLDAFTLLPDGFTLDTVPATFDGT

SEQ ID NO: 1558358 - protein, 18 aa, Mycobacterium tuberculosis
VGPRQWRWPLGEIDRPFE

SEQ ID NO: 1558359 - protein, 30 aa, Mycobacterium tuberculosis; identical to SEQ ID NO: 224024

SEQ ID NO: 1558360 - protein, 24 aa, Mycobacterium tuberculosis
VGWGNFGLGNSGLTPGLMGLGNIG

SEQ ID NO: 1558361 - protein, 22 aa, Mycobacterium tuberculosis
VHGRGPLSDLLVQALRCSGARI

SEQ ID NO: 1558362 - protein, 25 aa, Mycobacterium tuberculosis
VHVSSFTALFRPNLATLSADLPVAG

SEQ ID NO: 1558363 - protein, 22 aa, Mycobacterium tuberculosis
VIAGLVIALLAAITPAAGERPE

SEQ ID NO: 1558364 - protein, 19 aa, Mycobacterium tuberculosis
VILVIGLRGDNKSTTATSP

SEQ ID NO: 1558365 - protein, 19 aa, Mycobacterium tuberculosis
VISDFQRPEILVRNWAASA

SEQ ID NO: 1558366 - protein, 25 aa, Mycobacterium tuberculosis
VISLSAFTAAVWARASRTPRVCASA

SEQ ID NO: 1558367 - protein, 33 aa, Mycobacterium tuberculosis
VITAVEPRLWNMSTVLPILQDTTIVAAGPSVQN

SEQ ID NO: 1558368 - protein, 25 aa, Mycobacterium tuberculosis
VLAALRPHFRLRPDPAPRGSAPAEL

SEQ ID NO: 1558369 - protein, 25 aa, Mycobacterium tuberculosis
VLAARPVGVPAIVVPPVAAPNVLAG

SEQ ID NO: 1558370 - protein, 28 aa, Mycobacterium tuberculosis
VLDVINAPALALLGAPLIVNGANGAPGT

SEQ ID NO: 1558371 - protein, 19 aa, Mycobacterium tuberculosis
VLDVNPRYISLIPVNVVAD

SEQ ID NO: 1558372 - protein, 26 aa, Mycobacterium tuberculosis
VLGLINAPTQALWGRPLIGNGADGDR

SEQ ID NO: 1558373 - protein, 27 aa, Mycobacterium tuberculosis
VLGLINAPTQALWGRPLIGNGADGTAA

SEQ ID NO: 1558374 - protein, 21 aa, Mycobacterium tuberculosis
VLILCWSLLGAAPAHADDSRL

SEQ ID NO: 1558375 - protein, 29 aa, Mycobacterium tuberculosis
VLLSGDRVIPQWVKIRNVDGFNGSFWHGG

SEQ ID NO: 1558376 - protein, 25 aa, Mycobacterium tuberculosis
VLLSGDRVIPQWVKVRNVDGFNGSF

SEQ ID NO: 1558377 - protein, 30 aa, Mycobacterium tuberculosis
VLNAINAPTQTLFGRPLIGDGANGTAENPD

SEQ ID NO: 1558378 - protein, 18 aa, Mycobacterium tuberculosis
VLPVIPLSLDINGGVGAI

SEQ ID NO: 1558379 - protein, 25 aa, Mycobacterium tuberculosis
VLQSSWVHLLPSRKEGWGLAVIEAA

SEQ ID NO: 1558380 - protein, 18 aa, Mycobacterium tuberculosis
VLVALPARLANTVAGAAL

SEQ ID NO: 1558381 - protein, 35 aa, Mycobacterium tuberculosis
VLVANDRWWGTKAITKRITVWPQGADIQDRVNNRS

SEQ ID NO: 1558382 - protein, 17 aa, Mycobacterium tuberculosis
VLVSLVSSNLLGFNAPA

SEQ ID NO: 1558383 - protein, 32 aa, Mycobacterium tuberculosis
VMRHRAWQGLVLLVLALLLSSCGWRGISNVAI

SEQ ID NO: 1558384 - protein, 19 aa, Mycobacterium tuberculosis
VNEPFQTLTGRPLIGNGAN

SEQ ID NO: 1558385 - protein, 26 aa, Mycobacterium tuberculosis
VNISGGLPAFTLFAGGLTIPTNAIPL

SEQ ID NO: 1558386 - protein, 29 aa, Mycobacterium tuberculosis
VNTTAWFVMATIRNAVFLGHAFAALNPAT

SEQ ID NO: 1558387 - protein, 25 aa, Mycobacterium tuberculosis
VPAGGTIAAARRGAGSASVLDAATI

SEQ ID NO: 1558388 - protein, 30 aa, Mycobacterium tuberculosis
VPDVVLLDDRWWFHFALSGVLTALDDLFGQ

SEQ ID NO: 1558389 - protein, 18 aa, Mycobacterium tuberculosis
VPELTWVPAGGGAPVGNP

SEQ ID NO: 1558390 - protein, 17 aa, Mycobacterium tuberculosis
VPMCRVWIAGSPRMAPR

SEQ ID NO: 1558391 - protein, 22 aa, Mycobacterium tuberculosis
VPPGCVGPLQIALTKVAAEEHV

SEQ ID NO: 1558392 - protein, 24 aa, Mycobacterium tuberculosis
VPPLPPLPPLPISPAPPPAPPAPP

SEQ ID NO: 1558393 - protein, 18 aa, Mycobacterium tuberculosis
VPVRAFINPANRLMVYRR

SEQ ID NO: 1558394 - protein, 27 aa, Mycobacterium tuberculosis
VQALQQLVPRTPAALYWGARLTLVSRV

SEQ ID NO: 1558395 - protein, 18 aa, Mycobacterium tuberculosis
VQALTGAASAYASAKATN

SEQ ID NO: 1558396 - protein, 24 aa, Mycobacterium tuberculosis
VQPADHILAILRQLNAVVIHADSS

SEQ ID NO: 1558397 - protein, 22 aa, Mycobacterium tuberculosis
VRAALAAMVLPASVAGAGWVAP

SEQ ID NO: 1558398 - protein, 25 aa, Mycobacterium tuberculosis
VRCSLVVSFLVPQCVWYARADPPAP

SEQ ID NO: 1558399 - protein, 22 aa, Mycobacterium tuberculosis
VREDWAALYKKAFAPLNELAGS

SEQ ID NO: 1558400 - protein, 19 aa, Mycobacterium tuberculosis
VRIVGVVVATTLALVSAPA

SEQ ID NO: 1558401 - protein, 19 aa, Mycobacterium tuberculosis
VRLGLAAQLARQLGAPVVR

SEQ ID NO: 1558402 - protein, 29 aa, Mycobacterium tuberculosis
VRRQARIPAKPALRALRVIPAILGRPADT

SEQ ID NO: 1558403 - protein, 30 aa, Mycobacterium tuberculosis
VRRQARIPAKPALRALRVIPAILGRPADTV

SEQ ID NO: 1558404 - protein, 29 aa, Mycobacterium tuberculosis
VRTLSKLVRHHLLLPITATRRDLNDPKTI

SEQ ID NO: 1558405 - protein, 30 aa, Mycobacterium tuberculosis; identical to SEQ ID NO: 1531520

SEQ ID NO: 1558406 - protein, 33 aa, Mycobacterium tuberculosis
VRTPRPQLTAAFGGALWAARRPGDTSATVLTAV

SEQ ID NO: 1558407 - protein, 25 aa, Mycobacterium tuberculosis
VSGEGCVVLLLKRLPDAVRDGDRVL

SEQ ID NO: 1558408 - protein, 33 aa, Mycobacterium tuberculosis; identical to SEQ ID NO: 1515426

SEQ ID NO: 1558409 - protein, 26 aa, Mycobacterium tuberculosis
VSIGILLSLIAPLGPPLARADGTSQL

SEQ ID NO: 1558410 - protein, 19 aa, Mycobacterium tuberculosis
VSNALRMPPRAYVMPRVPA

SEQ ID NO: 1558411 - protein, 23 aa, Mycobacterium tuberculosis
VSPWQILVSEFMLQQTPAARVLA

SEQ ID NO: 1558412 - protein, 34 aa, Mycobacterium tuberculosis
VSRVLGCLVTAVTVATVVTLGPAASAFNLVHQGV

SEQ ID NO: 1558413 - protein, 26 aa, Mycobacterium tuberculosis
VSVDVNIPIHIPITASFTDIVYSGLD

SEQ ID NO: 1558414 - protein, 18 aa, Mycobacterium tuberculosis
VTGQFLWQNVFGVWPVSG

SEQ ID NO: 1558415 - protein, 19 aa, Mycobacterium tuberculosis
VTLIAGPLLFVFFTSFKDQ

SEQ ID NO: 1558416 - protein, 17 aa, Mycobacterium tuberculosis
VTLLIVSAAAGWLGGSA

SEQ ID NO: 1558417 - protein, 18 aa, Mycobacterium tuberculosis
VTLLIVSAAAGWLGGSAM

SEQ ID NO: 1558418 - protein, 33 aa, Mycobacterium tuberculosis
VTPLQQLVDVINAPFRSALGRPLIGNGANGKPG

SEQ ID NO: 1558419 - protein, 20 aa, Mycobacterium tuberculosis
VTPTPIPLTLNLDTTPWTLF

SEQ ID NO: 1558420 - protein, 20 aa, Mycobacterium tuberculosis
VTQPWLADHQIHGAAALPGA

SEQ ID NO: 1558421 - protein, 29 aa, Mycobacterium tuberculosis
VTRTAAPPRILWLDTAAPAKLILEVRAMD

SEQ ID NO: 1558422 - protein, 19 aa, Mycobacterium tuberculosis
VTSGLTAGVWPGAAAAAMA

SEQ ID NO: 1558423 - protein, 17 aa, Mycobacterium tuberculosis
VTSGLTAGVWQGAAAAA

SEQ ID NO: 1558424 - protein, 27 aa, Mycobacterium tuberculosis
VTSVSIPSWWQPYVLSVASLTSAGQPS

SEQ ID NO: 1558425 - protein, 21 aa, Mycobacterium tuberculosis
VTTKLPPFATRTDSVLLVATS

SEQ ID NO: 1558426 - protein, 28 aa, Mycobacterium tuberculosis
VTVIVAPMFHAWGFSQLVLASSLACTIV

SEQ ID NO: 1558427 - protein, 17 aa, Mycobacterium tuberculosis
VVAANRALLAALVATNV

SEQ ID NO: 1558428 - protein, 20 aa, Mycobacterium tuberculosis
VVAGVLFLENIIVPGLTVSG

SEQ ID NO: 1558429 - protein, 31 aa, Mycobacterium tuberculosis
VVAIVVLGWYYLRIPSLVGIGQYTLKADLPA

SEQ ID NO: 1558430 - protein, 34 aa, Mycobacterium tuberculosis
VVFDMLKRYHAGVEQLLVFLPQGAAIAQTVLTPT

SEQ ID NO: 1558431 - protein, 18 aa, Mycobacterium tuberculosis
VVIPVVNDWPNDCGDNGA

SEQ ID NO: 1558432 - protein, 22 aa, Mycobacterium tuberculosis
VVLARTGVVLSPAGGMLRRMRP

SEQ ID NO: 1558433 - protein, 17 aa, Mycobacterium tuberculosis
VVLIAEPIRAASAAAVD

SEQ ID NO: 1558434 - protein, 19 aa, Mycobacterium tuberculosis
VVLVALPARLANTVAGAAL

SEQ ID NO: 1558435 - protein, 17 aa, Mycobacterium tuberculosis
VVMLLVAAGLVVSSGTS

SEQ ID NO: 1558436 - protein, 26 aa, Mycobacterium tuberculosis
VVMVAGVILWRFFGDALSNRSHTAAA

SEQ ID NO: 1558437 - protein, 26 aa, Mycobacterium tuberculosis
VVVDAINIPIIHIPATPGFGNSTGGL

SEQ ID NO: 1558438 - protein, 22 aa, Mycobacterium tuberculosis
VVYQMQPVVFGAPLPLDPASAP

SEQ ID NO: 1558439 - protein, 48 aa, Mycobacterium tuberculosis; identical to SEQ ID NO: 1512168

SEQ ID NO: 1558440 - protein, 33 aa, Mycobacterium tuberculosis; identical to SEQ ID NO: 224441

SEQ ID NO: 1558441 - protein, 24 aa, Mycobacterium tuberculosis
WARPGGLACWPTGVNGGGWAVSVQ

SEQ ID NO: 1558442 - protein, 29 aa, Mycobacterium tuberculosis
WCRWCRISTIRPILTILRSCSPRLVAATT

SEQ ID NO: 1558443 - protein, 18 aa, Mycobacterium tuberculosis
WDDLLLPGIEVITPSPLS

SEQ ID NO: 1558444 - protein, 24 aa, Mycobacterium tuberculosis
WEDSRRGRRPGVDRGRPAAGTRNR

SEQ ID NO: 1558445 - protein, 18 aa, Mycobacterium tuberculosis
WGDTLKSYFDYQAGKYGT

SEQ ID NO: 1558446 - protein, 19 aa, Mycobacterium tuberculosis
WGVVNGTKAFLPHVIASGD

SEQ ID NO: 1558447 - protein, 17 aa, Mycobacterium tuberculosis
WIPLLILVVVAIAGFTV

SEQ ID NO: 1558448 - protein, 18 aa, Mycobacterium tuberculosis
WIPLLILVVVAIPGFTVQ

SEQ ID NO: 1558449 - protein, 19 aa, Mycobacterium tuberculosis
WIPMVIVIVVAVAAVTVSR

SEQ ID NO: 1558450 - protein, 18 aa, Mycobacterium tuberculosis
WKNVRLPERTRYVLSITW

SEQ ID NO: 1558451 - protein, 18 aa, Mycobacterium tuberculosis
WMTWSRRGMMRWARGEGD

SEQ ID NO: 1558452 - protein, 26 aa, Mycobacterium tuberculosis
WPVAGRMMGRLGWYVESMLSPRLHRR

SEQ ID NO: 1558453 - protein, 19 aa, Mycobacterium tuberculosis
WQRCRRRQRRHRRYRWCRR

SEQ ID NO: 1558454 - protein, 24 aa, Mycobacterium tuberculosis
WRATMARWPRRRSMRFESSPHGKR

SEQ ID NO: 1558455 - protein, 25 aa, Mycobacterium tuberculosis
WRFSVPLVCLLAGLLLAATHGVSGG

SEQ ID NO: 1558456 - protein, 24 aa, Mycobacterium tuberculosis
WRKTTLRVWVWSPTNPGASDPAAM

SEQ ID NO: 1558457 - protein, 25 aa, Mycobacterium tuberculosis
WRQWRQRRHRGVAVRQRRGRRPGRH

SEQ ID NO: 1558458 - protein, 23 aa, Mycobacterium tuberculosis
WRTGRLELPTRTGLTWLADFRAD

SEQ ID NO: 1558459 - protein, 17 aa, Mycobacterium tuberculosis
WSMGGYGALLLGSRLGP

SEQ ID NO: 1558460 - protein, 19 aa, Mycobacterium tuberculosis
WTGDYHGLVGFSFSIDIAG

SEQ ID NO: 1558461 - protein, 17 aa, Mycobacterium tuberculosis
WVAPGAPAAPATRGPLE

SEQ ID NO: 1558462 - protein, 32 aa, Mycobacterium tuberculosis; identical to SEQ ID NO: 237473

SEQ ID NO: 1558463 - protein, 34 aa, Mycobacterium tuberculosis
YAAAEAAAVSPLLAPINAQFVAATGRPLIGNGAN

SEQ ID NO: 1558464 - protein, 23 aa, Mycobacterium tuberculosis
YARSTPLFYYNKAAWQQAGLPDR

SEQ ID NO: 1558465 - protein, 42 aa, Mycobacterium tuberculosis
YASTEVAVERSLLGAVNAPTEALLGRPLIGNGADGTAPGQPG

SEQ ID NO: 1558466 - protein, 27 aa, Mycobacterium tuberculosis
YDESNPLPPPWYPQPASLPAAGATGQP

SEQ ID NO: 1558467 - protein, 17 aa, Mycobacterium tuberculosis
YESLSGAPIADWLASAL

SEQ ID NO: 1558468 - protein, 17 aa, Mycobacterium tuberculosis
YFALTPEERTALADPGP

SEQ ID NO: 1558469 - protein, 21 aa, Mycobacterium tuberculosis
YGALLLGSRLGPARTAAICAV

SEQ ID NO: 1558470 - protein, 17 aa, Mycobacterium tuberculosis
YGGARRLRARTGTPAVR

SEQ ID NO: 1558471 - protein, 23 aa, Mycobacterium tuberculosis
YGITIPQFPIRITTTGGIGPIVI

SEQ ID NO: 1558472 - protein, 27 aa, Mycobacterium tuberculosis
YGPDGLALPMRLALPGSVNRGNAAQAV

SEQ ID NO: 1558473 - protein, 33 aa, Mycobacterium tuberculosis
YHFDASAAVAQLAPWQQVLRNLGIDIGKNGQIN

SEQ ID NO: 1558474 - protein, 19 aa, Mycobacterium tuberculosis
YHQRFVQALSTGGEGICLG

SEQ ID NO: 1558475 - protein, 20 aa, Mycobacterium tuberculosis
YKSATFLQRNLPRGTTQGQA

SEQ ID NO: 1558476 - protein, 20 aa, Mycobacterium tuberculosis
YLHKPEQLAKLARAGFRVSD

SEQ ID NO: 1558477 - protein, 19 aa, Mycobacterium tuberculosis
YMLAPADWLAGDVHNTIPG

SEQ ID NO: 1558478 - protein, 25 aa, Mycobacterium tuberculosis
YNHGAYVFLGPGFTPGSPSSGSGGS

SEQ ID NO: 1558479 - protein, 27 aa, Mycobacterium tuberculosis
YPAGAAFSWWPTMLLPPGSHQDNMTVG

SEQ ID NO: 1558480 - protein, 21 aa, Mycobacterium tuberculosis
YPGRRPIPRPGWCRWCRISTI

SEQ ID NO: 1558481 - protein, 17 aa, Mycobacterium tuberculosis
YQPKFTHHMYLPMDVDA

SEQ ID NO: 1558482 - protein, 23 aa, Mycobacterium tuberculosis
YSAVSLRLHPDIRLFTAIPEQRS

SEQ ID NO: 1558483 - protein, 17 aa, Mycobacterium tuberculosis
YSGVFVHSAPWSVGAQG

SEQ ID NO: 1558484 - protein, 18 aa, Mycobacterium tuberculosis
YSLRYSSTALERAEDPIL

SEQ ID NO: 1558485 - protein, 22 aa, Mycobacterium tuberculosis
YSNGVLWRGDYQGLLGFSSGAN

SEQ ID NO: 1558486 - protein, 17 aa, Mycobacterium tuberculosis
YSWRIMPENLEDAGVSW

SEQ ID NO: 1558487 - protein, 27 aa, Mycobacterium tuberculosis
YTLTGPIVIGSFFLPAFNIPGIDVPAI

SEQ ID NO: 1558488 - protein, 29 aa, Mycobacterium tuberculosis
YVDDVALPGMLHLAILRSPYAHARIVRID

SEQ ID NO: 1558489 - protein, 30 aa, Mycobacterium tuberculosis
YVDDVALPGMLHLAILRSPYAHARIVRIDV

SEQ ID NO: 1558490 - protein, 20 aa, Mycobacterium tuberculosis
YWVRKPTYHNSFWYSSCMVT

SEQ ID NO: 1558491 - protein, 20 aa, Mycobacterium tuberculosis
YYDMLRKFGLGQRTGVGLPG

SEQ ID NO: 1558492 - protein, 17 aa, Mycobacterium tuberculosis
ASGLPIALWSKPAQGIK

SEQ ID NO: 1558493 - protein, 28 aa, Mycobacterium tuberculosis
FGFAVIVYLVWRFIVPLVGRLMSARQDT

SEQ ID NO: 1558494 - protein, 18 aa, Mycobacterium tuberculosis
FHDMPVVPLWDYISVVGW

SEQ ID NO: 1558495 - protein, 23 aa, Mycobacterium tuberculosis
GSTLLYPLFNLWGPAFHERYPNV

SEQ ID NO: 1558496 - protein, 24 aa, Mycobacterium tuberculosis
HSRQLLAAQIIWTLARADIRGPYV

SEQ ID NO: 1558497 - protein, 25 aa, Mycobacterium tuberculosis
IARMLLIWAALAAVALVLVGCIRVV

SEQ ID NO: 1558498 - protein, 23 aa, Mycobacterium tuberculosis
MNTGFLPFRFQPVYIDYSPSGIG

SEQ ID NO: 1558499 - protein, 24 aa, Mycobacterium tuberculosis
SGAATALIAIPTACSFSIGTSHSH

SEQ ID NO: 1558500 - protein, 21 aa, Mycobacterium tuberculosis
VQDVWIWVRPYFDDRATAAAK

SEQ ID NO: 1558501 - protein, 17 aa, Mycobacterium tuberculosis
VSQFFGKYFTPEQARQL

SEQ ID NO: 1558502 - protein, 20 aa, Mycobacterium tuberculosis
VWTMSNPRWTCDYGLAVVPH

SEQ ID NO: 1558503 - protein, 24 aa, Mycobacterium tuberculosis
YAEIGLLGFALIADALGGVDVCLK

SEQ ID NO: 1558504 - protein, 19 aa, Mycobacterium tuberculosis
YAELPYLFTDQYDLGMEYV

SEQ ID NO: 1558505 - protein, 20 aa, Mycobacterium tuberculosis
AVGWLPYIGILAPQINFFYY

SEQ ID NO: 1558506 - protein, 18 aa, Mycobacterium tuberculosis
GLPIALWSKPAQGIKQII

SEQ ID NO: 1558507 - protein, 19 aa, Mycobacterium tuberculosis
LGAAALIVALTRPTNSGPA

SEQ ID NO: 1558508 - protein, 21 aa, Mycobacterium tuberculosis
LTAYLRALPADGWLRVLCTCV

SEQ ID NO: 1558509 - protein, 18 aa, Mycobacterium tuberculosis
MKLDLLLTVPLDYYKKFM

SEQ ID NO: 1558510 - protein, 24 aa, Mycobacterium tuberculosis
NAEQYLWWVPHNVAGLVTALGGRT

SEQ ID NO: 1558511 - protein, 17 aa, Mycobacterium tuberculosis
NFFYYLGEPIVQAVLFN

SEQ ID NO: 1558512 - protein, 17 aa, Mycobacterium tuberculosis
PEFLSAEIFQPLGLAMV

SEQ ID NO: 1558513 - protein, 21 aa, Mycobacterium tuberculosis
RRRLLAVLIALALPGAAVALL

SEQ ID NO: 1558514 - protein, 24 aa, Mycobacterium tuberculosis
SADPLLPPPPIPAPVSAPATVPPV

SEQ ID NO: 1558515 - protein, 21 aa, Mycobacterium tuberculosis
SPTIDLPVPDDWRLLPESSRA

SEQ ID NO: 1558516 - protein, 23 aa, Mycobacterium tuberculosis
TVSGQLTLLVPFIDRVRARVDLR

SEQ ID NO: 1558517 - protein, 17 aa, Mycobacterium tuberculosis
ALSSWYVWAALGLYPST

SEQ ID NO: 1558518 - protein, 18 aa, Mycobacterium tuberculosis
ALTFPFAGGLGLMSNRAS

SEQ ID NO: 1558519 - protein, 24 aa, Mycobacterium tuberculosis
DDVHVAPRVIFLPGPAAALTSDDH

SEQ ID NO: 1558520 - protein, 23 aa, Mycobacterium tuberculosis
DEQPRLFYMHFWAENDAVALART

SEQ ID NO: 1558521 - protein, 20 aa, Mycobacterium tuberculosis
GFGVPWLYNYIGQPWKTQRT

SEQ ID NO: 1558522 - protein, 27 aa, Mycobacterium tuberculosis
LFDQPLLALRIPWYVTVLDLGSAGAVY

SEQ ID NO: 1558523 - protein, 23 aa, Mycobacterium tuberculosis
MVVAAQPYLAWLTYTAESAAHAA

SEQ ID NO: 1558524 - protein, 17 aa, Mycobacterium tuberculosis
NLTAWAVGWLPYIGILA

SEQ ID NO: 1558525 - protein, 17 aa, Mycobacterium tuberculosis
NYRVLWQAAGPDTISGA

SEQ ID NO: 1558526 - protein, 21 aa, Mycobacterium tuberculosis
QGLVLLVLALLLSSCGWRGIS

SEQ ID NO: 1558527 - protein, 23 aa, Mycobacterium tuberculosis
RGPDPLGVLYWQVPKGSTLDSTI

SEQ ID NO: 1558528 - protein, 18 aa, Mycobacterium tuberculosis
TYVQLFVLIAAANDVRCD

SEQ ID NO: 1558529 - protein, 17 aa, Mycobacterium tuberculosis
VVPLIVNLYAFGARDFD

SEQ ID NO: 1558530 - protein, 18 aa, Mycobacterium tuberculosis
AAVSTSVLSALFLGAGAA

SEQ ID NO: 1558531 - protein, 23 aa, Mycobacterium tuberculosis
AGGRAWDGLWDPTLPMIPSANIP

SEQ ID NO: 1558532 - protein, 17 aa, Mycobacterium tuberculosis
AVFTRPFQAFWVELPAC

SEQ ID NO: 1558533 - protein, 22 aa, Mycobacterium tuberculosis
DRPNLFIKIPATKAGLPAISAV

SEQ ID NO: 1558534 - protein, 18 aa, Mycobacterium tuberculosis
DTIVLRRSRPLQISLDGH

SEQ ID NO: 1558535 - protein, 22 aa, Mycobacterium tuberculosis
EPGRITVILALHDLINGGHVGH

SEQ ID NO: 1558536 - protein, 18 aa, Mycobacterium tuberculosis
FAFFEIQLRLPVNGRWVL

SEQ ID NO: 1558537 - protein, 17 aa, Mycobacterium tuberculosis
FGKYFTPEQARQLIAEQ

SEQ ID NO: 1558538 - protein, 20 aa, Mycobacterium tuberculosis
FRHRTGNAVILVLMLVAATQ

SEQ ID NO: 1558539 - protein, 17 aa, Mycobacterium tuberculosis
FVFRHRTGNAVILVLML

SEQ ID NO: 1558540 - protein, 21 aa, Mycobacterium tuberculosis
GHSMFPWLTLALVGNSTSSIL

SEQ ID NO: 1558541 - protein, 18 aa, Mycobacterium tuberculosis
ITMRPYLVGSLKGPDLAN

SEQ ID NO: 1558542 - protein, 24 aa, Mycobacterium tuberculosis
KGIALYLNFDMLASPNPGYFTYDG

SEQ ID NO: 1558543 - protein, 20 aa, Mycobacterium tuberculosis
LLLVLAFAGGYAVAACKTVT

SEQ ID NO: 1558544 - protein, 22 aa, Mycobacterium tuberculosis
MERAGLLLPLGWDPRLPVMGQK

SEQ ID NO: 1558545 - protein, 20 aa, Mycobacterium tuberculosis
QLLLTFPFPNFGIKQAVRGD

SEQ ID NO: 1558546 - protein, 18 aa, Mycobacterium tuberculosis
RALWIAALSFGLGGVAVA

SEQ ID NO: 1558547 - protein, 20 aa, Mycobacterium tuberculosis
SLLATFPFPNETFQNFQRGE

SEQ ID NO: 1558548 - protein, 19 aa, Mycobacterium tuberculosis
TRSLSLLATFPFPNETFQN

SEQ ID NO: 1558549 - protein, 25 aa, Mycobacterium tuberculosis
VLAEWFLRRFSLLDSLYMVPSVPII

SEQ ID NO: 1558550 - protein, 25 aa, Mycobacterium tuberculosis
VLLDDRWWFHFALSGVLTALDDLFG

SEQ ID NO: 1558551 - protein, 24 aa, Mycobacterium tuberculosis
YGVDPLILRQAYPVRQAPYGLAGS

SEQ ID NO: 1558552 - protein, 30 aa, Mycobacterium tuberculosis; identical to SEQ ID NO: 237828

SEQ ID NO: 1558553 - protein, 18 aa, Mycobacterium tuberculosis
AITLWLGLVAQFGQMITG

SEQ ID NO: 1558554 - protein, 24 aa, Mycobacterium tuberculosis
AQSYLRNFLAAPPPQRAAMAAQLQ

SEQ ID NO: 1558555 - protein, 27 aa, Mycobacterium tuberculosis
AVFTTPHRFLYDPLGFLRLLTSSGATH

SEQ ID NO: 1558556 - protein, 23 aa, Mycobacterium tuberculosis
DFDPYQFLLIPLARITGIEDPAL

SEQ ID NO: 1558557 - protein, 17 aa, Mycobacterium tuberculosis
EIQLRLPVNGRWVLVVT

SEQ ID NO: 1558558 - protein, 17 aa, Mycobacterium tuberculosis
ELPLCALLTAWVRGQAR

SEQ ID NO: 1558559 - protein, 24 aa, Mycobacterium tuberculosis
ESNPLPPPWYPQPASLPAAGATGQ

SEQ ID NO: 1558560 - protein, 20 aa, Mycobacterium tuberculosis
FTRPFQAFWVELPACNNWVD

SEQ ID NO: 1558561 - protein, 19 aa, Mycobacterium tuberculosis
GEFLRASLPPFWQTTNATQ

SEQ ID NO: 1558562 - protein, 18 aa, Mycobacterium tuberculosis
KAWFPLTKRWLGFEDAHI

SEQ ID NO: 1558563 - protein, 18 aa, Mycobacterium tuberculosis
LSLLWVLRGWRRPDDVRV

SEQ ID NO: 1558564 - protein, 18 aa, Mycobacterium tuberculosis
RSFLLQLGGIRALGYSPE

SEQ ID NO: 1558565 - protein, 21 aa, Mycobacterium tuberculosis
TSVLSALFLGAGAALLSACSS

SEQ ID NO: 1558566 - protein, 25 aa, Mycobacterium tuberculosis
TVKTTMEALWWDRPFALAGVDIGAS

SEQ ID NO: 1558567 - protein, 17 aa, Mycobacterium tuberculosis
WASWAFVGPNHRAYFGG

SEQ ID NO: 1558568 - protein, 17 aa, Mycobacterium tuberculosis
ACWPSWTPPPLMSRWSN

SEQ ID NO: 1558569 - protein, 18 aa, Mycobacterium tuberculosis
AEYLRLLRRHNVAAALSG

SEQ ID NO: 1558570 - protein, 18 aa, Mycobacterium tuberculosis
ALLVVALTERPDLLMAAT

SEQ ID NO: 1558571 - protein, 18 aa, Mycobacterium tuberculosis
DGTLGLSLLWVLRGWRRP

SEQ ID NO: 1558572 - protein, 25 aa, Mycobacterium tuberculosis
DQPALRPLLDLLPIAGGSGTLGERF

SEQ ID NO: 1558573 - protein, 30 aa, Mycobacterium tuberculosis
DRRQVLQRLKYLPLAPFRISYAYTNFGVTA

SEQ ID NO: 1558574 - protein, 24 aa, Mycobacterium tuberculosis
FNCLAPGMWPAWWLSNDDPGRSGE

SEQ ID NO: 1558575 - protein, 23 aa, Mycobacterium tuberculosis
IERLRKLWDVPALAFVGIGNGTQ

SEQ ID NO: 1558576 - protein, 19 aa, Mycobacterium tuberculosis
IIGRACWPSWTPPPLMSRW

SEQ ID NO: 1558577 - protein, 25 aa, Mycobacterium tuberculosis
QHASMLFLPVRILTSPITTLASMAR

SEQ ID NO: 1558578 - protein, 24 aa, Mycobacterium tuberculosis
SRRLWTMLIFMLWHAIFVEHSVVP

SEQ ID NO: 1558579 - protein, 17 aa, Mycobacterium tuberculosis
VILVLMLVAATQLFFLQ

SEQ ID NO: 1558580 - protein, 24 aa, Mycobacterium tuberculosis
WDTPVVSKLPWFALRDPYVTGQVT

SEQ ID NO: 1558581 - protein, 17 aa, Mycobacterium tuberculosis
WIPLLILVVVAIAGFTV

SEQ ID NO: 1558582 - protein, 25 aa, Mycobacterium tuberculosis
AVHYPWLPLRRLLLDHYPSIERIAS

SEQ ID NO: 1558583 - protein, 24 aa, Mycobacterium tuberculosis
DAGPPQRWFVVWLGTANNPVDKGA

SEQ ID NO: 1558584 - protein, 24 aa, Mycobacterium tuberculosis
EDQLFRFSRILDVQPRLAILLGDC

SEQ ID NO: 1558585 - protein, 19 aa, Mycobacterium tuberculosis
LAPLTTLRVGPIARRVITC

SEQ ID NO: 1558586 - protein, 19 aa, Mycobacterium tuberculosis
LLVPPYLVYVRLARPFIAF

SEQ ID NO: 1558587 - protein, 18 aa, Mycobacterium tuberculosis
QADCFAGVYLWWVAEGKS

SEQ ID NO: 1558588 - protein, 17 aa, Mycobacterium tuberculosis
TLRVGPIARRVITCTSA

SEQ ID NO: 1558589 - protein, 24 aa, Mycobacterium tuberculosis
WRNGIWYTARLRPGPLRPAERRTA

SEQ ID NO: 1558590 - protein, 21 aa, Mycobacterium tuberculosis
AQPLEWFCLFSSAAALVGSPG

SEQ ID NO: 1558591 - protein, 25 aa, Mycobacterium tuberculosis
ASAAKFIWFFATRTRFGLWFRNVAM

SEQ ID NO: 1558592 - protein, 24 aa, Mycobacterium tuberculosis
ASPAGWLFVSRWTAGGNSLHIRAG

SEQ ID NO: 1558593 - protein, 18 aa, Mycobacterium tuberculosis
DRLRWWAGPWPDDERWWD

SEQ ID NO: 1558594 - protein, 23 aa, Mycobacterium tuberculosis
DTRLGLFPFRRNLSLYAVDLALL

SEQ ID NO: 1558595 - protein, 18 aa, Mycobacterium tuberculosis
ENPKCHLAWTTLAGIGRV

SEQ ID NO: 1558596 - protein, 18 aa, Mycobacterium tuberculosis
FFKAMVVNLLPYQILQPW

SEQ ID NO: 1558597 - protein, 17 aa, Mycobacterium tuberculosis
LDAFAHWRRAQGLPATS

SEQ ID NO: 1558598 - protein, 24 aa, Mycobacterium tuberculosis
LRWSWLLSVLAAVGLGLATAPAQA

SEQ ID NO: 1558599 - protein, 17 aa, Mycobacterium tuberculosis
LTTLFPPVRPRQWLEIR

SEQ ID NO: 1558600 - protein, 17 aa, Mycobacterium tuberculosis
PAPPRGLSAVPLEPGQQ

SEQ ID NO: 1558601 - protein, 19 aa, Mycobacterium tuberculosis
PIPPIIHYGAIAYAPSGAS

SEQ ID NO: 1558602 - protein, 24 aa, Mycobacterium tuberculosis
RSDPFVAILRFPFIPQAMREHYAE

SEQ ID NO: 1558603 - protein, 18 aa, Mycobacterium tuberculosis
WRFSVPLVCLLAGLLLAA

SEQ ID NO: 1558604 - protein, 24 aa, Mycobacterium tuberculosis
APIMGTPWLTAFAQRSRFAEAFHA

SEQ ID NO: 1558605 - protein, 19 aa, Mycobacterium tuberculosis
GVAIMIWTLMNARNSRDSL

SEQ ID NO: 1558606 - protein, 18 aa, Mycobacterium tuberculosis
RHTPPHAWYIAFAPAQAP

SEQ ID NO: 1558607 - protein, 21 aa, Mycobacterium tuberculosis
SPQRWKYLTSGLLGLQRGSDA

SEQ ID NO: 1558608 - protein, 20 aa, Mycobacterium tuberculosis
TTNPPVEGAFYWLNNREVRW

SEQ ID NO: 1558609 - protein, 17 aa, Mycobacterium tuberculosis
VPLYRRNALTERQLLAV

SEQ ID NO: 1558610 - protein, 20 aa, Mycobacterium tuberculosis
APTQALLGRPIIGNGANGLP

SEQ ID NO: 1558611 - protein, 22 aa, Mycobacterium tuberculosis
DLPQLPYLPLQVPQQLSLPADL

SEQ ID NO: 1558612 - protein, 17 aa, Mycobacterium tuberculosis
DYALLAVPYLTLRELAK

SEQ ID NO: 1558613 - protein, 21 aa, Mycobacterium tuberculosis
GQFALTYPRRLGFGLGSSVVS

SEQ ID NO: 1558614 - protein, 18 aa, Mycobacterium tuberculosis
PPRGLSAVPLEPGQQTVG

SEQ ID NO: 1558615 - protein, 22 aa, Mycobacterium tuberculosis
TLTLVAFWWWQRPRTNAVAADS

SEQ ID NO: 1558616 - protein, 18 aa, Mycobacterium tuberculosis
TLYRKWLTVLGPAPAPPT

SEQ ID NO: 1558617 - protein, 21 aa, Mycobacterium tuberculosis
VLRRLLRLCARYSAHPTVIFA

SEQ ID NO: 1558618 - protein, 17 aa, Mycobacterium tuberculosis
YLTSGLLGLQRGSDAGD

SEQ ID NO: 1558619 - protein, 20 aa, Mycobacterium tuberculosis
ELINQWYYNPAFFAIMSDCA

SEQ ID NO: 1558620 - protein, 19 aa, Mycobacterium tuberculosis
HVGILPYPRNLDSLVLIAS

SEQ ID NO: 1558621 - protein, 26 aa, Mycobacterium tuberculosis
PLSSALLSFGLLLGGLPLAAPPLAGA

SEQ ID NO: 1558622 - protein, 26 aa, Mycobacterium tuberculosis
RDPLTVFLVLIIVFSLVLAGLIGGEL

SEQ ID NO: 1558623 - protein, 17 aa, Mycobacterium tuberculosis
SFGVAPLLLWQVATRHF

SEQ ID NO: 1558624 - protein, 23 aa, Mycobacterium tuberculosis
TLGFTIPGFTIPAAPLPLTIDID

SEQ ID NO: 1558625 - protein, 23 aa, Mycobacterium tuberculosis
TLMDSHPFTWLPLLSRVLGSAQL

SEQ ID NO: 1558626 - protein, 19 aa, Mycobacterium tuberculosis
TVAYRFSWHLPKDRIWTYD

SEQ ID NO: 1558627 - protein, 17 aa, Mycobacterium tuberculosis
ETFLTSELPQWLSANRA

SEQ ID NO: 1558628 - protein, 25 aa, Mycobacterium tuberculosis
GVGPITVLPIQILPTIPLNIHQTFS

SEQ ID NO: 1558629 - protein, 18 aa, Mycobacterium tuberculosis
IARVIMRSAIGFFASFTV

SEQ ID NO: 1558630 - protein, 18 aa, Mycobacterium tuberculosis
LPAELLPADWPGAGLRAA

SEQ ID NO: 1558631 - protein, 18 aa, Mycobacterium tuberculosis
RFIGLLMLSVLVAGCSSN

SEQ ID NO: 1558632 - protein, 22 aa, Mycobacterium tuberculosis
RPDIPIHYLLADTFTICDQYFS

SEQ ID NO: 1558633 - protein, 28 aa, Mycobacterium tuberculosis
TGSSSLVIPFWKIGWQNLGLPTGFDVVH

SEQ ID NO: 1558634 - protein, 25 aa, Mycobacterium tuberculosis
VLVVLGACLALWLSGCSSPKPDAEE

SEQ ID NO: 1558635 - protein, 20 aa, Mycobacterium tuberculosis
GTVLRFVPPLAALGSVPVTF

SEQ ID NO: 1558636 - protein, 25 aa, Mycobacterium tuberculosis
LRNPERVWGWYLWRHYLVANVEPND

SEQ ID NO: 1558637 - protein, 21 aa, Mycobacterium tuberculosis
RQDIPIHYLLADTFTICDGYH

SEQ ID NO: 1558638 - protein, 20 aa, Mycobacterium tuberculosis
YLYAHLRLLWMCRERLLAEL

SEQ ID NO: 1558639 - protein, 22 aa, Mycobacterium tuberculosis
AAVLLLTPITVPAGYPGAVAPA

SEQ ID NO: 1558640 - protein, 17 aa, Mycobacterium tuberculosis
GLWFRNVAMRTMNFGPL

SEQ ID NO: 1558641 - protein, 27 aa, Mycobacterium tuberculosis
LLNLINAPTQALLGRPLIGNGANGLPG

SEQ ID NO: 1558642 - protein, 25 aa, Mycobacterium tuberculosis
LVLTLTLVAFWWWQRPRTNAVAADS

SEQ ID NO: 1558643 - protein, 19 aa, Mycobacterium tuberculosis
PDMTLFLDLKQTPPQPLVS

SEQ ID NO: 1558644 - protein, 19 aa, Mycobacterium tuberculosis
QAIELWKIVDRPNLFIKIP

SEQ ID NO: 1558645 - protein, 20 aa, Mycobacterium tuberculosis
QAIELWKIVDRPNLFIKIPA

SEQ ID NO: 1558646 - protein, 22 aa, Mycobacterium tuberculosis
SAQAAMFHEQFVRALAAGGNSY

SEQ ID NO: 1558647 - protein, 19 aa, Mycobacterium tuberculosis
FDCSGLVMWAFQQAGIALP

SEQ ID NO: 1558648 - protein, 17 aa, Mycobacterium tuberculosis
ILLFLGAVLAGCASVPS

SEQ ID NO: 1558649 - protein, 17 aa, Mycobacterium tuberculosis
IPEFPIHWTSTGGIGPI

SEQ ID NO: 1558650 - protein, 19 aa, Mycobacterium tuberculosis
LLCAMVLALAWLSAVAGCS

SEQ ID NO: 1558651 - protein, 20 aa, Mycobacterium tuberculosis
QFALTYPRRLGFGLGSSVVS

SEQ ID NO: 1558652 - protein, 17 aa, Mycobacterium tuberculosis
SGPRWLALLLQPLSGPP

SEQ ID NO: 1558653 - protein, 25 aa, Mycobacterium tuberculosis
APAPPPFRLPLLFVNALGDNWIVGA

SEQ ID NO: 1558654 - protein, 21 aa, Mycobacterium tuberculosis
AVLLLTPITVPAGYPGAVAPA

SEQ ID NO: 1558655 - protein, 26 aa, Mycobacterium tuberculosis
DRSLHRVVLLALLPLGLAAAPGRTTR

SEQ ID NO: 1558656 - protein, 34 aa, Mycobacterium tuberculosis; identical to SEQ ID NO: 1394823

SEQ ID NO: 1558657 - protein, 26 aa, Mycobacterium tuberculosis
LDVLNGPFQALFGRPLIGDGANGAPG

SEQ ID NO: 1558658 - protein, 22 aa, Mycobacterium tuberculosis
MDPALYLVWAQANAAAGYRYSV

SEQ ID NO: 1558659 - protein, 24 aa, Mycobacterium tuberculosis
NAINAPTLALLGRPLIGDGTDAAP

SEQ ID NO: 1558660 - protein, 18 aa, Mycobacterium tuberculosis
QALQLELLNAINAPTLAL

SEQ ID NO: 1558661 - protein, 25 aa, Mycobacterium tuberculosis
SAQAALFHEQFVHAMTAGAGAYAGA

SEQ ID NO: 1558662 - protein, 27 aa, Mycobacterium tuberculosis
TVFQRTPIWCFPKFDVPLPTAVRWAMR

SEQ ID NO: 1558663 - protein, 23 aa, Mycobacterium tuberculosis
AEESAFVLLALQAPVAGDLRAIV

SEQ ID NO: 1558664 - protein, 22 aa, Mycobacterium tuberculosis
DRVTLFRAWYSRRNFGQLSGSV

SEQ ID NO: 1558665 - protein, 21 aa, Mycobacterium tuberculosis
EQLMPHWMLSLRAADMRRGGT

SEQ ID NO: 1558666 - protein, 23 aa, Mycobacterium tuberculosis
FDCSGLVMWAFQQAGIALPHSSQ

SEQ ID NO: 1558667 - protein, 25 aa, Mycobacterium tuberculosis
GGAGGPGGLIWGGGGAGGVGGAGGG

SEQ ID NO: 1558668 - protein, 25 aa, Mycobacterium tuberculosis
GVGGDGGWLAPGGAGGAGGQGGAGG

SEQ ID NO: 1558669 - protein, 17 aa, Mycobacterium tuberculosis
LGLPYLVLARPPWDPGT

SEQ ID NO: 1558670 - protein, 18 aa, Mycobacterium tuberculosis
LINQWYYNPAFFAIMSDC

SEQ ID NO: 1558671 - protein, 20 aa, Mycobacterium tuberculosis
PIPPIIHYGAIAYAPSGASG

SEQ ID NO: 1558672 - protein, 21 aa, Mycobacterium tuberculosis
TIIPPIHIPSIPLGFAAIGHI

SEQ ID NO: 1558673 - protein, 21 aa, Mycobacterium tuberculosis
AAFHEQFVQALTAAAGRYAST

SEQ ID NO: 1558674 - protein, 24 aa, Mycobacterium tuberculosis
DLEFIQFHPTMLFAGRAGGRRPLI

SEQ ID NO: 1558675 - protein, 17 aa, Mycobacterium tuberculosis
FFKAMVVNLLPYQILQP

SEQ ID NO: 1558676 - protein, 18 aa, Mycobacterium tuberculosis
FGLWFRNVAMRTMNFGPL

SEQ ID NO: 1558677 - protein, 17 aa, Mycobacterium tuberculosis
FVQLVLSNLFGQNAPAI

SEQ ID NO: 1558678 - protein, 26 aa, Mycobacterium tuberculosis
GAVNAPTEALLGRPLIGNGADGTAPG

SEQ ID NO: 1558679 - protein, 17 aa, Mycobacterium tuberculosis
HETMVIPPIVFLPSMTI

SEQ ID NO: 1558680 - protein, 17 aa, Mycobacterium tuberculosis
ILAPLTPAAIFLVATIG

SEQ ID NO: 1558681 - protein, 18 aa, Mycobacterium tuberculosis
ILWRGNFEGLFGLNVGIT

SEQ ID NO: 1558682 - protein, 21 aa, Mycobacterium tuberculosis
LGACLALWLSGCSSPKPDAEE

SEQ ID NO: 1558683 - protein, 19 aa, Mycobacterium tuberculosis
LLALICVLPIALSPWPARA

SEQ ID NO: 1558684 - protein, 25 aa, Mycobacterium tuberculosis
LRSDPFVAILRFPFIPQAMREHYAE

SEQ ID NO: 1558685 - protein, 19 aa, Mycobacterium tuberculosis
QLLATAALDLASIGSQVSA

SEQ ID NO: 1558686 - protein, 18 aa, Mycobacterium tuberculosis
TFHEDPVAGVWAVGGVGG

SEQ ID NO: 1558687 - protein, 26 aa, Mycobacterium tuberculosis
VPEYIGNLLLYFQPDATVTMLDAVEL

SEQ ID NO: 1558688 - protein, 21 aa, Mycobacterium tuberculosis
AAALPSWQQALRGLPGLGQVA

SEQ ID NO: 1558689 - protein, 18 aa, Mycobacterium tuberculosis
AAAPYAGWLAAAAARAAG

SEQ ID NO: 1558690 - protein, 20 aa, Mycobacterium tuberculosis
AGSLWRLEFLLQSTQDPSLL

SEQ ID NO: 1558691 - protein, 26 aa, Mycobacterium tuberculosis
ARTADPWLAPIFARSTLRHSHHLGGI

SEQ ID NO: 1558692 - protein, 17 aa, Mycobacterium tuberculosis
ASFVFRHRTGNAVILVL

SEQ ID NO: 1558693 - protein, 17 aa, Mycobacterium tuberculosis
DMTLFLDLKQTPPQPLV

SEQ ID NO: 1558694 - protein, 23 aa, Mycobacterium tuberculosis
DQLFRFSRILDVQPRLAILLGDC

SEQ ID NO: 1558695 - protein, 17 aa, Mycobacterium tuberculosis
FFNIYFCSVTIKINGPA

SEQ ID NO: 1558696 - protein, 22 aa, Mycobacterium tuberculosis
FSNGILWRGNFEGLFGLNVGIT

SEQ ID NO: 1558697 - protein, 18 aa, Mycobacterium tuberculosis
FVQALTAAAGRYASTEAA

SEQ ID NO: 1558698 - protein, 17 aa, Mycobacterium tuberculosis
KLGPLISALLNPGARNA

SEQ ID NO: 1558699 - protein, 20 aa, Mycobacterium tuberculosis
LYVHSAPWALPALGLENVSH

SEQ ID NO: 1558700 - protein, 26 aa, Mycobacterium tuberculosis
PDQPALRPLLDLLPIAGGSGTLGERF

SEQ ID NO: 1558701 - protein, 24 aa, Mycobacterium tuberculosis
PYQQRGLAWLAFLSSLGLGSCLAD

SEQ ID NO: 1558702 - protein, 19 aa, Mycobacterium tuberculosis
QQADCFAGVYLWWVAEGKS

SEQ ID NO: 1558703 - protein, 17 aa, Mycobacterium tuberculosis
RHTPPHAWYIAFAPAQA

SEQ ID NO: 1558704 - protein, 21 aa, Mycobacterium tuberculosis
RPDIPIHYLLADTFTICDQYF

SEQ ID NO: 1558705 - protein, 25 aa, Mycobacterium tuberculosis
SGDGPPIFLLSLKAGGTGLNLTAAN

SEQ ID NO: 1558706 - protein, 22 aa, Mycobacterium tuberculosis
VLRRLLRLCARYSAHPTVIFAS

SEQ ID NO: 1558707 - protein, 18 aa, Mycobacterium tuberculosis
WQQALRGLPGLGQVASAI

SEQ ID NO: 1558708 - protein, 19 aa, Mycobacterium tuberculosis
YLYAHLRLLWMCRERLLAE

SEQ ID NO: 1558709 - protein, 24 aa, Mycobacterium tuberculosis
AINAPTQLWLGRPLIGDGVHGAPG

SEQ ID NO: 1558710 - protein, 20 aa, Mycobacterium tuberculosis
ALFHEQFVQALTGAASAYAS

SEQ ID NO: 1558711 - protein, 20 aa, Mycobacterium tuberculosis
APTQTLLGRPLIGNGADGLP

SEQ ID NO: 1558712 - protein, 20 aa, Mycobacterium tuberculosis
DSMPALHMLPLADALGVLPV

SEQ ID NO: 1558713 - protein, 20 aa, Mycobacterium tuberculosis
DTRAYFRGECLRRFGADIAA

SEQ ID NO: 1558714 - protein, 17 aa, Mycobacterium tuberculosis
FPNFFMMLGPHSPVGNF

SEQ ID NO: 1558715 - protein, 24 aa, Mycobacterium tuberculosis
GAGGAGGWLFGVGGAGGVGGAGGG

SEQ ID NO: 1558716 - protein, 21 aa, Mycobacterium tuberculosis
GALNQAGFFGTGGKGGNGGNG

SEQ ID NO: 1558717 - protein, 24 aa, Mycobacterium tuberculosis
HASMLFLPVRILTSPITTLASMAR

SEQ ID NO: 1558718 - protein, 17 aa, Mycobacterium tuberculosis
LAALIDEPMFAKSVAAA

SEQ ID NO: 1558719 - protein, 17 aa, Mycobacterium tuberculosis
LHMLPLADALGVLPVLA

SEQ ID NO: 1558720 - protein, 18 aa, Mycobacterium tuberculosis
LHQVVIGNELPLPPVRSA

SEQ ID NO: 1558721 - protein, 23 aa, Mycobacterium tuberculosis
LINAPTQALWGRPLIGNGADGTA

SEQ ID NO: 1558722 - protein, 18 aa, Mycobacterium tuberculosis
PTQTLLGRPLIGNGADGL

SEQ ID NO: 1558723 - protein, 27 aa, Mycobacterium tuberculosis
QAGGPGGPAGLWGNGGPGGAGGSGGGT

SEQ ID NO: 1558724 - protein, 18 aa, Mycobacterium tuberculosis
QWVLPWPNPRYSKLARVF

SEQ ID NO: 1558725 - protein, 20 aa, Mycobacterium tuberculosis
RFHQQFVQALTASVGSYAAA

SEQ ID NO: 1558726 - protein, 36 aa, Mycobacterium tuberculosis
SGGPRRQRWCRWQRRRWLGRQRRRRWCRWQRRCRRQ

SEQ ID NO: 1558727 - protein, 23 aa, Mycobacterium tuberculosis
TGQPGGAGGLLWGNGGNGGSGAA

SEQ ID NO: 1558728 - protein, 25 aa, Mycobacterium tuberculosis
THSRLATFALALAAAALPLAGCSST

SEQ ID NO: 1558729 - protein, 25 aa, Mycobacterium tuberculosis
VGGPPLVFQLLWYPTTMADLSLPSF

SEQ ID NO: 1558730 - protein, 25 aa, Mycobacterium tuberculosis
VPEYIGNLLLYFQPDATVTMLDAVE

SEQ ID NO: 1558731 - protein, 19 aa, Mycobacterium tuberculosis
VRSFLLQLGGIRALGYSPE

SEQ ID NO: 1558732 - protein, 19 aa, Mycobacterium tuberculosis
AAAAPYAGWLAAAAARAAG

SEQ ID NO: 1558733 - protein, 35 aa, Mycobacterium tuberculosis; identical to SEQ ID NO: 237824

SEQ ID NO: 1558734 - protein, 23 aa, Mycobacterium tuberculosis
AAMVVAAAPYAGWLAAAAARAGG

SEQ ID NO: 1558735 - protein, 23 aa, Mycobacterium tuberculosis
AAVLLLTPITVPAGYPGAVAPAT

SEQ ID NO: 1558736 - protein, 29 aa, Mycobacterium tuberculosis
ADPYDAYLRLHLLSHRLVAPHGLNASGLF

SEQ ID NO: 1558737 - protein, 34 aa, Mycobacterium tuberculosis; identical to SEQ ID NO: 238041

SEQ ID NO: 1558738 - protein, 18 aa, Mycobacterium tuberculosis
AFYAQFVQALSAGGGAYA

SEQ ID NO: 1558739 - protein, 21 aa, Mycobacterium tuberculosis
AGGAAGWLYGSGGAGGAGGAG

SEQ ID NO: 1558740 - protein, 24 aa, Mycobacterium tuberculosis
AGGRGALLLGAGGQGGLGGAGGQG

SEQ ID NO: 1558741 - protein, 35 aa, Mycobacterium tuberculosis
ALEQQVLGAINAPTQLWLGRPLIGDGVHGAPGTGQ

SEQ ID NO: 1558742 - protein, 19 aa, Mycobacterium tuberculosis
APTLALLGRPLIGNGADGA

SEQ ID NO: 1558743 - protein, 18 aa, Mycobacterium tuberculosis
AQAALFHEQFVHAMTAGA

SEQ ID NO: 1558744 - protein, 24 aa, Mycobacterium tuberculosis
AQVAAYHQRFVQALSTGAGAYASA

SEQ ID NO: 1558745 - protein, 26 aa, Mycobacterium tuberculosis
DEVSARIAALFGGFGLEYQAISAQVA

SEQ ID NO: 1558746 - protein, 21 aa, Mycobacterium tuberculosis
DEVSLAISALFGQHAQAYQAL

SEQ ID NO: 1558747 - protein, 19 aa, Mycobacterium tuberculosis
DGASGLGLGLSGFDGGQGG

SEQ ID NO: 1558748 - protein, 18 aa, Mycobacterium tuberculosis
DLPQLPYLPLQVPQQLSL

SEQ ID NO: 1558749 - protein, 29 aa, Mycobacterium tuberculosis
DRRQVLQRLKYLPLAPFRISYAYTNFGVT

SEQ ID NO: 1558750 - protein, 17 aa, Mycobacterium tuberculosis
EGCVVLLLKRLPDAVRD

SEQ ID NO: 1558751 - protein, 20 aa, Mycobacterium tuberculosis
FDCSGLVMWAFQQAGIALPH

SEQ ID NO: 1558752 - protein, 18 aa, Mycobacterium tuberculosis
GAGGLLWGNGGNGGAGDA

SEQ ID NO: 1558753 - protein, 25 aa, Mycobacterium tuberculosis
GAGGRGALLLGAGGQGGLGGAGGQG

SEQ ID NO: 1558754 - protein, 26 aa, Mycobacterium tuberculosis
GGAGGAGGWLFGVGGAGGVGGAGGGT

SEQ ID NO: 1558755 - protein, 17 aa, Mycobacterium tuberculosis
GGRAWLWGTGGAGGAGG

SEQ ID NO: 1558756 - protein, 34 aa, Mycobacterium tuberculosis; identical to SEQ ID NO: 165458

SEQ ID NO: 1558757 - protein, 21 aa, Mycobacterium tuberculosis
GSGGHALLWGAGGAGGNGGSG

SEQ ID NO: 1558758 - protein, 17 aa, Mycobacterium tuberculosis
GTGGVLLGLDGFTAPAS

SEQ ID NO: 1558759 - protein, 24 aa, Mycobacterium tuberculosis
GVGPITVLPIQILPTIPLNIHQTF

SEQ ID NO: 1558760 - protein, 21 aa, Mycobacterium tuberculosis
GVVFLLLVWQALGSSPNSEDD

SEQ ID NO: 1558761 - protein, 22 aa, Mycobacterium tuberculosis
IERLRKLWDVPALAFVGIGNGT

SEQ ID NO: 1558762 - protein, 23 aa, Mycobacterium tuberculosis
INAPTQLWLGRPLIGDGVHGAPG

SEQ ID NO: 1558763 - protein, 18 aa, Mycobacterium tuberculosis
IPEFPIHWTSTGGIGPII

SEQ ID NO: 1558764 - protein, 17 aa, Mycobacterium tuberculosis
IYRAGVAAWWTSPMTRA

SEQ ID NO: 1558765 - protein, 23 aa, Mycobacterium tuberculosis
KTTMEALWWDRPFALAGVDIGAS

SEQ ID NO: 1558766 - protein, 17 aa, Mycobacterium tuberculosis
LAAIAIAFLAGCSSTKP

SEQ ID NO: 1558767 - protein, 27 aa, Mycobacterium tuberculosis
LAAINAPTQTLLGRPLIGNGADGLPGQ

SEQ ID NO: 1558768 - protein, 26 aa, Mycobacterium tuberculosis
LAAINARFERIFGRPLIGDGANGGPG

SEQ ID NO: 1558769 - protein, 18 aa, Mycobacterium tuberculosis
LAPLTTLRVGPIARRVIT

SEQ ID NO: 1558770 - protein, 19 aa, Mycobacterium tuberculosis
LLLTFPFPNFGIKQAVRGD

SEQ ID NO: 1558771 - protein, 28 aa, Mycobacterium tuberculosis
LLNAINAPTQALLGRPLIGDGAVGTASS

SEQ ID NO: 1558772 - protein, 26 aa, Mycobacterium tuberculosis
LNAINAPTQTLFGRPLIGDGANGTAE

SEQ ID NO: 1558773 - protein, 17 aa, Mycobacterium tuberculosis
MARFHQQFVQALTASVG

SEQ ID NO: 1558774 - protein, 19 aa, Mycobacterium tuberculosis
PPMRIWPRRFDAPPGPCRA

SEQ ID NO: 1558775 - protein, 18 aa, Mycobacterium tuberculosis
PTLALLGRPLIGNGADGA

SEQ ID NO: 1558776 - protein, 19 aa, Mycobacterium tuberculosis
QLPYLPLQVPQQLSLPADL

SEQ ID NO: 1558777 - protein, 23 aa, Mycobacterium tuberculosis
QSYLRNFLAAPPPQRAAMAAQLQ

SEQ ID NO: 1558778 - protein, 17 aa, Mycobacterium tuberculosis
RAWRLPWPDGTVVYELD

SEQ ID NO: 1558779 - protein, 35 aa, Mycobacterium tuberculosis
RRLRRQWRQGRRRCRPWLHRRRGRQGRRWRQRRFQ

SEQ ID NO: 1558780 - protein, 20 aa, Mycobacterium tuberculosis
TIFHDQFVQALTSGGNLYAA

SEQ ID NO: 1558781 - protein, 22 aa, Mycobacterium tuberculosis
TPVVSKLPWFALRDPYVTGQVT

SEQ ID NO: 1558782 - protein, 19 aa, Mycobacterium tuberculosis
TTNPPVEGAFYWLNNREVR

SEQ ID NO: 1558783 - protein, 25 aa, Mycobacterium tuberculosis
VDVINAPFRSALGRPLIGNGANGKP

SEQ ID NO: 1558784 - protein, 23 aa, Mycobacterium tuberculosis
VLNGPFQALFGRPLIGDGANGAP

SEQ ID NO: 1558785 - protein, 24 aa, Mycobacterium tuberculosis
VTVMALIVLLLLNATMTQVFTADG

SEQ ID NO: 1558786 - protein, 19 aa, Mycobacterium tuberculosis
WRFSVPLVCLLAGLLLAAT

SEQ ID NO: 1558787 - protein, 25 aa, Mycobacterium tuberculosis
AAAALAPWQQAVPGLLGLLDSAQSS

SEQ ID NO: 1558788 - protein, 24 aa, Mycobacterium tuberculosis
AAAVPVVFLTAWYGLADLAEIKAG

SEQ ID NO: 1558789 - protein, 33 aa, Mycobacterium tuberculosis; identical to SEQ ID NO: 228289

SEQ ID NO: 1558790 - protein, 19 aa, Mycobacterium tuberculosis
AAFHDQFTLALTSSAGAYA

SEQ ID NO: 1558791 - protein, 17 aa, Mycobacterium tuberculosis
AAHAPYLAWLMRASETS

SEQ ID NO: 1558792 - protein, 20 aa, Mycobacterium tuberculosis
AALFAALALALTGGAWQWSA

SEQ ID NO: 1558793 - protein, 25 aa, Mycobacterium tuberculosis
AAQLSSWSIGLQQALPAAPSALAAA

SEQ ID NO: 1558794 - protein, 31 aa, Mycobacterium tuberculosis
AEAAAVSPLLDPINEFFLANTGRPLIGNGAN

SEQ ID NO: 1558795 - protein, 23 aa, Mycobacterium tuberculosis
AFAVAGLILAGWAGSVGLAGADP

SEQ ID NO: 1558796 - protein, 18 aa, Mycobacterium tuberculosis
AFHEQFVQALTAAAGRYA

SEQ ID NO: 1558797 - protein, 18 aa, Mycobacterium tuberculosis
AFVQLVLSNLFGQNAPAI

SEQ ID NO: 1558798 - protein, 21 aa, Mycobacterium tuberculosis
AGGAGGLLFGNGGAGAAGAPG

SEQ ID NO: 1558799 - protein, 25 aa, Mycobacterium tuberculosis
AGGPGGPAGLWGNGGPGGAGGSGGG

SEQ ID NO: 1558800 - protein, 20 aa, Mycobacterium tuberculosis
AGGRAELLFGAGGAGGAGTD

SEQ ID NO: 1558801 - protein, 23 aa, Mycobacterium tuberculosis
AGGRGALLLGAGGQGGLGGAGGQ

SEQ ID NO: 1558802 - protein, 18 aa, Mycobacterium tuberculosis
AIARQMAAFHDQFTLALT

SEQ ID NO: 1558803 - protein, 17 aa, Mycobacterium tuberculosis
AINAPTLALLGRPLIGN

SEQ ID NO: 1558804 - protein, 20 aa, Mycobacterium tuberculosis
ALFHEQFVHAMTAGAGAYAG

SEQ ID NO: 1558805 - protein, 22 aa, Mycobacterium tuberculosis
ALTPIAAGPRRARSGAGTGLAG

SEQ ID NO: 1558806 - protein, 20 aa, Mycobacterium tuberculosis
APTQALLGRPLIGNGANGLP

SEQ ID NO: 1558807 - protein, 18 aa, Mycobacterium tuberculosis
ARDPFGIKPLFIATGAGG

SEQ ID NO: 1558808 - protein, 17 aa, Mycobacterium tuberculosis
ARLFPRGLAAFIELRDQ

SEQ ID NO: 1558809 - protein, 23 aa, Mycobacterium tuberculosis
ARVATFHEQFVRSLTAAGSAYAT

SEQ ID NO: 1558810 - protein, 26 aa, Mycobacterium tuberculosis
AVLVVLGACLALWLSGCSSPKPDAEE

SEQ ID NO: 1558811 - protein, 24 aa, Mycobacterium tuberculosis
AVNAPTEALLGRPLIGNGADGTAP

SEQ ID NO: 1558812 - protein, 25 aa, Mycobacterium tuberculosis
DEVSARIAALFGGFGLEYQAISAQV

SEQ ID NO: 1558813 - protein, 29 aa, Mycobacterium tuberculosis
DTGSSSLVIPFWKIGWQNLGLPTGFDVVH

SEQ ID NO: 1558814 - protein, 23 aa, Mycobacterium tuberculosis
EAFQFYFELLLFDYPTHIVQIVE

SEQ ID NO: 1558815 - protein, 19 aa, Mycobacterium tuberculosis
EGASGLGLGLSGFDGGQGG

SEQ ID NO: 1558816 - protein, 19 aa, Mycobacterium tuberculosis
GARAALFHEQFVQALTGAA

SEQ ID NO: 1558817 - protein, 20 aa, Mycobacterium tuberculosis
GDGASGLGLGLSGFDGGQGG

SEQ ID NO: 1558818 - protein, 22 aa, Mycobacterium tuberculosis
GGRAWDGLWDPTLPMIPSANIP

SEQ ID NO: 1558819 - protein, 26 aa, Mycobacterium tuberculosis
GGRDEQLLLLPLTSLRGLRHTLKKLS

SEQ ID NO: 1558820 - protein, 19 aa, Mycobacterium tuberculosis
GGVSGLLLGLDGFNAPAST

SEQ ID NO: 1558821 - protein, 22 aa, Mycobacterium tuberculosis
GPDPLGVLYWQVPKGSTLDSTI

SEQ ID NO: 1558822 - protein, 24 aa, Mycobacterium tuberculosis
GRRETWLIMRLPVIGNTQALRWRT

SEQ ID NO: 1558823 - protein, 18 aa, Mycobacterium tuberculosis
GVAIMIWTLMNARNSRDS

SEQ ID NO: 1558824 - protein, 17 aa, Mycobacterium tuberculosis
IKLAWITAVVAGLMVGV

SEQ ID NO: 1558825 - protein, 29 aa, Mycobacterium tuberculosis
IQPLPPKRAGLLIRALYRIAKRRFGEVPE

SEQ ID NO: 1558826 - protein, 22 aa, Mycobacterium tuberculosis
LEFIQFHPTMLFAGRAGGRRPL

SEQ ID NO: 1558827 - protein, 23 aa, Mycobacterium tuberculosis
LEFIQFHPTMLFAGRAGGRRPLI

SEQ ID NO: 1558828 - protein, 22 aa, Mycobacterium tuberculosis
LGFTIPGFTIPAAPLPLTIDID

SEQ ID NO: 1558829 - protein, 20 aa, Mycobacterium tuberculosis
LGGNGGWLYGNGGAGGIGGA

SEQ ID NO: 1558830 - protein, 25 aa, Mycobacterium tuberculosis
LGLINAPTQALLGRPLIGNGADGTA

SEQ ID NO: 1558831 - protein, 25 aa, Mycobacterium tuberculosis
LGLINAPTQALWGRPLIGNGADGTA

SEQ ID NO: 1558832 - protein, 27 aa, Mycobacterium tuberculosis
LNAINAPTQALLGRPLIGDGAVGTASS

SEQ ID NO: 1558833 - protein, 18 aa, Mycobacterium tuberculosis
LVLGAIGIWIAIRPKPVQ

SEQ ID NO: 1558834 - protein, 17 aa, Mycobacterium tuberculosis
LWRGNFEGLFSAYLGFT

SEQ ID NO: 1558835 - protein, 23 aa, Mycobacterium tuberculosis
NCLAPGMWPAWWLSNDDPGRSGE

SEQ ID NO: 1558836 - protein, 17 aa, Mycobacterium tuberculosis
NGGAGGLLWGNGGNGGA

SEQ ID NO: 1558837 - protein, 20 aa, Mycobacterium tuberculosis
NIVPLYRRNALTERQLLAVN

SEQ ID NO: 1558838 - protein, 32 aa, Mycobacterium tuberculosis
NVEQQVLGLINAPTQALLGRPLIGNGADGTAA

SEQ ID NO: 1558839 - protein, 17 aa, Mycobacterium tuberculosis
PTDTRAYFRGECLRRFG

SEQ ID NO: 1558840 - protein, 19 aa, Mycobacterium tuberculosis
PTQALLGRPIIGNGANGLP

SEQ ID NO: 1558841 - protein, 26 aa, Mycobacterium tuberculosis
QAGGPGGPAGLWGNGGPGGAGGSGGG

SEQ ID NO: 1558842 - protein, 20 aa, Mycobacterium tuberculosis
QGLVLLVLALLLSSCGWRGI

SEQ ID NO: 1558843 - protein, 29 aa, Mycobacterium tuberculosis
QRLLDLINGPTQALLGRPLIGDGANGGPG

SEQ ID NO: 1558844 - protein, 19 aa, Mycobacterium tuberculosis
RAWIPLLILVVVAIAGFTV

SEQ ID NO: 1558845 - protein, 22 aa, Mycobacterium tuberculosis
RHPTFLAFPMMMLVSLVVTAVT

SEQ ID NO: 1558846 - protein, 21 aa, Mycobacterium tuberculosis
RRCRRQRWRWRCRQRRLRRQW

SEQ ID NO: 1558847 - protein, 18 aa, Mycobacterium tuberculosis
RWRWRCRQRRLRRQWRQG

SEQ ID NO: 1558848 - protein, 23 aa, Mycobacterium tuberculosis
SALLSFGLLLGGLPLAAPPLAGA

SEQ ID NO: 1558849 - protein, 26 aa, Mycobacterium tuberculosis
SAQVAAYHQRFVQALSTGAGAYASAE

SEQ ID NO: 1558850 - protein, 22 aa, Mycobacterium tuberculosis
TCVMWTLALTRPPDVREAAVCN

SEQ ID NO: 1558851 - protein, 17 aa, Mycobacterium tuberculosis
TGGLLFGAGGNGGPGGS

SEQ ID NO: 1558852 - protein, 17 aa, Mycobacterium tuberculosis
TYPAHWGPAAVAALDSA

SEQ ID NO: 1558853 - protein, 21 aa, Mycobacterium tuberculosis
VALPGMLHLAILRSPYAHARI

SEQ ID NO: 1558854 - protein, 31 aa, Mycobacterium tuberculosis
VEQQVLGLINAPTQALLGRPLIGNGADGTAA

SEQ ID NO: 1558855 - protein, 25 aa, Mycobacterium tuberculosis
VFTTPHRFLYDPLGFLRLLTSSGAT

SEQ ID NO: 1558856 - protein, 24 aa, Mycobacterium tuberculosis
VGGVSGLLLGLDGFNAPASTSPLH

SEQ ID NO: 1558857 - protein, 25 aa, Mycobacterium tuberculosis
VGVALVFVQWWGQPAWSWAVLGLRG

SEQ ID NO: 1558858 - protein, 19 aa, Mycobacterium tuberculosis
VMSFVVAVPEALAAAASDV

SEQ ID NO: 1558859 - protein, 17 aa, Mycobacterium tuberculosis
WGQPAWSWAVLGLRGRR

SEQ ID NO: 1558860 - protein, 22 aa, Mycobacterium tuberculosis
AAALAPWQQAVPGLSGLLGGAA

SEQ ID NO: 1558861 - protein, 17 aa, Mycobacterium tuberculosis
AAFLEYLDMFYNLGIAG

SEQ ID NO: 1558862 - protein, 19 aa, Mycobacterium tuberculosis
AAFYAQFVQALSAGGGAYA

SEQ ID NO: 1558863 - protein, 18 aa, Mycobacterium tuberculosis
AAGQLFSAGGAAGAVGVG

SEQ ID NO: 1558864 - protein, 26 aa, Mycobacterium tuberculosis
AAINAPTQTLLGRPLIGNGADGLPGQ

SEQ ID NO: 1558865 - protein, 25 aa, Mycobacterium tuberculosis
AAINARFERIFGRPLIGDGANGGPG

SEQ ID NO: 1558866 - protein, 22 aa, Mycobacterium tuberculosis
AAPPRILWLDTAAPAKLILEVR

SEQ ID NO: 1558867 - protein, 26 aa, Mycobacterium tuberculosis
AAQLSSWSIGLQQALPAAPSALAAAI

SEQ ID NO: 1558868 - protein, 24 aa, Mycobacterium tuberculosis
AASIGAYLWVPDILECLASVMADA

SEQ ID NO: 1558869 - protein, 20 aa, Mycobacterium tuberculosis
AAYHQRFVQALSTGAGAYAS

SEQ ID NO: 1558870 - protein, 19 aa, Mycobacterium tuberculosis
ADTIVLRRSRPLQISLDGH

SEQ ID NO: 1558871 - protein, 23 aa, Mycobacterium tuberculosis
AELDRVWGHLPFGAQWYSANELA

SEQ ID NO: 1558872 - protein, 19 aa, Mycobacterium tuberculosis
AEWMLDSVRLGVPLGPAVR

SEQ ID NO: 1558873 - protein, 28 aa, Mycobacterium tuberculosis
AGCVLAAWGWVVMSFVVAVPEALAAAAS

SEQ ID NO: 1558874 - protein, 17 aa, Mycobacterium tuberculosis
AGGAGFSRALIVAGDNG

SEQ ID NO: 1558875 - protein, 20 aa, Mycobacterium tuberculosis
AGGAGGILWGNGGAGGSGAP

SEQ ID NO: 1558876 - protein, 18 aa, Mycobacterium tuberculosis
AGGHRWIRRKPGLGWGTV

SEQ ID NO: 1558877 - protein, 17 aa, Mycobacterium tuberculosis
AGGSGGWLLGNGGVGGA

SEQ ID NO: 1558878 - protein, 20 aa, Mycobacterium tuberculosis
AGLPRLSWFAGLTWFAGGST

SEQ ID NO: 1558879 - protein, 17 aa, Mycobacterium tuberculosis
AGQLFSAGGAAGAVGVG

SEQ ID NO: 1558880 - protein, 21 aa, Mycobacterium tuberculosis
AGTVLRFVPPLAALGSVPVTF

SEQ ID NO: 1558881 - protein, 22 aa, Mycobacterium tuberculosis
AHPSVHLLPRPLRSRVPIVLSR

SEQ ID NO: 1558882 - protein, 25 aa, Mycobacterium tuberculosis
AINAPTQLWLGRPLIGDGVHGAPGT

SEQ ID NO: 1558883 - protein, 19 aa, Mycobacterium tuberculosis
ALFHEQFVHAMTAGAGAYA

SEQ ID NO: 1558884 - protein, 17 aa, Mycobacterium tuberculosis
ALLAVPYLTLRELAKSA

SEQ ID NO: 1558885 - protein, 17 aa, Mycobacterium tuberculosis
ALSLTPFTPSPSAAATP

SEQ ID NO: 1558886 - protein, 17 aa, Mycobacterium tuberculosis
AMFHEQFVRALAAGGNS

SEQ ID NO: 1558887 - protein, 26 aa, Mycobacterium tuberculosis
APAPPPFRLPLLFVNALGDNWIVGAS

SEQ ID NO: 1558888 - protein, 17 aa, Mycobacterium tuberculosis
APTLALLVTPRLIRARE

SEQ ID NO: 1558889 - protein, 20 aa, Mycobacterium tuberculosis
APTQALLGRPLIGDGAVGTA

SEQ ID NO: 1558890 - protein, 23 aa, Mycobacterium tuberculosis
APVRRRGLFRLDAGVVAAIEQQR

SEQ ID NO: 1558891 - protein, 23 aa, Mycobacterium tuberculosis
AQAALFHEQFVHAMTAGAGAYAG

SEQ ID NO: 1558892 - protein, 18 aa, Mycobacterium tuberculosis
AQMARFHQQFVHALTASV

SEQ ID NO: 1558893 - protein, 17 aa, Mycobacterium tuberculosis
AQTLLGRPLIGNGADGA

SEQ ID NO: 1558894 - protein, 20 aa, Mycobacterium tuberculosis
AQVALAWLISLPGVVAIPGA

SEQ ID NO: 1558895 - protein, 17 aa, Mycobacterium tuberculosis
ARAALFHEQFVQALTGA

SEQ ID NO: 1558896 - protein, 18 aa, Mycobacterium tuberculosis
ARAALFHEQFVQALTGAA

SEQ ID NO: 1558897 - protein, 21 aa, Mycobacterium tuberculosis
ARIAALFGGFGLEYQAISAQV

SEQ ID NO: 1558898 - protein, 17 aa, Mycobacterium tuberculosis
ARVATFHEQFVRSLTAA

SEQ ID NO: 1558899 - protein, 24 aa, Mycobacterium tuberculosis
ARVATFHEQFVRSLTAAGSAYATA

SEQ ID NO: 1558900 - protein, 22 aa, Mycobacterium tuberculosis
ASPTVIRRYFRYHRRLRQRRRW

SEQ ID NO: 1558901 - protein, 25 aa, Mycobacterium tuberculosis
ASTSVMVLWFIPPPTVFRCGWCRWT

SEQ ID NO: 1558902 - protein, 20 aa, Mycobacterium tuberculosis
ATFHEQFVRSLTAAGSAYAT

SEQ ID NO: 1558903 - protein, 21 aa, Mycobacterium tuberculosis
ATYKAWFPLTKRWLGFEDAHI

SEQ ID NO: 1558904 - protein, 22 aa, Mycobacterium tuberculosis
AVAMLVAIFRARPSPFYIMDEV

SEQ ID NO: 1558905 - protein, 19 aa, Mycobacterium tuberculosis
AVGWLPYIGILAPQINFFY

SEQ ID NO: 1558906 - protein, 23 aa, Mycobacterium tuberculosis
AVIIAGFPFLDLGNVTIGGFNLA

SEQ ID NO: 1558907 - protein, 19 aa, Mycobacterium tuberculosis
AVILVLMLVAATQLFFLQV

SEQ ID NO: 1558908 - protein, 22 aa, Mycobacterium tuberculosis
AVKWALAARVGPAVLARTPALN

SEQ ID NO: 1558909 - protein, 22 aa, Mycobacterium tuberculosis
AVTVIFFGPVDIDPFTVPVIRI

SEQ ID NO: 1558910 - protein, 17 aa, Mycobacterium tuberculosis
AWLVWFGGGFIPLVPGA

SEQ ID NO: 1558911 - protein, 19 aa, Mycobacterium tuberculosis
AWRFSVPLVCLLAGLLLAA

SEQ ID NO: 1558912 - protein, 19 aa, Mycobacterium tuberculosis
AYHQRFVQALSTGAGAYAS

SEQ ID NO: 1558913 - protein, 17 aa, Mycobacterium tuberculosis
CDDLVPYRTLVTQAPVG

SEQ ID NO: 1558914 - protein, 20 aa, Mycobacterium tuberculosis
CDYALLAVPYLTLRELAKSA

SEQ ID NO: 1558915 - protein, 21 aa, Mycobacterium tuberculosis
CPNTRIVLGWLFAGCDGSSIC

SEQ ID NO: 1558916 - protein, 17 aa, Mycobacterium tuberculosis
DCSGLVMWAFQQAGIAL

SEQ ID NO: 1558917 - protein, 25 aa, Mycobacterium tuberculosis
DEVSARIAALFGGLGLEYQAISAQV

SEQ ID NO: 1558918 - protein, 20 aa, Mycobacterium tuberculosis
DGTVLFGPIQIPIINVPPTP

SEQ ID NO: 1558919 - protein, 21 aa, Mycobacterium tuberculosis
DGTVLFGPIQIPIINVPPTPG

SEQ ID NO: 1558920 - protein, 28 aa, Mycobacterium tuberculosis
DIGPITIQPIPILPTIPLSIHQTVNLGP

SEQ ID NO: 1558921 - protein, 30 aa, Mycobacterium tuberculosis
DLAGCVLAAWGWVVMSFVVAVPEALAAAAS

SEQ ID NO: 1558922 - protein, 30 aa, Mycobacterium tuberculosis; identical to SEQ ID NO: 1533158

SEQ ID NO: 1558923 - protein, 23 aa, Mycobacterium tuberculosis
DQRWLIARVIMRSAIGFFASFTV

SEQ ID NO: 1558924 - protein, 25 aa, Mycobacterium tuberculosis
DRRKRWRRVSGRTGLPRRQWLDMWA

SEQ ID NO: 1558925 - protein, 22 aa, Mycobacterium tuberculosis
DSPRAWPIRAPSRLQVWRTRAT

SEQ ID NO: 1558926 - protein, 24 aa, Mycobacterium tuberculosis
DVLNGPFQALFGRPLIGDGANGAP

SEQ ID NO: 1558927 - protein, 24 aa, Mycobacterium tuberculosis
EDQLFRFSRILDVQPRLAILLGEC

SEQ ID NO: 1558928 - protein, 47 aa, Mycobacterium tuberculosis
EGPPAPPPAPPPPTPNPPAPPPTPPPPARVQVRGWRSPDDGAAPVPE

SEQ ID NO: 1558929 - protein, 17 aa, Mycobacterium tuberculosis
EHNVLNALNAPTQALLG

SEQ ID NO: 1558930 - protein, 23 aa, Mycobacterium tuberculosis
EPGRITVILALHDLINGGYVGHY

SEQ ID NO: 1558931 - protein, 32 aa, Mycobacterium tuberculosis
EQIVLGVINAPTQALLGRPLIGDGANATTPGG

SEQ ID NO: 1558932 - protein, 33 aa, Mycobacterium tuberculosis
EQQVLGAINAPTQLWLGRPLIGDGVHGAPGTGQ

SEQ ID NO: 1558933 - protein, 30 aa, Mycobacterium tuberculosis; identical to SEQ ID NO: 1556982

SEQ ID NO: 1558934 - protein, 31 aa, Mycobacterium tuberculosis; identical to SEQ ID NO: 237871

SEQ ID NO: 1558935 - protein, 18 aa, Mycobacterium tuberculosis
EVSARIAALFGGFGLEYQ

SEQ ID NO: 1558936 - protein, 18 aa, Mycobacterium tuberculosis
EVSLAISALFGQHAQAYQ

SEQ ID NO: 1558937 - protein, 17 aa, Mycobacterium tuberculosis
FAVLYPTGRLINAPLPT

SEQ ID NO: 1558938 - protein, 17 aa, Mycobacterium tuberculosis
FCTAGMVPPWNPAVGSS

SEQ ID NO: 1558939 - protein, 26 aa, Mycobacterium tuberculosis
FDQPLLALRIPWYVTVLDLGSAGAVY

SEQ ID NO: 1558940 - protein, 17 aa, Mycobacterium tuberculosis
FLEYLDMFYNLGIAGRA

SEQ ID NO: 1558941 - protein, 17 aa, Mycobacterium tuberculosis
FLFDFRDGIELNPIVIP

SEQ ID NO: 1558942 - protein, 25 aa, Mycobacterium tuberculosis
FNCLAPGMWPAWWLSNDDPGRSGEI

SEQ ID NO: 1558943 - protein, 17 aa, Mycobacterium tuberculosis
FQALFGRPLIGDGANGA

SEQ ID NO: 1558944 - protein, 17 aa, Mycobacterium tuberculosis
FTLLPDGFTLDTVPATF

SEQ ID NO: 1558945 - protein, 19 aa, Mycobacterium tuberculosis
FTRPFQAFWVELPACNNWV

SEQ ID NO: 1558946 - protein, 17 aa, Mycobacterium tuberculosis
FVNQLPFPTFSLGKITI

SEQ ID NO: 1558947 - protein, 18 aa, Mycobacterium tuberculosis
FVQALTAAAGRYASTEVA

SEQ ID NO: 1558948 - protein, 18 aa, Mycobacterium tuberculosis
GAAGWLYGSGGAGGAGGA

SEQ ID NO: 1558949 - protein, 17 aa, Mycobacterium tuberculosis
GAGFSRALIVAGDNGGD

SEQ ID NO: 1558950 - protein, 24 aa, Mycobacterium tuberculosis
GAGGPGGLIWGGGGAGGVGGAGGG

SEQ ID NO: 1558951 - protein, 22 aa, Mycobacterium tuberculosis
GAGGRAELLFGAGGAGGAGTDG

SEQ ID NO: 1558952 - protein, 24 aa, Mycobacterium tuberculosis
GAGRGLFLGLGGDGGAGGTSNNNG

SEQ ID NO: 1558953 - protein, 29 aa, Mycobacterium tuberculosis
GASPTAPGPLAFPAPKAWPARPASAGRRR

SEQ ID NO: 1558954 - protein, 21 aa, Mycobacterium tuberculosis
GDGASGLGLGLSGFDGGQGGQ

SEQ ID NO: 1558955 - protein, 20 aa, Mycobacterium tuberculosis
GEGASGLGLGLSGFDGGQGG

SEQ ID NO: 1558956 - protein, 21 aa, Mycobacterium tuberculosis
GEGASGLGLGLSGFDGGQGGQ

SEQ ID NO: 1558957 - protein, 22 aa, Mycobacterium tuberculosis
GEQTHKRPIKKKKKKKKKKKKK

SEQ ID NO: 1558958 - protein, 18 aa, Mycobacterium tuberculosis
GFGLEYQAISAQVAAYHQ

SEQ ID NO: 1558959 - protein, 25 aa, Mycobacterium tuberculosis
GGAGGAGGWLFGVGGAGGVGGAGGG

SEQ ID NO: 1558960 - protein, 19 aa, Mycobacterium tuberculosis
GGAGGLLFGNGGAGAAGAP

SEQ ID NO: 1558961 - protein, 21 aa, Mycobacterium tuberculosis
GGAIRIPLISIPAAPGFGNST

SEQ ID NO: 1558962 - protein, 34 aa, Mycobacterium tuberculosis
GGGGGWGGPPPSRTGSNPLDLKPATVQPPTQEVA

SEQ ID NO: 1558963 - protein, 27 aa, Mycobacterium tuberculosis
GGGGVGVFFLFFCVSARPTRSARPARP

SEQ ID NO: 1558964 - protein, 22 aa, Mycobacterium tuberculosis
GGNAWVLLGMFATRPRWHPPVT

SEQ ID NO: 1558965 - protein, 19 aa, Mycobacterium tuberculosis
GGNGGWLYGNGGAGGIGGA

SEQ ID NO: 1558966 - protein, 22 aa, Mycobacterium tuberculosis
GGNPCLLTPPPWYPILRGTTQQ

SEQ ID NO: 1558967 - protein, 19 aa, Mycobacterium tuberculosis
GGRAELLFGAGGAGGAGTD

SEQ ID NO: 1558968 - protein, 19 aa, Mycobacterium tuberculosis
GHPCWANYFPVTRTVPEPP

SEQ ID NO: 1558969 - protein, 21 aa, Mycobacterium tuberculosis
GIANFLGFSVLHGGAGGAGGT

SEQ ID NO: 1558970 - protein, 23 aa, Mycobacterium tuberculosis
GLDWRWLVLWWKSHAPHIANNLM

SEQ ID NO: 1558971 - protein, 23 aa, Mycobacterium tuberculosis
GLIGLPLLGIPVTPGYFNLTGGP

SEQ ID NO: 1558972 - protein, 24 aa, Mycobacterium tuberculosis
GLINAPTQALWGRPLIGNGADGTA

SEQ ID NO: 1558973 - protein, 17 aa, Mycobacterium tuberculosis
GLPIALWSKPAQGIKQI

SEQ ID NO: 1558974 - protein, 24 aa, Mycobacterium tuberculosis
GLRCPPWSWRWSLRWIRRAAAHRC

SEQ ID NO: 1558975 - protein, 19 aa, Mycobacterium tuberculosis
GMFATRPRWHPPVTIPPLP

SEQ ID NO: 1558976 - protein, 25 aa, Mycobacterium tuberculosis
GNYSNGFFWRGDYQGLIGLSTTITI

SEQ ID NO: 1558977 - protein, 30 aa, Mycobacterium tuberculosis; identical to SEQ ID NO: 237891

SEQ ID NO: 1558978 - protein, 20 aa, Mycobacterium tuberculosis
GQWGGLCVWPRPLEPGVLGG

SEQ ID NO: 1558979 - protein, 22 aa, Mycobacterium tuberculosis
GRCRVPLILRLDPKIGLPDIRA

SEQ ID NO: 1558980 - protein, 20 aa, Mycobacterium tuberculosis
GRGTRLPVWLTQWGYRRPAE

SEQ ID NO: 1558981 - protein, 44 aa, Mycobacterium tuberculosis; identical to SEQ ID NO: 1550644

SEQ ID NO: 1558982 - protein, 23 aa, Mycobacterium tuberculosis
GRRETWLIMRLPVIGNTQALRWR

SEQ ID NO: 1558983 - protein, 21 aa, Mycobacterium tuberculosis
GRRRRCRWSRRVAGRQRWQRW

SEQ ID NO: 1558984 - protein, 17 aa, Mycobacterium tuberculosis
GSWLPPGPAAVADYPTV

SEQ ID NO: 1558985 - protein, 17 aa, Mycobacterium tuberculosis
GVPWLYNYIGQPWKTQR

SEQ ID NO: 1558986 - protein, 23 aa, Mycobacterium tuberculosis
GVVSPGFIGAPLALAALGQMARG

SEQ ID NO: 1558987 - protein, 19 aa, Mycobacterium tuberculosis
HFIARLVLVLLDETFLPGG

SEQ ID NO: 1558988 - protein, 19 aa, Mycobacterium tuberculosis
IARVIMRSAIGFFASFTVS

SEQ ID NO: 1558989 - protein, 23 aa, Mycobacterium tuberculosis
IDLTIRWDTPPITLFPNGISAPD

SEQ ID NO: 1558990 - protein, 18 aa, Mycobacterium tuberculosis
IFHDQFVQALTSGGNLYA

SEQ ID NO: 1558991 - protein, 17 aa, Mycobacterium tuberculosis
IITAIKPAARPAPHFCD

SEQ ID NO: 1558992 - protein, 18 aa, Mycobacterium tuberculosis
ILAPLTPAAIFLVATIGA

SEQ ID NO: 1558993 - protein, 21 aa, Mycobacterium tuberculosis
INWIRGFLPPLPPISPPGFPS

SEQ ID NO: 1558994 - protein, 17 aa, Mycobacterium tuberculosis
IPLIKIPAAPGFGNSTT

SEQ ID NO: 1558995 - protein, 19 aa, Mycobacterium tuberculosis
IRAPSRLQVWRTRATTARE

SEQ ID NO: 1558996 - protein, 26 aa, Mycobacterium tuberculosis
ISPQTLFFPFVLLLAATALYRGNDKK

SEQ ID NO: 1558997 - protein, 25 aa, Mycobacterium tuberculosis
ISTQVAAFHDRFAQTLSAAVGSYVS

SEQ ID NO: 1558998 - protein, 22 aa, Mycobacterium tuberculosis
ITFLHFVRLPAMLFGVGRYTVT

SEQ ID NO: 1558999 - protein, 30 aa, Mycobacterium tuberculosis
ITTVPVLWDGTVLFGPIQIPIINVPPTPGF

SEQ ID NO: 1559000 - protein, 17 aa, Mycobacterium tuberculosis
IVALTRPTNSGPATAAG

SEQ ID NO: 1559001 - protein, 23 aa, Mycobacterium tuberculosis
KKRPFYFGVLTWYMDRVLELVHD

SEQ ID NO: 1559002 - protein, 18 aa, Mycobacterium tuberculosis
KLGPLISALLNPGARNAA

SEQ ID NO: 1559003 - protein, 19 aa, Mycobacterium tuberculosis
KLVRHHLLLPITATRRDLN

SEQ ID NO: 1559004 - protein, 20 aa, Mycobacterium tuberculosis
KLVRHHLLLPITATRRDLND

SEQ ID NO: 1559005 - protein, 20 aa, Mycobacterium tuberculosis
KRAWIPLLILVVVAIAGFTV

SEQ ID NO: 1559006 - protein, 23 aa, Mycobacterium tuberculosis
KSPNAEWYLYTKDWLALLRQFAP

SEQ ID NO: 1559007 - protein, 17 aa, Mycobacterium tuberculosis
KVDLPQLPYLPLQVPQQ

SEQ ID NO: 1559008 - protein, 18 aa, Mycobacterium tuberculosis
LEWLDRMDLVNGKLICLV

SEQ ID NO: 1559009 - protein, 21 aa, Mycobacterium tuberculosis
LGAALLIAALLLSTYTTSRIA

SEQ ID NO: 1559010 - protein, 28 aa, Mycobacterium tuberculosis
LGAINAPTQLWLGRPLIGDGVHGAPGTG

SEQ ID NO: 1559011 - protein, 22 aa, Mycobacterium tuberculosis
LGVHRIFLITVALALLTASPAS

SEQ ID NO: 1559012 - protein, 25 aa, Mycobacterium tuberculosis
LGVVNAPAQALLGRPLIGNGANGAD

SEQ ID NO: 1559013 - protein, 25 aa, Mycobacterium tuberculosis
LHSCSPDLPWDLLQRSRISAVSVDA

SEQ ID NO: 1559014 - protein, 17 aa, Mycobacterium tuberculosis
LIGFFINIVVLRNDLRG

SEQ ID NO: 1559015 - protein, 21 aa, Mycobacterium tuberculosis
LLDDRWWFHFALSGVLTALDD

SEQ ID NO: 1559016 - protein, 17 aa, Mycobacterium tuberculosis
LLFGFRGAGGAGGHGGA

SEQ ID NO: 1559017 - protein, 17 aa, Mycobacterium tuberculosis
LLGLDGFTAPASTSPLH

SEQ ID NO: 1559018 - protein, 19 aa, Mycobacterium tuberculosis
LLLVLAFAGGYAVAACKTV

SEQ ID NO: 1559019 - protein, 19 aa, Mycobacterium tuberculosis
LNLINAPTQALLGRPLIGN

SEQ ID NO: 1559020 - protein, 20 aa, Mycobacterium tuberculosis
LPELGAWLAGAARFTVVTHA

SEQ ID NO: 1559021 - protein, 33 aa, Mycobacterium tuberculosis
LPLRAMVMVLLFLGVVFLLLGWQALGSSPNSED

SEQ ID NO: 1559022 - protein, 18 aa, Mycobacterium tuberculosis
LPVWLTQWGYRRPAEDTV

SEQ ID NO: 1559023 - protein, 17 aa, Mycobacterium tuberculosis
LPYLPLQVPQQLSLPAD

SEQ ID NO: 1559024 - protein, 25 aa, Mycobacterium tuberculosis
LQGKPAVLWFWTPWCPFCNAEAPSL

SEQ ID NO: 1559025 - protein, 33 aa, Mycobacterium tuberculosis
LRDGKKNKKIFFFFFFFFLKKKKKKKKKKKKKK

SEQ ID NO: 1559026 - protein, 25 aa, Mycobacterium tuberculosis
LRQDFAFRFHWLLRVGFADCVDSRQ

SEQ ID NO: 1559027 - protein, 24 aa, Mycobacterium tuberculosis
LSHPYLDTVLFLLGVTRGEIEAAD

SEQ ID NO: 1559028 - protein, 19 aa, Mycobacterium tuberculosis
LTGCYWWNWPPTTIRPTGS

SEQ ID NO: 1559029 - protein, 19 aa, Mycobacterium tuberculosis
LTRLLRDGKKNKKIFFFFF

SEQ ID NO: 1559030 - protein, 25 aa, Mycobacterium tuberculosis
LTRSLSLLATFPFPNETFQNFQRGE

SEQ ID NO: 1559031 - protein, 24 aa, Mycobacterium tuberculosis
LTSGLFPFHFTLNGGIGPISIPTT

SEQ ID NO: 1559032 - protein, 26 aa, Mycobacterium tuberculosis
LVDVINAPFRSALGRPLIGNGANGKP

SEQ ID NO: 1559033 - protein, 17 aa, Mycobacterium tuberculosis
LWRGNFEGLFGLNVGIT

SEQ ID NO: 1559034 - protein, 21 aa, Mycobacterium tuberculosis
LYPTGRLINAPLPTWNHRRLL

SEQ ID NO: 1559035 - protein, 17 aa, Mycobacterium tuberculosis
MLGLLAATLLLGGCTGQ

SEQ ID NO: 1559036 - protein, 23 aa, Mycobacterium tuberculosis
MTTMITLRRRFAVAVAGVATAAA

SEQ ID NO: 1559037 - protein, 24 aa, Mycobacterium tuberculosis
MVAAAQPYLAWLTYTAEAAAHAGS

SEQ ID NO: 1559038 - protein, 18 aa, Mycobacterium tuberculosis
NAINAPTLALLGRPLIGN

SEQ ID NO: 1559039 - protein, 25 aa, Mycobacterium tuberculosis
NAINAPTQALLGRPLIGDGAVGTAS

SEQ ID NO: 1559040 - protein, 25 aa, Mycobacterium tuberculosis
NAINAPTQTLFGRPLIGDGANGTAE

SEQ ID NO: 1559041 - protein, 21 aa, Mycobacterium tuberculosis
NAPTQALLGRPLIGNGANGLP

SEQ ID NO: 1559042 - protein, 20 aa, Mycobacterium tuberculosis
NAPTQALWGRPLIGNGADGT

SEQ ID NO: 1559043 - protein, 21 aa, Mycobacterium tuberculosis
NAVILVLMLVAATQLFFLQVS

SEQ ID NO: 1559044 - protein, 17 aa, Mycobacterium tuberculosis
NFTAWAVGWLPYIGILA

SEQ ID NO: 1559045 - protein, 17 aa, Mycobacterium tuberculosis
NFTIPIIGFESFAFSFH

SEQ ID NO: 1559046 - protein, 20 aa, Mycobacterium tuberculosis
NGILWRGNFEGLFSAYLGFT

SEQ ID NO: 1559047 - protein, 21 aa, Mycobacterium tuberculosis
NGILWRGNFEGLFSAYLGFTI

SEQ ID NO: 1559048 - protein, 17 aa, Mycobacterium tuberculosis
NLINAPTQALLGRPLIG

SEQ ID NO: 1559049 - protein, 20 aa, Mycobacterium tuberculosis
NPGTLMWWIARSLELLQDFQ

SEQ ID NO: 1559050 - protein, 24 aa, Mycobacterium tuberculosis
NPLNPVQFPKALLLKVTGPIAQQF

SEQ ID NO: 1559051 - protein, 26 aa, Mycobacterium tuberculosis
NSFTIPGFQIRVLLGPAAVLVNEMIG

SEQ ID NO: 1559052 - protein, 32 aa, Mycobacterium tuberculosis; identical to SEQ ID NO: 1534171

SEQ ID NO: 1559053 - protein, 32 aa, Mycobacterium tuberculosis
PCGAMVMVLLFLGVVFLLLGWQALGSSPNSED

SEQ ID NO: 1559054 - protein, 18 aa, Mycobacterium tuberculosis
PDDLLNALIDFLAAVRNG

SEQ ID NO: 1559055 - protein, 23 aa, Mycobacterium tuberculosis
PEYIGNLLLYFQPDATVTMLDAV

SEQ ID NO: 1559056 - protein, 18 aa, Mycobacterium tuberculosis
PFWGGPLLGALAAAVVPG

SEQ ID NO: 1559057 - protein, 22 aa, Mycobacterium tuberculosis
PGGYTIDPLPLHLALNLTVPDS

SEQ ID NO: 1559058 - protein, 26 aa, Mycobacterium tuberculosis
PHPAEVTWHWWWLGAADLGGLLVVTE

SEQ ID NO: 1559059 - protein, 18 aa, Mycobacterium tuberculosis
PIIIPTINITLPTAAITV

SEQ ID NO: 1559060 - protein, 23 aa, Mycobacterium tuberculosis
PIMGTPWLTAFAQRSRFAEAFHA

SEQ ID NO: 1559061 - protein, 18 aa, Mycobacterium tuberculosis
PINEFFLANTGRPLIGNG

SEQ ID NO: 1559062 - protein, 20 aa, Mycobacterium tuberculosis
PLAHIALASGCCDLAGCVLA

SEQ ID NO: 1559063 - protein, 19 aa, Mycobacterium tuberculosis
PLLDPINEFFLANTGRPLI

SEQ ID NO: 1559064 - protein, 21 aa, Mycobacterium tuberculosis
PPRAPSRPRSWLLRPIGSLGC

SEQ ID NO: 1559065 - protein, 18 aa, Mycobacterium tuberculosis
PQLAFLPRQAFLDTNIIG

SEQ ID NO: 1559066 - protein, 17 aa, Mycobacterium tuberculosis
PRGLSAVPLEPGQQTVG

SEQ ID NO: 1559067 - protein, 19 aa, Mycobacterium tuberculosis
PRTIWLCISETSSLLLTRC

SEQ ID NO: 1559068 - protein, 17 aa, Mycobacterium tuberculosis
PRVIIPEATISALPPAS

SEQ ID NO: 1559069 - protein, 18 aa, Mycobacterium tuberculosis
PRWHPPVTIPPLPHHSHT

SEQ ID NO: 1559070 - protein, 19 aa, Mycobacterium tuberculosis
PTEALLGRPLIGNGADGTA

SEQ ID NO: 1559071 - protein, 18 aa, Mycobacterium tuberculosis
PTQALLGRPLIGDGANGG

SEQ ID NO: 1559072 - protein, 19 aa, Mycobacterium tuberculosis
PTQALLGRPLIGDGAVGTA

SEQ ID NO: 1559073 - protein, 19 aa, Mycobacterium tuberculosis
PTQALLGRPLIGNGANGLP

SEQ ID NO: 1559074 - protein, 18 aa, Mycobacterium tuberculosis
PTQALWGRPLIGNGADGT

SEQ ID NO: 1559075 - protein, 20 aa, Mycobacterium tuberculosis
PVIADQPIITAIKPAARPAP

SEQ ID NO: 1559076 - protein, 20 aa, Mycobacterium tuberculosis
PVNHLPLTLPLRYLGMSDAE

SEQ ID NO: 1559077 - protein, 17 aa, Mycobacterium tuberculosis
PWLWAKFIGHAQAIAPA

SEQ ID NO: 1559078 - protein, 22 aa, Mycobacterium tuberculosis
PWPRATWPWLATTYALELGVDI

SEQ ID NO: 1559079 - protein, 20 aa, Mycobacterium tuberculosis
QAAMFHEQFVRALAAGGNSY

SEQ ID NO: 1559080 - protein, 17 aa, Mycobacterium tuberculosis
QAIELWKIVDRPNLFIK

SEQ ID NO: 1559081 - protein, 18 aa, Mycobacterium tuberculosis
QLTAAFGGALWAARRPGD

SEQ ID NO: 1559082 - protein, 22 aa, Mycobacterium tuberculosis
QLTPWQQLLSVLPPVVTAAPAG

SEQ ID NO: 1559083 - protein, 23 aa, Mycobacterium tuberculosis
QMGGALFVGWWLASGPQQGRGLG

SEQ ID NO: 1559084 - protein, 24 aa, Mycobacterium tuberculosis
QVVPWASLLQRFPGLGAGATGATG

SEQ ID NO: 1559085 - protein, 27 aa, Mycobacterium tuberculosis
RAAGLPRLSWFAGLTWFAGGSTGAGCA

SEQ ID NO: 1559086 - protein, 23 aa, Mycobacterium tuberculosis
RAATVHPLLVAANRNAFAQLVMS

SEQ ID NO: 1559087 - protein, 30 aa, Mycobacterium tuberculosis; identical to SEQ ID NO: 1533184

SEQ ID NO: 1559088 - protein, 22 aa, Mycobacterium tuberculosis
REKLFPLICRYAVAYHVVFIPS

SEQ ID NO: 1559089 - protein, 18 aa, Mycobacterium tuberculosis
RFIQLTPVYTGGAVLPDN

SEQ ID NO: 1559090 - protein, 18 aa, Mycobacterium tuberculosis
RFRRSIQTILLAALGRTI

SEQ ID NO: 1559091 - protein, 18 aa, Mycobacterium tuberculosis
RGDRTMFLFVFRAEHDNP

SEQ ID NO: 1559092 - protein, 20 aa, Mycobacterium tuberculosis
RGLMQLLAATNWFGQNAPAL

SEQ ID NO: 1559093 - protein, 24 aa, Mycobacterium tuberculosis
RGRRPRRVAVRRWRGWRERRGRGR

SEQ ID NO: 1559094 - protein, 19 aa, Mycobacterium tuberculosis
RIAALFGGFGLEYQAISAQ

SEQ ID NO: 1559095 - protein, 17 aa, Mycobacterium tuberculosis
RILALLLAVLLAVSGVA

SEQ ID NO: 1559096 - protein, 28 aa, Mycobacterium tuberculosis
RLLDLINGPTQALLGRPLIGDGANGGPG

SEQ ID NO: 1559097 - protein, 24 aa, Mycobacterium tuberculosis
RLRHFGVRITRILALLLAVLLAVS

SEQ ID NO: 1559098 - protein, 34 aa, Mycobacterium tuberculosis
RLRRQWRQGRRRCRPWLHRRRGRQGRRWRQRRFQ

SEQ ID NO: 1559099 - protein, 29 aa, Mycobacterium tuberculosis
RNAFAQLVMSNWFGLNAPLIAAVEGAYEQ

SEQ ID NO: 1559100 - protein, 20 aa, Mycobacterium tuberculosis
RQDIPIHYLLADTFTICDGY

SEQ ID NO: 1559101 - protein, 24 aa, Mycobacterium tuberculosis
RRCRAGPGGFRRGRSALAFGSGGV

SEQ ID NO: 1559102 - protein, 20 aa, Mycobacterium tuberculosis
RRCRRQRWRWRCRQRRLRRQ

SEQ ID NO: 1559103 - protein, 20 aa, Mycobacterium tuberculosis
RSPFGQVRRGRWSRRCNVTA

SEQ ID NO: 1559104 - protein, 17 aa, Mycobacterium tuberculosis
RTAMLLVPPYLVYVRLA

SEQ ID NO: 1559105 - protein, 22 aa, Mycobacterium tuberculosis
RVGPAVLARTPALNGSAGANGT

SEQ ID NO: 1559106 - protein, 19 aa, Mycobacterium tuberculosis
RVLAIWPDWVRRWPTPSAT

SEQ ID NO: 1559107 - protein, 20 aa, Mycobacterium tuberculosis
RVPVWFMRQAGRSLPEYRAL

SEQ ID NO: 1559108 - protein, 19 aa, Mycobacterium tuberculosis
RWLVLYLRRPGGQTQFAAP

SEQ ID NO: 1559109 - protein, 21 aa, Mycobacterium tuberculosis
SAAEWLPRVIIPEATISALPP

SEQ ID NO: 1559110 - protein, 17 aa, Mycobacterium tuberculosis
SAQAAMFHEQFVRALAA

SEQ ID NO: 1559111 - protein, 25 aa, Mycobacterium tuberculosis
SAQVAAYHQRFVQALSTGAGAYASA

SEQ ID NO: 1559112 - protein, 23 aa, Mycobacterium tuberculosis
SASSRFLLNLPLFSRQALHPDVD

SEQ ID NO: 1559113 - protein, 24 aa, Mycobacterium tuberculosis
SFVFRHRTGNAVILVLMLVAATQL

SEQ ID NO: 1559114 - protein, 36 aa, Mycobacterium tuberculosis; identical to SEQ ID NO: 238093

SEQ ID NO: 1559115 - protein, 23 aa, Mycobacterium tuberculosis
SGGVGLLGWAWVVAGAVDLLTTG

SEQ ID NO: 1559116 - protein, 20 aa, Mycobacterium tuberculosis
SGRPWDGDQLLRALGLRPPG

SEQ ID NO: 1559117 - protein, 20 aa, Mycobacterium tuberculosis
SGRPWDRDQLLRALGLRPPG

SEQ ID NO: 1559118 - protein, 17 aa, Mycobacterium tuberculosis
SIFKLYVLHALAGAVQH

SEQ ID NO: 1559119 - protein, 29 aa, Mycobacterium tuberculosis
SMNCRNGFQWSAHFDPRYGSASKDVQQQL

SEQ ID NO: 1559120 - protein, 22 aa, Mycobacterium tuberculosis
SPAGWLFVSRWTAGGNSLHIRA

SEQ ID NO: 1559121 - protein, 21 aa, Mycobacterium tuberculosis
SQMSFVIAVPEALTMAASDLA

SEQ ID NO: 1559122 - protein, 21 aa, Mycobacterium tuberculosis
SRRRRRLPPFAAPGRPCFTNA

SEQ ID NO: 1559123 - protein, 17 aa, Mycobacterium tuberculosis
SSGFFNFGTGNSGLLVS

SEQ ID NO: 1559124 - protein, 22 aa, Mycobacterium tuberculosis
SSLVIPFWKIGWAEPGLAHRVR

SEQ ID NO: 1559125 - protein, 24 aa, Mycobacterium tuberculosis
SVLAYPRVVWIAGGLLKGASLHAE

SEQ ID NO: 1559126 - protein, 20 aa, Mycobacterium tuberculosis
SVLSALFLGAGAALLSACSS

SEQ ID NO: 1559127 - protein, 31 aa, Mycobacterium tuberculosis; identical to SEQ ID NO: 206766

SEQ ID NO: 1559128 - protein, 28 aa, Mycobacterium tuberculosis
TDGLPPRLWRNFLAKPPLPALFGKTTNA

SEQ ID NO: 1559129 - protein, 17 aa, Mycobacterium tuberculosis
TEALLGRPLIGNGADGT

SEQ ID NO: 1559130 - protein, 18 aa, Mycobacterium tuberculosis
TEALLGRPLIGNGADGTA

SEQ ID NO: 1559131 - protein, 21 aa, Mycobacterium tuberculosis
TGGNGALLFGFRGAGGAGGHG

SEQ ID NO: 1559132 - protein, 18 aa, Mycobacterium tuberculosis
TGGRGGWLAGAGGAGGAG

SEQ ID NO: 1559133 - protein, 19 aa, Mycobacterium tuberculosis
TGLWGRLLPEWEPIRDLPP

SEQ ID NO: 1559134 - protein, 17 aa, Mycobacterium tuberculosis
TLGSWLPPGPAAVADYP

SEQ ID NO: 1559135 - protein, 19 aa, Mycobacterium tuberculosis
TLPLLWRRLTTAGVKYADQ

SEQ ID NO: 1559136 - protein, 17 aa, Mycobacterium tuberculosis
TQALLGRPLIGDGAVGT

SEQ ID NO: 1559137 - protein, 17 aa, Mycobacterium tuberculosis
TQTLLGRPLIGNGADGL

SEQ ID NO: 1559138 - protein, 26 aa, Mycobacterium tuberculosis
TSPLLAPINEFFLANTGRPLIGNGTN

SEQ ID NO: 1559139 - protein, 21 aa, Mycobacterium tuberculosis
TSTLVAAIPAVTTSASETPAA

SEQ ID NO: 1559140 - protein, 25 aa, Mycobacterium tuberculosis
TTAPVWITMLWPLADRPPVGPRGHP

SEQ ID NO: 1559141 - protein, 27 aa, Mycobacterium tuberculosis
TTAPVWITMLWPLADRPRLAPGAPGGT

SEQ ID NO: 1559142 - protein, 21 aa, Mycobacterium tuberculosis
TTVPVLWDGTVLFGPIQIPII

SEQ ID NO: 1559143 - protein, 17 aa, Mycobacterium tuberculosis
TVKTTMEALWWDRPFAL

SEQ ID NO: 1559144 - protein, 21 aa, Mycobacterium tuberculosis
TVMEDYFYRPFRDLVIRAAER

SEQ ID NO: 1559145 - protein, 19 aa, Mycobacterium tuberculosis
TVPVLWDGTVLFGPIQIPI

SEQ ID NO: 1559146 - protein, 25 aa, Mycobacterium tuberculosis
TVVNAPTQALLGRPIIGNGANGLPN

SEQ ID NO: 1559147 - protein, 23 aa, Mycobacterium tuberculosis
VAAELVPVLRPRGLFAHDVDLAG

SEQ ID NO: 1559148 - protein, 18 aa, Mycobacterium tuberculosis
VAARFIQLTPVYTGGAVL

SEQ ID NO: 1559149 - protein, 22 aa, Mycobacterium tuberculosis
VAIVVLGWYYLRIPSLVGIGQY

SEQ ID NO: 1559150 - protein, 23 aa, Mycobacterium tuberculosis
VALVFVQWWGQPAWSWAVLGLRG

SEQ ID NO: 1559151 - protein, 20 aa, Mycobacterium tuberculosis
VAMLVAIFRARPSPFYIMDE

SEQ ID NO: 1559152 - protein, 22 aa, Mycobacterium tuberculosis
VAPGGQWRFAPGLLLGCGVAMG

SEQ ID NO: 1559153 - protein, 22 aa, Mycobacterium tuberculosis
VAVMPVCCWMFGIGGPRRPPGG

SEQ ID NO: 1559154 - protein, 24 aa, Mycobacterium tuberculosis
VDVINAPFRSALGRPLIGNGANGK

SEQ ID NO: 1559155 - protein, 20 aa, Mycobacterium tuberculosis
VENPKCHLAWTTLAGIGRVE

SEQ ID NO: 1559156 - protein, 23 aa, Mycobacterium tuberculosis
VGGDGGWLAPGGAGGAGGQGGAG

SEQ ID NO: 1559157 - protein, 24 aa, Mycobacterium tuberculosis
VGLNLVIDMPLPISLGVNIPIDIP

SEQ ID NO: 1559158 - protein, 18 aa, Mycobacterium tuberculosis
VILVLMLVAATQLFFLQV

SEQ ID NO: 1559159 - protein, 25 aa, Mycobacterium tuberculosis
VLAITFLHFVRLPAMLFGVGRYTVT

SEQ ID NO: 1559160 - protein, 28 aa, Mycobacterium tuberculosis
VLGVINAPTQALLGRPLIGDGANATTPG

SEQ ID NO: 1559161 - protein, 25 aa, Mycobacterium tuberculosis
VPHYGIGYGLLRYVYAPTGRVLGAQ

SEQ ID NO: 1559162 - protein, 21 aa, Mycobacterium tuberculosis
VPPSWAWPKPAVAPPVLFGCR

SEQ ID NO: 1559163 - protein, 17 aa, Mycobacterium tuberculosis
VPVLWDGTVLFGPIQIP

SEQ ID NO: 1559164 - protein, 17 aa, Mycobacterium tuberculosis
VREGFVMRLAIVGTAAA

SEQ ID NO: 1559165 - protein, 19 aa, Mycobacterium tuberculosis
VRGRLRAWIPRSMPGVYGR

SEQ ID NO: 1559166 - protein, 18 aa, Mycobacterium tuberculosis
VRWRLSGLGLRVIAHDPY

SEQ ID NO: 1559167 - protein, 18 aa, Mycobacterium tuberculosis
VTVFLGATPIGDATSRAT

SEQ ID NO: 1559168 - protein, 18 aa, Mycobacterium tuberculosis
VTYPAHWGPAAVAALDSA

SEQ ID NO: 1559169 - protein, 24 aa, Mycobacterium tuberculosis
VVMVAGVILWRFFGDALSNRSHTA

SEQ ID NO: 1559170 - protein, 30 aa, Mycobacterium tuberculosis
WAMRAAPTLAWPTWVWATSGSPTPAPTTSG

SEQ ID NO: 1559171 - protein, 17 aa, Mycobacterium tuberculosis
WARYNVPWQPAFVFYRA

SEQ ID NO: 1559172 - protein, 17 aa, Mycobacterium tuberculosis
WDTPVVSKLPWFALRDP

SEQ ID NO: 1559173 - protein, 18 aa, Mycobacterium tuberculosis
WFHFALSGVLTALDDLFG

SEQ ID NO: 1559174 - protein, 20 aa, Mycobacterium tuberculosis
WNYAPTNYLLLGLALEKAAG

SEQ ID NO: 1559175 - protein, 26 aa, Mycobacterium tuberculosis
WQRRCRRQRWRWRCRQRRLRRQWRQG

SEQ ID NO: 1559176 - protein, 20 aa, Mycobacterium tuberculosis
WRFSVPLVCLLAGLLLAATH

SEQ ID NO: 1559177 - protein, 23 aa, Mycobacterium tuberculosis
YGDFQNFYLCDLQIKWNGFQAGG

SEQ ID NO: 1559178 - protein, 20 aa, Mycobacterium tuberculosis
YGEFLRASLPPFWQTTNATQ

SEQ ID NO: 1559179 - protein, 17 aa, Mycobacterium tuberculosis
YPPRWKTAGDRRGLVWG

SEQ ID NO: 1559180 - protein, 23 aa, Mycobacterium tuberculosis
YSNGILWRGDYQGLIGYSYALTI

SEQ ID NO: 1559181 - protein, 4 aa, Staphylococcus aureus
SLGG

SEQ ID NO: 1559182 - protein, 10 aa, Staphylococcus aureus
VGPSGSGKST

SEQ ID NO: 1559183 - protein, 8 aa, Staphylococcus aureus
LNEEQRNG

SEQ ID NO: 1559184 - protein, 4 aa, Staphylococcus aureus
WGGS

SEQ ID NO: 1559185 - protein, 8 aa, Staphylococcus aureus
NTKEPNTI

SEQ ID NO: 1559186 - protein, 10 aa, Staphylococcus aureus
KDDPSQSANL

SEQ ID NO: 1559187 - protein, 4 aa, Staphylococcus aureus
TASQ

SEQ ID NO: 1559188 - protein, 6 aa, Staphylococcus aureus
EGDKKL

SEQ ID NO: 1559189 - protein, 12 aa, Staphylococcus aureus
SGLGTENGHGNY

SEQ ID NO: 1559190 - protein, 5 aa, Staphylococcus aureus
EENSH

SEQ ID NO: 1559191 - protein, 16 aa, Staphylococcus aureus
IEEDTNKDKPNYQFGG

SEQ ID NO: 1559192 - protein, 4 aa, Staphylococcus aureus
ISPQ

SEQ ID NO: 1559193 - protein, 31 aa, Staphylococcus aureus
ELGYEGGQNSGNQSFEEDTEEDKPKYEQGGN

SEQ ID NO: 1559194 - protein, 16 aa, Staphylococcus aureus
YEEDTNPGGGQVTTES

SEQ ID NO: 1559195 - protein, 11 aa, Staphylococcus aureus
SDLGPKITPIG

SEQ ID NO: 1559196 - protein, 7 aa, Staphylococcus aureus
YKTPKYS

SEQ ID NO: 1559197 - protein, 6 aa, Staphylococcus aureus
CKPEDK

SEQ ID NO: 1559198 - protein, 6 aa, Staphylococcus aureus
DSNPTK

SEQ ID NO: 1559199 - protein, 7 aa, Staphylococcus aureus
IAKEAGV

SEQ ID NO: 1559200 - protein, 4 aa, Staphylococcus aureus
SSSG

SEQ ID NO: 1559201 - protein, 5 aa, Staphylococcus aureus
LDSGK

SEQ ID NO: 1559202 - protein, 6 aa, Staphylococcus aureus
GTITYG

SEQ ID NO: 1559203 - protein, 7 aa, Staphylococcus aureus
NTKNKRS

SEQ ID NO: 1559204 - protein, 6 aa, Staphylococcus aureus
ADNMTL

SEQ ID NO: 1559205 - protein, 8 aa, Staphylococcus aureus
GPKSDQIK

SEQ ID NO: 1559206 - protein, 8 aa, Staphylococcus aureus
NAAGTTFT

SEQ ID NO: 1559207 - protein, 4 aa, Staphylococcus aureus
GGIG

SEQ ID NO: 1559208 - protein, 8 aa, Staphylococcus aureus
SIKPNTST

SEQ ID NO: 1559209 - protein, 10 aa, Staphylococcus aureus
DEESTKGIVT

SEQ ID NO: 1559210 - protein, 6 aa, Staphylococcus aureus
AGGRAK

SEQ ID NO: 1559211 - protein, 8 aa, Staphylococcus aureus
FPGNDALS

SEQ ID NO: 1559212 - protein, 4 aa, Staphylococcus aureus
FVGT

SEQ ID NO: 1559213 - protein, 12 aa, Staphylococcus aureus
GAAITSYTTPAT

SEQ ID NO: 1559214 - protein, 6 aa, Staphylococcus aureus
GARASR

SEQ ID NO: 1559215 - protein, 4 aa, Staphylococcus aureus
GKNV

SEQ ID NO: 1559216 - protein, 5 aa, Staphylococcus aureus
GNTLP

SEQ ID NO: 1559217 - protein, 7 aa, Staphylococcus aureus
NENKEDD

SEQ ID NO: 1559218 - protein, 6 aa, Staphylococcus aureus
NPIASP

SEQ ID NO: 1559219 - protein, 6 aa, Staphylococcus aureus
QLSAAK

SEQ ID NO: 1559220 - protein, 9 aa, Staphylococcus aureus
QSSVSAGSL

SEQ ID NO: 1559221 - protein, 5 aa, Staphylococcus aureus
RKGSP

SEQ ID NO: 1559222 - protein, 10 aa, Staphylococcus aureus
SLNDSGSERS

SEQ ID NO: 1559223 - protein, 16 aa, Staphylococcus aureus
SSAFASAEAPAEDRGK

SEQ ID NO: 1559224 - protein, 11 aa, Staphylococcus aureus
SSSKTKPDAAI

SEQ ID NO: 1559225 - protein, 9 aa, Staphylococcus aureus
SVNDKRQLS

SEQ ID NO: 1559226 - protein, 6 aa, Staphylococcus aureus
TTGSKT

SEQ ID NO: 1559227 - protein, 5 aa, Staphylococcus aureus
AAGAF

SEQ ID NO: 1559228 - protein, 8 aa, Staphylococcus aureus
AAIASEGS

SEQ ID NO: 1559229 - protein, 4 aa, Staphylococcus aureus
AALG

SEQ ID NO: 1559230 - protein, 7 aa, Staphylococcus aureus
AAPTPVS

SEQ ID NO: 1559231 - protein, 8 aa, Staphylococcus aureus
AATKSSTL

SEQ ID NO: 1559232 - protein, 4 aa, Staphylococcus aureus
AATT

SEQ ID NO: 1559233 - protein, 15 aa, Staphylococcus aureus
AAYEPTSAVNVSQTG

SEQ ID NO: 1559234 - protein, 7 aa, Staphylococcus aureus
AEDNGEY

SEQ ID NO: 1559235 - protein, 4 aa, Staphylococcus aureus
AENS

SEQ ID NO: 1559236 - protein, 16 aa, Staphylococcus aureus
AESSPDKRRNSLGSGL

SEQ ID NO: 1559237 - protein, 9 aa, Staphylococcus aureus
AGADEEKQE

SEQ ID NO: 1559238 - protein, 4 aa, Staphylococcus aureus
AGGG

SEQ ID NO: 1559239 - protein, 12 aa, Staphylococcus aureus
AGGQGAKDYGDV

SEQ ID NO: 1559240 - protein, 6 aa, Staphylococcus aureus
AHAGTG

SEQ ID NO: 1559241 - protein, 4 aa, Staphylococcus aureus
AIPD

SEQ ID NO: 1559242 - protein, 6 aa, Staphylococcus aureus
AKAIGM

SEQ ID NO: 1559243 - protein, 7 aa, Staphylococcus aureus
AKPNKEM

SEQ ID NO: 1559244 - protein, 6 aa, Staphylococcus aureus
AMPNET

SEQ ID NO: 1559245 - protein, 5 aa, Staphylococcus aureus
AMSTV

SEQ ID NO: 1559246 - protein, 6 aa, Staphylococcus aureus
ANGMTG

SEQ ID NO: 1559247 - protein, 6 aa, Staphylococcus aureus
ANQYGQ

SEQ ID NO: 1559248 - protein, 5 aa, Staphylococcus aureus
ANTVA

SEQ ID NO: 1559249 - protein, 4 aa, Staphylococcus aureus
APPD

SEQ ID NO: 1559250 - protein, 9 aa, Staphylococcus aureus
AQGGGSGGR

SEQ ID NO: 1559251 - protein, 16 aa, Staphylococcus aureus
ARESINVSSSKDRAQF

SEQ ID NO: 1559252 - protein, 6 aa, Staphylococcus aureus
ARGETL

SEQ ID NO: 1559253 - protein, 5 aa, Staphylococcus aureus
ARYPG

SEQ ID NO: 1559254 - protein, 4 aa, Staphylococcus aureus
ASQT

SEQ ID NO: 1559255 - protein, 8 aa, Staphylococcus aureus
ATGQGRGA

SEQ ID NO: 1559256 - protein, 10 aa, Staphylococcus aureus
ATHEPDLPPG

SEQ ID NO: 1559257 - protein, 4 aa, Staphylococcus aureus
ATPG

SEQ ID NO: 1559258 - protein, 16 aa, Staphylococcus aureus
ATPSTDTAISNAPLDK

SEQ ID NO: 1559259 - protein, 5 aa, Staphylococcus aureus
DAFQG

SEQ ID NO: 1559260 - protein, 21 aa, Staphylococcus aureus
DDDNFDKGKKEEIKVNGEKYK

SEQ ID NO: 1559261 - protein, 6 aa, Staphylococcus aureus
DDKQSD

SEQ ID NO: 1559262 - protein, 13 aa, Staphylococcus aureus
DDVPTDEEIATTE

SEQ ID NO: 1559263 - protein, 6 aa, Staphylococcus aureus
DDYSDG

SEQ ID NO: 1559264 - protein, 4 aa, Staphylococcus aureus
DEVE

SEQ ID NO: 1559265 - protein, 15 aa, Staphylococcus aureus
DFATSDKKTLETELT

SEQ ID NO: 1559266 - protein, 12 aa, Staphylococcus aureus
DGRLSKDALSQQ

SEQ ID NO: 1559267 - protein, 5 aa, Staphylococcus aureus
DIPGG

SEQ ID NO: 1559268 - protein, 5 aa, Staphylococcus aureus
DKIGE

SEQ ID NO: 1559269 - protein, 16 aa, Staphylococcus aureus
DKTKKDEIVERSRESF

SEQ ID NO: 1559270 - protein, 6 aa, Staphylococcus aureus
DLGASG

SEQ ID NO: 1559271 - protein, 8 aa, Staphylococcus aureus
DMDGASSW

SEQ ID NO: 1559272 - protein, 6 aa, Staphylococcus aureus
DPKQPP

SEQ ID NO: 1559273 - protein, 26 aa, Staphylococcus aureus
DSQIDQQSSMQDTGKEEYKQTVKENL

SEQ ID NO: 1559274 - protein, 6 aa, Staphylococcus aureus
DTPNVA

SEQ ID NO: 1559275 - protein, 10 aa, Staphylococcus aureus
DTPQSQGLPP

SEQ ID NO: 1559276 - protein, 7 aa, Staphylococcus aureus
DVTATKR

SEQ ID NO: 1559277 - protein, 12 aa, Staphylococcus aureus
DYARSGNPNREL

SEQ ID NO: 1559278 - protein, 7 aa, Staphylococcus aureus
DYGPPTV

SEQ ID NO: 1559279 - protein, 10 aa, Staphylococcus aureus
DYKSQKDSVE

SEQ ID NO: 1559280 - protein, 17 aa, Staphylococcus aureus
EARSKAIESHPNYLKKY

SEQ ID NO: 1559281 - protein, 8 aa, Staphylococcus aureus
EATNHEST

SEQ ID NO: 1559282 - protein, 12 aa, Staphylococcus aureus
EDKDSSSSKSSK

SEQ ID NO: 1559283 - protein, 5 aa, Staphylococcus aureus
EESPV

SEQ ID NO: 1559284 - protein, 8 aa, Staphylococcus aureus
EETEERQQ

SEQ ID NO: 1559285 - protein, 8 aa, Staphylococcus aureus
EGQEVKQG

SEQ ID NO: 1559286 - protein, 9 aa, Staphylococcus aureus
EPLQPGQGG

SEQ ID NO: 1559287 - protein, 5 aa, Staphylococcus aureus
EPQRQ

SEQ ID NO: 1559288 - protein, 5 aa, Staphylococcus aureus
EQQER

SEQ ID NO: 1559289 - protein, 6 aa, Staphylococcus aureus
ERIEKG

SEQ ID NO: 1559290 - protein, 6 aa, Staphylococcus aureus
ERTSKE

SEQ ID NO: 1559291 - protein, 7 aa, Staphylococcus aureus
ESPGPAI

SEQ ID NO: 1559292 - protein, 10 aa, Staphylococcus aureus
ESSEEARHQT

SEQ ID NO: 1559293 - protein, 7 aa, Staphylococcus aureus
ETSPMGS

SEQ ID NO: 1559294 - protein, 15 aa, Staphylococcus aureus
EVSTGASNDFERATQ

SEQ ID NO: 1559295 - protein, 6 aa, Staphylococcus aureus
EYPTIK

SEQ ID NO: 1559296 - protein, 8 aa, Staphylococcus aureus
FAGETTTI

SEQ ID NO: 1559297 - protein, 18 aa, Staphylococcus aureus
FKGERDDVRTRETNLGNA

SEQ ID NO: 1559298 - protein, 12 aa, Staphylococcus aureus
FSHGTNDAQKSM

SEQ ID NO: 1559299 - protein, 9 aa, Staphylococcus aureus
FSTGGEYAG

SEQ ID NO: 1559300 - protein, 5 aa, Staphylococcus aureus
FSTGQ

SEQ ID NO: 1559301 - protein, 6 aa, Staphylococcus aureus
GAGQVG

SEQ ID NO: 1559302 - protein, 7 aa, Staphylococcus aureus
GATFEES

SEQ ID NO: 1559303 - protein, 8 aa, Staphylococcus aureus
GDPDVTKY

SEQ ID NO: 1559304 - protein, 7 aa, Staphylococcus aureus
GFGGSDA

SEQ ID NO: 1559305 - protein, 4 aa, Staphylococcus aureus
GFTN

SEQ ID NO: 1559306 - protein, 14 aa, Staphylococcus aureus
GGDTEKRTVSGAGA

SEQ ID NO: 1559307 - protein, 14 aa, Staphylococcus aureus
GGPPVSGQNAGSTD

SEQ ID NO: 1559308 - protein, 13 aa, Staphylococcus aureus
GGVGNAYAEDPKP

SEQ ID NO: 1559309 - protein, 10 aa, Staphylococcus aureus
GGYAQHQQDA

SEQ ID NO: 1559310 - protein, 17 aa, Staphylococcus aureus
GIENPTDIAKETIKSGT

SEQ ID NO: 1559311 - protein, 9 aa, Staphylococcus aureus
GKGSNLGKN

SEQ ID NO: 1559312 - protein, 11 aa, Staphylococcus aureus
GKTKNDEDYSS

SEQ ID NO: 1559313 - protein, 10 aa, Staphylococcus aureus
GKYHSDEAYA

SEQ ID NO: 1559314 - protein, 5 aa, Staphylococcus aureus
GMTTN

SEQ ID NO: 1559315 - protein, 6 aa, Staphylococcus aureus
GPGSFS

SEQ ID NO: 1559316 - protein, 5 aa, Staphylococcus aureus
GPNQF

SEQ ID NO: 1559317 - protein, 8 aa, Staphylococcus aureus
GPPGTGKT

SEQ ID NO: 1559318 - protein, 8 aa, Staphylococcus aureus
GQNATKAQ

SEQ ID NO: 1559319 - protein, 7 aa, Staphylococcus aureus
GQRATST

SEQ ID NO: 1559320 - protein, 13 aa, Staphylococcus aureus
GRRTKNESARKSN

SEQ ID NO: 1559321 - protein, 5 aa, Staphylococcus aureus
GSAIG

SEQ ID NO: 1559322 - protein, 5 aa, Staphylococcus aureus
GSAVT

SEQ ID NO: 1559323 - protein, 6 aa, Staphylococcus aureus
GSIAAK

SEQ ID NO: 1559324 - protein, 9 aa, Staphylococcus aureus
GSPAALTAP

SEQ ID NO: 1559325 - protein, 4 aa, Staphylococcus aureus
GTIT

SEQ ID NO: 1559326 - protein, 7 aa, Staphylococcus aureus
GTTAGTT

SEQ ID NO: 1559327 - protein, 5 aa, Staphylococcus aureus
GTTSI

SEQ ID NO: 1559328 - protein, 4 aa, Staphylococcus aureus
GTYT

SEQ ID NO: 1559329 - protein, 6 aa, Staphylococcus aureus
GVESVG

SEQ ID NO: 1559330 - protein, 7 aa, Staphylococcus aureus
GVGGGAT

SEQ ID NO: 1559331 - protein, 7 aa, Staphylococcus aureus
GVSGTTW

SEQ ID NO: 1559332 - protein, 6 aa, Staphylococcus aureus
HATGRA

SEQ ID NO: 1559333 - protein, 7 aa, Staphylococcus aureus
HEAGSRD

SEQ ID NO: 1559334 - protein, 4 aa, Staphylococcus aureus
HKNL

SEQ ID NO: 1559335 - protein, 6 aa, Staphylococcus aureus
HKTSKE

SEQ ID NO: 1559336 - protein, 8 aa, Staphylococcus aureus
HNNPGGGF

SEQ ID NO: 1559337 - protein, 17 aa, Staphylococcus aureus
IAGPAKKSRVISKKERN

SEQ ID NO: 1559338 - protein, 10 aa, Staphylococcus aureus
IDPSTQETWR

SEQ ID NO: 1559339 - protein, 14 aa, Staphylococcus aureus
IEEQTYERNREAVD

SEQ ID NO: 1559340 - protein, 11 aa, Staphylococcus aureus
IERPPQPIQKN

SEQ ID NO: 1559341 - protein, 6 aa, Staphylococcus aureus
IGMSSS

SEQ ID NO: 1559342 - protein, 4 aa, Staphylococcus aureus
IGTT

SEQ ID NO: 1559343 - protein, 10 aa, Staphylococcus aureus
IKDEEDVEKE

SEQ ID NO: 1559344 - protein, 8 aa, Staphylococcus aureus
IKEEEKQS

SEQ ID NO: 1559345 - protein, 7 aa, Staphylococcus aureus
IKHEKDS

SEQ ID NO: 1559346 - protein, 12 aa, Staphylococcus aureus
IKNSEKKDQDYI

SEQ ID NO: 1559347 - protein, 6 aa, Staphylococcus aureus
IKTPQP

SEQ ID NO: 1559348 - protein, 24 aa, Staphylococcus aureus
INGKKYDIKDQSVQLDTSNKEYKV

SEQ ID NO: 1559349 - protein, 4 aa, Staphylococcus aureus
IPQG

SEQ ID NO: 1559350 - protein, 7 aa, Staphylococcus aureus
ISANKDI

SEQ ID NO: 1559351 - protein, 11 aa, Staphylococcus aureus
ISQRTPGFSGA

SEQ ID NO: 1559352 - protein, 18 aa, Staphylococcus aureus
ITGKKLERKDFRKGYTAE

SEQ ID NO: 1559353 - protein, 5 aa, Staphylococcus aureus
ITNGT

SEQ ID NO: 1559354 - protein, 7 aa, Staphylococcus aureus
KAHGPHG

SEQ ID NO: 1559355 - protein, 8 aa, Staphylococcus aureus
KAITKADV

SEQ ID NO: 1559356 - protein, 7 aa, Staphylococcus aureus
KASPEFI

SEQ ID NO: 1559357 - protein, 8 aa, Staphylococcus aureus
KAVRGAAN

SEQ ID NO: 1559358 - protein, 8 aa, Staphylococcus aureus
KDDPEELG

SEQ ID NO: 1559359 - protein, 10 aa, Staphylococcus aureus
KDQLAQNGQG

SEQ ID NO: 1559360 - protein, 11 aa, Staphylococcus aureus
KEFGATPGLGG

SEQ ID NO: 1559361 - protein, 13 aa, Staphylococcus aureus
KELDESAKIDGAG

SEQ ID NO: 1559362 - protein, 6 aa, Staphylococcus aureus
KENEQH

SEQ ID NO: 1559363 - protein, 5 aa, Staphylococcus aureus
KGDEV

SEQ ID NO: 1559364 - protein, 6 aa, Staphylococcus aureus
KGFNTS

SEQ ID NO: 1559365 - protein, 5 aa, Staphylococcus aureus
KGIPL

SEQ ID NO: 1559366 - protein, 6 aa, Staphylococcus aureus
KGLPNA

SEQ ID NO: 1559367 - protein, 6 aa, Staphylococcus aureus
KGLSTT

SEQ ID NO: 1559368 - protein, 7 aa, Staphylococcus aureus
KGRRGPA

SEQ ID NO: 1559369 - protein, 22 aa, Staphylococcus aureus
KGTNVQMPKGSSEISSIDQGGN

SEQ ID NO: 1559370 - protein, 11 aa, Staphylococcus aureus
KHDGKDKTNTY

SEQ ID NO: 1559371 - protein, 9 aa, Staphylococcus aureus
KHGRDTESL

SEQ ID NO: 1559372 - protein, 11 aa, Staphylococcus aureus
KKFKEMGSRIP

SEQ ID NO: 1559373 - protein, 7 aa, Staphylococcus aureus
KKPTARY

SEQ ID NO: 1559374 - protein, 25 aa, Staphylococcus aureus
KKQPANHADANKAQALPETGEENPF

SEQ ID NO: 1559375 - protein, 7 aa, Staphylococcus aureus
KKVGEES

SEQ ID NO: 1559376 - protein, 11 aa, Staphylococcus aureus
KLASKDAGSKI

SEQ ID NO: 1559377 - protein, 9 aa, Staphylococcus aureus
KLSGGQRQR

SEQ ID NO: 1559378 - protein, 8 aa, Staphylococcus aureus
KNEGVTPA

SEQ ID NO: 1559379 - protein, 7 aa, Staphylococcus aureus
KPAPKTV

SEQ ID NO: 1559380 - protein, 7 aa, Staphylococcus aureus
KQEDNIN

SEQ ID NO: 1559381 - protein, 7 aa, Staphylococcus aureus
KQEEQMK

SEQ ID NO: 1559382 - protein, 17 aa, Staphylococcus aureus
KQGEHGNISFGDQLFEA

SEQ ID NO: 1559383 - protein, 4 aa, Staphylococcus aureus
KQSF

SEQ ID NO: 1559384 - protein, 6 aa, Staphylococcus aureus
KRKSPA

SEQ ID NO: 1559385 - protein, 5 aa, Staphylococcus aureus
KRPIK

SEQ ID NO: 1559386 - protein, 6 aa, Staphylococcus aureus
KRPTIN

SEQ ID NO: 1559387 - protein, 8 aa, Staphylococcus aureus
KSKDRDAI

SEQ ID NO: 1559388 - protein, 12 aa, Staphylococcus aureus
KSLNDKKGDTVA

SEQ ID NO: 1559389 - protein, 11 aa, Staphylococcus aureus
KSQADSEAFRT

SEQ ID NO: 1559390 - protein, 7 aa, Staphylococcus aureus
KSTFETS

SEQ ID NO: 1559391 - protein, 5 aa, Staphylococcus aureus
KVDNP

SEQ ID NO: 1559392 - protein, 6 aa, Staphylococcus aureus
KVKELG

SEQ ID NO: 1559393 - protein, 7 aa, Staphylococcus aureus
KVNEEDD

SEQ ID NO: 1559394 - protein, 6 aa, Staphylococcus aureus
KVTGTG

SEQ ID NO: 1559395 - protein, 6 aa, Staphylococcus aureus
KWNPAS

SEQ ID NO: 1559396 - protein, 6 aa, Staphylococcus aureus
KYQANT

SEQ ID NO: 1559397 - protein, 6 aa, Staphylococcus aureus
LAPTTH

SEQ ID NO: 1559398 - protein, 10 aa, Staphylococcus aureus
LGEAETQSKL

SEQ ID NO: 1559399 - protein, 7 aa, Staphylococcus aureus
LGEGGVT

SEQ ID NO: 1559400 - protein, 6 aa, Staphylococcus aureus
LGNTRS

SEQ ID NO: 1559401 - protein, 9 aa, Staphylococcus aureus
LKKDAEKDF

SEQ ID NO: 1559402 - protein, 5 aa, Staphylococcus aureus
LNGEG

SEQ ID NO: 1559403 - protein, 8 aa, Staphylococcus aureus
LNNLNDKD

SEQ ID NO: 1559404 - protein, 7 aa, Staphylococcus aureus
LNRESAQ

SEQ ID NO: 1559405 - protein, 10 aa, Staphylococcus aureus
LQETQKELQN

SEQ ID NO: 1559406 - protein, 13 aa, Staphylococcus aureus
LQNSKDGDRQNQA

SEQ ID NO: 1559407 - protein, 9 aa, Staphylococcus aureus
LSANSDTFR

SEQ ID NO: 1559408 - protein, 11 aa, Staphylococcus aureus
LSNQSKGEEMA

SEQ ID NO: 1559409 - protein, 11 aa, Staphylococcus aureus
LSRSDKGTAGL

SEQ ID NO: 1559410 - protein, 8 aa, Staphylococcus aureus
LSSRKDNL

SEQ ID NO: 1559411 - protein, 5 aa, Staphylococcus aureus
LSTSD

SEQ ID NO: 1559412 - protein, 9 aa, Staphylococcus aureus
LVPNSKPAL

SEQ ID NO: 1559413 - protein, 10 aa, Staphylococcus aureus
MQGEPNYSSQ

SEQ ID NO: 1559414 - protein, 4 aa, Staphylococcus aureus
MSGT

SEQ ID NO: 1559415 - protein, 29 aa, Staphylococcus aureus
MSLPGTDGLKTGSSDTANYNHTITTKRGK

SEQ ID NO: 1559416 - protein, 9 aa, Staphylococcus aureus
MSPLSDTTN

SEQ ID NO: 1559417 - protein, 6 aa, Staphylococcus aureus
NAKKNA

SEQ ID NO: 1559418 - protein, 6 aa, Staphylococcus aureus
NAPPRH

SEQ ID NO: 1559419 - protein, 7 aa, Staphylococcus aureus
NGQGISK

SEQ ID NO: 1559420 - protein, 6 aa, Staphylococcus aureus
NHTPRE

SEQ ID NO: 1559421 - protein, 6 aa, Staphylococcus aureus
NIGGAI

SEQ ID NO: 1559422 - protein, 7 aa, Staphylococcus aureus
NKGQLSL

SEQ ID NO: 1559423 - protein, 13 aa, Staphylococcus aureus
NKKNTTKNKEDIS

SEQ ID NO: 1559424 - protein, 7 aa, Staphylococcus aureus
NKPSDAY

SEQ ID NO: 1559425 - protein, 8 aa, Staphylococcus aureus
NKPYTGAT

SEQ ID NO: 1559426 - protein, 9 aa, Staphylococcus aureus
NKQSNTYAP

SEQ ID NO: 1559427 - protein, 11 aa, Staphylococcus aureus
NMAKRQTKDIE

SEQ ID NO: 1559428 - protein, 6 aa, Staphylococcus aureus
NMDNDE

SEQ ID NO: 1559429 - protein, 13 aa, Staphylococcus aureus
NNGGTTVAEGTVK

SEQ ID NO: 1559430 - protein, 10 aa, Staphylococcus aureus
NPTGAENSRL

SEQ ID NO: 1559431 - protein, 8 aa, Staphylococcus aureus
NPVQKKNL

SEQ ID NO: 1559432 - protein, 5 aa, Staphylococcus aureus
NRPDI

SEQ ID NO: 1559433 - protein, 4 aa, Staphylococcus aureus
NSND

SEQ ID NO: 1559434 - protein, 7 aa, Staphylococcus aureus
NSSMGEI

SEQ ID NO: 1559435 - protein, 7 aa, Staphylococcus aureus
NTAGGVA

SEQ ID NO: 1559436 - protein, 11 aa, Staphylococcus aureus
NTPEDPEKDAY

SEQ ID NO: 1559437 - protein, 4 aa, Staphylococcus aureus
NTVT

SEQ ID NO: 1559438 - protein, 10 aa, Staphylococcus aureus
PANGAAADLS

SEQ ID NO: 1559439 - protein, 8 aa, Staphylococcus aureus
PAPQTSLG

SEQ ID NO: 1559440 - protein, 5 aa, Staphylococcus aureus
PDNAT

SEQ ID NO: 1559441 - protein, 5 aa, Staphylococcus aureus
PEIDY

SEQ ID NO: 1559442 - protein, 7 aa, Staphylococcus aureus
PENIDNV

SEQ ID NO: 1559443 - protein, 6 aa, Staphylococcus aureus
PGGVPA

SEQ ID NO: 1559444 - protein, 14 aa, Staphylococcus aureus
PGKDIADDYKPQHL

SEQ ID NO: 1559445 - protein, 7 aa, Staphylococcus aureus
PGYKPQN

SEQ ID NO: 1559446 - protein, 13 aa, Staphylococcus aureus
PHAQADDYNTYHR

SEQ ID NO: 1559447 - protein, 5 aa, Staphylococcus aureus
PKAHA

SEQ ID NO: 1559448 - protein, 7 aa, Staphylococcus aureus
PNKTNTL

SEQ ID NO: 1559449 - protein, 4 aa, Staphylococcus aureus
PQLP

SEQ ID NO: 1559450 - protein, 7 aa, Staphylococcus aureus
PRGQAGG

SEQ ID NO: 1559451 - protein, 14 aa, Staphylococcus aureus
PRTPERNATNPPQE

SEQ ID NO: 1559452 - protein, 7 aa, Staphylococcus aureus
PSSSSHA

SEQ ID NO: 1559453 - protein, 4 aa, Staphylococcus aureus
PVSG

SEQ ID NO: 1559454 - protein, 5 aa, Staphylococcus aureus
QAAGS

SEQ ID NO: 1559455 - protein, 4 aa, Staphylococcus aureus
QFSR

SEQ ID NO: 1559456 - protein, 8 aa, Staphylococcus aureus
QHSPFDGK

SEQ ID NO: 1559457 - protein, 10 aa, Staphylococcus aureus
QIQTKDGALY

SEQ ID NO: 1559458 - protein, 8 aa, Staphylococcus aureus
QNDGSVEP

SEQ ID NO: 1559459 - protein, 6 aa, Staphylococcus aureus
QNETYK

SEQ ID NO: 1559460 - protein, 4 aa, Staphylococcus aureus
QNGC

SEQ ID NO: 1559461 - protein, 5 aa, Staphylococcus aureus
QNTVA

SEQ ID NO: 1559462 - protein, 11 aa, Staphylococcus aureus
QRPSPQWDGSA

SEQ ID NO: 1559463 - protein, 10 aa, Staphylococcus aureus
QRRKRYPSIA

SEQ ID NO: 1559464 - protein, 4 aa, Staphylococcus aureus
QSDY

SEQ ID NO: 1559465 - protein, 7 aa, Staphylococcus aureus
QSSSATI

SEQ ID NO: 1559466 - protein, 9 aa, Staphylococcus aureus
QSTISSSLN

SEQ ID NO: 1559467 - protein, 5 aa, Staphylococcus aureus
QTGQL

SEQ ID NO: 1559468 - protein, 9 aa, Staphylococcus aureus
QTKGDNPQF

SEQ ID NO: 1559469 - protein, 9 aa, Staphylococcus aureus
QTQTRRLGV

SEQ ID NO: 1559470 - protein, 8 aa, Staphylococcus aureus
QTYQTSPA

SEQ ID NO: 1559471 - protein, 7 aa, Staphylococcus aureus
QVETGNS

SEQ ID NO: 1559472 - protein, 12 aa, Staphylococcus aureus
QYQKQEQDYSQN

SEQ ID NO: 1559473 - protein, 5 aa, Staphylococcus aureus
RAKGQ

SEQ ID NO: 1559474 - protein, 9 aa, Staphylococcus aureus
RASQSTNSF

SEQ ID NO: 1559475 - protein, 7 aa, Staphylococcus aureus
REPTDDI

SEQ ID NO: 1559476 - protein, 7 aa, Staphylococcus aureus
RESAKLS

SEQ ID NO: 1559477 - protein, 8 aa, Staphylococcus aureus
RGECTTKG

SEQ ID NO: 1559478 - protein, 4 aa, Staphylococcus aureus
RGPI

SEQ ID NO: 1559479 - protein, 6 aa, Staphylococcus aureus
RITGEN

SEQ ID NO: 1559480 - protein, 10 aa, Staphylococcus aureus
RKEDSHKGDY

SEQ ID NO: 1559481 - protein, 8 aa, Staphylococcus aureus
RKQPDHGE

SEQ ID NO: 1559482 - protein, 4 aa, Staphylococcus aureus
RLEQ

SEQ ID NO: 1559483 - protein, 4 aa, Staphylococcus aureus
RNIG

SEQ ID NO: 1559484 - protein, 5 aa, Staphylococcus aureus
RPDTT

SEQ ID NO: 1559485 - protein, 4 aa, Staphylococcus aureus
RPRP

SEQ ID NO: 1559486 - protein, 6 aa, Staphylococcus aureus
RQHDED

SEQ ID NO: 1559487 - protein, 7 aa, Staphylococcus aureus
RTLEDSS

SEQ ID NO: 1559488 - protein, 8 aa, Staphylococcus aureus
RTMGASET

SEQ ID NO: 1559489 - protein, 4 aa, Staphylococcus aureus
RTNT

SEQ ID NO: 1559490 - protein, 10 aa, Staphylococcus aureus
SAAAKAKQGA

SEQ ID NO: 1559491 - protein, 4 aa, Staphylococcus aureus
SAIT

SEQ ID NO: 1559492 - protein, 7 aa, Staphylococcus aureus
SAKYNAS

SEQ ID NO: 1559493 - protein, 6 aa, Staphylococcus aureus
SANNMT

SEQ ID NO: 1559494 - protein, 7 aa, Staphylococcus aureus
SDFSKKD

SEQ ID NO: 1559495 - protein, 10 aa, Staphylococcus aureus
SDLSEHAKGV

SEQ ID NO: 1559496 - protein, 4 aa, Staphylococcus aureus
SEIT

SEQ ID NO: 1559497 - protein, 6 aa, Staphylococcus aureus
SENGGI

SEQ ID NO: 1559498 - protein, 6 aa, Staphylococcus aureus
SESART

SEQ ID NO: 1559499 - protein, 10 aa, Staphylococcus aureus
SFPSGHSNAS

SEQ ID NO: 1559500 - protein, 7 aa, Staphylococcus aureus
SGADANM

SEQ ID NO: 1559501 - protein, 7 aa, Staphylococcus aureus
SGGRGGI

SEQ ID NO: 1559502 - protein, 13 aa, Staphylococcus aureus
SKADGTAVKVAPK

SEQ ID NO: 1559503 - protein, 13 aa, Staphylococcus aureus
SKAKMYDNNKRRV

SEQ ID NO: 1559504 - protein, 9 aa, Staphylococcus aureus
SKTEGLSTK

SEQ ID NO: 1559505 - protein, 8 aa, Staphylococcus aureus
SMEENSDK

SEQ ID NO: 1559506 - protein, 6 aa, Staphylococcus aureus
SNDSQV

SEQ ID NO: 1559507 - protein, 7 aa, Staphylococcus aureus
SNSSNAA

SEQ ID NO: 1559508 - protein, 7 aa, Staphylococcus aureus
SPLDTAK

SEQ ID NO: 1559509 - protein, 6 aa, Staphylococcus aureus
SPRKFK

SEQ ID NO: 1559510 - protein, 8 aa, Staphylococcus aureus
SQESPFSK

SEQ ID NO: 1559511 - protein, 7 aa, Staphylococcus aureus
SQNPQLK

SEQ ID NO: 1559512 - protein, 4 aa, Staphylococcus aureus
SRNV

SEQ ID NO: 1559513 - protein, 7 aa, Staphylococcus aureus
SRRDGFN

SEQ ID NO: 1559514 - protein, 8 aa, Staphylococcus aureus
SRTEGELI

SEQ ID NO: 1559515 - protein, 7 aa, Staphylococcus aureus
SSKIPDA

SEQ ID NO: 1559516 - protein, 6 aa, Staphylococcus aureus
SVEEKE

SEQ ID NO: 1559517 - protein, 11 aa, Staphylococcus aureus
TANLDSESELK

SEQ ID NO: 1559518 - protein, 9 aa, Staphylococcus aureus
TASGGDGYS

SEQ ID NO: 1559519 - protein, 13 aa, Staphylococcus aureus
TDTKGREDKPFDN

SEQ ID NO: 1559520 - protein, 5 aa, Staphylococcus aureus
TEPYS

SEQ ID NO: 1559521 - protein, 4 aa, Staphylococcus aureus
TERR

SEQ ID NO: 1559522 - protein, 7 aa, Staphylococcus aureus
THPTNHS

SEQ ID NO: 1559523 - protein, 5 aa, Staphylococcus aureus
TKAHK

SEQ ID NO: 1559524 - protein, 9 aa, Staphylococcus aureus
TKAPRIYEK

SEQ ID NO: 1559525 - protein, 8 aa, Staphylococcus aureus
TKNPIAEP

SEQ ID NO: 1559526 - protein, 12 aa, Staphylococcus aureus
TNNKPKDEISDL

SEQ ID NO: 1559527 - protein, 7 aa, Staphylococcus aureus
TQVSKAK

SEQ ID NO: 1559528 - protein, 4 aa, Staphylococcus aureus
TSAN

SEQ ID NO: 1559529 - protein, 4 aa, Staphylococcus aureus
TSFS

SEQ ID NO: 1559530 - protein, 4 aa, Staphylococcus aureus
TSIH

SEQ ID NO: 1559531 - protein, 15 aa, Staphylococcus aureus
TTPETKTKTRPEGIK

SEQ ID NO: 1559532 - protein, 9 aa, Staphylococcus aureus
VATQPERDN

SEQ ID NO: 1559533 - protein, 8 aa, Staphylococcus aureus
VGKGNSPF

SEQ ID NO: 1559534 - protein, 20 aa, Staphylococcus aureus
VGRQRGAGVGGGHDEREQTL

SEQ ID NO: 1559535 - protein, 6 aa, Staphylococcus aureus
VKRSDY

SEQ ID NO: 1559536 - protein, 12 aa, Staphylococcus aureus
VNDKSKVDVPGL

SEQ ID NO: 1559537 - protein, 5 aa, Staphylococcus aureus
VNPHD

SEQ ID NO: 1559538 - protein, 13 aa, Staphylococcus aureus
VQRTETIKSNDIN

SEQ ID NO: 1559539 - protein, 4 aa, Staphylococcus aureus
VSED

SEQ ID NO: 1559540 - protein, 6 aa, Staphylococcus aureus
VTEDDN

SEQ ID NO: 1559541 - protein, 9 aa, Staphylococcus aureus
WAPRTKRGR

SEQ ID NO: 1559542 - protein, 8 aa, Staphylococcus aureus
YEPQEGPG

SEQ ID NO: 1559543 - protein, 11 aa, Staphylococcus aureus
YGHDPKKEKSM

SEQ ID NO: 1559544 - protein, 5 aa, Staphylococcus aureus
YKPGD

SEQ ID NO: 1559545 - protein, 10 aa, Staphylococcus aureus
YPEQYSSGIT

SEQ ID NO: 1559546 - protein, 14 aa, Staphylococcus aureus
YQASDSLKETNKSL

SEQ ID NO: 1559547 - protein, 14 aa, Staphylococcus aureus
YTSQENKKKQRQKM

SEQ ID NO: 1559548 - protein, 6 aa, Staphylococcus aureus
YYTREE

SEQ ID NO: 1559549 - protein, 4 aa, Staphylococcus aureus
AADE

SEQ ID NO: 1559550 - protein, 7 aa, Staphylococcus aureus
AAGKTNT

SEQ ID NO: 1559551 - protein, 9 aa, Staphylococcus aureus
AALNPQKRE

SEQ ID NO: 1559552 - protein, 9 aa, Staphylococcus aureus
AANSGVYTT

SEQ ID NO: 1559553 - protein, 6 aa, Staphylococcus aureus
AAVPGT

SEQ ID NO: 1559554 - protein, 7 aa, Staphylococcus aureus
ADKDKHY

SEQ ID NO: 1559555 - protein, 17 aa, Staphylococcus aureus
AETFYNPSTYVKAVLGG

SEQ ID NO: 1559556 - protein, 6 aa, Staphylococcus aureus
AGAGET

SEQ ID NO: 1559557 - protein, 11 aa, Staphylococcus aureus
AGETKDPQKNI

SEQ ID NO: 1559558 - protein, 6 aa, Staphylococcus aureus
AGGDGV

SEQ ID NO: 1559559 - protein, 4 aa, Staphylococcus aureus
AGGL

SEQ ID NO: 1559560 - protein, 12 aa, Staphylococcus aureus
AGGVKGPAGPNS

SEQ ID NO: 1559561 - protein, 5 aa, Staphylococcus aureus
AGSIG

SEQ ID NO: 1559562 - protein, 11 aa, Staphylococcus aureus
AGTTGSGKSEI

SEQ ID NO: 1559563 - protein, 6 aa, Staphylococcus aureus
AHTPVK

SEQ ID NO: 1559564 - protein, 6 aa, Staphylococcus aureus
AIGPTL

SEQ ID NO: 1559565 - protein, 4 aa, Staphylococcus aureus
AITA

SEQ ID NO: 1559566 - protein, 11 aa, Staphylococcus aureus
AKEHPEDDIPK

SEQ ID NO: 1559567 - protein, 8 aa, Staphylococcus aureus
AKEPYNVT

SEQ ID NO: 1559568 - protein, 6 aa, Staphylococcus aureus
AKGNST

SEQ ID NO: 1559569 - protein, 7 aa, Staphylococcus aureus
AKPEHKK

SEQ ID NO: 1559570 - protein, 5 aa, Staphylococcus aureus
AKSDI

SEQ ID NO: 1559571 - protein, 10 aa, Staphylococcus aureus
ALPGRLASHG

SEQ ID NO: 1559572 - protein, 9 aa, Staphylococcus aureus
ALSNPNTVK

SEQ ID NO: 1559573 - protein, 6 aa, Staphylococcus aureus
AMTSRK

SEQ ID NO: 1559574 - protein, 5 aa, Staphylococcus aureus
APLSS

SEQ ID NO: 1559575 - protein, 6 aa, Staphylococcus aureus
APNGMR

SEQ ID NO: 1559576 - protein, 8 aa, Staphylococcus aureus
APQATSID

SEQ ID NO: 1559577 - protein, 4 aa, Staphylococcus aureus
ARIG

SEQ ID NO: 1559578 - protein, 9 aa, Staphylococcus aureus
ASSDLGASP

SEQ ID NO: 1559579 - protein, 6 aa, Staphylococcus aureus
ASSPEE

SEQ ID NO: 1559580 - protein, 6 aa, Staphylococcus aureus
ASVSGS

SEQ ID NO: 1559581 - protein, 7 aa, Staphylococcus aureus
ATARAGA

SEQ ID NO: 1559582 - protein, 6 aa, Staphylococcus aureus
ATDVPT

SEQ ID NO: 1559583 - protein, 7 aa, Staphylococcus aureus
ATKQQDL

SEQ ID NO: 1559584 - protein, 4 aa, Staphylococcus aureus
ATPI

SEQ ID NO: 1559585 - protein, 10 aa, Staphylococcus aureus
ATTNGGLDIT

SEQ ID NO: 1559586 - protein, 8 aa, Staphylococcus aureus
ATTRSAGL

SEQ ID NO: 1559587 - protein, 5 aa, Staphylococcus aureus
DAGIR

SEQ ID NO: 1559588 - protein, 8 aa, Staphylococcus aureus
DANQTVQQ

SEQ ID NO: 1559589 - protein, 8 aa, Staphylococcus aureus
DATKTGGS

SEQ ID NO: 1559590 - protein, 4 aa, Staphylococcus aureus
DDDE

SEQ ID NO: 1559591 - protein, 5 aa, Staphylococcus aureus
DDIDQ

SEQ ID NO: 1559592 - protein, 13 aa, Staphylococcus aureus
DESSSGRGSSSSL

SEQ ID NO: 1559593 - protein, 8 aa, Staphylococcus aureus
DETEDELE

SEQ ID NO: 1559594 - protein, 5 aa, Staphylococcus aureus
DGGFP

SEQ ID NO: 1559595 - protein, 14 aa, Staphylococcus aureus
DGPDKIGVAAPNEQ

SEQ ID NO: 1559596 - protein, 9 aa, Staphylococcus aureus
DGSTDTTID

SEQ ID NO: 1559597 - protein, 10 aa, Staphylococcus aureus
DHSTGTRDVK

SEQ ID NO: 1559598 - protein, 7 aa, Staphylococcus aureus
DINGSKS

SEQ ID NO: 1559599 - protein, 8 aa, Staphylococcus aureus
DKISTTQA

SEQ ID NO: 1559600 - protein, 5 aa, Staphylococcus aureus
DKTGV

SEQ ID NO: 1559601 - protein, 7 aa, Staphylococcus aureus
DLKQNLS

SEQ ID NO: 1559602 - protein, 5 aa, Staphylococcus aureus
DLKSI

SEQ ID NO: 1559603 - protein, 15 aa, Staphylococcus aureus
DLNRQMAKNDKDNEL

SEQ ID NO: 1559604 - protein, 17 aa, Staphylococcus aureus
DLSGLEDEETKENQTEL

SEQ ID NO: 1559605 - protein, 5 aa, Staphylococcus aureus
DMNPG

SEQ ID NO: 1559606 - protein, 7 aa, Staphylococcus aureus
DNHTPFD

SEQ ID NO: 1559607 - protein, 5 aa, Staphylococcus aureus
DNIAR

SEQ ID NO: 1559608 - protein, 13 aa, Staphylococcus aureus
DNQVAQDTSSLIN

SEQ ID NO: 1559609 - protein, 8 aa, Staphylococcus aureus
DPAVASGP

SEQ ID NO: 1559610 - protein, 13 aa, Staphylococcus aureus
DQNKAAENGISAS

SEQ ID NO: 1559611 - protein, 5 aa, Staphylococcus aureus
DQQSM

SEQ ID NO: 1559612 - protein, 9 aa, Staphylococcus aureus
DRPDGYKAV

SEQ ID NO: 1559613 - protein, 6 aa, Staphylococcus aureus
DRTSTR

SEQ ID NO: 1559614 - protein, 16 aa, Staphylococcus aureus
DSDADRKKKGGGERSD

SEQ ID NO: 1559615 - protein, 13 aa, Staphylococcus aureus
DSEKDLEKDLKDQ

SEQ ID NO: 1559616 - protein, 5 aa, Staphylococcus aureus
DSNTG

SEQ ID NO: 1559617 - protein, 14 aa, Staphylococcus aureus
DVNDTYSHKSGDAV

SEQ ID NO: 1559618 - protein, 9 aa, Staphylococcus aureus
DVPEEQYQG

SEQ ID NO: 1559619 - protein, 5 aa, Staphylococcus aureus
DYTSA

SEQ ID NO: 1559620 - protein, 9 aa, Staphylococcus aureus
EAGNKGWGS

SEQ ID NO: 1559621 - protein, 7 aa, Staphylococcus aureus
EAPTPVS

SEQ ID NO: 1559622 - protein, 13 aa, Staphylococcus aureus
EARIKEREAVSHE

SEQ ID NO: 1559623 - protein, 14 aa, Staphylococcus aureus
EARQYEQSAKPTHI

SEQ ID NO: 1559624 - protein, 9 aa, Staphylococcus aureus
EDKSATSEL

SEQ ID NO: 1559625 - protein, 9 aa, Staphylococcus aureus
EEASEDYSR

SEQ ID NO: 1559626 - protein, 5 aa, Staphylococcus aureus
EEATD

SEQ ID NO: 1559627 - protein, 15 aa, Staphylococcus aureus
EETKNTVEVKDGMGK

SEQ ID NO: 1559628 - protein, 7 aa, Staphylococcus aureus
EGKKKID

SEQ ID NO: 1559629 - protein, 18 aa, Staphylococcus aureus
EKELQKITDAAKKQNGVK

SEQ ID NO: 1559630 - protein, 19 aa, Staphylococcus aureus
EKNLKDKIKSEKTEYSAKK

SEQ ID NO: 1559631 - protein, 8 aa, Staphylococcus aureus
EKTQQVKG

SEQ ID NO: 1559632 - protein, 16 aa, Staphylococcus aureus
EKVKRARTQEEKMAAN

SEQ ID NO: 1559633 - protein, 9 aa, Staphylococcus aureus
ELKSEQPDF

SEQ ID NO: 1559634 - protein, 7 aa, Staphylococcus aureus
ELNQENV

SEQ ID NO: 1559635 - protein, 5 aa, Staphylococcus aureus
EMTNE

SEQ ID NO: 1559636 - protein, 10 aa, Staphylococcus aureus
ENEEILPDTK

SEQ ID NO: 1559637 - protein, 9 aa, Staphylococcus aureus
ENKVDDQEL

SEQ ID NO: 1559638 - protein, 8 aa, Staphylococcus aureus
ENNDKQKV

SEQ ID NO: 1559639 - protein, 8 aa, Staphylococcus aureus
EPATSSIN

SEQ ID NO: 1559640 - protein, 8 aa, Staphylococcus aureus
EPGYKSLT

SEQ ID NO: 1559641 - protein, 8 aa, Staphylococcus aureus
EPNEQENE

SEQ ID NO: 1559642 - protein, 4 aa, Staphylococcus aureus
EPVL

SEQ ID NO: 1559643 - protein, 4 aa, Staphylococcus aureus
EQLT

SEQ ID NO: 1559644 - protein, 6 aa, Staphylococcus aureus
ESLGQV

SEQ ID NO: 1559645 - protein, 6 aa, Staphylococcus aureus
FEEDEE

SEQ ID NO: 1559646 - protein, 7 aa, Staphylococcus aureus
FKDEPGV

SEQ ID NO: 1559647 - protein, 25 aa, Staphylococcus aureus
FKSATEDLDKESHDTPSKESKQQRE

SEQ ID NO: 1559648 - protein, 5 aa, Staphylococcus aureus
FLGSQ

SEQ ID NO: 1559649 - protein, 5 aa, Staphylococcus aureus
FPGKS

SEQ ID NO: 1559650 - protein, 4 aa, Staphylococcus aureus
FPPY

SEQ ID NO: 1559651 - protein, 10 aa, Staphylococcus aureus
FSKDAMSKTQ

SEQ ID NO: 1559652 - protein, 15 aa, Staphylococcus aureus
FSNTAEKMGGVKSTV

SEQ ID NO: 1559653 - protein, 4 aa, Staphylococcus aureus
FTPE

SEQ ID NO: 1559654 - protein, 7 aa, Staphylococcus aureus
GAETYRV

SEQ ID NO: 1559655 - protein, 5 aa, Staphylococcus aureus
GAGIG

SEQ ID NO: 1559656 - protein, 6 aa, Staphylococcus aureus
GAIQSN

SEQ ID NO: 1559657 - protein, 7 aa, Staphylococcus aureus
GANQPKY

SEQ ID NO: 1559658 - protein, 7 aa, Staphylococcus aureus
GDADNFA

SEQ ID NO: 1559659 - protein, 7 aa, Staphylococcus aureus
GDRKSTI

SEQ ID NO: 1559660 - protein, 9 aa, Staphylococcus aureus
GEFSPGPGV

SEQ ID NO: 1559661 - protein, 6 aa, Staphylococcus aureus
GGAAYQ

SEQ ID NO: 1559662 - protein, 4 aa, Staphylococcus aureus
GGDS

SEQ ID NO: 1559663 - protein, 4 aa, Staphylococcus aureus
GGGM

SEQ ID NO: 1559664 - protein, 9 aa, Staphylococcus aureus
GGPREEGIS

SEQ ID NO: 1559665 - protein, 4 aa, Staphylococcus aureus
GGVT

SEQ ID NO: 1559666 - protein, 6 aa, Staphylococcus aureus
GIPPLS

SEQ ID NO: 1559667 - protein, 18 aa, Staphylococcus aureus
GKDADGKDAYKAANAKEN

SEQ ID NO: 1559668 - protein, 9 aa, Staphylococcus aureus
GKLGSEPSI

SEQ ID NO: 1559669 - protein, 10 aa, Staphylococcus aureus
GKSKSTEEIK

SEQ ID NO: 1559670 - protein, 6 aa, Staphylococcus aureus
GLADKI

SEQ ID NO: 1559671 - protein, 7 aa, Staphylococcus aureus
GLNDPVA

SEQ ID NO: 1559672 - protein, 4 aa, Staphylococcus aureus
GNDT

SEQ ID NO: 1559673 - protein, 6 aa, Staphylococcus aureus
GNSKTN

SEQ ID NO: 1559674 - protein, 11 aa, Staphylococcus aureus
GQVTGKGTHSE

SEQ ID NO: 1559675 - protein, 9 aa, Staphylococcus aureus
GRGEHKANR

SEQ ID NO: 1559676 - protein, 6 aa, Staphylococcus aureus
GRTYTT

SEQ ID NO: 1559677 - protein, 7 aa, Staphylococcus aureus
GSFSSYS

SEQ ID NO: 1559678 - protein, 8 aa, Staphylococcus aureus
GSPAAGWT

SEQ ID NO: 1559679 - protein, 5 aa, Staphylococcus aureus
GTDDF

SEQ ID NO: 1559680 - protein, 6 aa, Staphylococcus aureus
GTGNML

SEQ ID NO: 1559681 - protein, 8 aa, Staphylococcus aureus
GTKQPSLP

SEQ ID NO: 1559682 - protein, 4 aa, Staphylococcus aureus
GTLG

SEQ ID NO: 1559683 - protein, 5 aa, Staphylococcus aureus
GTTQI

SEQ ID NO: 1559684 - protein, 5 aa, Staphylococcus aureus
GTVTE

SEQ ID NO: 1559685 - protein, 5 aa, Staphylococcus aureus
GVGAE

SEQ ID NO: 1559686 - protein, 10 aa, Staphylococcus aureus
HFNNKEEKYD

SEQ ID NO: 1559687 - protein, 13 aa, Staphylococcus aureus
HIEKTEEQSSDKN

SEQ ID NO: 1559688 - protein, 5 aa, Staphylococcus aureus
HNPLD

SEQ ID NO: 1559689 - protein, 13 aa, Staphylococcus aureus
HNRESQSTTGIGE

SEQ ID NO: 1559690 - protein, 5 aa, Staphylococcus aureus
HPPEY

SEQ ID NO: 1559691 - protein, 8 aa, Staphylococcus aureus
HTLSGGEI

SEQ ID NO: 1559692 - protein, 10 aa, Staphylococcus aureus
IASPASGQIK

SEQ ID NO: 1559693 - protein, 13 aa, Staphylococcus aureus
IEGSRLKTAYAEA

SEQ ID NO: 1559694 - protein, 11 aa, Staphylococcus aureus
IGGASDDINNA

SEQ ID NO: 1559695 - protein, 5 aa, Staphylococcus aureus
IGPTL

SEQ ID NO: 1559696 - protein, 15 aa, Staphylococcus aureus
IKGKTYKKSYNMNNR

SEQ ID NO: 1559697 - protein, 13 aa, Staphylococcus aureus
IKPSQGEVRAPFN

SEQ ID NO: 1559698 - protein, 48 aa, Staphylococcus aureus
IKQHPDVQKVTDATSKVASKTSAAISNTASDVKEYVGDKKQDFENKRE

SEQ ID NO: 1559699 - protein, 22 aa, Staphylococcus aureus
IKTPYTKKTKVDEISEDLKDTK

SEQ ID NO: 1559700 - protein, 6 aa, Staphylococcus aureus
IPQTAE

SEQ ID NO: 1559701 - protein, 26 aa, Staphylococcus aureus
IRSNYKDANDTINKHQLSGQGGIQSD

SEQ ID NO: 1559702 - protein, 6 aa, Staphylococcus aureus
ISAETS

SEQ ID NO: 1559703 - protein, 8 aa, Staphylococcus aureus
ISGPTGAL

SEQ ID NO: 1559704 - protein, 11 aa, Staphylococcus aureus
ISRKAEKEHQS

SEQ ID NO: 1559705 - protein, 4 aa, Staphylococcus aureus
ISTN

SEQ ID NO: 1559706 - protein, 5 aa, Staphylococcus aureus
ITAPH

SEQ ID NO: 1559707 - protein, 6 aa, Staphylococcus aureus
ITGNDQ

SEQ ID NO: 1559708 - protein, 8 aa, Staphylococcus aureus
ITGTRGAT

SEQ ID NO: 1559709 - protein, 10 aa, Staphylococcus aureus
ITTGEINEQS

SEQ ID NO: 1559710 - protein, 8 aa, Staphylococcus aureus
KADTDQAL

SEQ ID NO: 1559711 - protein, 7 aa, Staphylococcus aureus
KAIGPSG

SEQ ID NO: 1559712 - protein, 9 aa, Staphylococcus aureus
KAKRGTYSA

SEQ ID NO: 1559713 - protein, 9 aa, Staphylococcus aureus
KAQDANTVQ

SEQ ID NO: 1559714 - protein, 10 aa, Staphylococcus aureus
KAYDDKQAHT

SEQ ID NO: 1559715 - protein, 7 aa, Staphylococcus aureus
KDDANEI

SEQ ID NO: 1559716 - protein, 14 aa, Staphylococcus aureus
KDEEIEPAKAHSAK

SEQ ID NO: 1559717 - protein, 4 aa, Staphylococcus aureus
KDKW

SEQ ID NO: 1559718 - protein, 4 aa, Staphylococcus aureus
KDYD

SEQ ID NO: 1559719 - protein, 6 aa, Staphylococcus aureus
KDYERG

SEQ ID NO: 1559720 - protein, 51 aa, Staphylococcus aureus
KEKQVKDEKAKSEEEKAKAKDEKLKQQEENEKKQKEQAQKDKEKRQEAERK

SEQ ID NO: 1559721 - protein, 18 aa, Staphylococcus aureus
KEPQIEKSQLSDTQQNQI

SEQ ID NO: 1559722 - protein, 5 aa, Staphylococcus aureus
KGDAV

SEQ ID NO: 1559723 - protein, 7 aa, Staphylococcus aureus
KGDKITL

SEQ ID NO: 1559724 - protein, 9 aa, Staphylococcus aureus
KGDYPKNAH

SEQ ID NO: 1559725 - protein, 7 aa, Staphylococcus aureus
KGEDNPI

SEQ ID NO: 1559726 - protein, 14 aa, Staphylococcus aureus
KGESMDPTLKDGER

SEQ ID NO: 1559727 - protein, 5 aa, Staphylococcus aureus
KGIKY

SEQ ID NO: 1559728 - protein, 5 aa, Staphylococcus aureus
KGNIP

SEQ ID NO: 1559729 - protein, 7 aa, Staphylococcus aureus
KHPPRWQ

SEQ ID NO: 1559730 - protein, 8 aa, Staphylococcus aureus
KIASPSSI

SEQ ID NO: 1559731 - protein, 7 aa, Staphylococcus aureus
KIKETEK

SEQ ID NO: 1559732 - protein, 9 aa, Staphylococcus aureus
KIQQSSKKT

SEQ ID NO: 1559733 - protein, 10 aa, Staphylococcus aureus
KKANDEPAYN

SEQ ID NO: 1559734 - protein, 7 aa, Staphylococcus aureus
KKAPGHA

SEQ ID NO: 1559735 - protein, 8 aa, Staphylococcus aureus
KKGSSFYD

SEQ ID NO: 1559736 - protein, 9 aa, Staphylococcus aureus
KKNSDQTKW

SEQ ID NO: 1559737 - protein, 11 aa, Staphylococcus aureus
KKQGQDPNKVL

SEQ ID NO: 1559738 - protein, 9 aa, Staphylococcus aureus
KKRPTGKQN

SEQ ID NO: 1559739 - protein, 13 aa, Staphylococcus aureus
KKRQTQGNEVKNH

SEQ ID NO: 1559740 - protein, 6 aa, Staphylococcus aureus
KKSGDT

SEQ ID NO: 1559741 - protein, 9 aa, Staphylococcus aureus
KKYGNSPKA

SEQ ID NO: 1559742 - protein, 4 aa, Staphylococcus aureus
KKYS

SEQ ID NO: 1559743 - protein, 9 aa, Staphylococcus aureus
KLPEDVTSR

SEQ ID NO: 1559744 - protein, 8 aa, Staphylococcus aureus
KNDTPPTM

SEQ ID NO: 1559745 - protein, 6 aa, Staphylococcus aureus
KNNITN

SEQ ID NO: 1559746 - protein, 15 aa, Staphylococcus aureus
KNQGRNKVMFNPIIN

SEQ ID NO: 1559747 - protein, 10 aa, Staphylococcus aureus
KPADRNHPYG

SEQ ID NO: 1559748 - protein, 7 aa, Staphylococcus aureus
KPAYEDV

SEQ ID NO: 1559749 - protein, 10 aa, Staphylococcus aureus
KPEQLPKKAH

SEQ ID NO: 1559750 - protein, 8 aa, Staphylococcus aureus
KQVGKESE

SEQ ID NO: 1559751 - protein, 12 aa, Staphylococcus aureus
KRDRSGENFSRK

SEQ ID NO: 1559752 - protein, 7 aa, Staphylococcus aureus
KRFGGNP

SEQ ID NO: 1559753 - protein, 9 aa, Staphylococcus aureus
KRGDYSPRE

SEQ ID NO: 1559754 - protein, 6 aa, Staphylococcus aureus
KRTSGN

SEQ ID NO: 1559755 - protein, 6 aa, Staphylococcus aureus
KRVSKG

SEQ ID NO: 1559756 - protein, 13 aa, Staphylococcus aureus
KSAKEQGSNATRA

SEQ ID NO: 1559757 - protein, 14 aa, Staphylococcus aureus
KSPREATGDNWDGL

SEQ ID NO: 1559758 - protein, 5 aa, Staphylococcus aureus
KTGAI

SEQ ID NO: 1559759 - protein, 4 aa, Staphylococcus aureus
KTSG

SEQ ID NO: 1559760 - protein, 34 aa, Staphylococcus aureus
KTTTPSKLTQEQGDYATTVSAKVTNKDVGGTTRQ

SEQ ID NO: 1559761 - protein, 5 aa, Staphylococcus aureus
KTVDS

SEQ ID NO: 1559762 - protein, 5 aa, Staphylococcus aureus
KVEGP

SEQ ID NO: 1559763 - protein, 6 aa, Staphylococcus aureus
KVLPKG

SEQ ID NO: 1559764 - protein, 13 aa, Staphylococcus aureus
KYIPNTDLKRGQA

SEQ ID NO: 1559765 - protein, 5 aa, Staphylococcus aureus
KYKTP

SEQ ID NO: 1559766 - protein, 6 aa, Staphylococcus aureus
LEDPDE

SEQ ID NO: 1559767 - protein, 11 aa, Staphylococcus aureus
LGKPNDKPEFN

SEQ ID NO: 1559768 - protein, 20 aa, Staphylococcus aureus
LGSVGMKPTNPLTPAEKKKY

SEQ ID NO: 1559769 - protein, 11 aa, Staphylococcus aureus
LPGRKKTEEEV

SEQ ID NO: 1559770 - protein, 7 aa, Staphylococcus aureus
LPPEQRK

SEQ ID NO: 1559771 - protein, 4 aa, Staphylococcus aureus
LQQG

SEQ ID NO: 1559772 - protein, 7 aa, Staphylococcus aureus
LTGDEKK

SEQ ID NO: 1559773 - protein, 4 aa, Staphylococcus aureus
LTGG

SEQ ID NO: 1559774 - protein, 22 aa, Staphylococcus aureus
LTGKEASTTSEVKAQSAKNMNP

SEQ ID NO: 1559775 - protein, 28 aa, Staphylococcus aureus
LYSNEAGQGTGPHAAAAAEVSHPSKQGL

SEQ ID NO: 1559776 - protein, 11 aa, Staphylococcus aureus
MAGAVGGGGIG

SEQ ID NO: 1559777 - protein, 5 aa, Staphylococcus aureus
MGDGV

SEQ ID NO: 1559778 - protein, 6 aa, Staphylococcus aureus
MGDNRT

SEQ ID NO: 1559779 - protein, 4 aa, Staphylococcus aureus
MKQN

SEQ ID NO: 1559780 - protein, 10 aa, Staphylococcus aureus
MSGNSGTQSL

SEQ ID NO: 1559781 - protein, 7 aa, Staphylococcus aureus
NAAFNQS

SEQ ID NO: 1559782 - protein, 6 aa, Staphylococcus aureus
NALTPS

SEQ ID NO: 1559783 - protein, 5 aa, Staphylococcus aureus
NATAK

SEQ ID NO: 1559784 - protein, 7 aa, Staphylococcus aureus
NDADNQW

SEQ ID NO: 1559785 - protein, 10 aa, Staphylococcus aureus
NDATGTATPI

SEQ ID NO: 1559786 - protein, 4 aa, Staphylococcus aureus
NDRI

SEQ ID NO: 1559787 - protein, 4 aa, Staphylococcus aureus
NDTF

SEQ ID NO: 1559788 - protein, 7 aa, Staphylococcus aureus
NEQQGME

SEQ ID NO: 1559789 - protein, 7 aa, Staphylococcus aureus
NGDSQFG

SEQ ID NO: 1559790 - protein, 5 aa, Staphylococcus aureus
NGGEE

SEQ ID NO: 1559791 - protein, 6 aa, Staphylococcus aureus
NHTAID

SEQ ID NO: 1559792 - protein, 4 aa, Staphylococcus aureus
NKKY

SEQ ID NO: 1559793 - protein, 8 aa, Staphylococcus aureus
NKNTMSGT

SEQ ID NO: 1559794 - protein, 7 aa, Staphylococcus aureus
NKPLDET

SEQ ID NO: 1559795 - protein, 8 aa, Staphylococcus aureus
NKPSGKRI

SEQ ID NO: 1559796 - protein, 6 aa, Staphylococcus aureus
NKTTKL

SEQ ID NO: 1559797 - protein, 18 aa, Staphylococcus aureus
NLPEKTVTTVKENGKTVD

SEQ ID NO: 1559798 - protein, 5 aa, Staphylococcus aureus
NLSGS

SEQ ID NO: 1559799 - protein, 7 aa, Staphylococcus aureus
NNGHPIG

SEQ ID NO: 1559800 - protein, 8 aa, Staphylococcus aureus
NNSTSYRV

SEQ ID NO: 1559801 - protein, 7 aa, Staphylococcus aureus
NNTDSPE

SEQ ID NO: 1559802 - protein, 6 aa, Staphylococcus aureus
NPGTNL

SEQ ID NO: 1559803 - protein, 5 aa, Staphylococcus aureus
NPPLY

SEQ ID NO: 1559804 - protein, 8 aa, Staphylococcus aureus
NPRLTGDK

SEQ ID NO: 1559805 - protein, 6 aa, Staphylococcus aureus
NQENTQ

SEQ ID NO: 1559806 - protein, 8 aa, Staphylococcus aureus
NQSIKSDT

SEQ ID NO: 1559807 - protein, 10 aa, Staphylococcus aureus
NREVSKDSRA

SEQ ID NO: 1559808 - protein, 9 aa, Staphylococcus aureus
NRQPKDTVY

SEQ ID NO: 1559809 - protein, 7 aa, Staphylococcus aureus
NSPEAQT

SEQ ID NO: 1559810 - protein, 6 aa, Staphylococcus aureus
NSTNRS

SEQ ID NO: 1559811 - protein, 5 aa, Staphylococcus aureus
NTERL

SEQ ID NO: 1559812 - protein, 6 aa, Staphylococcus aureus
NTVGGV

SEQ ID NO: 1559813 - protein, 4 aa, Staphylococcus aureus
NVAS

SEQ ID NO: 1559814 - protein, 5 aa, Staphylococcus aureus
NVGTT

SEQ ID NO: 1559815 - protein, 5 aa, Staphylococcus aureus
NVTEG

SEQ ID NO: 1559816 - protein, 5 aa, Staphylococcus aureus
NYDDI

SEQ ID NO: 1559817 - protein, 8 aa, Staphylococcus aureus
NYNTRPVK

SEQ ID NO: 1559818 - protein, 4 aa, Staphylococcus aureus
NYSP

SEQ ID NO: 1559819 - protein, 5 aa, Staphylococcus aureus
PDEEM

SEQ ID NO: 1559820 - protein, 6 aa, Staphylococcus aureus
PDREEI

SEQ ID NO: 1559821 - protein, 15 aa, Staphylococcus aureus
PEEHGQAQGPIEEIT

SEQ ID NO: 1559822 - protein, 8 aa, Staphylococcus aureus
PEGGAQTH

SEQ ID NO: 1559823 - protein, 4 aa, Staphylococcus aureus
PEPH

SEQ ID NO: 1559824 - protein, 31 aa, Staphylococcus aureus
PGAGLDPTKLPKGDISKYQSTAHAAEQSTYG

SEQ ID NO: 1559825 - protein, 5 aa, Staphylococcus aureus
PGGAV

SEQ ID NO: 1559826 - protein, 8 aa, Staphylococcus aureus
PGGTSSNV

SEQ ID NO: 1559827 - protein, 5 aa, Staphylococcus aureus
PGTVN

SEQ ID NO: 1559828 - protein, 8 aa, Staphylococcus aureus
PHTKNEAD

SEQ ID NO: 1559829 - protein, 8 aa, Staphylococcus aureus
PKGQTEAA

SEQ ID NO: 1559830 - protein, 14 aa, Staphylococcus aureus
PKGTPIKAPTNGKV

SEQ ID NO: 1559831 - protein, 11 aa, Staphylococcus aureus
PKKAAGTAAGL

SEQ ID NO: 1559832 - protein, 5 aa, Staphylococcus aureus
PKLDD

SEQ ID NO: 1559833 - protein, 7 aa, Staphylococcus aureus
PLGDKQL

SEQ ID NO: 1559834 - protein, 4 aa, Staphylococcus aureus
PNNT

SEQ ID NO: 1559835 - protein, 10 aa, Staphylococcus aureus
PPEKRGAAMG

SEQ ID NO: 1559836 - protein, 6 aa, Staphylococcus aureus
PPFSGF

SEQ ID NO: 1559837 - protein, 7 aa, Staphylococcus aureus
PRDTRAE

SEQ ID NO: 1559838 - protein, 15 aa, Staphylococcus aureus
PSKQNRPTVNNRITD

SEQ ID NO: 1559839 - protein, 4 aa, Staphylococcus aureus
PSNP

SEQ ID NO: 1559840 - protein, 11 aa, Staphylococcus aureus
PSSNSDGNYTK

SEQ ID NO: 1559841 - protein, 7 aa, Staphylococcus aureus
PTADATV

SEQ ID NO: 1559842 - protein, 7 aa, Staphylococcus aureus
PTTGSFA

SEQ ID NO: 1559843 - protein, 6 aa, Staphylococcus aureus
QAPDAE

SEQ ID NO: 1559844 - protein, 22 aa, Staphylococcus aureus
QDRQDSNEILKTPDAADITLPG

SEQ ID NO: 1559845 - protein, 4 aa, Staphylococcus aureus
QGDA

SEQ ID NO: 1559846 - protein, 11 aa, Staphylococcus aureus
QKDGSSEKSHM

SEQ ID NO: 1559847 - protein, 7 aa, Staphylococcus aureus
QKPSGVV

SEQ ID NO: 1559848 - protein, 19 aa, Staphylococcus aureus
QLTESLQDELANNKDLQDA

SEQ ID NO: 1559849 - protein, 5 aa, Staphylococcus aureus
QPGGA

SEQ ID NO: 1559850 - protein, 6 aa, Staphylococcus aureus
QPNMNG

SEQ ID NO: 1559851 - protein, 7 aa, Staphylococcus aureus
QQQASAT

SEQ ID NO: 1559852 - protein, 8 aa, Staphylococcus aureus
QSSTNTNP

SEQ ID NO: 1559853 - protein, 5 aa, Staphylococcus aureus
QTPGR

SEQ ID NO: 1559854 - protein, 7 aa, Staphylococcus aureus
QTRSGQN

SEQ ID NO: 1559855 - protein, 5 aa, Staphylococcus aureus
QTSGL

SEQ ID NO: 1559856 - protein, 5 aa, Staphylococcus aureus
QYQSV

SEQ ID NO: 1559857 - protein, 4 aa, Staphylococcus aureus
RADA

SEQ ID NO: 1559858 - protein, 4 aa, Staphylococcus aureus
RDIE

SEQ ID NO: 1559859 - protein, 9 aa, Staphylococcus aureus
RDLGATEPQ

SEQ ID NO: 1559860 - protein, 4 aa, Staphylococcus aureus
RDSR

SEQ ID NO: 1559861 - protein, 9 aa, Staphylococcus aureus
REDTLSQNA

SEQ ID NO: 1559862 - protein, 22 aa, Staphylococcus aureus
REHNGGSNKKGKNTQVVSKKKK

SEQ ID NO: 1559863 - protein, 5 aa, Staphylococcus aureus
RNQGT

SEQ ID NO: 1559864 - protein, 7 aa, Staphylococcus aureus
RNQNNQV

SEQ ID NO: 1559865 - protein, 16 aa, Staphylococcus aureus
RREPDKFHYPKERIQI

SEQ ID NO: 1559866 - protein, 6 aa, Staphylococcus aureus
RRLSSA

SEQ ID NO: 1559867 - protein, 18 aa, Staphylococcus aureus
RSENEVDDMIEEPEKEKT

SEQ ID NO: 1559868 - protein, 5 aa, Staphylococcus aureus
RTRDQ

SEQ ID NO: 1559869 - protein, 8 aa, Staphylococcus aureus
RYNEKRSF

SEQ ID NO: 1559870 - protein, 8 aa, Staphylococcus aureus
SADASDEI

SEQ ID NO: 1559871 - protein, 4 aa, Staphylococcus aureus
SAGD

SEQ ID NO: 1559872 - protein, 6 aa, Staphylococcus aureus
SAIPPK

SEQ ID NO: 1559873 - protein, 4 aa, Staphylococcus aureus
SASA

SEQ ID NO: 1559874 - protein, 5 aa, Staphylococcus aureus
SDDID

SEQ ID NO: 1559875 - protein, 8 aa, Staphylococcus aureus
SDEQEETW

SEQ ID NO: 1559876 - protein, 10 aa, Staphylococcus aureus
SDIDSTNDSI

SEQ ID NO: 1559877 - protein, 5 aa, Staphylococcus aureus
SDISD

SEQ ID NO: 1559878 - protein, 6 aa, Staphylococcus aureus
SEGSDQ

SEQ ID NO: 1559879 - protein, 11 aa, Staphylococcus aureus
SEGSSLQGSQI

SEQ ID NO: 1559880 - protein, 9 aa, Staphylococcus aureus
SEGVNPTIG

SEQ ID NO: 1559881 - protein, 10 aa, Staphylococcus aureus
SEKDESIEKN

SEQ ID NO: 1559882 - protein, 11 aa, Staphylococcus aureus
SEKKKESSDVY

SEQ ID NO: 1559883 - protein, 6 aa, Staphylococcus aureus
SEKTSR

SEQ ID NO: 1559884 - protein, 4 aa, Staphylococcus aureus
SENI

SEQ ID NO: 1559885 - protein, 8 aa, Staphylococcus aureus
SEQRSSAM

SEQ ID NO: 1559886 - protein, 5 aa, Staphylococcus aureus
SFKDD

SEQ ID NO: 1559887 - protein, 7 aa, Staphylococcus aureus
SGATFGS

SEQ ID NO: 1559888 - protein, 16 aa, Staphylococcus aureus
SGATYDIEGDKLEVED

SEQ ID NO: 1559889 - protein, 12 aa, Staphylococcus aureus
SGDTHNNFIYNE

SEQ ID NO: 1559890 - protein, 5 aa, Staphylococcus aureus
SGEYN

SEQ ID NO: 1559891 - protein, 4 aa, Staphylococcus aureus
SGGA

SEQ ID NO: 1559892 - protein, 4 aa, Staphylococcus aureus
SGIG

SEQ ID NO: 1559893 - protein, 4 aa, Staphylococcus aureus
SGLS

SEQ ID NO: 1559894 - protein, 10 aa, Staphylococcus aureus
SGQNSTITGT

SEQ ID NO: 1559895 - protein, 6 aa, Staphylococcus aureus
SIKNEP

SEQ ID NO: 1559896 - protein, 5 aa, Staphylococcus aureus
SIYGA

SEQ ID NO: 1559897 - protein, 13 aa, Staphylococcus aureus
SKFAKGGKYLGKG

SEQ ID NO: 1559898 - protein, 10 aa, Staphylococcus aureus
SKGFRDGPRT

SEQ ID NO: 1559899 - protein, 6 aa, Staphylococcus aureus
SKGRSI

SEQ ID NO: 1559900 - protein, 10 aa, Staphylococcus aureus
SKTMPDEQRQ

SEQ ID NO: 1559901 - protein, 18 aa, Staphylococcus aureus
SMSMEGGHGNAAAYGKTI

SEQ ID NO: 1559902 - protein, 6 aa, Staphylococcus aureus
SNAKRW

SEQ ID NO: 1559903 - protein, 7 aa, Staphylococcus aureus
SNGTKAV

SEQ ID NO: 1559904 - protein, 12 aa, Staphylococcus aureus
SPAMATGGMGDT

SEQ ID NO: 1559905 - protein, 6 aa, Staphylococcus aureus
SPERKI

SEQ ID NO: 1559906 - protein, 7 aa, Staphylococcus aureus
SPGYGRT

SEQ ID NO: 1559907 - protein, 5 aa, Staphylococcus aureus
SPQQG

SEQ ID NO: 1559908 - protein, 9 aa, Staphylococcus aureus
SPTGNSAAV

SEQ ID NO: 1559909 - protein, 8 aa, Staphylococcus aureus
SQAGPGGA

SEQ ID NO: 1559910 - protein, 9 aa, Staphylococcus aureus
SQDSSVKGY

SEQ ID NO: 1559911 - protein, 5 aa, Staphylococcus aureus
SQSAT

SEQ ID NO: 1559912 - protein, 9 aa, Staphylococcus aureus
SQYGGQEGA

SEQ ID NO: 1559913 - protein, 8 aa, Staphylococcus aureus
SREKDTAI

SEQ ID NO: 1559914 - protein, 7 aa, Staphylococcus aureus
SSGPIDR

SEQ ID NO: 1559915 - protein, 4 aa, Staphylococcus aureus
SSLG

SEQ ID NO: 1559916 - protein, 12 aa, Staphylococcus aureus
SSPSSVGGGIRT

SEQ ID NO: 1559917 - protein, 7 aa, Staphylococcus aureus
STDAELK

SEQ ID NO: 1559918 - protein, 4 aa, Staphylococcus aureus
STGV

SEQ ID NO: 1559919 - protein, 12 aa, Staphylococcus aureus
STKDNKVDSEEA

SEQ ID NO: 1559920 - protein, 11 aa, Staphylococcus aureus
STKEQEVESIK

SEQ ID NO: 1559921 - protein, 11 aa, Staphylococcus aureus
STSNYTNKNVD

SEQ ID NO: 1559922 - protein, 6 aa, Staphylococcus aureus
SVENAQ

SEQ ID NO: 1559923 - protein, 16 aa, Staphylococcus aureus
SVGGSSPVDPTGSTNS

SEQ ID NO: 1559924 - protein, 15 aa, Staphylococcus aureus
SVNPGNSGGAVVNRE

SEQ ID NO: 1559925 - protein, 5 aa, Staphylococcus aureus
SWGGS

SEQ ID NO: 1559926 - protein, 8 aa, Staphylococcus aureus
SYQAEQAP

SEQ ID NO: 1559927 - protein, 15 aa, Staphylococcus aureus
TAGESDDPKKSMPKA

SEQ ID NO: 1559928 - protein, 6 aa, Staphylococcus aureus
TAKQSN

SEQ ID NO: 1559929 - protein, 7 aa, Staphylococcus aureus
TAKTTPA

SEQ ID NO: 1559930 - protein, 6 aa, Staphylococcus aureus
TAPTPV

SEQ ID NO: 1559931 - protein, 7 aa, Staphylococcus aureus
TATRTTP

SEQ ID NO: 1559932 - protein, 28 aa, Staphylococcus aureus
TDDPALADQIKEEKKDETYFDRSIRILF

SEQ ID NO: 1559933 - protein, 7 aa, Staphylococcus aureus
TDFSSTQ

SEQ ID NO: 1559934 - protein, 5 aa, Staphylococcus aureus
TDNTV

SEQ ID NO: 1559935 - protein, 5 aa, Staphylococcus aureus
TDYSR

SEQ ID NO: 1559936 - protein, 5 aa, Staphylococcus aureus
TENGK

SEQ ID NO: 1559937 - protein, 4 aa, Staphylococcus aureus
TGDF

SEQ ID NO: 1559938 - protein, 6 aa, Staphylococcus aureus
THEGEL

SEQ ID NO: 1559939 - protein, 6 aa, Staphylococcus aureus
TIADSA

SEQ ID NO: 1559940 - protein, 8 aa, Staphylococcus aureus
TIDPGPME

SEQ ID NO: 1559941 - protein, 8 aa, Staphylococcus aureus
TKEQRGSI

SEQ ID NO: 1559942 - protein, 11 aa, Staphylococcus aureus
TKGQQTHVNGD

SEQ ID NO: 1559943 - protein, 5 aa, Staphylococcus aureus
TKPKV

SEQ ID NO: 1559944 - protein, 24 aa, Staphylococcus aureus
TKQELGEEEPELSRTSKGNVTNQT

SEQ ID NO: 1559945 - protein, 12 aa, Staphylococcus aureus
TKTGSADGCGSS

SEQ ID NO: 1559946 - protein, 5 aa, Staphylococcus aureus
TLGAS

SEQ ID NO: 1559947 - protein, 6 aa, Staphylococcus aureus
TLSDPT

SEQ ID NO: 1559948 - protein, 6 aa, Staphylococcus aureus
TMSGNT

SEQ ID NO: 1559949 - protein, 9 aa, Staphylococcus aureus
TNRKQGNDI

SEQ ID NO: 1559950 - protein, 10 aa, Staphylococcus aureus
TPKPGETEQA

SEQ ID NO: 1559951 - protein, 12 aa, Staphylococcus aureus
TPPNFDKPFKAK

SEQ ID NO: 1559952 - protein, 16 aa, Staphylococcus aureus
TPPTADPKTTEAYTEA

SEQ ID NO: 1559953 - protein, 6 aa, Staphylococcus aureus
TQHTKM

SEQ ID NO: 1559954 - protein, 4 aa, Staphylococcus aureus
TRNQ

SEQ ID NO: 1559955 - protein, 6 aa, Staphylococcus aureus
TSIGTT

SEQ ID NO: 1559956 - protein, 5 aa, Staphylococcus aureus
TSNKD

SEQ ID NO: 1559957 - protein, 10 aa, Staphylococcus aureus
TSSISEKGFD

SEQ ID NO: 1559958 - protein, 13 aa, Staphylococcus aureus
TSVESESGTGSAL

SEQ ID NO: 1559959 - protein, 6 aa, Staphylococcus aureus
TTATGT

SEQ ID NO: 1559960 - protein, 9 aa, Staphylococcus aureus
TTPKENRKK

SEQ ID NO: 1559961 - protein, 5 aa, Staphylococcus aureus
TVTMT

SEQ ID NO: 1559962 - protein, 8 aa, Staphylococcus aureus
VAETEARL

SEQ ID NO: 1559963 - protein, 16 aa, Staphylococcus aureus
VDEDESYIEDDVTKKE

SEQ ID NO: 1559964 - protein, 15 aa, Staphylococcus aureus
VDRTTNGSGKVSAHT

SEQ ID NO: 1559965 - protein, 10 aa, Staphylococcus aureus
VEEDKRGKQM

SEQ ID NO: 1559966 - protein, 24 aa, Staphylococcus aureus
VENETSKDSSLPKDKASQDEVGSG

SEQ ID NO: 1559967 - protein, 7 aa, Staphylococcus aureus
VENNESM

SEQ ID NO: 1559968 - protein, 12 aa, Staphylococcus aureus
VETNGSSGIKNH

SEQ ID NO: 1559969 - protein, 4 aa, Staphylococcus aureus
VEVN

SEQ ID NO: 1559970 - protein, 17 aa, Staphylococcus aureus
VGDKENQKITFSNNKSV

SEQ ID NO: 1559971 - protein, 4 aa, Staphylococcus aureus
VGGT

SEQ ID NO: 1559972 - protein, 13 aa, Staphylococcus aureus
VIPNYSEKMTNSY

SEQ ID NO: 1559973 - protein, 9 aa, Staphylococcus aureus
VKSKRGAEL

SEQ ID NO: 1559974 - protein, 18 aa, Staphylococcus aureus
VLKSGKLKEVHTKEEIGC

SEQ ID NO: 1559975 - protein, 4 aa, Staphylococcus aureus
VNRG

SEQ ID NO: 1559976 - protein, 13 aa, Staphylococcus aureus
VPATKGTLTGGID

SEQ ID NO: 1559977 - protein, 8 aa, Staphylococcus aureus
VPGVSGGT

SEQ ID NO: 1559978 - protein, 13 aa, Staphylococcus aureus
VQPTNEKMTDLQD

SEQ ID NO: 1559979 - protein, 13 aa, Staphylococcus aureus
VRTISKDAKNNTR

SEQ ID NO: 1559980 - protein, 9 aa, Staphylococcus aureus
VSEKEKDSL

SEQ ID NO: 1559981 - protein, 6 aa, Staphylococcus aureus
VTGGAA

SEQ ID NO: 1559982 - protein, 16 aa, Staphylococcus aureus
VTKEDEIEGLRGEDDA

SEQ ID NO: 1559983 - protein, 9 aa, Staphylococcus aureus
WTAKSSELI

SEQ ID NO: 1559984 - protein, 4 aa, Staphylococcus aureus
YARG

SEQ ID NO: 1559985 - protein, 10 aa, Staphylococcus aureus
YDEKEKQKAI

SEQ ID NO: 1559986 - protein, 12 aa, Staphylococcus aureus
YDKAKGQEYLKS

SEQ ID NO: 1559987 - protein, 8 aa, Staphylococcus aureus
YENEDKYD

SEQ ID NO: 1559988 - protein, 6 aa, Staphylococcus aureus
YGGPNM

SEQ ID NO: 1559989 - protein, 5 aa, Staphylococcus aureus
YGQDT

SEQ ID NO: 1559990 - protein, 12 aa, Staphylococcus aureus
YKNLGGEKQRNM

SEQ ID NO: 1559991 - protein, 6 aa, Staphylococcus aureus
YKTSFT

SEQ ID NO: 1559992 - protein, 15 aa, Staphylococcus aureus
YNVTDGTVNANGTPH

SEQ ID NO: 1559993 - protein, 6 aa, Staphylococcus aureus
YPGLEG

SEQ ID NO: 1559994 - protein, 8 aa, Staphylococcus aureus
YPLNPQST

SEQ ID NO: 1559995 - protein, 8 aa, Staphylococcus aureus
YQGDDSKI

SEQ ID NO: 1559996 - protein, 5 aa, Staphylococcus aureus
YQGHK

SEQ ID NO: 1559997 - protein, 13 aa, Staphylococcus aureus
YRDGKEKEINIKL

SEQ ID NO: 1559998 - protein, 7 aa, Staphylococcus aureus
AAAGGYG

SEQ ID NO: 1559999 - protein, 5 aa, Staphylococcus aureus
AAGNA

SEQ ID NO: 1560000 - protein, 4 aa, Staphylococcus aureus
AAKI

SEQ ID NO: 1560001 - protein, 8 aa, Staphylococcus aureus
AALYSGSN

SEQ ID NO: 1560002 - protein, 13 aa, Staphylococcus aureus
AANFDTKKADSIL

SEQ ID NO: 1560003 - protein, 16 aa, Staphylococcus aureus
AANSAEALDPQKTMPR

SEQ ID NO: 1560004 - protein, 5 aa, Staphylococcus aureus
AAQRA

SEQ ID NO: 1560005 - protein, 11 aa, Staphylococcus aureus
AASATNSGIYS

SEQ ID NO: 1560006 - protein, 6 aa, Staphylococcus aureus
AASGAF

SEQ ID NO: 1560007 - protein, 7 aa, Staphylococcus aureus
AATQAGG

SEQ ID NO: 1560008 - protein, 5 aa, Staphylococcus aureus
AATSG

SEQ ID NO: 1560009 - protein, 6 aa, Staphylococcus aureus
AATVGK

SEQ ID NO: 1560010 - protein, 8 aa, Staphylococcus aureus
ADKNYTEK

SEQ ID NO: 1560011 - protein, 9 aa, Staphylococcus aureus
ADLDKYAND

SEQ ID NO: 1560012 - protein, 5 aa, Staphylococcus aureus
ADSAT

SEQ ID NO: 1560013 - protein, 8 aa, Staphylococcus aureus
AFGGPASI

SEQ ID NO: 1560014 - protein, 9 aa, Staphylococcus aureus
AFSKANKSS

SEQ ID NO: 1560015 - protein, 6 aa, Staphylococcus aureus
AGDLGF

SEQ ID NO: 1560016 - protein, 13 aa, Staphylococcus aureus
AGESENPERAVPK

SEQ ID NO: 1560017 - protein, 4 aa, Staphylococcus aureus
AGFG

SEQ ID NO: 1560018 - protein, 6 aa, Staphylococcus aureus
AGGCSI

SEQ ID NO: 1560019 - protein, 8 aa, Staphylococcus aureus
AGKGGSNW

SEQ ID NO: 1560020 - protein, 5 aa, Staphylococcus aureus
AGSLS

SEQ ID NO: 1560021 - protein, 11 aa, Staphylococcus aureus
AGSRVGTGNIA

SEQ ID NO: 1560022 - protein, 6 aa, Staphylococcus aureus
AHKDGL

SEQ ID NO: 1560023 - protein, 6 aa, Staphylococcus aureus
AIGSGQ

SEQ ID NO: 1560024 - protein, 8 aa, Staphylococcus aureus
AIPETGGL

SEQ ID NO: 1560025 - protein, 4 aa, Staphylococcus aureus
AKRI

SEQ ID NO: 1560026 - protein, 10 aa, Staphylococcus aureus
AKSNASTQHY

SEQ ID NO: 1560027 - protein, 6 aa, Staphylococcus aureus
AKSPFE

SEQ ID NO: 1560028 - protein, 7 aa, Staphylococcus aureus
AKTGSLL

SEQ ID NO: 1560029 - protein, 8 aa, Staphylococcus aureus
AKTTQKKQ

SEQ ID NO: 1560030 - protein, 25 aa, Staphylococcus aureus
ALEEQEATFGRKRHSGAPLTGGKEF

SEQ ID NO: 1560031 - protein, 8 aa, Staphylococcus aureus
ALGSTEFT

SEQ ID NO: 1560032 - protein, 8 aa, Staphylococcus aureus
ALNGKADD

SEQ ID NO: 1560033 - protein, 9 aa, Staphylococcus aureus
AMGQGIAKA

SEQ ID NO: 1560034 - protein, 7 aa, Staphylococcus aureus
AMKNGQK

SEQ ID NO: 1560035 - protein, 10 aa, Staphylococcus aureus
ANAANPSSNV

SEQ ID NO: 1560036 - protein, 8 aa, Staphylococcus aureus
ANEQFNKT

SEQ ID NO: 1560037 - protein, 10 aa, Staphylococcus aureus
ANKGLKDNNT

SEQ ID NO: 1560038 - protein, 6 aa, Staphylococcus aureus
ANRQEI

SEQ ID NO: 1560039 - protein, 6 aa, Staphylococcus aureus
ANYQAK

SEQ ID NO: 1560040 - protein, 18 aa, Staphylococcus aureus
APETKAEPIKGMKAEAKK

SEQ ID NO: 1560041 - protein, 10 aa, Staphylococcus aureus
APKASHSDSI

SEQ ID NO: 1560042 - protein, 4 aa, Staphylococcus aureus
APKS

SEQ ID NO: 1560043 - protein, 6 aa, Staphylococcus aureus
APMYPS

SEQ ID NO: 1560044 - protein, 11 aa, Staphylococcus aureus
APYKKAKTLER

SEQ ID NO: 1560045 - protein, 11 aa, Staphylococcus aureus
ARAKSQTTNAL

SEQ ID NO: 1560046 - protein, 6 aa, Staphylococcus aureus
ASDRAR

SEQ ID NO: 1560047 - protein, 18 aa, Staphylococcus aureus
ASGVSDDAAKASNITEQT

SEQ ID NO: 1560048 - protein, 14 aa, Staphylococcus aureus
ASNYEDIKQDTDRL

SEQ ID NO: 1560049 - protein, 5 aa, Staphylococcus aureus
ASPFI

SEQ ID NO: 1560050 - protein, 8 aa, Staphylococcus aureus
ASSCNSGI

SEQ ID NO: 1560051 - protein, 5 aa, Staphylococcus aureus
ASSIG

SEQ ID NO: 1560052 - protein, 8 aa, Staphylococcus aureus
ASSNGKNL

SEQ ID NO: 1560053 - protein, 9 aa, Staphylococcus aureus
ASSNNGGLN

SEQ ID NO: 1560054 - protein, 7 aa, Staphylococcus aureus
ASSRAMK

SEQ ID NO: 1560055 - protein, 4 aa, Staphylococcus aureus
ASTS

SEQ ID NO: 1560056 - protein, 6 aa, Staphylococcus aureus
ATANNT

SEQ ID NO: 1560057 - protein, 8 aa, Staphylococcus aureus
ATEEAGAK

SEQ ID NO: 1560058 - protein, 6 aa, Staphylococcus aureus
ATKGRT

SEQ ID NO: 1560059 - protein, 15 aa, Staphylococcus aureus
ATQDPAMASTFGATA

SEQ ID NO: 1560060 - protein, 4 aa, Staphylococcus aureus
ATTT

SEQ ID NO: 1560061 - protein, 16 aa, Staphylococcus aureus
ATVGDKGRGNGPNGFR

SEQ ID NO: 1560062 - protein, 7 aa, Staphylococcus aureus
AVEKTAF

SEQ ID NO: 1560063 - protein, 5 aa, Staphylococcus aureus
AVTTP

SEQ ID NO: 1560064 - protein, 5 aa, Staphylococcus aureus
AYDAT

SEQ ID NO: 1560065 - protein, 16 aa, Staphylococcus aureus
AYEQRQNDSGHFRYDN

SEQ ID NO: 1560066 - protein, 5 aa, Staphylococcus aureus
CATGT

SEQ ID NO: 1560067 - protein, 4 aa, Staphylococcus aureus
DAHD

SEQ ID NO: 1560068 - protein, 7 aa, Staphylococcus aureus
DANQERK

SEQ ID NO: 1560069 - protein, 13 aa, Staphylococcus aureus
DDMTSGNYDNAQN

SEQ ID NO: 1560070 - protein, 8 aa, Staphylococcus aureus
DEFDDDEV

SEQ ID NO: 1560071 - protein, 5 aa, Staphylococcus aureus
DEQIG

SEQ ID NO: 1560072 - protein, 4 aa, Staphylococcus aureus
DEQM

SEQ ID NO: 1560073 - protein, 7 aa, Staphylococcus aureus
DESKAQQ

SEQ ID NO: 1560074 - protein, 7 aa, Staphylococcus aureus
DETEDEL

SEQ ID NO: 1560075 - protein, 5 aa, Staphylococcus aureus
DEYNE

SEQ ID NO: 1560076 - protein, 21 aa, Staphylococcus aureus
DFKKVNPSKYKYETGPKANSK

SEQ ID NO: 1560077 - protein, 5 aa, Staphylococcus aureus
DGNYV

SEQ ID NO: 1560078 - protein, 7 aa, Staphylococcus aureus
DGTNIES

SEQ ID NO: 1560079 - protein, 16 aa, Staphylococcus aureus
DGTVTAGTSAPLSDGA

SEQ ID NO: 1560080 - protein, 9 aa, Staphylococcus aureus
DGVNDAPAL

SEQ ID NO: 1560081 - protein, 7 aa, Staphylococcus aureus
DIATGLG

SEQ ID NO: 1560082 - protein, 12 aa, Staphylococcus aureus
DIKNGVGAQPIE

SEQ ID NO: 1560083 - protein, 11 aa, Staphylococcus aureus
DKDGGFRGGPA

SEQ ID NO: 1560084 - protein, 10 aa, Staphylococcus aureus
DKEKQDRYGR

SEQ ID NO: 1560085 - protein, 17 aa, Staphylococcus aureus
DKNKFKKVTEEISKKRD

SEQ ID NO: 1560086 - protein, 7 aa, Staphylococcus aureus
DKQEKLQ

SEQ ID NO: 1560087 - protein, 39 aa, Staphylococcus aureus
DKRERDINRDIDDAEQAKLNAQKLEEENKQKLKETQEEV

SEQ ID NO: 1560088 - protein, 7 aa, Staphylococcus aureus
DKSRPQT

SEQ ID NO: 1560089 - protein, 14 aa, Staphylococcus aureus
DKSRSRSQGGNGLG

SEQ ID NO: 1560090 - protein, 5 aa, Staphylococcus aureus
DLNSS

SEQ ID NO: 1560091 - protein, 25 aa, Staphylococcus aureus
DLTRAQDNKLSDNIKSKFGDTPQIN

SEQ ID NO: 1560092 - protein, 8 aa, Staphylococcus aureus
DNALTAAT

SEQ ID NO: 1560093 - protein, 9 aa, Staphylococcus aureus
DNKDSIKRD

SEQ ID NO: 1560094 - protein, 7 aa, Staphylococcus aureus
DPNHDGS

SEQ ID NO: 1560095 - protein, 7 aa, Staphylococcus aureus
DQSQDKS

SEQ ID NO: 1560096 - protein, 7 aa, Staphylococcus aureus
DQVRQPN

SEQ ID NO: 1560097 - protein, 10 aa, Staphylococcus aureus
DRDKSSRRLE

SEQ ID NO: 1560098 - protein, 5 aa, Staphylococcus aureus
DSDKI

SEQ ID NO: 1560099 - protein, 7 aa, Staphylococcus aureus
DSEDIDT

SEQ ID NO: 1560100 - protein, 5 aa, Staphylococcus aureus
DSIKS

SEQ ID NO: 1560101 - protein, 10 aa, Staphylococcus aureus
DSVPNVTTDV

SEQ ID NO: 1560102 - protein, 9 aa, Staphylococcus aureus
DTSNYGHSA

SEQ ID NO: 1560103 - protein, 6 aa, Staphylococcus aureus
DVKGSK

SEQ ID NO: 1560104 - protein, 6 aa, Staphylococcus aureus
DVPAQF

SEQ ID NO: 1560105 - protein, 7 aa, Staphylococcus aureus
DWGNTRT

SEQ ID NO: 1560106 - protein, 9 aa, Staphylococcus aureus
DYGDKRTCQ

SEQ ID NO: 1560107 - protein, 9 aa, Staphylococcus aureus
DYKTKPVNH

SEQ ID NO: 1560108 - protein, 13 aa, Staphylococcus aureus
DYNGANISGIASA

SEQ ID NO: 1560109 - protein, 6 aa, Staphylococcus aureus
DYTNPE

SEQ ID NO: 1560110 - protein, 11 aa, Staphylococcus aureus
DYYPEETDADK

SEQ ID NO: 1560111 - protein, 8 aa, Staphylococcus aureus
EADTGMRN

SEQ ID NO: 1560112 - protein, 9 aa, Staphylococcus aureus
EAKKDKDLK

SEQ ID NO: 1560113 - protein, 9 aa, Staphylococcus aureus
EANKAGLTI

SEQ ID NO: 1560114 - protein, 14 aa, Staphylococcus aureus
EAQVSQKEYKGFGG

SEQ ID NO: 1560115 - protein, 9 aa, Staphylococcus aureus
EDEAEAEDN

SEQ ID NO: 1560116 - protein, 5 aa, Staphylococcus aureus
EDEAN

SEQ ID NO: 1560117 - protein, 18 aa, Staphylococcus aureus
EDIERKTKEIISDIESKN

SEQ ID NO: 1560118 - protein, 14 aa, Staphylococcus aureus
EDPAIYQNKDGHLK

SEQ ID NO: 1560119 - protein, 12 aa, Staphylococcus aureus
EEANDKLANIND

SEQ ID NO: 1560120 - protein, 4 aa, Staphylococcus aureus
EEEG

SEQ ID NO: 1560121 - protein, 11 aa, Staphylococcus aureus
EEENEKSRRSK

SEQ ID NO: 1560122 - protein, 5 aa, Staphylococcus aureus
EEGDK

SEQ ID NO: 1560123 - protein, 10 aa, Staphylococcus aureus
EEIGNAASHG

SEQ ID NO: 1560124 - protein, 8 aa, Staphylococcus aureus
EEKLSKTD

SEQ ID NO: 1560125 - protein, 6 aa, Staphylococcus aureus
EERPIT

SEQ ID NO: 1560126 - protein, 5 aa, Staphylococcus aureus
EFNTS

SEQ ID NO: 1560127 - protein, 10 aa, Staphylococcus aureus
EGAWKDEELA

SEQ ID NO: 1560128 - protein, 6 aa, Staphylococcus aureus
EGDTSQ

SEQ ID NO: 1560129 - protein, 7 aa, Staphylococcus aureus
EGGKNQN

SEQ ID NO: 1560130 - protein, 8 aa, Staphylococcus aureus
EGKDGRLQ

SEQ ID NO: 1560131 - protein, 6 aa, Staphylococcus aureus
EGQITN

SEQ ID NO: 1560132 - protein, 10 aa, Staphylococcus aureus
EGSASASEVF

SEQ ID NO: 1560133 - protein, 6 aa, Staphylococcus aureus
EGSQVG

SEQ ID NO: 1560134 - protein, 6 aa, Staphylococcus aureus
EHAGPA

SEQ ID NO: 1560135 - protein, 6 aa, Staphylococcus aureus
EHLGSA

SEQ ID NO: 1560136 - protein, 7 aa, Staphylococcus aureus
EIQENND

SEQ ID NO: 1560137 - protein, 18 aa, Staphylococcus aureus
EITKPSETTVTEEMSDEP

SEQ ID NO: 1560138 - protein, 6 aa, Staphylococcus aureus
EKIEET

SEQ ID NO: 1560139 - protein, 6 aa, Staphylococcus aureus
EKQPVS

SEQ ID NO: 1560140 - protein, 5 aa, Staphylococcus aureus
EKTGY

SEQ ID NO: 1560141 - protein, 5 aa, Staphylococcus aureus
EKYAS

SEQ ID NO: 1560142 - protein, 7 aa, Staphylococcus aureus
EKYQTPE

SEQ ID NO: 1560143 - protein, 7 aa, Staphylococcus aureus
ELGGTDT

SEQ ID NO: 1560144 - protein, 8 aa, Staphylococcus aureus
EMQKKNDQ

SEQ ID NO: 1560145 - protein, 5 aa, Staphylococcus aureus
EMTPE

SEQ ID NO: 1560146 - protein, 9 aa, Staphylococcus aureus
ENEAGKSTI

SEQ ID NO: 1560147 - protein, 10 aa, Staphylococcus aureus
ENIRSGVEKS

SEQ ID NO: 1560148 - protein, 9 aa, Staphylococcus aureus
ENPDNISKT

SEQ ID NO: 1560149 - protein, 8 aa, Staphylococcus aureus
ENPGDMKG

SEQ ID NO: 1560150 - protein, 5 aa, Staphylococcus aureus
ENQKP

SEQ ID NO: 1560151 - protein, 5 aa, Staphylococcus aureus
ENSNE

SEQ ID NO: 1560152 - protein, 6 aa, Staphylococcus aureus
EPKDLT

SEQ ID NO: 1560153 - protein, 9 aa, Staphylococcus aureus
EPPFNGETA

SEQ ID NO: 1560154 - protein, 10 aa, Staphylococcus aureus
EQEPDTSDKI

SEQ ID NO: 1560155 - protein, 6 aa, Staphylococcus aureus
EQLNSP

SEQ ID NO: 1560156 - protein, 10 aa, Staphylococcus aureus
EQQEKQKRQK

SEQ ID NO: 1560157 - protein, 6 aa, Staphylococcus aureus
ERPQNL

SEQ ID NO: 1560158 - protein, 13 aa, Staphylococcus aureus
ERQAGATTDTFPG

SEQ ID NO: 1560159 - protein, 11 aa, Staphylococcus aureus
ERTGGSGNASS

SEQ ID NO: 1560160 - protein, 6 aa, Staphylococcus aureus
ERTTDL

SEQ ID NO: 1560161 - protein, 6 aa, Staphylococcus aureus
ESFNQQ

SEQ ID NO: 1560162 - protein, 8 aa, Staphylococcus aureus
ESNPGPGL

SEQ ID NO: 1560163 - protein, 5 aa, Staphylococcus aureus
ESQRK

SEQ ID NO: 1560164 - protein, 7 aa, Staphylococcus aureus
ESSGNQL

SEQ ID NO: 1560165 - protein, 10 aa, Staphylococcus aureus
ESTNDKVKTH

SEQ ID NO: 1560166 - protein, 4 aa, Staphylococcus aureus
ETGA

SEQ ID NO: 1560167 - protein, 5 aa, Staphylococcus aureus
ETGTH

SEQ ID NO: 1560168 - protein, 4 aa, Staphylococcus aureus
ETMK

SEQ ID NO: 1560169 - protein, 8 aa, Staphylococcus aureus
ETNEKYGF

SEQ ID NO: 1560170 - protein, 6 aa, Staphylococcus aureus
ETSDIS

SEQ ID NO: 1560171 - protein, 4 aa, Staphylococcus aureus
FATG

SEQ ID NO: 1560172 - protein, 12 aa, Staphylococcus aureus
FDQLPNKNYSEG

SEQ ID NO: 1560173 - protein, 14 aa, Staphylococcus aureus
FETPIKQTRKDEIG

SEQ ID NO: 1560174 - protein, 6 aa, Staphylococcus aureus
FGEGFN

SEQ ID NO: 1560175 - protein, 9 aa, Staphylococcus aureus
FKGTKEDDM

SEQ ID NO: 1560176 - protein, 7 aa, Staphylococcus aureus
FNETELE

SEQ ID NO: 1560177 - protein, 9 aa, Staphylococcus aureus
FNIPSGKEL

SEQ ID NO: 1560178 - protein, 5 aa, Staphylococcus aureus
FNPQE

SEQ ID NO: 1560179 - protein, 8 aa, Staphylococcus aureus
FNQKSPEI

SEQ ID NO: 1560180 - protein, 8 aa, Staphylococcus aureus
FNSSQTGY

SEQ ID NO: 1560181 - protein, 12 aa, Staphylococcus aureus
FSTSGKKRRGFR

SEQ ID NO: 1560182 - protein, 10 aa, Staphylococcus aureus
GAERNKTPNE

SEQ ID NO: 1560183 - protein, 7 aa, Staphylococcus aureus
GATPNAM

SEQ ID NO: 1560184 - protein, 10 aa, Staphylococcus aureus
GDKIKNPYGS

SEQ ID NO: 1560185 - protein, 4 aa, Staphylococcus aureus
GDLD

SEQ ID NO: 1560186 - protein, 10 aa, Staphylococcus aureus
GDNKNTAQAI

SEQ ID NO: 1560187 - protein, 7 aa, Staphylococcus aureus
GDTSHNL

SEQ ID NO: 1560188 - protein, 5 aa, Staphylococcus aureus
GEEDL

SEQ ID NO: 1560189 - protein, 8 aa, Staphylococcus aureus
GEKRGKLE

SEQ ID NO: 1560190 - protein, 10 aa, Staphylococcus aureus
GELKNPKRDL

SEQ ID NO: 1560191 - protein, 9 aa, Staphylococcus aureus
GESIPVEKN

SEQ ID NO: 1560192 - protein, 12 aa, Staphylococcus aureus
GEYDIKESNKIV

SEQ ID NO: 1560193 - protein, 7 aa, Staphylococcus aureus
GGAGEET

SEQ ID NO: 1560194 - protein, 5 aa, Staphylococcus aureus
GGASL

SEQ ID NO: 1560195 - protein, 7 aa, Staphylococcus aureus
GGASTIH

SEQ ID NO: 1560196 - protein, 17 aa, Staphylococcus aureus
GGATGYAINPARDLGPR

SEQ ID NO: 1560197 - protein, 13 aa, Staphylococcus aureus
GGETTSLIKATFG

SEQ ID NO: 1560198 - protein, 7 aa, Staphylococcus aureus
GGGAAKK

SEQ ID NO: 1560199 - protein, 7 aa, Staphylococcus aureus
GGGTSGL

SEQ ID NO: 1560200 - protein, 6 aa, Staphylococcus aureus
GGKAGG

SEQ ID NO: 1560201 - protein, 9 aa, Staphylococcus aureus
GGKAVATSA

SEQ ID NO: 1560202 - protein, 10 aa, Staphylococcus aureus
GGPPSTTYGE

SEQ ID NO: 1560203 - protein, 8 aa, Staphylococcus aureus
GHDKPTNL

SEQ ID NO: 1560204 - protein, 7 aa, Staphylococcus aureus
GHTDTKA

SEQ ID NO: 1560205 - protein, 5 aa, Staphylococcus aureus
GIASY

SEQ ID NO: 1560206 - protein, 5 aa, Staphylococcus aureus
GIKGK

SEQ ID NO: 1560207 - protein, 7 aa, Staphylococcus aureus
GIKRPEE

SEQ ID NO: 1560208 - protein, 6 aa, Staphylococcus aureus
GIPEED

SEQ ID NO: 1560209 - protein, 7 aa, Staphylococcus aureus
GKDRQRA

SEQ ID NO: 1560210 - protein, 7 aa, Staphylococcus aureus
GKKDTYY

SEQ ID NO: 1560211 - protein, 12 aa, Staphylococcus aureus
GKSGGINNEYAG

SEQ ID NO: 1560212 - protein, 9 aa, Staphylococcus aureus
GKTNKNGVP

SEQ ID NO: 1560213 - protein, 6 aa, Staphylococcus aureus
GLASGV

SEQ ID NO: 1560214 - protein, 18 aa, Staphylococcus aureus
GLPQGSAFSLKGDNTYQS

SEQ ID NO: 1560215 - protein, 7 aa, Staphylococcus aureus
GNAAPIT

SEQ ID NO: 1560216 - protein, 5 aa, Staphylococcus aureus
GNDEI

SEQ ID NO: 1560217 - protein, 10 aa, Staphylococcus aureus
GNKHSESTPH

SEQ ID NO: 1560218 - protein, 9 aa, Staphylococcus aureus
GNNHVSTSK

SEQ ID NO: 1560219 - protein, 6 aa, Staphylococcus aureus
GNPGKA

SEQ ID NO: 1560220 - protein, 4 aa, Staphylococcus aureus
GPFN

SEQ ID NO: 1560221 - protein, 5 aa, Staphylococcus aureus
GPTLS

SEQ ID NO: 1560222 - protein, 6 aa, Staphylococcus aureus
GQTDKF

SEQ ID NO: 1560223 - protein, 4 aa, Staphylococcus aureus
GSAV

SEQ ID NO: 1560224 - protein, 6 aa, Staphylococcus aureus
GSFSTY

SEQ ID NO: 1560225 - protein, 10 aa, Staphylococcus aureus
GSIKQDQYDK

SEQ ID NO: 1560226 - protein, 5 aa, Staphylococcus aureus
GSKAL

SEQ ID NO: 1560227 - protein, 8 aa, Staphylococcus aureus
GSSVKGGT

SEQ ID NO: 1560228 - protein, 12 aa, Staphylococcus aureus
GSTMNKNGTITM

SEQ ID NO: 1560229 - protein, 6 aa, Staphylococcus aureus
GSTTQP

SEQ ID NO: 1560230 - protein, 5 aa, Staphylococcus aureus
GTAVP

SEQ ID NO: 1560231 - protein, 4 aa, Staphylococcus aureus
GTFE

SEQ ID NO: 1560232 - protein, 4 aa, Staphylococcus aureus
GTGA

SEQ ID NO: 1560233 - protein, 6 aa, Staphylococcus aureus
GTGTEV

SEQ ID NO: 1560234 - protein, 5 aa, Staphylococcus aureus
GTIGG

SEQ ID NO: 1560235 - protein, 7 aa, Staphylococcus aureus
GTKESAG

SEQ ID NO: 1560236 - protein, 9 aa, Staphylococcus aureus
GTNATDGTT

SEQ ID NO: 1560237 - protein, 12 aa, Staphylococcus aureus
GTPEKVSQHSHR

SEQ ID NO: 1560238 - protein, 7 aa, Staphylococcus aureus
GTPLSAG

SEQ ID NO: 1560239 - protein, 5 aa, Staphylococcus aureus
GTPPN

SEQ ID NO: 1560240 - protein, 7 aa, Staphylococcus aureus
GTPSDVD

SEQ ID NO: 1560241 - protein, 22 aa, Staphylococcus aureus
GTTTTTSYIESTSGVAVGARTG

SEQ ID NO: 1560242 - protein, 8 aa, Staphylococcus aureus
GVGQAKAN

SEQ ID NO: 1560243 - protein, 5 aa, Staphylococcus aureus
GVNSK

SEQ ID NO: 1560244 - protein, 4 aa, Staphylococcus aureus
GVPE

SEQ ID NO: 1560245 - protein, 4 aa, Staphylococcus aureus
GVPL

SEQ ID NO: 1560246 - protein, 7 aa, Staphylococcus aureus
HAKSDVV

SEQ ID NO: 1560247 - protein, 19 aa, Staphylococcus aureus
HDPKLGAVTGNPRIRNKSS

SEQ ID NO: 1560248 - protein, 4 aa, Staphylococcus aureus
HERG

SEQ ID NO: 1560249 - protein, 11 aa, Staphylococcus aureus
HHDVDSSEAMK

SEQ ID NO: 1560250 - protein, 10 aa, Staphylococcus aureus
HKAGTQSAIN

SEQ ID NO: 1560251 - protein, 7 aa, Staphylococcus aureus
HKQGDYI

SEQ ID NO: 1560252 - protein, 9 aa, Staphylococcus aureus
HNRNPSSIE

SEQ ID NO: 1560253 - protein, 8 aa, Staphylococcus aureus
HPEAHKNS

SEQ ID NO: 1560254 - protein, 19 aa, Staphylococcus aureus
HPEIKKPLNKLENKISDED

SEQ ID NO: 1560255 - protein, 5 aa, Staphylococcus aureus
HRPDQ

SEQ ID NO: 1560256 - protein, 9 aa, Staphylococcus aureus
HRQQATTKQ

SEQ ID NO: 1560257 - protein, 7 aa, Staphylococcus aureus
HRSSNKQ

SEQ ID NO: 1560258 - protein, 4 aa, Staphylococcus aureus
HSEQ

SEQ ID NO: 1560259 - protein, 7 aa, Staphylococcus aureus
HYDPKKK

SEQ ID NO: 1560260 - protein, 5 aa, Staphylococcus aureus
IADRI

SEQ ID NO: 1560261 - protein, 8 aa, Staphylococcus aureus
IAKTRGLQ

SEQ ID NO: 1560262 - protein, 5 aa, Staphylococcus aureus
IDAVS

SEQ ID NO: 1560263 - protein, 6 aa, Staphylococcus aureus
IDPGEL

SEQ ID NO: 1560264 - protein, 7 aa, Staphylococcus aureus
IDPNSSP

SEQ ID NO: 1560265 - protein, 6 aa, Staphylococcus aureus
IEKGET

SEQ ID NO: 1560266 - protein, 5 aa, Staphylococcus aureus
IERQK

SEQ ID NO: 1560267 - protein, 6 aa, Staphylococcus aureus
IETDQN

SEQ ID NO: 1560268 - protein, 6 aa, Staphylococcus aureus
IGGPSK

SEQ ID NO: 1560269 - protein, 7 aa, Staphylococcus aureus
IKTPSDG

SEQ ID NO: 1560270 - protein, 6 aa, Staphylococcus aureus
INESTS

SEQ ID NO: 1560271 - protein, 7 aa, Staphylococcus aureus
INGQGGS

SEQ ID NO: 1560272 - protein, 4 aa, Staphylococcus aureus
INKS

SEQ ID NO: 1560273 - protein, 4 aa, Staphylococcus aureus
INTK

SEQ ID NO: 1560274 - protein, 4 aa, Staphylococcus aureus
IPSW

SEQ ID NO: 1560275 - protein, 8 aa, Staphylococcus aureus
ISENHNNA

SEQ ID NO: 1560276 - protein, 7 aa, Staphylococcus aureus
ISGENQI

SEQ ID NO: 1560277 - protein, 12 aa, Staphylococcus aureus
ISNWENDKSLPD

SEQ ID NO: 1560278 - protein, 10 aa, Staphylococcus aureus
ITGDPVAERI

SEQ ID NO: 1560279 - protein, 9 aa, Staphylococcus aureus
ITGKKNKAR

SEQ ID NO: 1560280 - protein, 5 aa, Staphylococcus aureus
KAGGI

SEQ ID NO: 1560281 - protein, 5 aa, Staphylococcus aureus
KAGIN

SEQ ID NO: 1560282 - protein, 12 aa, Staphylococcus aureus
KAKKQGMSLEND

SEQ ID NO: 1560283 - protein, 4 aa, Staphylococcus aureus
KANV

SEQ ID NO: 1560284 - protein, 7 aa, Staphylococcus aureus
KAPKNIT

SEQ ID NO: 1560285 - protein, 6 aa, Staphylococcus aureus
KAPTAE

SEQ ID NO: 1560286 - protein, 8 aa, Staphylococcus aureus
KAYTGATA

SEQ ID NO: 1560287 - protein, 11 aa, Staphylococcus aureus
KDAPESYEGSI

SEQ ID NO: 1560288 - protein, 8 aa, Staphylococcus aureus
KDDASGLA

SEQ ID NO: 1560289 - protein, 8 aa, Staphylococcus aureus
KDDDSAHF

SEQ ID NO: 1560290 - protein, 7 aa, Staphylococcus aureus
KDEQAKG

SEQ ID NO: 1560291 - protein, 29 aa, Staphylococcus aureus
KDFNNKKVGAQKGTEQEKIAQTEIENASI

SEQ ID NO: 1560292 - protein, 5 aa, Staphylococcus aureus
KDKFE

SEQ ID NO: 1560293 - protein, 5 aa, Staphylococcus aureus
KDNKY

SEQ ID NO: 1560294 - protein, 5 aa, Staphylococcus aureus
KDPSQ

SEQ ID NO: 1560295 - protein, 7 aa, Staphylococcus aureus
KDPYSEY

SEQ ID NO: 1560296 - protein, 7 aa, Staphylococcus aureus
KDSRIQS

SEQ ID NO: 1560297 - protein, 18 aa, Staphylococcus aureus
KDSTNSESGYNSHDNRSH

SEQ ID NO: 1560298 - protein, 10 aa, Staphylococcus aureus
KDVTDTERSR

SEQ ID NO: 1560299 - protein, 18 aa, Staphylococcus aureus
KDYEPEELESVVEHEIQS

SEQ ID NO: 1560300 - protein, 5 aa, Staphylococcus aureus
KEKNY

SEQ ID NO: 1560301 - protein, 8 aa, Staphylococcus aureus
KENNTNKA

SEQ ID NO: 1560302 - protein, 5 aa, Staphylococcus aureus
KENVG

SEQ ID NO: 1560303 - protein, 7 aa, Staphylococcus aureus
KESAVRR

SEQ ID NO: 1560304 - protein, 15 aa, Staphylococcus aureus
KESKETTHKDDEYIY

SEQ ID NO: 1560305 - protein, 7 aa, Staphylococcus aureus
KEVDATN

SEQ ID NO: 1560306 - protein, 7 aa, Staphylococcus aureus
KEVPPNI

SEQ ID NO: 1560307 - protein, 6 aa, Staphylococcus aureus
KEYKHA

SEQ ID NO: 1560308 - protein, 15 aa, Staphylococcus aureus
KFQSGKDAIKGITGR

SEQ ID NO: 1560309 - protein, 15 aa, Staphylococcus aureus
KGAKELSQAAKEPAH

SEQ ID NO: 1560310 - protein, 17 aa, Staphylococcus aureus
KGDSYKKEAQKKNPKFI

SEQ ID NO: 1560311 - protein, 13 aa, Staphylococcus aureus
KGDVNDISSEAQT

SEQ ID NO: 1560312 - protein, 20 aa, Staphylococcus aureus
KGIGDSVQTLNSSVDRVTNS

SEQ ID NO: 1560313 - protein, 8 aa, Staphylococcus aureus
KGLDSGTA

SEQ ID NO: 1560314 - protein, 5 aa, Staphylococcus aureus
KGRRL

SEQ ID NO: 1560315 - protein, 8 aa, Staphylococcus aureus
KGRSRRSE

SEQ ID NO: 1560316 - protein, 8 aa, Staphylococcus aureus
KGSAQGDV

SEQ ID NO: 1560317 - protein, 5 aa, Staphylococcus aureus
KHESS

SEQ ID NO: 1560318 - protein, 5 aa, Staphylococcus aureus
KHLPN

SEQ ID NO: 1560319 - protein, 7 aa, Staphylococcus aureus
KHPGTHQ

SEQ ID NO: 1560320 - protein, 8 aa, Staphylococcus aureus
KHTATTRR

SEQ ID NO: 1560321 - protein, 7 aa, Staphylococcus aureus
KIAKDNN

SEQ ID NO: 1560322 - protein, 7 aa, Staphylococcus aureus
KITPAKF

SEQ ID NO: 1560323 - protein, 5 aa, Staphylococcus aureus
KKEVQ

SEQ ID NO: 1560324 - protein, 6 aa, Staphylococcus aureus
KKGLYD

SEQ ID NO: 1560325 - protein, 9 aa, Staphylococcus aureus
KKITERDKK

SEQ ID NO: 1560326 - protein, 7 aa, Staphylococcus aureus
KKQGEYL

SEQ ID NO: 1560327 - protein, 13 aa, Staphylococcus aureus
KKQTAQRLGSQAT

SEQ ID NO: 1560328 - protein, 7 aa, Staphylococcus aureus
KKSIVGD

SEQ ID NO: 1560329 - protein, 9 aa, Staphylococcus aureus
KKSKNGRVS

SEQ ID NO: 1560330 - protein, 5 aa, Staphylococcus aureus
KKVVA

SEQ ID NO: 1560331 - protein, 9 aa, Staphylococcus aureus
KLDSSLSSF

SEQ ID NO: 1560332 - protein, 11 aa, Staphylococcus aureus
KLRSQGAKDMD

SEQ ID NO: 1560333 - protein, 8 aa, Staphylococcus aureus
KLTATEKA

SEQ ID NO: 1560334 - protein, 13 aa, Staphylococcus aureus
KLTDRAIKQTPNA

SEQ ID NO: 1560335 - protein, 19 aa, Staphylococcus aureus
KLTEANNALKNNASQGKIE

SEQ ID NO: 1560336 - protein, 16 aa, Staphylococcus aureus
KNDDDNPTTEKPPKRS

SEQ ID NO: 1560337 - protein, 7 aa, Staphylococcus aureus
KNDPPKV

SEQ ID NO: 1560338 - protein, 6 aa, Staphylococcus aureus
KNDSRM

SEQ ID NO: 1560339 - protein, 10 aa, Staphylococcus aureus
KNGKNRKDKL

SEQ ID NO: 1560340 - protein, 5 aa, Staphylococcus aureus
KNGYT

SEQ ID NO: 1560341 - protein, 28 aa, Staphylococcus aureus
KNIGADLQTEQALADKNIAQAKAEERRA

SEQ ID NO: 1560342 - protein, 18 aa, Staphylococcus aureus
KNPAIKDKDHSAPNSRPI

SEQ ID NO: 1560343 - protein, 7 aa, Staphylococcus aureus
KNPPINE

SEQ ID NO: 1560344 - protein, 13 aa, Staphylococcus aureus
KNQPQAKKALSDL

SEQ ID NO: 1560345 - protein, 7 aa, Staphylococcus aureus
KNRTRIP

SEQ ID NO: 1560346 - protein, 8 aa, Staphylococcus aureus
KNSRYGIA

SEQ ID NO: 1560347 - protein, 6 aa, Staphylococcus aureus
KNSTYR

SEQ ID NO: 1560348 - protein, 7 aa, Staphylococcus aureus
KNTEKHR

SEQ ID NO: 1560349 - protein, 9 aa, Staphylococcus aureus
KPGDTVNDI

SEQ ID NO: 1560350 - protein, 6 aa, Staphylococcus aureus
KPITDM

SEQ ID NO: 1560351 - protein, 7 aa, Staphylococcus aureus
KPKNNSF

SEQ ID NO: 1560352 - protein, 10 aa, Staphylococcus aureus
KQDSHNLKQR

SEQ ID NO: 1560353 - protein, 6 aa, Staphylococcus aureus
KQISAS

SEQ ID NO: 1560354 - protein, 4 aa, Staphylococcus aureus
KRGI

SEQ ID NO: 1560355 - protein, 6 aa, Staphylococcus aureus
KRIRPE

SEQ ID NO: 1560356 - protein, 6 aa, Staphylococcus aureus
KRKELN

SEQ ID NO: 1560357 - protein, 8 aa, Staphylococcus aureus
KRREEIAT

SEQ ID NO: 1560358 - protein, 8 aa, Staphylococcus aureus
KRSAANGA

SEQ ID NO: 1560359 - protein, 17 aa, Staphylococcus aureus
KRVQEAQANTESEKRRL

SEQ ID NO: 1560360 - protein, 9 aa, Staphylococcus aureus
KSAVRYSEV

SEQ ID NO: 1560361 - protein, 6 aa, Staphylococcus aureus
KSGRAV

SEQ ID NO: 1560362 - protein, 9 aa, Staphylococcus aureus
KSPYRPKGK

SEQ ID NO: 1560363 - protein, 8 aa, Staphylococcus aureus
KSRNHSDS

SEQ ID NO: 1560364 - protein, 7 aa, Staphylococcus aureus
KSSSDLA

SEQ ID NO: 1560365 - protein, 9 aa, Staphylococcus aureus
KTAQTVTDL

SEQ ID NO: 1560366 - protein, 4 aa, Staphylococcus aureus
KTFQ

SEQ ID NO: 1560367 - protein, 7 aa, Staphylococcus aureus
KTNAEKL

SEQ ID NO: 1560368 - protein, 12 aa, Staphylococcus aureus
KTNNDIDMKRRQ

SEQ ID NO: 1560369 - protein, 16 aa, Staphylococcus aureus
KTPGREDEETEIRNSS

SEQ ID NO: 1560370 - protein, 6 aa, Staphylococcus aureus
KTQGAE

SEQ ID NO: 1560371 - protein, 10 aa, Staphylococcus aureus
KTSDSLSDDA

SEQ ID NO: 1560372 - protein, 4 aa, Staphylococcus aureus
KTTY

SEQ ID NO: 1560373 - protein, 19 aa, Staphylococcus aureus
KTVESQESEAKDSKETYDT

SEQ ID NO: 1560374 - protein, 5 aa, Staphylococcus aureus
KVPEG

SEQ ID NO: 1560375 - protein, 5 aa, Staphylococcus aureus
KYDKR

SEQ ID NO: 1560376 - protein, 5 aa, Staphylococcus aureus
KYEAD

SEQ ID NO: 1560377 - protein, 7 aa, Staphylococcus aureus
KYPYGDT

SEQ ID NO: 1560378 - protein, 8 aa, Staphylococcus aureus
KYSRGDKR

SEQ ID NO: 1560379 - protein, 7 aa, Staphylococcus aureus
LAGGDGV

SEQ ID NO: 1560380 - protein, 6 aa, Staphylococcus aureus
LDKYNA

SEQ ID NO: 1560381 - protein, 20 aa, Staphylococcus aureus
LDPTTRHRKNQSNHRPQSIN

SEQ ID NO: 1560382 - protein, 14 aa, Staphylococcus aureus
LETRAEKLKEVERR

SEQ ID NO: 1560383 - protein, 11 aa, Staphylococcus aureus
LGEEGEDPEFS

SEQ ID NO: 1560384 - protein, 6 aa, Staphylococcus aureus
LGGNDS

SEQ ID NO: 1560385 - protein, 6 aa, Staphylococcus aureus
LGPAAQ

SEQ ID NO: 1560386 - protein, 15 aa, Staphylococcus aureus
LKAKNERQSDNPEFK

SEQ ID NO: 1560387 - protein, 15 aa, Staphylococcus aureus
LKDPQDVAAETKARS

SEQ ID NO: 1560388 - protein, 15 aa, Staphylococcus aureus
LKEEATQLEPVKQSD

SEQ ID NO: 1560389 - protein, 10 aa, Staphylococcus aureus
LKESELEEDI

SEQ ID NO: 1560390 - protein, 8 aa, Staphylococcus aureus
LKKQADKM

SEQ ID NO: 1560391 - protein, 13 aa, Staphylococcus aureus
LKPQHSDDTFKDY

SEQ ID NO: 1560392 - protein, 20 aa, Staphylococcus aureus
LKRKKGGYATWSSPDRGNTQ

SEQ ID NO: 1560393 - protein, 10 aa, Staphylococcus aureus
LKSEQSQQAI

SEQ ID NO: 1560394 - protein, 6 aa, Staphylococcus aureus
LNGEGF

SEQ ID NO: 1560395 - protein, 6 aa, Staphylococcus aureus
LPGGQT

SEQ ID NO: 1560396 - protein, 6 aa, Staphylococcus aureus
LQEKEN

SEQ ID NO: 1560397 - protein, 6 aa, Staphylococcus aureus
LQGEKG

SEQ ID NO: 1560398 - protein, 8 aa, Staphylococcus aureus
LQSPKSQR

SEQ ID NO: 1560399 - protein, 6 aa, Staphylococcus aureus
LQSSNV

SEQ ID NO: 1560400 - protein, 10 aa, Staphylococcus aureus
LRKQPQKADV

SEQ ID NO: 1560401 - protein, 11 aa, Staphylococcus aureus
LSEEKPRNSNK

SEQ ID NO: 1560402 - protein, 9 aa, Staphylococcus aureus
LSETSLTQT

SEQ ID NO: 1560403 - protein, 13 aa, Staphylococcus aureus
LSKKYDASINSKS

SEQ ID NO: 1560404 - protein, 10 aa, Staphylococcus aureus
LSPISKDETV

SEQ ID NO: 1560405 - protein, 5 aa, Staphylococcus aureus
LTKDQ

SEQ ID NO: 1560406 - protein, 4 aa, Staphylococcus aureus
LTSV

SEQ ID NO: 1560407 - protein, 6 aa, Staphylococcus aureus
LTTSDD

SEQ ID NO: 1560408 - protein, 4 aa, Staphylococcus aureus
MAGN

SEQ ID NO: 1560409 - protein, 9 aa, Staphylococcus aureus
MDNESDQIN

SEQ ID NO: 1560410 - protein, 4 aa, Staphylococcus aureus
MDNP

SEQ ID NO: 1560411 - protein, 8 aa, Staphylococcus aureus
MGGGQYSA

SEQ ID NO: 1560412 - protein, 7 aa, Staphylococcus aureus
MGGKENI

SEQ ID NO: 1560413 - protein, 9 aa, Staphylococcus aureus
MNDETRQSL

SEQ ID NO: 1560414 - protein, 6 aa, Staphylococcus aureus
MSEAAR

SEQ ID NO: 1560415 - protein, 6 aa, Staphylococcus aureus
MSGDPT

SEQ ID NO: 1560416 - protein, 8 aa, Staphylococcus aureus
NAENTKLV

SEQ ID NO: 1560417 - protein, 16 aa, Staphylococcus aureus
NAERFNRNEEIKDPKA

SEQ ID NO: 1560418 - protein, 9 aa, Staphylococcus aureus
NAKDKKQAI

SEQ ID NO: 1560419 - protein, 14 aa, Staphylococcus aureus
NANSTTEIYNLLMK

SEQ ID NO: 1560420 - protein, 8 aa, Staphylococcus aureus
NAPAETST

SEQ ID NO: 1560421 - protein, 18 aa, Staphylococcus aureus
NAQITKQSLETLTSQNVK

SEQ ID NO: 1560422 - protein, 6 aa, Staphylococcus aureus
NAQKNV

SEQ ID NO: 1560423 - protein, 8 aa, Staphylococcus aureus
NARPERKK

SEQ ID NO: 1560424 - protein, 17 aa, Staphylococcus aureus
NDAKGRHDELQSTVENV

SEQ ID NO: 1560425 - protein, 8 aa, Staphylococcus aureus
NDDDINRK

SEQ ID NO: 1560426 - protein, 5 aa, Staphylococcus aureus
NDELY

SEQ ID NO: 1560427 - protein, 11 aa, Staphylococcus aureus
NDGSPISPQAE

SEQ ID NO: 1560428 - protein, 7 aa, Staphylococcus aureus
NDNEAPI

SEQ ID NO: 1560429 - protein, 6 aa, Staphylococcus aureus
NDQQLS

SEQ ID NO: 1560430 - protein, 9 aa, Staphylococcus aureus
NDRKQNPNV

SEQ ID NO: 1560431 - protein, 21 aa, Staphylococcus aureus
NEAGMGSAPNAAATAAVPHPV

SEQ ID NO: 1560432 - protein, 10 aa, Staphylococcus aureus
NEKGRASSAL

SEQ ID NO: 1560433 - protein, 8 aa, Staphylococcus aureus
NEKPQPAQ

SEQ ID NO: 1560434 - protein, 5 aa, Staphylococcus aureus
NENPA

SEQ ID NO: 1560435 - protein, 7 aa, Staphylococcus aureus
NEPERDE

SEQ ID NO: 1560436 - protein, 7 aa, Staphylococcus aureus
NEQFSER

SEQ ID NO: 1560437 - protein, 10 aa, Staphylococcus aureus
NESDAQSVRQ

SEQ ID NO: 1560438 - protein, 10 aa, Staphylococcus aureus
NEYTQERNKL

SEQ ID NO: 1560439 - protein, 6 aa, Staphylococcus aureus
NFSGNA

SEQ ID NO: 1560440 - protein, 7 aa, Staphylococcus aureus
NGQNETI

SEQ ID NO: 1560441 - protein, 5 aa, Staphylococcus aureus
NGSRN

SEQ ID NO: 1560442 - protein, 15 aa, Staphylococcus aureus
NIAPGENDIKQSKYH

SEQ ID NO: 1560443 - protein, 10 aa, Staphylococcus aureus
NISQNEDKIS

SEQ ID NO: 1560444 - protein, 5 aa, Staphylococcus aureus
NITQY

SEQ ID NO: 1560445 - protein, 7 aa, Staphylococcus aureus
NKAAEEY

SEQ ID NO: 1560446 - protein, 8 aa, Staphylococcus aureus
NKLPRAGR

SEQ ID NO: 1560447 - protein, 10 aa, Staphylococcus aureus
NKNGKTTDLN

SEQ ID NO: 1560448 - protein, 8 aa, Staphylococcus aureus
NKRHDINE

SEQ ID NO: 1560449 - protein, 13 aa, Staphylococcus aureus
NKRTDQSDDESPE

SEQ ID NO: 1560450 - protein, 9 aa, Staphylococcus aureus
NKSKTSVAS

SEQ ID NO: 1560451 - protein, 8 aa, Staphylococcus aureus
NKTNSHGV

SEQ ID NO: 1560452 - protein, 8 aa, Staphylococcus aureus
NLDGDEAM

SEQ ID NO: 1560453 - protein, 8 aa, Staphylococcus aureus
NLRNGGAN

SEQ ID NO: 1560454 - protein, 8 aa, Staphylococcus aureus
NLTTEQAK

SEQ ID NO: 1560455 - protein, 18 aa, Staphylococcus aureus
NNLDTQAKAAQKDSQALR

SEQ ID NO: 1560456 - protein, 6 aa, Staphylococcus aureus
NNPGGL

SEQ ID NO: 1560457 - protein, 8 aa, Staphylococcus aureus
NNQGLTSK

SEQ ID NO: 1560458 - protein, 5 aa, Staphylococcus aureus
NPAGS

SEQ ID NO: 1560459 - protein, 12 aa, Staphylococcus aureus
NPDAQTDAMSEE

SEQ ID NO: 1560460 - protein, 9 aa, Staphylococcus aureus
NPGTGDSVV

SEQ ID NO: 1560461 - protein, 6 aa, Staphylococcus aureus
NPKNGD

SEQ ID NO: 1560462 - protein, 6 aa, Staphylococcus aureus
NPPYGD

SEQ ID NO: 1560463 - protein, 12 aa, Staphylococcus aureus
NQASHSTRLNET

SEQ ID NO: 1560464 - protein, 19 aa, Staphylococcus aureus
NQASSVGNLSQTMNSNYDA

SEQ ID NO: 1560465 - protein, 11 aa, Staphylococcus aureus
NQKANDSSVQK

SEQ ID NO: 1560466 - protein, 6 aa, Staphylococcus aureus
NQLPKD

SEQ ID NO: 1560467 - protein, 7 aa, Staphylococcus aureus
NREKIKD

SEQ ID NO: 1560468 - protein, 29 aa, Staphylococcus aureus
NRHYRRGSANYKANNVATDANHSYTSRVD

SEQ ID NO: 1560469 - protein, 4 aa, Staphylococcus aureus
NRIE

SEQ ID NO: 1560470 - protein, 18 aa, Staphylococcus aureus
NRYRKDYSNVDKSLNEAE

SEQ ID NO: 1560471 - protein, 10 aa, Staphylococcus aureus
NSKSEGMTEW

SEQ ID NO: 1560472 - protein, 6 aa, Staphylococcus aureus
NSNDYT

SEQ ID NO: 1560473 - protein, 5 aa, Staphylococcus aureus
NSPRY

SEQ ID NO: 1560474 - protein, 12 aa, Staphylococcus aureus
NSVKTKVQGLND

SEQ ID NO: 1560475 - protein, 4 aa, Staphylococcus aureus
NTDI

SEQ ID NO: 1560476 - protein, 6 aa, Staphylococcus aureus
NTNYEE

SEQ ID NO: 1560477 - protein, 12 aa, Staphylococcus aureus
NVKSDLSQTYDQ

SEQ ID NO: 1560478 - protein, 7 aa, Staphylococcus aureus
NYPNNRT

SEQ ID NO: 1560479 - protein, 6 aa, Staphylococcus aureus
PATGLD

SEQ ID NO: 1560480 - protein, 11 aa, Staphylococcus aureus
PATPSNTARAG

SEQ ID NO: 1560481 - protein, 5 aa, Staphylococcus aureus
PATSS

SEQ ID NO: 1560482 - protein, 5 aa, Staphylococcus aureus
PDGDT

SEQ ID NO: 1560483 - protein, 11 aa, Staphylococcus aureus
PDIPIKNQKNN

SEQ ID NO: 1560484 - protein, 9 aa, Staphylococcus aureus
PEEHRSEGV

SEQ ID NO: 1560485 - protein, 14 aa, Staphylococcus aureus
PEETFEKKKEYSQQ

SEQ ID NO: 1560486 - protein, 7 aa, Staphylococcus aureus
PENDRRM

SEQ ID NO: 1560487 - protein, 9 aa, Staphylococcus aureus
PEQVSSEYG

SEQ ID NO: 1560488 - protein, 8 aa, Staphylococcus aureus
PGEKIPVD

SEQ ID NO: 1560489 - protein, 10 aa, Staphylococcus aureus
PHGKEPADYT

SEQ ID NO: 1560490 - protein, 5 aa, Staphylococcus aureus
PINKK

SEQ ID NO: 1560491 - protein, 10 aa, Staphylococcus aureus
PISDSTGRRK

SEQ ID NO: 1560492 - protein, 8 aa, Staphylococcus aureus
PLAEPSKG

SEQ ID NO: 1560493 - protein, 12 aa, Staphylococcus aureus
PLPTTHKALNSR

SEQ ID NO: 1560494 - protein, 7 aa, Staphylococcus aureus
PLSAAGG

SEQ ID NO: 1560495 - protein, 5 aa, Staphylococcus aureus
PNVKT

SEQ ID NO: 1560496 - protein, 6 aa, Staphylococcus aureus
PPHPGP

SEQ ID NO: 1560497 - protein, 12 aa, Staphylococcus aureus
PPNGAKSMSDEA

SEQ ID NO: 1560498 - protein, 9 aa, Staphylococcus aureus
PREKEETLK

SEQ ID NO: 1560499 - protein, 17 aa, Staphylococcus aureus
PREYETRKISDSDNVTE

SEQ ID NO: 1560500 - protein, 18 aa, Staphylococcus aureus
PRISSKDKLRSVKKGVVQ

SEQ ID NO: 1560501 - protein, 6 aa, Staphylococcus aureus
PTHYTN

SEQ ID NO: 1560502 - protein, 37 aa, Staphylococcus aureus
PTLADAAKPNNVKPVQPKPAQPKTPTEQTKPVQPKVE

SEQ ID NO: 1560503 - protein, 4 aa, Staphylococcus aureus
PTPV

SEQ ID NO: 1560504 - protein, 10 aa, Staphylococcus aureus
PTTALDKQNS

SEQ ID NO: 1560505 - protein, 10 aa, Staphylococcus aureus
PTTGNSGNGF

SEQ ID NO: 1560506 - protein, 5 aa, Staphylococcus aureus
PVKDI

SEQ ID NO: 1560507 - protein, 9 aa, Staphylococcus aureus
PVNKKAETT

SEQ ID NO: 1560508 - protein, 5 aa, Staphylococcus aureus
PVSST

SEQ ID NO: 1560509 - protein, 12 aa, Staphylococcus aureus
PYGKQGLQALSG

SEQ ID NO: 1560510 - protein, 11 aa, Staphylococcus aureus
QDEIPSNQAEW

SEQ ID NO: 1560511 - protein, 7 aa, Staphylococcus aureus
QEVASTT

SEQ ID NO: 1560512 - protein, 12 aa, Staphylococcus aureus
QFGSGNTGATNS

SEQ ID NO: 1560513 - protein, 6 aa, Staphylococcus aureus
QGGINA

SEQ ID NO: 1560514 - protein, 6 aa, Staphylococcus aureus
QGLGRE

SEQ ID NO: 1560515 - protein, 5 aa, Staphylococcus aureus
QGLTQ

SEQ ID NO: 1560516 - protein, 8 aa, Staphylococcus aureus
QKQGYKSD

SEQ ID NO: 1560517 - protein, 13 aa, Staphylococcus aureus
QLAPDGKQGQYQG

SEQ ID NO: 1560518 - protein, 4 aa, Staphylococcus aureus
QLDE

SEQ ID NO: 1560519 - protein, 7 aa, Staphylococcus aureus
QLDSPSM

SEQ ID NO: 1560520 - protein, 8 aa, Staphylococcus aureus
QLKKSPKH

SEQ ID NO: 1560521 - protein, 5 aa, Staphylococcus aureus
QMPDK

SEQ ID NO: 1560522 - protein, 8 aa, Staphylococcus aureus
QNAKHTYS

SEQ ID NO: 1560523 - protein, 8 aa, Staphylococcus aureus
QNDDKRSL

SEQ ID NO: 1560524 - protein, 6 aa, Staphylococcus aureus
QNETPH

SEQ ID NO: 1560525 - protein, 9 aa, Staphylococcus aureus
QNGEPRVNS

SEQ ID NO: 1560526 - protein, 6 aa, Staphylococcus aureus
QNGSIS

SEQ ID NO: 1560527 - protein, 13 aa, Staphylococcus aureus
QNKAKQQKLNIWS

SEQ ID NO: 1560528 - protein, 13 aa, Staphylococcus aureus
QNNQGTWQANHTS

SEQ ID NO: 1560529 - protein, 6 aa, Staphylococcus aureus
QNRTLQ

SEQ ID NO: 1560530 - protein, 8 aa, Staphylococcus aureus
QPKGYDLN

SEQ ID NO: 1560531 - protein, 7 aa, Staphylococcus aureus
QPVPPPW

SEQ ID NO: 1560532 - protein, 4 aa, Staphylococcus aureus
QQEH

SEQ ID NO: 1560533 - protein, 9 aa, Staphylococcus aureus
QQENEIKNK

SEQ ID NO: 1560534 - protein, 11 aa, Staphylococcus aureus
QQKKEKTKKQY

SEQ ID NO: 1560535 - protein, 11 aa, Staphylococcus aureus
QRGSEEKDVKI

SEQ ID NO: 1560536 - protein, 8 aa, Staphylococcus aureus
QRKDPSGV

SEQ ID NO: 1560537 - protein, 10 aa, Staphylococcus aureus
QSDKSEKAYK

SEQ ID NO: 1560538 - protein, 5 aa, Staphylococcus aureus
QSGHG

SEQ ID NO: 1560539 - protein, 8 aa, Staphylococcus aureus
QSKEDVDA

SEQ ID NO: 1560540 - protein, 5 aa, Staphylococcus aureus
QSPFT

SEQ ID NO: 1560541 - protein, 8 aa, Staphylococcus aureus
QSSYADST

SEQ ID NO: 1560542 - protein, 5 aa, Staphylococcus aureus
QTETT

SEQ ID NO: 1560543 - protein, 7 aa, Staphylococcus aureus
QTISLTG

SEQ ID NO: 1560544 - protein, 8 aa, Staphylococcus aureus
QTPHGEGY

SEQ ID NO: 1560545 - protein, 13 aa, Staphylococcus aureus
QTRVNSASSLSVT

SEQ ID NO: 1560546 - protein, 9 aa, Staphylococcus aureus
QTTREFKDG

SEQ ID NO: 1560547 - protein, 8 aa, Staphylococcus aureus
QTTTSNAQ

SEQ ID NO: 1560548 - protein, 6 aa, Staphylococcus aureus
RDEPNV

SEQ ID NO: 1560549 - protein, 6 aa, Staphylococcus aureus
RDYEGR

SEQ ID NO: 1560550 - protein, 5 aa, Staphylococcus aureus
REKDN

SEQ ID NO: 1560551 - protein, 4 aa, Staphylococcus aureus
RFSS

SEQ ID NO: 1560552 - protein, 8 aa, Staphylococcus aureus
RGKFTDRA

SEQ ID NO: 1560553 - protein, 31 aa, Staphylococcus aureus
RGKKKEMKYTTDKSGKVTSSEVLNPGARGQD

SEQ ID NO: 1560554 - protein, 6 aa, Staphylococcus aureus
RGQEIS

SEQ ID NO: 1560555 - protein, 7 aa, Staphylococcus aureus
RGYSGAT

SEQ ID NO: 1560556 - protein, 14 aa, Staphylococcus aureus
RHSKKNDVAEYHPP

SEQ ID NO: 1560557 - protein, 6 aa, Staphylococcus aureus
RKDEYA

SEQ ID NO: 1560558 - protein, 15 aa, Staphylococcus aureus
RKNRGEKIDDPLTDR

SEQ ID NO: 1560559 - protein, 6 aa, Staphylococcus aureus
RNKQNK

SEQ ID NO: 1560560 - protein, 7 aa, Staphylococcus aureus
RNPLASP

SEQ ID NO: 1560561 - protein, 14 aa, Staphylococcus aureus
RPETLEDGKKGISP

SEQ ID NO: 1560562 - protein, 12 aa, Staphylococcus aureus
RPSRQRKNDESI

SEQ ID NO: 1560563 - protein, 9 aa, Staphylococcus aureus
RPTATDEEV

SEQ ID NO: 1560564 - protein, 6 aa, Staphylococcus aureus
RQRPAS

SEQ ID NO: 1560565 - protein, 6 aa, Staphylococcus aureus
RSEARR

SEQ ID NO: 1560566 - protein, 5 aa, Staphylococcus aureus
RSGNI

SEQ ID NO: 1560567 - protein, 10 aa, Staphylococcus aureus
RSKQGKCGTC

SEQ ID NO: 1560568 - protein, 6 aa, Staphylococcus aureus
RSSKSN

SEQ ID NO: 1560569 - protein, 8 aa, Staphylococcus aureus
RTKVGNDF

SEQ ID NO: 1560570 - protein, 5 aa, Staphylococcus aureus
RTPLT

SEQ ID NO: 1560571 - protein, 13 aa, Staphylococcus aureus
RTSISKTNGKDAV

SEQ ID NO: 1560572 - protein, 8 aa, Staphylococcus aureus
RVNFSGDE

SEQ ID NO: 1560573 - protein, 6 aa, Staphylococcus aureus
SAEMKS

SEQ ID NO: 1560574 - protein, 9 aa, Staphylococcus aureus
SANPPLYDS

SEQ ID NO: 1560575 - protein, 7 aa, Staphylococcus aureus
SAQAING

SEQ ID NO: 1560576 - protein, 8 aa, Staphylococcus aureus
SASEDTIT

SEQ ID NO: 1560577 - protein, 8 aa, Staphylococcus aureus
SAYTSQSL

SEQ ID NO: 1560578 - protein, 10 aa, Staphylococcus aureus
SDKPSDFRES

SEQ ID NO: 1560579 - protein, 5 aa, Staphylococcus aureus
SDYTD

SEQ ID NO: 1560580 - protein, 7 aa, Staphylococcus aureus
SEHKDNK

SEQ ID NO: 1560581 - protein, 15 aa, Staphylococcus aureus
SEHKSNQPKRETTQV

SEQ ID NO: 1560582 - protein, 12 aa, Staphylococcus aureus
SEINKGTTFKII

SEQ ID NO: 1560583 - protein, 5 aa, Staphylococcus aureus
SEINS

SEQ ID NO: 1560584 - protein, 5 aa, Staphylococcus aureus
SEIQN

SEQ ID NO: 1560585 - protein, 5 aa, Staphylococcus aureus
SELSP

SEQ ID NO: 1560586 - protein, 12 aa, Staphylococcus aureus
SEPKIQVEEPNR

SEQ ID NO: 1560587 - protein, 5 aa, Staphylococcus aureus
SERYY

SEQ ID NO: 1560588 - protein, 9 aa, Staphylococcus aureus
SGATKGMTP

SEQ ID NO: 1560589 - protein, 7 aa, Staphylococcus aureus
SGGGKST

SEQ ID NO: 1560590 - protein, 6 aa, Staphylococcus aureus
SGITNY

SEQ ID NO: 1560591 - protein, 5 aa, Staphylococcus aureus
SGQKI

SEQ ID NO: 1560592 - protein, 8 aa, Staphylococcus aureus
SHRNNGAA

SEQ ID NO: 1560593 - protein, 9 aa, Staphylococcus aureus
SIENEKERL

SEQ ID NO: 1560594 - protein, 6 aa, Staphylococcus aureus
SIGTPT

SEQ ID NO: 1560595 - protein, 6 aa, Staphylococcus aureus
SITNPI

SEQ ID NO: 1560596 - protein, 7 aa, Staphylococcus aureus
SKAHPDL

SEQ ID NO: 1560597 - protein, 9 aa, Staphylococcus aureus
SKDDGKTFY

SEQ ID NO: 1560598 - protein, 5 aa, Staphylococcus aureus
SKDKY

SEQ ID NO: 1560599 - protein, 6 aa, Staphylococcus aureus
SKDSKL

SEQ ID NO: 1560600 - protein, 6 aa, Staphylococcus aureus
SKGRTI

SEQ ID NO: 1560601 - protein, 7 aa, Staphylococcus aureus
SKKEEVY

SEQ ID NO: 1560602 - protein, 46 aa, Staphylococcus aureus
SKKKVKRQTEEKYEQQEQNIKKSHEEALEKERIQNKKTITKQQEDY

SEQ ID NO: 1560603 - protein, 6 aa, Staphylococcus aureus
SKKTYQ

SEQ ID NO: 1560604 - protein, 10 aa, Staphylococcus aureus
SKLTDTGSSV

SEQ ID NO: 1560605 - protein, 19 aa, Staphylococcus aureus
SKLTGEDEETAKENGITNQ

SEQ ID NO: 1560606 - protein, 5 aa, Staphylococcus aureus
SKNAL

SEQ ID NO: 1560607 - protein, 11 aa, Staphylococcus aureus
SKQAFDASDSL

SEQ ID NO: 1560608 - protein, 9 aa, Staphylococcus aureus
SKQAITQQK

SEQ ID NO: 1560609 - protein, 10 aa, Staphylococcus aureus
SKRNKAIGRA

SEQ ID NO: 1560610 - protein, 5 aa, Staphylococcus aureus
SKVDV

SEQ ID NO: 1560611 - protein, 6 aa, Staphylococcus aureus
SLGQSN

SEQ ID NO: 1560612 - protein, 5 aa, Staphylococcus aureus
SLNGV

SEQ ID NO: 1560613 - protein, 16 aa, Staphylococcus aureus
SLSPANYDRPSVAGTA

SEQ ID NO: 1560614 - protein, 7 aa, Staphylococcus aureus
SNEDKDE

SEQ ID NO: 1560615 - protein, 4 aa, Staphylococcus aureus
SNGM

SEQ ID NO: 1560616 - protein, 15 aa, Staphylococcus aureus
SNKDGKQDSTEKGIK

SEQ ID NO: 1560617 - protein, 8 aa, Staphylococcus aureus
SNPFGTNG

SEQ ID NO: 1560618 - protein, 15 aa, Staphylococcus aureus
SNTKTRLTNDSQQQI

SEQ ID NO: 1560619 - protein, 8 aa, Staphylococcus aureus
SPDKAHDV

SEQ ID NO: 1560620 - protein, 14 aa, Staphylococcus aureus
SPEQAKGEATDECT

SEQ ID NO: 1560621 - protein, 8 aa, Staphylococcus aureus
SPEYNQRK

SEQ ID NO: 1560622 - protein, 6 aa, Staphylococcus aureus
SPINKN

SEQ ID NO: 1560623 - protein, 5 aa, Staphylococcus aureus
SPKSA

SEQ ID NO: 1560624 - protein, 5 aa, Staphylococcus aureus
SPPIK

SEQ ID NO: 1560625 - protein, 4 aa, Staphylococcus aureus
SPQL

SEQ ID NO: 1560626 - protein, 14 aa, Staphylococcus aureus
SQGIDQANGQLNDA

SEQ ID NO: 1560627 - protein, 8 aa, Staphylococcus aureus
SQHGPKRP

SEQ ID NO: 1560628 - protein, 17 aa, Staphylococcus aureus
SQQQAPPNFSKTNKYGV

SEQ ID NO: 1560629 - protein, 7 aa, Staphylococcus aureus
SRADTKK

SEQ ID NO: 1560630 - protein, 13 aa, Staphylococcus aureus
SRAKNKKDVGSAT

SEQ ID NO: 1560631 - protein, 16 aa, Staphylococcus aureus
SRKEEGAGGDFGRQQR

SEQ ID NO: 1560632 - protein, 9 aa, Staphylococcus aureus
SRSGSTIST

SEQ ID NO: 1560633 - protein, 10 aa, Staphylococcus aureus
SSGASSLTGV

SEQ ID NO: 1560634 - protein, 8 aa, Staphylococcus aureus
SSGTRVDF

SEQ ID NO: 1560635 - protein, 7 aa, Staphylococcus aureus
SSKGGTP

SEQ ID NO: 1560636 - protein, 5 aa, Staphylococcus aureus
SSLGV

SEQ ID NO: 1560637 - protein, 5 aa, Staphylococcus aureus
SSLTE

SEQ ID NO: 1560638 - protein, 7 aa, Staphylococcus aureus
STAGDAA

SEQ ID NO: 1560639 - protein, 4 aa, Staphylococcus aureus
SVKP

SEQ ID NO: 1560640 - protein, 10 aa, Staphylococcus aureus
SYNGGEINQT

SEQ ID NO: 1560641 - protein, 15 aa, Staphylococcus aureus
TAGETKDPEKTLPKA

SEQ ID NO: 1560642 - protein, 4 aa, Staphylococcus aureus
TAGL

SEQ ID NO: 1560643 - protein, 9 aa, Staphylococcus aureus
TAVGDNNPY

SEQ ID NO: 1560644 - protein, 9 aa, Staphylococcus aureus
TDEVSEGTA

SEQ ID NO: 1560645 - protein, 7 aa, Staphylococcus aureus
TDLTSKN

SEQ ID NO: 1560646 - protein, 9 aa, Staphylococcus aureus
TDSEEQLKG

SEQ ID NO: 1560647 - protein, 9 aa, Staphylococcus aureus
TEDIQGKVD

SEQ ID NO: 1560648 - protein, 4 aa, Staphylococcus aureus
TEED

SEQ ID NO: 1560649 - protein, 11 aa, Staphylococcus aureus
TEQQQVERERR

SEQ ID NO: 1560650 - protein, 7 aa, Staphylococcus aureus
TEVTGTA

SEQ ID NO: 1560651 - protein, 7 aa, Staphylococcus aureus
TGDPLAP

SEQ ID NO: 1560652 - protein, 12 aa, Staphylococcus aureus
TGKSGLGEKGTV

SEQ ID NO: 1560653 - protein, 12 aa, Staphylococcus aureus
TGQGKTSDSEFT

SEQ ID NO: 1560654 - protein, 6 aa, Staphylococcus aureus
THGTEA

SEQ ID NO: 1560655 - protein, 16 aa, Staphylococcus aureus
TIENNQQKALASEDDL

SEQ ID NO: 1560656 - protein, 7 aa, Staphylococcus aureus
TKKQIGG

SEQ ID NO: 1560657 - protein, 18 aa, Staphylococcus aureus
TKKSKEPRLEPRLGNQYG

SEQ ID NO: 1560658 - protein, 9 aa, Staphylococcus aureus
TKQKSKDFL

SEQ ID NO: 1560659 - protein, 9 aa, Staphylococcus aureus
TKQSNRSLI

SEQ ID NO: 1560660 - protein, 8 aa, Staphylococcus aureus
TKVGGDTA

SEQ ID NO: 1560661 - protein, 8 aa, Staphylococcus aureus
TLADGSTE

SEQ ID NO: 1560662 - protein, 11 aa, Staphylococcus aureus
TNATASVNKNL

SEQ ID NO: 1560663 - protein, 9 aa, Staphylococcus aureus
TNGAFTKDQ

SEQ ID NO: 1560664 - protein, 7 aa, Staphylococcus aureus
TNHESQG

SEQ ID NO: 1560665 - protein, 7 aa, Staphylococcus aureus
TNISQDQ

SEQ ID NO: 1560666 - protein, 7 aa, Staphylococcus aureus
TNPAVQS

SEQ ID NO: 1560667 - protein, 9 aa, Staphylococcus aureus
TNQNTSDKA

SEQ ID NO: 1560668 - protein, 7 aa, Staphylococcus aureus
TNQTNSQ

SEQ ID NO: 1560669 - protein, 7 aa, Staphylococcus aureus
TNTKSLP

SEQ ID NO: 1560670 - protein, 12 aa, Staphylococcus aureus
TNWKDKKLNQEL

SEQ ID NO: 1560671 - protein, 4 aa, Staphylococcus aureus
TPIT

SEQ ID NO: 1560672 - protein, 5 aa, Staphylococcus aureus
TPLSD

SEQ ID NO: 1560673 - protein, 8 aa, Staphylococcus aureus
TPNHKHDE

SEQ ID NO: 1560674 - protein, 10 aa, Staphylococcus aureus
TPPQMSKDND

SEQ ID NO: 1560675 - protein, 7 aa, Staphylococcus aureus
TQDIEEA

SEQ ID NO: 1560676 - protein, 5 aa, Staphylococcus aureus
TQTTQ

SEQ ID NO: 1560677 - protein, 9 aa, Staphylococcus aureus
TSGLTGPES

SEQ ID NO: 1560678 - protein, 7 aa, Staphylococcus aureus
TSITGDN

SEQ ID NO: 1560679 - protein, 4 aa, Staphylococcus aureus
TSKD

SEQ ID NO: 1560680 - protein, 7 aa, Staphylococcus aureus
TSNTATA

SEQ ID NO: 1560681 - protein, 4 aa, Staphylococcus aureus
TSPI

SEQ ID NO: 1560682 - protein, 6 aa, Staphylococcus aureus
TSPIDL

SEQ ID NO: 1560683 - protein, 4 aa, Staphylococcus aureus
TSSF

SEQ ID NO: 1560684 - protein, 7 aa, Staphylococcus aureus
TSSVADG

SEQ ID NO: 1560685 - protein, 5 aa, Staphylococcus aureus
TSYTA

SEQ ID NO: 1560686 - protein, 10 aa, Staphylococcus aureus
TTHYSSGPAP

SEQ ID NO: 1560687 - protein, 5 aa, Staphylococcus aureus
TTTEQ

SEQ ID NO: 1560688 - protein, 5 aa, Staphylococcus aureus
TTYGG

SEQ ID NO: 1560689 - protein, 5 aa, Staphylococcus aureus
VADKF

SEQ ID NO: 1560690 - protein, 15 aa, Staphylococcus aureus
VAKSASQQNKENNTE

SEQ ID NO: 1560691 - protein, 11 aa, Staphylococcus aureus
VDGKTDQQIAD

SEQ ID NO: 1560692 - protein, 4 aa, Staphylococcus aureus
VDIK

SEQ ID NO: 1560693 - protein, 9 aa, Staphylococcus aureus
VDKGQMEAA

SEQ ID NO: 1560694 - protein, 7 aa, Staphylococcus aureus
VDPDNSP

SEQ ID NO: 1560695 - protein, 28 aa, Staphylococcus aureus
VDQPINSDSVEISGGFKGQEGVKKAKQI

SEQ ID NO: 1560696 - protein, 9 aa, Staphylococcus aureus
VEESNHAKE

SEQ ID NO: 1560697 - protein, 5 aa, Staphylococcus aureus
VGAGG

SEQ ID NO: 1560698 - protein, 5 aa, Staphylococcus aureus
VGGKL

SEQ ID NO: 1560699 - protein, 7 aa, Staphylococcus aureus
VGQEDTS

SEQ ID NO: 1560700 - protein, 9 aa, Staphylococcus aureus
VGRGTTEKI

SEQ ID NO: 1560701 - protein, 6 aa, Staphylococcus aureus
VGSTFS

SEQ ID NO: 1560702 - protein, 9 aa, Staphylococcus aureus
VHNSSQLSH

SEQ ID NO: 1560703 - protein, 5 aa, Staphylococcus aureus
VITST

SEQ ID NO: 1560704 - protein, 4 aa, Staphylococcus aureus
VKRG

SEQ ID NO: 1560705 - protein, 7 aa, Staphylococcus aureus
VKYRDST

SEQ ID NO: 1560706 - protein, 11 aa, Staphylococcus aureus
VNEKSYKVENN

SEQ ID NO: 1560707 - protein, 11 aa, Staphylococcus aureus
VNKTKERIKSQ

SEQ ID NO: 1560708 - protein, 12 aa, Staphylococcus aureus
VNNTEKEIKQIQ

SEQ ID NO: 1560709 - protein, 4 aa, Staphylococcus aureus
VPTI

SEQ ID NO: 1560710 - protein, 13 aa, Staphylococcus aureus
VQDADPGKLIMTV

SEQ ID NO: 1560711 - protein, 7 aa, Staphylococcus aureus
VSARTQG

SEQ ID NO: 1560712 - protein, 7 aa, Staphylococcus aureus
VSKNTSD

SEQ ID NO: 1560713 - protein, 6 aa, Staphylococcus aureus
VSSPIA

SEQ ID NO: 1560714 - protein, 8 aa, Staphylococcus aureus
VTATGDFG

SEQ ID NO: 1560715 - protein, 6 aa, Staphylococcus aureus
VTGGAV

SEQ ID NO: 1560716 - protein, 5 aa, Staphylococcus aureus
VTTKS

SEQ ID NO: 1560717 - protein, 5 aa, Staphylococcus aureus
VTTNN

SEQ ID NO: 1560718 - protein, 13 aa, Staphylococcus aureus
VVPTAGKTGTAEV

SEQ ID NO: 1560719 - protein, 14 aa, Staphylococcus aureus
VYKDGKRAFKPSTI

SEQ ID NO: 1560720 - protein, 10 aa, Staphylococcus aureus
WNPTGSDPKF

SEQ ID NO: 1560721 - protein, 8 aa, Staphylococcus aureus
WPNGGRQT

SEQ ID NO: 1560722 - protein, 6 aa, Staphylococcus aureus
WTTPGP

SEQ ID NO: 1560723 - protein, 13 aa, Staphylococcus aureus
YDEKGSVNAQKDI

SEQ ID NO: 1560724 - protein, 5 aa, Staphylococcus aureus
YDGDN

SEQ ID NO: 1560725 - protein, 4 aa, Staphylococcus aureus
YDIT

SEQ ID NO: 1560726 - protein, 5 aa, Staphylococcus aureus
YEKKN

SEQ ID NO: 1560727 - protein, 9 aa, Staphylococcus aureus
YEQSYQQQL

SEQ ID NO: 1560728 - protein, 6 aa, Staphylococcus aureus
YGGGKD

SEQ ID NO: 1560729 - protein, 6 aa, Staphylococcus aureus
YGSGMT

SEQ ID NO: 1560730 - protein, 12 aa, Staphylococcus aureus
YLSSAKGTQDIN

SEQ ID NO: 1560731 - protein, 7 aa, Staphylococcus aureus
YQTYTSN

SEQ ID NO: 1560732 - protein, 9 aa, Staphylococcus aureus
YSKPEKRSG

SEQ ID NO: 1560733 - protein, 5 aa, Staphylococcus aureus
YTAST

SEQ ID NO: 1560734 - protein, 6 aa, Staphylococcus aureus
YTPGGG

SEQ ID NO: 1560735 - protein, 4 aa, Staphylococcus aureus
AAAQ

SEQ ID NO: 1560736 - protein, 11 aa, Staphylococcus aureus
AAKKVGPRLGA

SEQ ID NO: 1560737 - protein, 6 aa, Staphylococcus aureus
AGAPPL

SEQ ID NO: 1560738 - protein, 6 aa, Staphylococcus aureus
AGGQAE

SEQ ID NO: 1560739 - protein, 8 aa, Staphylococcus aureus
AGKVYKKD

SEQ ID NO: 1560740 - protein, 11 aa, Staphylococcus aureus
AGNSATPFENP

SEQ ID NO: 1560741 - protein, 6 aa, Staphylococcus aureus
AHDNAV

SEQ ID NO: 1560742 - protein, 9 aa, Staphylococcus aureus
AIKPDKGKV

SEQ ID NO: 1560743 - protein, 6 aa, Staphylococcus aureus
AISDSI

SEQ ID NO: 1560744 - protein, 7 aa, Staphylococcus aureus
AKPGQSM

SEQ ID NO: 1560745 - protein, 10 aa, Staphylococcus aureus
AKQGEVGRRK

SEQ ID NO: 1560746 - protein, 9 aa, Staphylococcus aureus
ALAQTGTAL

SEQ ID NO: 1560747 - protein, 4 aa, Staphylococcus aureus
ALGA

SEQ ID NO: 1560748 - protein, 17 aa, Staphylococcus aureus
ALKKATEQANFIYHIFI

SEQ ID NO: 1560749 - protein, 13 aa, Staphylococcus aureus
ANIKDAGKGMGMT

SEQ ID NO: 1560750 - protein, 15 aa, Staphylococcus aureus
ANKHDDVLDKLINIL

SEQ ID NO: 1560751 - protein, 8 aa, Staphylococcus aureus
APAQHTQL

SEQ ID NO: 1560752 - protein, 6 aa, Staphylococcus aureus
APGGVN

SEQ ID NO: 1560753 - protein, 8 aa, Staphylococcus aureus
APIPGRSA

SEQ ID NO: 1560754 - protein, 7 aa, Staphylococcus aureus
APKNRGK

SEQ ID NO: 1560755 - protein, 9 aa, Staphylococcus aureus
APSKPEKLK

SEQ ID NO: 1560756 - protein, 6 aa, Staphylococcus aureus
AQESKI

SEQ ID NO: 1560757 - protein, 8 aa, Staphylococcus aureus
AQPPTPEW

SEQ ID NO: 1560758 - protein, 14 aa, Staphylococcus aureus
AQRRKERQENSNQI

SEQ ID NO: 1560759 - protein, 7 aa, Staphylococcus aureus
ASGSSNF

SEQ ID NO: 1560760 - protein, 5 aa, Staphylococcus aureus
ASIPT

SEQ ID NO: 1560761 - protein, 6 aa, Staphylococcus aureus
ATMPGS

SEQ ID NO: 1560762 - protein, 4 aa, Staphylococcus aureus
AVTK

SEQ ID NO: 1560763 - protein, 12 aa, Staphylococcus aureus
AVYSADKALPKI

SEQ ID NO: 1560764 - protein, 9 aa, Staphylococcus aureus
AYNPKPKDL

SEQ ID NO: 1560765 - protein, 23 aa, Staphylococcus aureus
AYTREGDISALGAQKEFTDQEMP

SEQ ID NO: 1560766 - protein, 9 aa, Staphylococcus aureus
DAEEAAKTK

SEQ ID NO: 1560767 - protein, 9 aa, Staphylococcus aureus
DAQEGDVIS

SEQ ID NO: 1560768 - protein, 10 aa, Staphylococcus aureus
DDLDGKKLDK

SEQ ID NO: 1560769 - protein, 5 aa, Staphylococcus aureus
DDYGR

SEQ ID NO: 1560770 - protein, 13 aa, Staphylococcus aureus
DEEHDSHETPPSR

SEQ ID NO: 1560771 - protein, 25 aa, Staphylococcus aureus
DEHPSDTYPEDDKNIKDKIVDKLKK

SEQ ID NO: 1560772 - protein, 5 aa, Staphylococcus aureus
DEPGG

SEQ ID NO: 1560773 - protein, 12 aa, Staphylococcus aureus
DESKLVDRAGKN

SEQ ID NO: 1560774 - protein, 4 aa, Staphylococcus aureus
DGFG

SEQ ID NO: 1560775 - protein, 7 aa, Staphylococcus aureus
DKAIKQT

SEQ ID NO: 1560776 - protein, 12 aa, Staphylococcus aureus
DKAQGGQSRTDS

SEQ ID NO: 1560777 - protein, 10 aa, Staphylococcus aureus
DKENIDSQGM

SEQ ID NO: 1560778 - protein, 7 aa, Staphylococcus aureus
DKKTSDF

SEQ ID NO: 1560779 - protein, 6 aa, Staphylococcus aureus
DKPGLV

SEQ ID NO: 1560780 - protein, 13 aa, Staphylococcus aureus
DNVKSGLEYTTQY

SEQ ID NO: 1560781 - protein, 18 aa, Staphylococcus aureus
DQRKYRKAMRKYKRNQRR

SEQ ID NO: 1560782 - protein, 4 aa, Staphylococcus aureus
DRHD

SEQ ID NO: 1560783 - protein, 8 aa, Staphylococcus aureus
DRQDQKAV

SEQ ID NO: 1560784 - protein, 6 aa, Staphylococcus aureus
DRSFTR

SEQ ID NO: 1560785 - protein, 7 aa, Staphylococcus aureus
DSGRILP

SEQ ID NO: 1560786 - protein, 4 aa, Staphylococcus aureus
DSPT

SEQ ID NO: 1560787 - protein, 16 aa, Staphylococcus aureus
DYNKAKVYGSKTFGKG

SEQ ID NO: 1560788 - protein, 6 aa, Staphylococcus aureus
EAESEV

SEQ ID NO: 1560789 - protein, 10 aa, Staphylococcus aureus
EAQSSKAPIQ

SEQ ID NO: 1560790 - protein, 7 aa, Staphylococcus aureus
EEIANEG

SEQ ID NO: 1560791 - protein, 8 aa, Staphylococcus aureus
EEQNSTNV

SEQ ID NO: 1560792 - protein, 6 aa, Staphylococcus aureus
EGIHNP

SEQ ID NO: 1560793 - protein, 18 aa, Staphylococcus aureus
EGKSSGLSGAISGGAEQL

SEQ ID NO: 1560794 - protein, 5 aa, Staphylococcus aureus
EGTLK

SEQ ID NO: 1560795 - protein, 10 aa, Staphylococcus aureus
EHKIQKRTPK

SEQ ID NO: 1560796 - protein, 4 aa, Staphylococcus aureus
EHST

SEQ ID NO: 1560797 - protein, 24 aa, Staphylococcus aureus
EIKNNGDLSNDKRSEETKKYNDKL

SEQ ID NO: 1560798 - protein, 10 aa, Staphylococcus aureus
EIKNPEKNIA

SEQ ID NO: 1560799 - protein, 8 aa, Staphylococcus aureus
EIKNTKDL

SEQ ID NO: 1560800 - protein, 5 aa, Staphylococcus aureus
EIQPQ

SEQ ID NO: 1560801 - protein, 8 aa, Staphylococcus aureus
EITKDDKK

SEQ ID NO: 1560802 - protein, 11 aa, Staphylococcus aureus
EKFDKKGYEVN

SEQ ID NO: 1560803 - protein, 9 aa, Staphylococcus aureus
EKGVENVPG

SEQ ID NO: 1560804 - protein, 12 aa, Staphylococcus aureus
EKHSWKAGKSNS

SEQ ID NO: 1560805 - protein, 30 aa, Staphylococcus aureus
EKKKYNKDVEKREKDYKAYLDNKSKEINKA

SEQ ID NO: 1560806 - protein, 7 aa, Staphylococcus aureus
EKQYNKN

SEQ ID NO: 1560807 - protein, 13 aa, Staphylococcus aureus
ENFTQRVSTNLEK

SEQ ID NO: 1560808 - protein, 15 aa, Staphylococcus aureus
ENKKIEDDDNDSGSV

SEQ ID NO: 1560809 - protein, 16 aa, Staphylococcus aureus
ENNTDMDKAEEQLKKE

SEQ ID NO: 1560810 - protein, 33 aa, Staphylococcus aureus
ENPNKGNKVNRSEQVNKSNNHAENPKPKEGVGT

SEQ ID NO: 1560811 - protein, 13 aa, Staphylococcus aureus
ENSRNTKTGGSGL

SEQ ID NO: 1560812 - protein, 5 aa, Staphylococcus aureus
EPATR

SEQ ID NO: 1560813 - protein, 6 aa, Staphylococcus aureus
EQGFTK

SEQ ID NO: 1560814 - protein, 6 aa, Staphylococcus aureus
EQGYTK

SEQ ID NO: 1560815 - protein, 8 aa, Staphylococcus aureus
EQIEYKND

SEQ ID NO: 1560816 - protein, 6 aa, Staphylococcus aureus
EQRTGI

SEQ ID NO: 1560817 - protein, 5 aa, Staphylococcus aureus
ERVHQ

SEQ ID NO: 1560818 - protein, 8 aa, Staphylococcus aureus
ESKPTFEN

SEQ ID NO: 1560819 - protein, 5 aa, Staphylococcus aureus
ETSRI

SEQ ID NO: 1560820 - protein, 7 aa, Staphylococcus aureus
EYATEQS

SEQ ID NO: 1560821 - protein, 11 aa, Staphylococcus aureus
FGTSAKKYIEG

SEQ ID NO: 1560822 - protein, 12 aa, Staphylococcus aureus
FKREDDSVETLR

SEQ ID NO: 1560823 - protein, 11 aa, Staphylococcus aureus
FTKNDNTKRKK

SEQ ID NO: 1560824 - protein, 9 aa, Staphylococcus aureus
GAGGSIGSE

SEQ ID NO: 1560825 - protein, 9 aa, Staphylococcus aureus
GAGSDHHIP

SEQ ID NO: 1560826 - protein, 4 aa, Staphylococcus aureus
GAQS

SEQ ID NO: 1560827 - protein, 10 aa, Staphylococcus aureus
GDAAGGLGGV

SEQ ID NO: 1560828 - protein, 4 aa, Staphylococcus aureus
GGHA

SEQ ID NO: 1560829 - protein, 10 aa, Staphylococcus aureus
GGKSFNKKPT

SEQ ID NO: 1560830 - protein, 14 aa, Staphylococcus aureus
GIKPDVTIDTPKYQ

SEQ ID NO: 1560831 - protein, 5 aa, Staphylococcus aureus
GILEN

SEQ ID NO: 1560832 - protein, 10 aa, Staphylococcus aureus
GLQASAGDRL

SEQ ID NO: 1560833 - protein, 8 aa, Staphylococcus aureus
GNGNMPKQ

SEQ ID NO: 1560834 - protein, 5 aa, Staphylococcus aureus
GNKDI

SEQ ID NO: 1560835 - protein, 14 aa, Staphylococcus aureus
GNPLAQNLASSTSN

SEQ ID NO: 1560836 - protein, 21 aa, Staphylococcus aureus
GPFKKGTNHETVQDLNGKDKV

SEQ ID NO: 1560837 - protein, 9 aa, Staphylococcus aureus
GPKTSSPNV

SEQ ID NO: 1560838 - protein, 6 aa, Staphylococcus aureus
GPTMTR

SEQ ID NO: 1560839 - protein, 5 aa, Staphylococcus aureus
GQSQL

SEQ ID NO: 1560840 - protein, 5 aa, Staphylococcus aureus
GRDGS

SEQ ID NO: 1560841 - protein, 7 aa, Staphylococcus aureus
GRPSAVD

SEQ ID NO: 1560842 - protein, 5 aa, Staphylococcus aureus
GSELG

SEQ ID NO: 1560843 - protein, 10 aa, Staphylococcus aureus
GSGSPENVEK

SEQ ID NO: 1560844 - protein, 7 aa, Staphylococcus aureus
GSNYLET

SEQ ID NO: 1560845 - protein, 8 aa, Staphylococcus aureus
GSTGSGKS

SEQ ID NO: 1560846 - protein, 9 aa, Staphylococcus aureus
GTAKATSYG

SEQ ID NO: 1560847 - protein, 5 aa, Staphylococcus aureus
GVGNT

SEQ ID NO: 1560848 - protein, 4 aa, Staphylococcus aureus
GVPF

SEQ ID NO: 1560849 - protein, 16 aa, Staphylococcus aureus
GYSGYNGQRQSNSSGI

SEQ ID NO: 1560850 - protein, 9 aa, Staphylococcus aureus
HSEREMGKA

SEQ ID NO: 1560851 - protein, 7 aa, Staphylococcus aureus
HSHHGSL

SEQ ID NO: 1560852 - protein, 4 aa, Staphylococcus aureus
HSTE

SEQ ID NO: 1560853 - protein, 5 aa, Staphylococcus aureus
HTELD

SEQ ID NO: 1560854 - protein, 6 aa, Staphylococcus aureus
IATSLG

SEQ ID NO: 1560855 - protein, 14 aa, Staphylococcus aureus
IDSDVKNNTQKSTL

SEQ ID NO: 1560856 - protein, 16 aa, Staphylococcus aureus
IEDNEAKNFDKKNTNF

SEQ ID NO: 1560857 - protein, 11 aa, Staphylococcus aureus
IEPTEALEDSE

SEQ ID NO: 1560858 - protein, 5 aa, Staphylococcus aureus
IITSG

SEQ ID NO: 1560859 - protein, 10 aa, Staphylococcus aureus
IKSEQQEKTE

SEQ ID NO: 1560860 - protein, 4 aa, Staphylococcus aureus
IKTN

SEQ ID NO: 1560861 - protein, 4 aa, Staphylococcus aureus
IKWT

SEQ ID NO: 1560862 - protein, 16 aa, Staphylococcus aureus
INQPTNVNSDMSQTTG

SEQ ID NO: 1560863 - protein, 24 aa, Staphylococcus aureus
IPDEYAKEVPESARTEALPEGKTA

SEQ ID NO: 1560864 - protein, 12 aa, Staphylococcus aureus
IPNAQIDGKVGR

SEQ ID NO: 1560865 - protein, 10 aa, Staphylococcus aureus
IRGEKDVKSL

SEQ ID NO: 1560866 - protein, 13 aa, Staphylococcus aureus
ISRSYSDKYPENE

SEQ ID NO: 1560867 - protein, 10 aa, Staphylococcus aureus
ITDDGDKDHI

SEQ ID NO: 1560868 - protein, 20 aa, Staphylococcus aureus
ITGENSKNYRVTADNKTYYV

SEQ ID NO: 1560869 - protein, 14 aa, Staphylococcus aureus
ITNNPDDYVDEETY

SEQ ID NO: 1560870 - protein, 6 aa, Staphylococcus aureus
ITTQDF

SEQ ID NO: 1560871 - protein, 8 aa, Staphylococcus aureus
KAATETAT

SEQ ID NO: 1560872 - protein, 12 aa, Staphylococcus aureus
KADKDGYIIFPK

SEQ ID NO: 1560873 - protein, 4 aa, Staphylococcus aureus
KANH

SEQ ID NO: 1560874 - protein, 13 aa, Staphylococcus aureus
KARSRDSGGTGLG

SEQ ID NO: 1560875 - protein, 11 aa, Staphylococcus aureus
KARTRKMGGTG

SEQ ID NO: 1560876 - protein, 8 aa, Staphylococcus aureus
KAVGASSR

SEQ ID NO: 1560877 - protein, 5 aa, Staphylococcus aureus
KDDSY

SEQ ID NO: 1560878 - protein, 27 aa, Staphylococcus aureus
KDIENKYKKQATLKQTGEIVSNGHQKD

SEQ ID NO: 1560879 - protein, 13 aa, Staphylococcus aureus
KDLDYKSKSKEPI

SEQ ID NO: 1560880 - protein, 6 aa, Staphylococcus aureus
KDMQPY

SEQ ID NO: 1560881 - protein, 5 aa, Staphylococcus aureus
KEGYI

SEQ ID NO: 1560882 - protein, 5 aa, Staphylococcus aureus
KENLY

SEQ ID NO: 1560883 - protein, 6 aa, Staphylococcus aureus
KFGGKP

SEQ ID NO: 1560884 - protein, 6 aa, Staphylococcus aureus
KFGQAD

SEQ ID NO: 1560885 - protein, 9 aa, Staphylococcus aureus
KGKATYQDI

SEQ ID NO: 1560886 - protein, 6 aa, Staphylococcus aureus
KGKSIG

SEQ ID NO: 1560887 - protein, 8 aa, Staphylococcus aureus
KGNHRLNG

SEQ ID NO: 1560888 - protein, 6 aa, Staphylococcus aureus
KGTPFE

SEQ ID NO: 1560889 - protein, 5 aa, Staphylococcus aureus
KGTTR

SEQ ID NO: 1560890 - protein, 8 aa, Staphylococcus aureus
KGVNNDDS

SEQ ID NO: 1560891 - protein, 6 aa, Staphylococcus aureus
KGYRKG

SEQ ID NO: 1560892 - protein, 8 aa, Staphylococcus aureus
KHDNSNGL

SEQ ID NO: 1560893 - protein, 15 aa, Staphylococcus aureus
KKARTLKKHAANEQA

SEQ ID NO: 1560894 - protein, 5 aa, Staphylococcus aureus
KKIGE

SEQ ID NO: 1560895 - protein, 8 aa, Staphylococcus aureus
KKSYHQDK

SEQ ID NO: 1560896 - protein, 10 aa, Staphylococcus aureus
KKVGKLKENV

SEQ ID NO: 1560897 - protein, 11 aa, Staphylococcus aureus
KKVPGTQQELD

SEQ ID NO: 1560898 - protein, 8 aa, Staphylococcus aureus
KKYSKNEI

SEQ ID NO: 1560899 - protein, 14 aa, Staphylococcus aureus
KLTKPLKNKEVKSV

SEQ ID NO: 1560900 - protein, 9 aa, Staphylococcus aureus
KNDHPEGTI

SEQ ID NO: 1560901 - protein, 14 aa, Staphylococcus aureus
KNESKKDKNDTNYR

SEQ ID NO: 1560902 - protein, 15 aa, Staphylococcus aureus
KNKHTYQNEPLPNRK

SEQ ID NO: 1560903 - protein, 14 aa, Staphylococcus aureus
KNKKIKVKTRLKNK

SEQ ID NO: 1560904 - protein, 7 aa, Staphylococcus aureus
KNNQTRL

SEQ ID NO: 1560905 - protein, 6 aa, Staphylococcus aureus
KNSPQY

SEQ ID NO: 1560906 - protein, 19 aa, Staphylococcus aureus
KPQGFTEGKRRVYTEQQRQ

SEQ ID NO: 1560907 - protein, 12 aa, Staphylococcus aureus
KQINKSGKMTDY

SEQ ID NO: 1560908 - protein, 9 aa, Staphylococcus aureus
KREGKDLPI

SEQ ID NO: 1560909 - protein, 5 aa, Staphylococcus aureus
KRTEK

SEQ ID NO: 1560910 - protein, 7 aa, Staphylococcus aureus
KRTKANV

SEQ ID NO: 1560911 - protein, 8 aa, Staphylococcus aureus
KSKYNPNW

SEQ ID NO: 1560912 - protein, 6 aa, Staphylococcus aureus
KSNPIS

SEQ ID NO: 1560913 - protein, 6 aa, Staphylococcus aureus
KSVSNQ

SEQ ID NO: 1560914 - protein, 5 aa, Staphylococcus aureus
KTLER

SEQ ID NO: 1560915 - protein, 6 aa, Staphylococcus aureus
KTPITS

SEQ ID NO: 1560916 - protein, 7 aa, Staphylococcus aureus
KTQSIQN

SEQ ID NO: 1560917 - protein, 15 aa, Staphylococcus aureus
KTTPNTGERVERGDS

SEQ ID NO: 1560918 - protein, 7 aa, Staphylococcus aureus
KVNAPSV

SEQ ID NO: 1560919 - protein, 7 aa, Staphylococcus aureus
KYDEMGG

SEQ ID NO: 1560920 - protein, 9 aa, Staphylococcus aureus
KYEGDDYQA

SEQ ID NO: 1560921 - protein, 9 aa, Staphylococcus aureus
KYFSPNGKY

SEQ ID NO: 1560922 - protein, 8 aa, Staphylococcus aureus
KYSDENEF

SEQ ID NO: 1560923 - protein, 19 aa, Staphylococcus aureus
LAQQNNAKISVSSDIDVGT

SEQ ID NO: 1560924 - protein, 9 aa, Staphylococcus aureus
LDADPETIQ

SEQ ID NO: 1560925 - protein, 5 aa, Staphylococcus aureus
LDGAG

SEQ ID NO: 1560926 - protein, 9 aa, Staphylococcus aureus
LENTSIQSI

SEQ ID NO: 1560927 - protein, 11 aa, Staphylococcus aureus
LETKGKIDYPD

SEQ ID NO: 1560928 - protein, 5 aa, Staphylococcus aureus
LGASG

SEQ ID NO: 1560929 - protein, 5 aa, Staphylococcus aureus
LGATN

SEQ ID NO: 1560930 - protein, 4 aa, Staphylococcus aureus
LGGP

SEQ ID NO: 1560931 - protein, 6 aa, Staphylococcus aureus
LGGQEN

SEQ ID NO: 1560932 - protein, 5 aa, Staphylococcus aureus
LGINP

SEQ ID NO: 1560933 - protein, 22 aa, Staphylococcus aureus
LGKAEADKLAKDWTNKGLSNRQ

SEQ ID NO: 1560934 - protein, 15 aa, Staphylococcus aureus
LGTYTPLKNNSELEE

SEQ ID NO: 1560935 - protein, 22 aa, Staphylococcus aureus
LKGETKTKYDAMKKDNVESTNK

SEQ ID NO: 1560936 - protein, 12 aa, Staphylococcus aureus
LKGSNDVKINDA

SEQ ID NO: 1560937 - protein, 7 aa, Staphylococcus aureus
LNEDDYE

SEQ ID NO: 1560938 - protein, 7 aa, Staphylococcus aureus
LNQQRQQ

SEQ ID NO: 1560939 - protein, 10 aa, Staphylococcus aureus
LPEEVRQERG

SEQ ID NO: 1560940 - protein, 16 aa, Staphylococcus aureus
LPGQGQTSRANKGQIE

SEQ ID NO: 1560941 - protein, 16 aa, Staphylococcus aureus
LSEDEASSSKMEETIP

SEQ ID NO: 1560942 - protein, 11 aa, Staphylococcus aureus
LSKETTKDNTL

SEQ ID NO: 1560943 - protein, 6 aa, Staphylococcus aureus
LSQSTK

SEQ ID NO: 1560944 - protein, 8 aa, Staphylococcus aureus
LSSGKEQF

SEQ ID NO: 1560945 - protein, 7 aa, Staphylococcus aureus
LTSSEDT

SEQ ID NO: 1560946 - protein, 5 aa, Staphylococcus aureus
MGGDV

SEQ ID NO: 1560947 - protein, 9 aa, Staphylococcus aureus
MGRRPDSRY

SEQ ID NO: 1560948 - protein, 9 aa, Staphylococcus aureus
MHEEKQKEV

SEQ ID NO: 1560949 - protein, 16 aa, Staphylococcus aureus
MPSKVDAKASTKQGDI

SEQ ID NO: 1560950 - protein, 4 aa, Staphylococcus aureus
MPVS

SEQ ID NO: 1560951 - protein, 9 aa, Staphylococcus aureus
NDKDGTGYV

SEQ ID NO: 1560952 - protein, 11 aa, Staphylococcus aureus
NDMSPTLNKGD

SEQ ID NO: 1560953 - protein, 5 aa, Staphylococcus aureus
NEENE

SEQ ID NO: 1560954 - protein, 6 aa, Staphylococcus aureus
NEKNYK

SEQ ID NO: 1560955 - protein, 6 aa, Staphylococcus aureus
NGAVRD

SEQ ID NO: 1560956 - protein, 9 aa, Staphylococcus aureus
NGPVKNDGK

SEQ ID NO: 1560957 - protein, 9 aa, Staphylococcus aureus
NKAEEQAIQ

SEQ ID NO: 1560958 - protein, 12 aa, Staphylococcus aureus
NKELKSPLDKEQ

SEQ ID NO: 1560959 - protein, 8 aa, Staphylococcus aureus
NKKNKSYI

SEQ ID NO: 1560960 - protein, 9 aa, Staphylococcus aureus
NLDKPNNVK

SEQ ID NO: 1560961 - protein, 7 aa, Staphylococcus aureus
NLLSDST

SEQ ID NO: 1560962 - protein, 9 aa, Staphylococcus aureus
NNADKTSIK

SEQ ID NO: 1560963 - protein, 48 aa, Staphylococcus aureus
NNDSDKVSNDPKVSQNYKKQVENQDGQINQQVDNAKENIKNNQKTDDI

SEQ ID NO: 1560964 - protein, 8 aa, Staphylococcus aureus
NPDSTAQG

SEQ ID NO: 1560965 - protein, 4 aa, Staphylococcus aureus
NPLA

SEQ ID NO: 1560966 - protein, 7 aa, Staphylococcus aureus
NPPDKYK

SEQ ID NO: 1560967 - protein, 7 aa, Staphylococcus aureus
NQGNSKG

SEQ ID NO: 1560968 - protein, 8 aa, Staphylococcus aureus
NRKANDQN

SEQ ID NO: 1560969 - protein, 7 aa, Staphylococcus aureus
NSQFNER

SEQ ID NO: 1560970 - protein, 16 aa, Staphylococcus aureus
NTPKNTYLKSEQQTAK

SEQ ID NO: 1560971 - protein, 9 aa, Staphylococcus aureus
NTSNSGVTG

SEQ ID NO: 1560972 - protein, 8 aa, Staphylococcus aureus
NYSKTYGS

SEQ ID NO: 1560973 - protein, 21 aa, Staphylococcus aureus
PAPGVNPAAFDNPQGSQGATE

SEQ ID NO: 1560974 - protein, 20 aa, Staphylococcus aureus
PDIPTPKPEKTLTLGKGNGL

SEQ ID NO: 1560975 - protein, 4 aa, Staphylococcus aureus
PGNA

SEQ ID NO: 1560976 - protein, 9 aa, Staphylococcus aureus
PKQASAKDA

SEQ ID NO: 1560977 - protein, 4 aa, Staphylococcus aureus
PLAS

SEQ ID NO: 1560978 - protein, 6 aa, Staphylococcus aureus
PLASSV

SEQ ID NO: 1560979 - protein, 11 aa, Staphylococcus aureus
PLPENQIDDTY

SEQ ID NO: 1560980 - protein, 4 aa, Staphylococcus aureus
PNKH

SEQ ID NO: 1560981 - protein, 9 aa, Staphylococcus aureus
PNSRDKNEY

SEQ ID NO: 1560982 - protein, 16 aa, Staphylococcus aureus
PPKSPKNYRYTKGQIY

SEQ ID NO: 1560983 - protein, 8 aa, Staphylococcus aureus
PSAEDTTF

SEQ ID NO: 1560984 - protein, 14 aa, Staphylococcus aureus
PSDISSPAQKLRRG

SEQ ID NO: 1560985 - protein, 5 aa, Staphylococcus aureus
PSSLP

SEQ ID NO: 1560986 - protein, 4 aa, Staphylococcus aureus
PVDI

SEQ ID NO: 1560987 - protein, 7 aa, Staphylococcus aureus
QANQKNI

SEQ ID NO: 1560988 - protein, 6 aa, Staphylococcus aureus
QASDDI

SEQ ID NO: 1560989 - protein, 11 aa, Staphylococcus aureus
QATQGAEAFNK

SEQ ID NO: 1560990 - protein, 4 aa, Staphylococcus aureus
QENM

SEQ ID NO: 1560991 - protein, 19 aa, Staphylococcus aureus
QFANGNYASNDKTFNSPKE

SEQ ID NO: 1560992 - protein, 8 aa, Staphylococcus aureus
QGTPNVTP

SEQ ID NO: 1560993 - protein, 8 aa, Staphylococcus aureus
QKPSQKKI

SEQ ID NO: 1560994 - protein, 9 aa, Staphylococcus aureus
QLEENNKEI

SEQ ID NO: 1560995 - protein, 12 aa, Staphylococcus aureus
QPLIVSDDKAIE

SEQ ID NO: 1560996 - protein, 8 aa, Staphylococcus aureus
QQISTSGS

SEQ ID NO: 1560997 - protein, 12 aa, Staphylococcus aureus
QTAHIQSTGCNA

SEQ ID NO: 1560998 - protein, 18 aa, Staphylococcus aureus
RANGLSGNNIRNGQQIVI

SEQ ID NO: 1560999 - protein, 10 aa, Staphylococcus aureus
RDDITDDQKV

SEQ ID NO: 1561000 - protein, 9 aa, Staphylococcus aureus
RDISGDPIT

SEQ ID NO: 1561001 - protein, 25 aa, Staphylococcus aureus
RDNHNVQTELTGTGMTSTEVGGNSE

SEQ ID NO: 1561002 - protein, 13 aa, Staphylococcus aureus
RDRVKDKASGRKT

SEQ ID NO: 1561003 - protein, 8 aa, Staphylococcus aureus
REPNMERP

SEQ ID NO: 1561004 - protein, 4 aa, Staphylococcus aureus
RGNP

SEQ ID NO: 1561005 - protein, 6 aa, Staphylococcus aureus
RKSEQR

SEQ ID NO: 1561006 - protein, 14 aa, Staphylococcus aureus
RNTNLQKDDYVDTT

SEQ ID NO: 1561007 - protein, 19 aa, Staphylococcus aureus
RQSEHRTSAPKRKKKKKIR

SEQ ID NO: 1561008 - protein, 10 aa, Staphylococcus aureus
RVSHEDSQKV

SEQ ID NO: 1561009 - protein, 8 aa, Staphylococcus aureus
SATNSTGV

SEQ ID NO: 1561010 - protein, 6 aa, Staphylococcus aureus
SDRSNA

SEQ ID NO: 1561011 - protein, 8 aa, Staphylococcus aureus
SEDNDKKT

SEQ ID NO: 1561012 - protein, 6 aa, Staphylococcus aureus
SEITQQ

SEQ ID NO: 1561013 - protein, 8 aa, Staphylococcus aureus
SERGSKTA

SEQ ID NO: 1561014 - protein, 11 aa, Staphylococcus aureus
SEYQQVSNNQG

SEQ ID NO: 1561015 - protein, 5 aa, Staphylococcus aureus
SGDAG

SEQ ID NO: 1561016 - protein, 13 aa, Staphylococcus aureus
SGVEYAKKHAKDV

SEQ ID NO: 1561017 - protein, 12 aa, Staphylococcus aureus
SGVKPGKDTERY

SEQ ID NO: 1561018 - protein, 6 aa, Staphylococcus aureus
SHGPLS

SEQ ID NO: 1561019 - protein, 18 aa, Staphylococcus aureus
SIPKQQPQTKPEKKTVSR

SEQ ID NO: 1561020 - protein, 6 aa, Staphylococcus aureus
SISDGQ

SEQ ID NO: 1561021 - protein, 9 aa, Staphylococcus aureus
SKEDQKTYL

SEQ ID NO: 1561022 - protein, 8 aa, Staphylococcus aureus
SKGPEKVK

SEQ ID NO: 1561023 - protein, 7 aa, Staphylococcus aureus
SKKARYN

SEQ ID NO: 1561024 - protein, 5 aa, Staphylococcus aureus
SKPMF

SEQ ID NO: 1561025 - protein, 14 aa, Staphylococcus aureus
SKQLKADGAVEYGV

SEQ ID NO: 1561026 - protein, 15 aa, Staphylococcus aureus
SKQNEGTTFTIQFPD

SEQ ID NO: 1561027 - protein, 19 aa, Staphylococcus aureus
SMQQGKGIVQTKEEDGKFV

SEQ ID NO: 1561028 - protein, 11 aa, Staphylococcus aureus
SNIKEAGKSMG

SEQ ID NO: 1561029 - protein, 9 aa, Staphylococcus aureus
SNKENDLKK

SEQ ID NO: 1561030 - protein, 12 aa, Staphylococcus aureus
SNLQYKPNQPHG

SEQ ID NO: 1561031 - protein, 5 aa, Staphylococcus aureus
SNRIE

SEQ ID NO: 1561032 - protein, 4 aa, Staphylococcus aureus
SNVV

SEQ ID NO: 1561033 - protein, 6 aa, Staphylococcus aureus
SPGNPV

SEQ ID NO: 1561034 - protein, 6 aa, Staphylococcus aureus
SPGVGK

SEQ ID NO: 1561035 - protein, 9 aa, Staphylococcus aureus
SPRERQQTL

SEQ ID NO: 1561036 - protein, 10 aa, Staphylococcus aureus
SQAAEQQSIS

SEQ ID NO: 1561037 - protein, 6 aa, Staphylococcus aureus
SQKSLQ

SEQ ID NO: 1561038 - protein, 6 aa, Staphylococcus aureus
SQTLAG

SEQ ID NO: 1561039 - protein, 5 aa, Staphylococcus aureus
SSDPF

SEQ ID NO: 1561040 - protein, 8 aa, Staphylococcus aureus
SSGASQQA

SEQ ID NO: 1561041 - protein, 7 aa, Staphylococcus aureus
SSLQAGS

SEQ ID NO: 1561042 - protein, 8 aa, Staphylococcus aureus
SSLQSVNT

SEQ ID NO: 1561043 - protein, 7 aa, Staphylococcus aureus
SSSGTTV

SEQ ID NO: 1561044 - protein, 9 aa, Staphylococcus aureus
SSSTPSMAG

SEQ ID NO: 1561045 - protein, 7 aa, Staphylococcus aureus
STHTNHP

SEQ ID NO: 1561046 - protein, 4 aa, Staphylococcus aureus
STQQ

SEQ ID NO: 1561047 - protein, 11 aa, Staphylococcus aureus
SVGGPASYSTI

SEQ ID NO: 1561048 - protein, 5 aa, Staphylococcus aureus
SVYST

SEQ ID NO: 1561049 - protein, 6 aa, Staphylococcus aureus
SYEDGD

SEQ ID NO: 1561050 - protein, 15 aa, Staphylococcus aureus
TAQSEINSQKERAIA

SEQ ID NO: 1561051 - protein, 16 aa, Staphylococcus aureus
TAVGQKEEVAKNTEKV

SEQ ID NO: 1561052 - protein, 11 aa, Staphylococcus aureus
TDDDPKSQRKV

SEQ ID NO: 1561053 - protein, 5 aa, Staphylococcus aureus
TDDTK

SEQ ID NO: 1561054 - protein, 4 aa, Staphylococcus aureus
TEPD

SEQ ID NO: 1561055 - protein, 6 aa, Staphylococcus aureus
TEQEMK

SEQ ID NO: 1561056 - protein, 5 aa, Staphylococcus aureus
TETDY

SEQ ID NO: 1561057 - protein, 8 aa, Staphylococcus aureus
TGKTYPPE

SEQ ID NO: 1561058 - protein, 4 aa, Staphylococcus aureus
TGSL

SEQ ID NO: 1561059 - protein, 7 aa, Staphylococcus aureus
THRKPGL

SEQ ID NO: 1561060 - protein, 6 aa, Staphylococcus aureus
TKDREI

SEQ ID NO: 1561061 - protein, 4 aa, Staphylococcus aureus
TKLD

SEQ ID NO: 1561062 - protein, 17 aa, Staphylococcus aureus
TNKEDYYATGGHKSANR

SEQ ID NO: 1561063 - protein, 9 aa, Staphylococcus aureus
TNNQSGELT

SEQ ID NO: 1561064 - protein, 7 aa, Staphylococcus aureus
TQEDISP

SEQ ID NO: 1561065 - protein, 5 aa, Staphylococcus aureus
TQERK

SEQ ID NO: 1561066 - protein, 9 aa, Staphylococcus aureus
TRDESKDQM

SEQ ID NO: 1561067 - protein, 6 aa, Staphylococcus aureus
TSEVDS

SEQ ID NO: 1561068 - protein, 7 aa, Staphylococcus aureus
TSHDKYQ

SEQ ID NO: 1561069 - protein, 4 aa, Staphylococcus aureus
TSNP

SEQ ID NO: 1561070 - protein, 4 aa, Staphylococcus aureus
TSPS

SEQ ID NO: 1561071 - protein, 21 aa, Staphylococcus aureus
TSRSKGDKVTKKIKIEEAQAH

SEQ ID NO: 1561072 - protein, 6 aa, Staphylococcus aureus
TSSSEA

SEQ ID NO: 1561073 - protein, 12 aa, Staphylococcus aureus
TSTPERKKQVDF

SEQ ID NO: 1561074 - protein, 11 aa, Staphylococcus aureus
TTGNKSESDKI

SEQ ID NO: 1561075 - protein, 5 aa, Staphylococcus aureus
TTIEN

SEQ ID NO: 1561076 - protein, 4 aa, Staphylococcus aureus
TTRI

SEQ ID NO: 1561077 - protein, 5 aa, Staphylococcus aureus
TTRQA

SEQ ID NO: 1561078 - protein, 7 aa, Staphylococcus aureus
TTTTKND

SEQ ID NO: 1561079 - protein, 6 aa, Staphylococcus aureus
TYIPNK

SEQ ID NO: 1561080 - protein, 6 aa, Staphylococcus aureus
VAGNTI

SEQ ID NO: 1561081 - protein, 16 aa, Staphylococcus aureus
VDGVQNAQLNGQTNRE

SEQ ID NO: 1561082 - protein, 9 aa, Staphylococcus aureus
VGAQFGQDA

SEQ ID NO: 1561083 - protein, 5 aa, Staphylococcus aureus
VGAQS

SEQ ID NO: 1561084 - protein, 4 aa, Staphylococcus aureus
VGFG

SEQ ID NO: 1561085 - protein, 4 aa, Staphylococcus aureus
VGKT

SEQ ID NO: 1561086 - protein, 9 aa, Staphylococcus aureus
VGRPDVKGR

SEQ ID NO: 1561087 - protein, 9 aa, Staphylococcus aureus
VKDHAKDAI

SEQ ID NO: 1561088 - protein, 7 aa, Staphylococcus aureus
VNGKEVT

SEQ ID NO: 1561089 - protein, 7 aa, Staphylococcus aureus
VNGKPFK

SEQ ID NO: 1561090 - protein, 11 aa, Staphylococcus aureus
VNGKSIKGKAL

SEQ ID NO: 1561091 - protein, 8 aa, Staphylococcus aureus
VNKNSTTM

SEQ ID NO: 1561092 - protein, 5 aa, Staphylococcus aureus
VPAGS

SEQ ID NO: 1561093 - protein, 7 aa, Staphylococcus aureus
VPDDDNR

SEQ ID NO: 1561094 - protein, 8 aa, Staphylococcus aureus
VPMSESEV

SEQ ID NO: 1561095 - protein, 4 aa, Staphylococcus aureus
VPQT

SEQ ID NO: 1561096 - protein, 9 aa, Staphylococcus aureus
VRGKENTEV

SEQ ID NO: 1561097 - protein, 7 aa, Staphylococcus aureus
VSPYKEQ

SEQ ID NO: 1561098 - protein, 18 aa, Staphylococcus aureus
VSSTPTKDAQNNRDIKYK

SEQ ID NO: 1561099 - protein, 8 aa, Staphylococcus aureus
VTEQETNI

SEQ ID NO: 1561100 - protein, 13 aa, Staphylococcus aureus
VTLGKASDKPEFN

SEQ ID NO: 1561101 - protein, 10 aa, Staphylococcus aureus
VTYKTTAQNV

SEQ ID NO: 1561102 - protein, 22 aa, Staphylococcus aureus
WNPVNHDNDQMNQVTQPTNDAQ

SEQ ID NO: 1561103 - protein, 5 aa, Staphylococcus aureus
WPPSG

SEQ ID NO: 1561104 - protein, 23 aa, Staphylococcus aureus
YATPSTDTAVASAPDDKSGVASG

SEQ ID NO: 1561105 - protein, 4 aa, Staphylococcus aureus
YDNE

SEQ ID NO: 1561106 - protein, 14 aa, Staphylococcus aureus
YEATSNGSDSVEFT

SEQ ID NO: 1561107 - protein, 8 aa, Staphylococcus aureus
YNHAKPPK

SEQ ID NO: 1561108 - protein, 13 aa, Staphylococcus aureus
YRKSTDEDIQTNN

SEQ ID NO: 1561109 - protein, 8 aa, Staphylococcus aureus
YSETANEL

SEQ ID NO: 1561110 - protein, 5 aa, Staphylococcus aureus
YTLEG

SEQ ID NO: 1561111 - protein, 5 aa, Staphylococcus aureus
AAGAD

SEQ ID NO: 1561112 - protein, 8 aa, Staphylococcus aureus
ADKPGFAS

SEQ ID NO: 1561113 - protein, 7 aa, Staphylococcus aureus
ADPTRNG

SEQ ID NO: 1561114 - protein, 9 aa, Staphylococcus aureus
AEKHGDKIT

SEQ ID NO: 1561115 - protein, 7 aa, Staphylococcus aureus
AETERDT

SEQ ID NO: 1561116 - protein, 6 aa, Staphylococcus aureus
AGEAGA

SEQ ID NO: 1561117 - protein, 7 aa, Staphylococcus aureus
AGGSTDL

SEQ ID NO: 1561118 - protein, 4 aa, Staphylococcus aureus
AIST

SEQ ID NO: 1561119 - protein, 17 aa, Staphylococcus aureus
AKNIADEYDVDSRKSAS

SEQ ID NO: 1561120 - protein, 9 aa, Staphylococcus aureus
AKRYKNEYN

SEQ ID NO: 1561121 - protein, 6 aa, Staphylococcus aureus
ALVGGN

SEQ ID NO: 1561122 - protein, 6 aa, Staphylococcus aureus
AMGASP

SEQ ID NO: 1561123 - protein, 8 aa, Staphylococcus aureus
ANNQELAT

SEQ ID NO: 1561124 - protein, 7 aa, Staphylococcus aureus
ANTFHSD

SEQ ID NO: 1561125 - protein, 11 aa, Staphylococcus aureus
AQITNANYKRH

SEQ ID NO: 1561126 - protein, 22 aa, Staphylococcus aureus
ASQTGTFRGRNSNFNGEGFSRQ

SEQ ID NO: 1561127 - protein, 9 aa, Staphylococcus aureus
ASSGPDEEW

SEQ ID NO: 1561128 - protein, 7 aa, Staphylococcus aureus
ATEEHHH

SEQ ID NO: 1561129 - protein, 10 aa, Staphylococcus aureus
ATEKSSPPWN

SEQ ID NO: 1561130 - protein, 5 aa, Staphylococcus aureus
ATGDI

SEQ ID NO: 1561131 - protein, 8 aa, Staphylococcus aureus
AYDTRGKI

SEQ ID NO: 1561132 - protein, 8 aa, Staphylococcus aureus
DASKNNES

SEQ ID NO: 1561133 - protein, 17 aa, Staphylococcus aureus
DDHSNAAMTHTSDAIAS

SEQ ID NO: 1561134 - protein, 7 aa, Staphylococcus aureus
DEDLKTQ

SEQ ID NO: 1561135 - protein, 37 aa, Staphylococcus aureus
DEPYNNEFKKDESKNAKEMKKISKDAQDQDNDDHGGG

SEQ ID NO: 1561136 - protein, 9 aa, Staphylococcus aureus
DGSSDNTAE

SEQ ID NO: 1561137 - protein, 8 aa, Staphylococcus aureus
DIKDKKNV

SEQ ID NO: 1561138 - protein, 6 aa, Staphylococcus aureus
DKTWSD

SEQ ID NO: 1561139 - protein, 7 aa, Staphylococcus aureus
DKYTYAE

SEQ ID NO: 1561140 - protein, 4 aa, Staphylococcus aureus
DLPP

SEQ ID NO: 1561141 - protein, 18 aa, Staphylococcus aureus
DNNGLADQSGLKKGDVIT

SEQ ID NO: 1561142 - protein, 5 aa, Staphylococcus aureus
DNTVG

SEQ ID NO: 1561143 - protein, 5 aa, Staphylococcus aureus
DNVDE

SEQ ID NO: 1561144 - protein, 8 aa, Staphylococcus aureus
DPNFTSEE

SEQ ID NO: 1561145 - protein, 4 aa, Staphylococcus aureus
DPSL

SEQ ID NO: 1561146 - protein, 12 aa, Staphylococcus aureus
DRDVQGGSTITQ

SEQ ID NO: 1561147 - protein, 15 aa, Staphylococcus aureus
DSNDSVKREKGKRGL

SEQ ID NO: 1561148 - protein, 4 aa, Staphylococcus aureus
DSNK

SEQ ID NO: 1561149 - protein, 11 aa, Staphylococcus aureus
DTFKSKQTEMR

SEQ ID NO: 1561150 - protein, 30 aa, Staphylococcus aureus
DTPETVKPNTPVQPFGKEASNYSKKTLTNQ

SEQ ID NO: 1561151 - protein, 11 aa, Staphylococcus aureus
DVSREDQDAYA

SEQ ID NO: 1561152 - protein, 10 aa, Staphylococcus aureus
EAIKPNVHQG

SEQ ID NO: 1561153 - protein, 13 aa, Staphylococcus aureus
EDLKKNKNALSDK

SEQ ID NO: 1561154 - protein, 14 aa, Staphylococcus aureus
EDQPTTYNGKKVEL

SEQ ID NO: 1561155 - protein, 42 aa, Staphylococcus aureus
EDREENLNQHQDKQNIDNTTSKKADKQIHKDSIDKHERFKNS

SEQ ID NO: 1561156 - protein, 10 aa, Staphylococcus aureus
EELDKTNPVV

SEQ ID NO: 1561157 - protein, 11 aa, Staphylococcus aureus
EKDDENSKELE

SEQ ID NO: 1561158 - protein, 5 aa, Staphylococcus aureus
EKDDT

SEQ ID NO: 1561159 - protein, 5 aa, Staphylococcus aureus
EKLTD

SEQ ID NO: 1561160 - protein, 4 aa, Staphylococcus aureus
EKRA

SEQ ID NO: 1561161 - protein, 13 aa, Staphylococcus aureus
EKRQSRRNIEKKD

SEQ ID NO: 1561162 - protein, 9 aa, Staphylococcus aureus
ELSYHKKKE

SEQ ID NO: 1561163 - protein, 5 aa, Staphylococcus aureus
ENGGK

SEQ ID NO: 1561164 - protein, 6 aa, Staphylococcus aureus
ENMEGG

SEQ ID NO: 1561165 - protein, 4 aa, Staphylococcus aureus
ENNV

SEQ ID NO: 1561166 - protein, 17 aa, Staphylococcus aureus
ENRGKANALNQGIKQAS

SEQ ID NO: 1561167 - protein, 5 aa, Staphylococcus aureus
EQGSN

SEQ ID NO: 1561168 - protein, 10 aa, Staphylococcus aureus
EQKHQAVETI

SEQ ID NO: 1561169 - protein, 5 aa, Staphylococcus aureus
EVENA

SEQ ID NO: 1561170 - protein, 11 aa, Staphylococcus aureus
FASTGDTSSDD

SEQ ID NO: 1561171 - protein, 21 aa, Staphylococcus aureus
FEDKGVENSIPSLKAAAKANV

SEQ ID NO: 1561172 - protein, 4 aa, Staphylococcus aureus
FGTT

SEQ ID NO: 1561173 - protein, 8 aa, Staphylococcus aureus
FNEEEKDT

SEQ ID NO: 1561174 - protein, 5 aa, Staphylococcus aureus
GEGYQ

SEQ ID NO: 1561175 - protein, 8 aa, Staphylococcus aureus
GETGLNGA

SEQ ID NO: 1561176 - protein, 6 aa, Staphylococcus aureus
GETKGK

SEQ ID NO: 1561177 - protein, 12 aa, Staphylococcus aureus
GFSQKLKENRLK

SEQ ID NO: 1561178 - protein, 10 aa, Staphylococcus aureus
GGGNGAEALN

SEQ ID NO: 1561179 - protein, 5 aa, Staphylococcus aureus
GGGTG

SEQ ID NO: 1561180 - protein, 9 aa, Staphylococcus aureus
GGIGSPINN

SEQ ID NO: 1561181 - protein, 5 aa, Staphylococcus aureus
GGKAN

SEQ ID NO: 1561182 - protein, 5 aa, Staphylococcus aureus
GGREM

SEQ ID NO: 1561183 - protein, 8 aa, Staphylococcus aureus
GKEPGQAV

SEQ ID NO: 1561184 - protein, 8 aa, Staphylococcus aureus
GKKAEQGV

SEQ ID NO: 1561185 - protein, 46 aa, Staphylococcus aureus
GKQHEAEKKEKKTEFKTTKKKVVKKDKQEDKQTANSKEDIKKSSPL

SEQ ID NO: 1561186 - protein, 13 aa, Staphylococcus aureus
GKTVAEKEVSYDD

SEQ ID NO: 1561187 - protein, 8 aa, Staphylococcus aureus
GLTADDVE

SEQ ID NO: 1561188 - protein, 10 aa, Staphylococcus aureus
GSNASGKSTF

SEQ ID NO: 1561189 - protein, 7 aa, Staphylococcus aureus
GSRGLRK

SEQ ID NO: 1561190 - protein, 4 aa, Staphylococcus aureus
GTKQ

SEQ ID NO: 1561191 - protein, 12 aa, Staphylococcus aureus
GTNTTERIAASE

SEQ ID NO: 1561192 - protein, 7 aa, Staphylococcus aureus
GTSGHTL

SEQ ID NO: 1561193 - protein, 10 aa, Staphylococcus aureus
GVARQPEARG

SEQ ID NO: 1561194 - protein, 6 aa, Staphylococcus aureus
GYTTEG

SEQ ID NO: 1561195 - protein, 5 aa, Staphylococcus aureus
HANGK

SEQ ID NO: 1561196 - protein, 5 aa, Staphylococcus aureus
HENRT

SEQ ID NO: 1561197 - protein, 11 aa, Staphylococcus aureus
HHGSKTSSSKE

SEQ ID NO: 1561198 - protein, 15 aa, Staphylococcus aureus
HNSELDDAERSSSDI

SEQ ID NO: 1561199 - protein, 8 aa, Staphylococcus aureus
HPISTQQH

SEQ ID NO: 1561200 - protein, 5 aa, Staphylococcus aureus
IDEDA

SEQ ID NO: 1561201 - protein, 9 aa, Staphylococcus aureus
IKEKGSSQT

SEQ ID NO: 1561202 - protein, 12 aa, Staphylococcus aureus
IKPTDGADKKHQ

SEQ ID NO: 1561203 - protein, 4 aa, Staphylococcus aureus
INTI

SEQ ID NO: 1561204 - protein, 4 aa, Staphylococcus aureus
IQAS

SEQ ID NO: 1561205 - protein, 6 aa, Staphylococcus aureus
ISSGAD

SEQ ID NO: 1561206 - protein, 4 aa, Staphylococcus aureus
ITET

SEQ ID NO: 1561207 - protein, 13 aa, Staphylococcus aureus
ITNEKYVQNKSNS

SEQ ID NO: 1561208 - protein, 5 aa, Staphylococcus aureus
ITSKN

SEQ ID NO: 1561209 - protein, 5 aa, Staphylococcus aureus
IVDQD

SEQ ID NO: 1561210 - protein, 29 aa, Staphylococcus aureus
IVRSSKSGVTTYNNNTGVANYNDKNEKYH

SEQ ID NO: 1561211 - protein, 10 aa, Staphylococcus aureus
KAAGQGVTNK

SEQ ID NO: 1561212 - protein, 11 aa, Staphylococcus aureus
KATSSDSSVKE

SEQ ID NO: 1561213 - protein, 5 aa, Staphylococcus aureus
KEAPY

SEQ ID NO: 1561214 - protein, 6 aa, Staphylococcus aureus
KEIPKD

SEQ ID NO: 1561215 - protein, 6 aa, Staphylococcus aureus
KGAGHS

SEQ ID NO: 1561216 - protein, 31 aa, Staphylococcus aureus
KGKKSDSSDVKTTTESVDVPYTGKNDKSQKV

SEQ ID NO: 1561217 - protein, 9 aa, Staphylococcus aureus
KGKSVTRNV

SEQ ID NO: 1561218 - protein, 7 aa, Staphylococcus aureus
KGKTASY

SEQ ID NO: 1561219 - protein, 11 aa, Staphylococcus aureus
KHEQALATDAR

SEQ ID NO: 1561220 - protein, 9 aa, Staphylococcus aureus
KHTSTDTKI

SEQ ID NO: 1561221 - protein, 4 aa, Staphylococcus aureus
KIAE

SEQ ID NO: 1561222 - protein, 12 aa, Staphylococcus aureus
KISDKRSKTRGY

SEQ ID NO: 1561223 - protein, 19 aa, Staphylococcus aureus
KKDKRARQGQNDDESSIPG

SEQ ID NO: 1561224 - protein, 12 aa, Staphylococcus aureus
KKLKGVASAAGI

SEQ ID NO: 1561225 - protein, 4 aa, Staphylococcus aureus
KKPI

SEQ ID NO: 1561226 - protein, 9 aa, Staphylococcus aureus
KKPTGGTIK

SEQ ID NO: 1561227 - protein, 19 aa, Staphylococcus aureus
KLDNQEKVDGTKRQDKGKI

SEQ ID NO: 1561228 - protein, 9 aa, Staphylococcus aureus
KLLDSDSNK

SEQ ID NO: 1561229 - protein, 7 aa, Staphylococcus aureus
KLTGGKN

SEQ ID NO: 1561230 - protein, 9 aa, Staphylococcus aureus
KNATTTKTF

SEQ ID NO: 1561231 - protein, 9 aa, Staphylococcus aureus
KNKRSTKSL

SEQ ID NO: 1561232 - protein, 6 aa, Staphylococcus aureus
KNPTKL

SEQ ID NO: 1561233 - protein, 10 aa, Staphylococcus aureus
KPAATITSGT

SEQ ID NO: 1561234 - protein, 10 aa, Staphylococcus aureus
KPAKYKKDSN

SEQ ID NO: 1561235 - protein, 6 aa, Staphylococcus aureus
KPGLDK

SEQ ID NO: 1561236 - protein, 6 aa, Staphylococcus aureus
KQQSAS

SEQ ID NO: 1561237 - protein, 8 aa, Staphylococcus aureus
KQTSLEKH

SEQ ID NO: 1561238 - protein, 5 aa, Staphylococcus aureus
KRGSL

SEQ ID NO: 1561239 - protein, 7 aa, Staphylococcus aureus
KRTYEDD

SEQ ID NO: 1561240 - protein, 47 aa, Staphylococcus aureus
KSFSKAKKALEEKGFKVESKEEYSDDIDEGDVISQSPKGKSVDEGST

SEQ ID NO: 1561241 - protein, 19 aa, Staphylococcus aureus
KVDQQRKKQQQKVDIRRQF

SEQ ID NO: 1561242 - protein, 13 aa, Staphylococcus aureus
KVQGDFGSTTSEI

SEQ ID NO: 1561243 - protein, 5 aa, Staphylococcus aureus
LADKL

SEQ ID NO: 1561244 - protein, 5 aa, Staphylococcus aureus
LDGSL

SEQ ID NO: 1561245 - protein, 8 aa, Staphylococcus aureus
LDNPQKKD

SEQ ID NO: 1561246 - protein, 17 aa, Staphylococcus aureus
LGAPTTQKDGKTVLTAN

SEQ ID NO: 1561247 - protein, 5 aa, Staphylococcus aureus
LKDKN

SEQ ID NO: 1561248 - protein, 14 aa, Staphylococcus aureus
LKQQEQNKADSKLT

SEQ ID NO: 1561249 - protein, 5 aa, Staphylococcus aureus
LNDKN

SEQ ID NO: 1561250 - protein, 4 aa, Staphylococcus aureus
LPEQ

SEQ ID NO: 1561251 - protein, 13 aa, Staphylococcus aureus
LPNANPKSNVIPK

SEQ ID NO: 1561252 - protein, 9 aa, Staphylococcus aureus
LSTSKNIRD

SEQ ID NO: 1561253 - protein, 5 aa, Staphylococcus aureus
LTESA

SEQ ID NO: 1561254 - protein, 7 aa, Staphylococcus aureus
LTPYRGH

SEQ ID NO: 1561255 - protein, 13 aa, Staphylococcus aureus
MGGNEPTNNPTLQ

SEQ ID NO: 1561256 - protein, 6 aa, Staphylococcus aureus
MGSKRP

SEQ ID NO: 1561257 - protein, 13 aa, Staphylococcus aureus
MKGEPQPEVDKPK

SEQ ID NO: 1561258 - protein, 16 aa, Staphylococcus aureus
MPKKSINEQQKLEQTR

SEQ ID NO: 1561259 - protein, 14 aa, Staphylococcus aureus
MSSSKKKKSISDDP

SEQ ID NO: 1561260 - protein, 7 aa, Staphylococcus aureus
NEEDLDD

SEQ ID NO: 1561261 - protein, 5 aa, Staphylococcus aureus
NEIDK

SEQ ID NO: 1561262 - protein, 25 aa, Staphylococcus aureus
NETIKEVKTNPKEYANRLKNNPKAF

SEQ ID NO: 1561263 - protein, 11 aa, Staphylococcus aureus
NEVESNNEVNF

SEQ ID NO: 1561264 - protein, 4 aa, Staphylococcus aureus
NINS

SEQ ID NO: 1561265 - protein, 4 aa, Staphylococcus aureus
NIPS

SEQ ID NO: 1561266 - protein, 5 aa, Staphylococcus aureus
NKTSS

SEQ ID NO: 1561267 - protein, 6 aa, Staphylococcus aureus
NLTRAN

SEQ ID NO: 1561268 - protein, 7 aa, Staphylococcus aureus
NNSQDTH

SEQ ID NO: 1561269 - protein, 8 aa, Staphylococcus aureus
NPHKAAQA

SEQ ID NO: 1561270 - protein, 8 aa, Staphylococcus aureus
NPSNQQQN

SEQ ID NO: 1561271 - protein, 4 aa, Staphylococcus aureus
NRNH

SEQ ID NO: 1561272 - protein, 6 aa, Staphylococcus aureus
PAADPE

SEQ ID NO: 1561273 - protein, 9 aa, Staphylococcus aureus
PEGLQGQNI

SEQ ID NO: 1561274 - protein, 27 aa, Staphylococcus aureus
PEKMADNLKKQGSYVPGIRPGEQTKKY

SEQ ID NO: 1561275 - protein, 14 aa, Staphylococcus aureus
PEMNAHGSSMTNTV

SEQ ID NO: 1561276 - protein, 7 aa, Staphylococcus aureus
PKGGGAY

SEQ ID NO: 1561277 - protein, 10 aa, Staphylococcus aureus
PKKSTTSGFQ

SEQ ID NO: 1561278 - protein, 7 aa, Staphylococcus aureus
PKTKKTE

SEQ ID NO: 1561279 - protein, 17 aa, Staphylococcus aureus
PLDSEESSRIEYDEDTG

SEQ ID NO: 1561280 - protein, 12 aa, Staphylococcus aureus
PTKAQKNSHSKY

SEQ ID NO: 1561281 - protein, 21 aa, Staphylococcus aureus
PYGYTPYEKDGTLKSDKDLKY

SEQ ID NO: 1561282 - protein, 12 aa, Staphylococcus aureus
QANKISRQITNN

SEQ ID NO: 1561283 - protein, 15 aa, Staphylococcus aureus
QDKTTEYARKTRRSV

SEQ ID NO: 1561284 - protein, 12 aa, Staphylococcus aureus
QEINQQVKQQQA

SEQ ID NO: 1561285 - protein, 4 aa, Staphylococcus aureus
QFGE

SEQ ID NO: 1561286 - protein, 10 aa, Staphylococcus aureus
QGTPTSTVEQ

SEQ ID NO: 1561287 - protein, 15 aa, Staphylococcus aureus
QPKKNRELKDEKISK

SEQ ID NO: 1561288 - protein, 4 aa, Staphylococcus aureus
QQAN

SEQ ID NO: 1561289 - protein, 8 aa, Staphylococcus aureus
QQKHELEE

SEQ ID NO: 1561290 - protein, 5 aa, Staphylococcus aureus
QRPSV

SEQ ID NO: 1561291 - protein, 5 aa, Staphylococcus aureus
QRTSQ

SEQ ID NO: 1561292 - protein, 14 aa, Staphylococcus aureus
QSEYFEDTTDENRQ

SEQ ID NO: 1561293 - protein, 16 aa, Staphylococcus aureus
RDDRPVDASYAKNRKI

SEQ ID NO: 1561294 - protein, 11 aa, Staphylococcus aureus
RDPLAGKTVTG

SEQ ID NO: 1561295 - protein, 4 aa, Staphylococcus aureus
RDRQ

SEQ ID NO: 1561296 - protein, 5 aa, Staphylococcus aureus
REETE

SEQ ID NO: 1561297 - protein, 5 aa, Staphylococcus aureus
RGKDD

SEQ ID NO: 1561298 - protein, 7 aa, Staphylococcus aureus
RKDRRQM

SEQ ID NO: 1561299 - protein, 7 aa, Staphylococcus aureus
RNEEKRI

SEQ ID NO: 1561300 - protein, 4 aa, Staphylococcus aureus
RNTK

SEQ ID NO: 1561301 - protein, 11 aa, Staphylococcus aureus
RQGSDTYKGRL

SEQ ID NO: 1561302 - protein, 5 aa, Staphylococcus aureus
RQPGK

SEQ ID NO: 1561303 - protein, 12 aa, Staphylococcus aureus
RQYGEGYYSRRE

SEQ ID NO: 1561304 - protein, 4 aa, Staphylococcus aureus
SAFG

SEQ ID NO: 1561305 - protein, 4 aa, Staphylococcus aureus
SASG

SEQ ID NO: 1561306 - protein, 17 aa, Staphylococcus aureus
SASTGRNDGLGITTPSA

SEQ ID NO: 1561307 - protein, 7 aa, Staphylococcus aureus
SDQQSKK

SEQ ID NO: 1561308 - protein, 8 aa, Staphylococcus aureus
SEENSESV

SEQ ID NO: 1561309 - protein, 12 aa, Staphylococcus aureus
SEQIKNKQEQAA

SEQ ID NO: 1561310 - protein, 8 aa, Staphylococcus aureus
SFESKEPV

SEQ ID NO: 1561311 - protein, 6 aa, Staphylococcus aureus
SGTGYH

SEQ ID NO: 1561312 - protein, 10 aa, Staphylococcus aureus
SGTISAKEAA

SEQ ID NO: 1561313 - protein, 7 aa, Staphylococcus aureus
SIEDTNN

SEQ ID NO: 1561314 - protein, 5 aa, Staphylococcus aureus
SIEPT

SEQ ID NO: 1561315 - protein, 13 aa, Staphylococcus aureus
SKDLNDKYSPSKL

SEQ ID NO: 1561316 - protein, 6 aa, Staphylococcus aureus
SNAIAS

SEQ ID NO: 1561317 - protein, 5 aa, Staphylococcus aureus
SPLEH

SEQ ID NO: 1561318 - protein, 8 aa, Staphylococcus aureus
SQATRDHI

SEQ ID NO: 1561319 - protein, 23 aa, Staphylococcus aureus
SSAVRSGKSYAEKEQWTSPDKAI

SEQ ID NO: 1561320 - protein, 20 aa, Staphylococcus aureus
SSQTDSRTIIGTGGAEKLLG

SEQ ID NO: 1561321 - protein, 4 aa, Staphylococcus aureus
SSSD

SEQ ID NO: 1561322 - protein, 8 aa, Staphylococcus aureus
SSTRNIKG

SEQ ID NO: 1561323 - protein, 7 aa, Staphylococcus aureus
STAGDTW

SEQ ID NO: 1561324 - protein, 13 aa, Staphylococcus aureus
STDQANNKSTTTF

SEQ ID NO: 1561325 - protein, 6 aa, Staphylococcus aureus
STLQSL

SEQ ID NO: 1561326 - protein, 10 aa, Staphylococcus aureus
STPAEGIPKE

SEQ ID NO: 1561327 - protein, 9 aa, Staphylococcus aureus
STVKDIEQK

SEQ ID NO: 1561328 - protein, 5 aa, Staphylococcus aureus
SYTTH

SEQ ID NO: 1561329 - protein, 10 aa, Staphylococcus aureus
TASTGGATNL

SEQ ID NO: 1561330 - protein, 15 aa, Staphylococcus aureus
TGKDIIPPKTYSGNV

SEQ ID NO: 1561331 - protein, 26 aa, Staphylococcus aureus
TINLGNAEQARGSEIAKQAKDLTAHT

SEQ ID NO: 1561332 - protein, 7 aa, Staphylococcus aureus
TNEHNLD

SEQ ID NO: 1561333 - protein, 12 aa, Staphylococcus aureus
TNEKTYSRKANE

SEQ ID NO: 1561334 - protein, 8 aa, Staphylococcus aureus
TNHAGELV

SEQ ID NO: 1561335 - protein, 7 aa, Staphylococcus aureus
TNIPDSG

SEQ ID NO: 1561336 - protein, 5 aa, Staphylococcus aureus
TNLGE

SEQ ID NO: 1561337 - protein, 16 aa, Staphylococcus aureus
TRDGQAALDFVQQQFE

SEQ ID NO: 1561338 - protein, 11 aa, Staphylococcus aureus
TRGRKTTQSEM

SEQ ID NO: 1561339 - protein, 6 aa, Staphylococcus aureus
TRIDSN

SEQ ID NO: 1561340 - protein, 4 aa, Staphylococcus aureus
TSSG

SEQ ID NO: 1561341 - protein, 40 aa, Staphylococcus aureus
TTDNGTGTVTNTVTGLPSGLSYDSATNSIIGTPTKIGQST

SEQ ID NO: 1561342 - protein, 6 aa, Staphylococcus aureus
TTKLEQ

SEQ ID NO: 1561343 - protein, 4 aa, Staphylococcus aureus
TVEP

SEQ ID NO: 1561344 - protein, 4 aa, Staphylococcus aureus
TVSS

SEQ ID NO: 1561345 - protein, 7 aa, Staphylococcus aureus
VEDSRNG

SEQ ID NO: 1561346 - protein, 12 aa, Staphylococcus aureus
VEKKEKEENSLK

SEQ ID NO: 1561347 - protein, 7 aa, Staphylococcus aureus
VGDRVKA

SEQ ID NO: 1561348 - protein, 5 aa, Staphylococcus aureus
VKEPK

SEQ ID NO: 1561349 - protein, 12 aa, Staphylococcus aureus
VKGKKTLDQDTF

SEQ ID NO: 1561350 - protein, 14 aa, Staphylococcus aureus
VKPATKPDASWDEM

SEQ ID NO: 1561351 - protein, 6 aa, Staphylococcus aureus
VNDEDI

SEQ ID NO: 1561352 - protein, 5 aa, Staphylococcus aureus
VNGDY

SEQ ID NO: 1561353 - protein, 9 aa, Staphylococcus aureus
VNGKTEYAG

SEQ ID NO: 1561354 - protein, 8 aa, Staphylococcus aureus
VNRKSEGI

SEQ ID NO: 1561355 - protein, 7 aa, Staphylococcus aureus
VSQKDYD

SEQ ID NO: 1561356 - protein, 5 aa, Staphylococcus aureus
VTAES

SEQ ID NO: 1561357 - protein, 8 aa, Staphylococcus aureus
VVDNGGKI

SEQ ID NO: 1561358 - protein, 10 aa, Staphylococcus aureus
YAPSKNKQSR

SEQ ID NO: 1561359 - protein, 11 aa, Staphylococcus aureus
YEKPPKSEKDP

SEQ ID NO: 1561360 - protein, 6 aa, Staphylococcus aureus
YGYQDV

SEQ ID NO: 1561361 - protein, 11 aa, Staphylococcus aureus
YNTEDVDAHNY

SEQ ID NO: 1561362 - protein, 5 aa, Staphylococcus aureus
YTHDK

SEQ ID NO: 1561363 - protein, 4 aa, Staphylococcus aureus
AEFR

SEQ ID NO: 1561364 - protein, 6 aa, Staphylococcus aureus
AGEHAD

SEQ ID NO: 1561365 - protein, 14 aa, Staphylococcus aureus
AGETKDPVKTIPKA

SEQ ID NO: 1561366 - protein, 5 aa, Staphylococcus aureus
AGPSS

SEQ ID NO: 1561367 - protein, 5 aa, Staphylococcus aureus
AGQAG

SEQ ID NO: 1561368 - protein, 6 aa, Staphylococcus aureus
AGQLGK

SEQ ID NO: 1561369 - protein, 4 aa, Staphylococcus aureus
ALKN

SEQ ID NO: 1561370 - protein, 5 aa, Staphylococcus aureus
ANEDR

SEQ ID NO: 1561371 - protein, 8 aa, Staphylococcus aureus
ANQNGKEI

SEQ ID NO: 1561372 - protein, 15 aa, Staphylococcus aureus
ANRQDEPNDKKATSV

SEQ ID NO: 1561373 - protein, 11 aa, Staphylococcus aureus
ASAGDKFSGNA

SEQ ID NO: 1561374 - protein, 6 aa, Staphylococcus aureus
ASNDAK

SEQ ID NO: 1561375 - protein, 11 aa, Staphylococcus aureus
ASRYTKPGDEI

SEQ ID NO: 1561376 - protein, 8 aa, Staphylococcus aureus
AVKSPAIA

SEQ ID NO: 1561377 - protein, 8 aa, Staphylococcus aureus
AYKENESI

SEQ ID NO: 1561378 - protein, 11 aa, Staphylococcus aureus
AYVGSGAAQFK

SEQ ID NO: 1561379 - protein, 9 aa, Staphylococcus aureus
DAYSQKGAI

SEQ ID NO: 1561380 - protein, 41 aa, Staphylococcus aureus
DFDDSGAKDFNSLSSKDREKLEKEIEKNGGKMFESILKKAS

SEQ ID NO: 1561381 - protein, 11 aa, Staphylococcus aureus
DGLEEPPVEPG

SEQ ID NO: 1561382 - protein, 20 aa, Staphylococcus aureus
DKDNDGSTEKGSFDITSDQR

SEQ ID NO: 1561383 - protein, 7 aa, Staphylococcus aureus
DKPLIPA

SEQ ID NO: 1561384 - protein, 5 aa, Staphylococcus aureus
DLNAG

SEQ ID NO: 1561385 - protein, 4 aa, Staphylococcus aureus
DQEV

SEQ ID NO: 1561386 - protein, 9 aa, Staphylococcus aureus
DQIGKGTKW

SEQ ID NO: 1561387 - protein, 10 aa, Staphylococcus aureus
DSDVKTHQTL

SEQ ID NO: 1561388 - protein, 7 aa, Staphylococcus aureus
DSKPEDT

SEQ ID NO: 1561389 - protein, 6 aa, Staphylococcus aureus
EDPNYS

SEQ ID NO: 1561390 - protein, 13 aa, Staphylococcus aureus
EETVAKSKFDTKG

SEQ ID NO: 1561391 - protein, 27 aa, Staphylococcus aureus
EIESPEAGDDHHYDESGEEIKASNKSF

SEQ ID NO: 1561392 - protein, 7 aa, Staphylococcus aureus
EKADHEI

SEQ ID NO: 1561393 - protein, 8 aa, Staphylococcus aureus
EKVTQGQP

SEQ ID NO: 1561394 - protein, 19 aa, Staphylococcus aureus
ELKAGQNIRVENGETIPAD

SEQ ID NO: 1561395 - protein, 7 aa, Staphylococcus aureus
ELSKGKT

SEQ ID NO: 1561396 - protein, 5 aa, Staphylococcus aureus
ENTLN

SEQ ID NO: 1561397 - protein, 11 aa, Staphylococcus aureus
EQSHNKEEAIK

SEQ ID NO: 1561398 - protein, 4 aa, Staphylococcus aureus
ERGI

SEQ ID NO: 1561399 - protein, 6 aa, Staphylococcus aureus
ERKNEI

SEQ ID NO: 1561400 - protein, 17 aa, Staphylococcus aureus
ESVEPGVTKHIEEEVIK

SEQ ID NO: 1561401 - protein, 8 aa, Staphylococcus aureus
ETDRFDGK

SEQ ID NO: 1561402 - protein, 19 aa, Staphylococcus aureus
ETGNGKSELAKGIKDGKKR

SEQ ID NO: 1561403 - protein, 6 aa, Staphylococcus aureus
ETHRTA

SEQ ID NO: 1561404 - protein, 14 aa, Staphylococcus aureus
EVTGEFNKETNNKF

SEQ ID NO: 1561405 - protein, 11 aa, Staphylococcus aureus
EYSKTGDNDYS

SEQ ID NO: 1561406 - protein, 10 aa, Staphylococcus aureus
FDAENSSNNI

SEQ ID NO: 1561407 - protein, 6 aa, Staphylococcus aureus
FSETEL

SEQ ID NO: 1561408 - protein, 7 aa, Staphylococcus aureus
GDATFGS

SEQ ID NO: 1561409 - protein, 4 aa, Staphylococcus aureus
GDLG

SEQ ID NO: 1561410 - protein, 10 aa, Staphylococcus aureus
GDNAPQGVAV

SEQ ID NO: 1561411 - protein, 7 aa, Staphylococcus aureus
GEGPILG

SEQ ID NO: 1561412 - protein, 5 aa, Staphylococcus aureus
GESIK

SEQ ID NO: 1561413 - protein, 6 aa, Staphylococcus aureus
GGEENL

SEQ ID NO: 1561414 - protein, 9 aa, Staphylococcus aureus
GGETTSKGL

SEQ ID NO: 1561415 - protein, 9 aa, Staphylococcus aureus
GGGGTFPIQ

SEQ ID NO: 1561416 - protein, 10 aa, Staphylococcus aureus
GGPYNQIRGT

SEQ ID NO: 1561417 - protein, 4 aa, Staphylococcus aureus
GGQS

SEQ ID NO: 1561418 - protein, 7 aa, Staphylococcus aureus
GISGGQF

SEQ ID NO: 1561419 - protein, 8 aa, Staphylococcus aureus
GKKAEPVK

SEQ ID NO: 1561420 - protein, 4 aa, Staphylococcus aureus
GKSL

SEQ ID NO: 1561421 - protein, 8 aa, Staphylococcus aureus
GLGSGAAN

SEQ ID NO: 1561422 - protein, 6 aa, Staphylococcus aureus
GNGYNT

SEQ ID NO: 1561423 - protein, 5 aa, Staphylococcus aureus
GPLAT

SEQ ID NO: 1561424 - protein, 5 aa, Staphylococcus aureus
GQIDK

SEQ ID NO: 1561425 - protein, 7 aa, Staphylococcus aureus
GRVGTGN

SEQ ID NO: 1561426 - protein, 4 aa, Staphylococcus aureus
GTQA

SEQ ID NO: 1561427 - protein, 5 aa, Staphylococcus aureus
GYSSN

SEQ ID NO: 1561428 - protein, 7 aa, Staphylococcus aureus
HAPQPEV

SEQ ID NO: 1561429 - protein, 24 aa, Staphylococcus aureus
HGGSIDVKSELGKGTTFIIKLPKP

SEQ ID NO: 1561430 - protein, 8 aa, Staphylococcus aureus
HYERDGKT

SEQ ID NO: 1561431 - protein, 8 aa, Staphylococcus aureus
IAKGLGQN

SEQ ID NO: 1561432 - protein, 4 aa, Staphylococcus aureus
IENP

SEQ ID NO: 1561433 - protein, 27 aa, Staphylococcus aureus
INGLTNPVKVDNEKLNKVKDHQAGGNA

SEQ ID NO: 1561434 - protein, 6 aa, Staphylococcus aureus
IPQLNE

SEQ ID NO: 1561435 - protein, 9 aa, Staphylococcus aureus
IQKGSHDEL

SEQ ID NO: 1561436 - protein, 9 aa, Staphylococcus aureus
ITQNSSGGL

SEQ ID NO: 1561437 - protein, 11 aa, Staphylococcus aureus
KAKNDVEETKD

SEQ ID NO: 1561438 - protein, 8 aa, Staphylococcus aureus
KASEAENN

SEQ ID NO: 1561439 - protein, 11 aa, Staphylococcus aureus
KDDPSQSANVL

SEQ ID NO: 1561440 - protein, 8 aa, Staphylococcus aureus
KDDPSVSK

SEQ ID NO: 1561441 - protein, 6 aa, Staphylococcus aureus
KDILEE

SEQ ID NO: 1561442 - protein, 8 aa, Staphylococcus aureus
KGLTYGNA

SEQ ID NO: 1561443 - protein, 6 aa, Staphylococcus aureus
KGMGST

SEQ ID NO: 1561444 - protein, 6 aa, Staphylococcus aureus
KKNKSF

SEQ ID NO: 1561445 - protein, 21 aa, Staphylococcus aureus
KKVKASPTTKYEIASNTKAFT

SEQ ID NO: 1561446 - protein, 17 aa, Staphylococcus aureus
KNGVSSGGSNESNGNTE

SEQ ID NO: 1561447 - protein, 10 aa, Staphylococcus aureus
KPGKANTRNA

SEQ ID NO: 1561448 - protein, 12 aa, Staphylococcus aureus
KQHPAGPEQITS

SEQ ID NO: 1561449 - protein, 6 aa, Staphylococcus aureus
KQRGVL

SEQ ID NO: 1561450 - protein, 5 aa, Staphylococcus aureus
KSAVT

SEQ ID NO: 1561451 - protein, 7 aa, Staphylococcus aureus
KSGTTNF

SEQ ID NO: 1561452 - protein, 8 aa, Staphylococcus aureus
KSPASPGS

SEQ ID NO: 1561453 - protein, 9 aa, Staphylococcus aureus
KSVKEAEQI

SEQ ID NO: 1561454 - protein, 11 aa, Staphylococcus aureus
KTMDTAKPVEK

SEQ ID NO: 1561455 - protein, 14 aa, Staphylococcus aureus
KVEPSNDFKPKKGD

SEQ ID NO: 1561456 - protein, 6 aa, Staphylococcus aureus
KYGPRP

SEQ ID NO: 1561457 - protein, 5 aa, Staphylococcus aureus
KYHAK

SEQ ID NO: 1561458 - protein, 11 aa, Staphylococcus aureus
LADEGNKPAKI

SEQ ID NO: 1561459 - protein, 8 aa, Staphylococcus aureus
LAKGLGQN

SEQ ID NO: 1561460 - protein, 17 aa, Staphylococcus aureus
LDEEEGRKESNSDLKEK

SEQ ID NO: 1561461 - protein, 8 aa, Staphylococcus aureus
LDTSRKPF

SEQ ID NO: 1561462 - protein, 12 aa, Staphylococcus aureus
LGADQAAKAGQS

SEQ ID NO: 1561463 - protein, 9 aa, Staphylococcus aureus
LGYSESNSF

SEQ ID NO: 1561464 - protein, 13 aa, Staphylococcus aureus
LNKESKKQEFENS

SEQ ID NO: 1561465 - protein, 4 aa, Staphylococcus aureus
LPKG

SEQ ID NO: 1561466 - protein, 8 aa, Staphylococcus aureus
LPSTPNKA

SEQ ID NO: 1561467 - protein, 9 aa, Staphylococcus aureus
LSSENPPAS

SEQ ID NO: 1561468 - protein, 5 aa, Staphylococcus aureus
LVNEE

SEQ ID NO: 1561469 - protein, 8 aa, Staphylococcus aureus
NENFSNSN

SEQ ID NO: 1561470 - protein, 6 aa, Staphylococcus aureus
NGKIDG

SEQ ID NO: 1561471 - protein, 7 aa, Staphylococcus aureus
NGRDYRR

SEQ ID NO: 1561472 - protein, 6 aa, Staphylococcus aureus
NHSEYV

SEQ ID NO: 1561473 - protein, 4 aa, Staphylococcus aureus
NKTR

SEQ ID NO: 1561474 - protein, 39 aa, Staphylococcus aureus
NQQSALTAKGYNYTSVDSSYASTYNDTNKTVKMTNAGQS

SEQ ID NO: 1561475 - protein, 5 aa, Staphylococcus aureus
NSTFT

SEQ ID NO: 1561476 - protein, 32 aa, Staphylococcus aureus
NSYEDVNTNTDGSALQINKNTNKQAIKDFLDE

SEQ ID NO: 1561477 - protein, 6 aa, Staphylococcus aureus
NTGNAA

SEQ ID NO: 1561478 - protein, 5 aa, Staphylococcus aureus
PIDDP

SEQ ID NO: 1561479 - protein, 13 aa, Staphylococcus aureus
PKAGGSLDGENMP

SEQ ID NO: 1561480 - protein, 7 aa, Staphylococcus aureus
PKEEALQ

SEQ ID NO: 1561481 - protein, 5 aa, Staphylococcus aureus
PQEEF

SEQ ID NO: 1561482 - protein, 5 aa, Staphylococcus aureus
PRPAL

SEQ ID NO: 1561483 - protein, 13 aa, Staphylococcus aureus
PVGKPPKKKKSKR

SEQ ID NO: 1561484 - protein, 8 aa, Staphylococcus aureus
PYTSGDKY

SEQ ID NO: 1561485 - protein, 9 aa, Staphylococcus aureus
QGSKQHTIT

SEQ ID NO: 1561486 - protein, 4 aa, Staphylococcus aureus
QGYT

SEQ ID NO: 1561487 - protein, 7 aa, Staphylococcus aureus
QKASTSL

SEQ ID NO: 1561488 - protein, 9 aa, Staphylococcus aureus
QKMGNQQVE

SEQ ID NO: 1561489 - protein, 9 aa, Staphylococcus aureus
QNDTSGELK

SEQ ID NO: 1561490 - protein, 7 aa, Staphylococcus aureus
QNNGGLT

SEQ ID NO: 1561491 - protein, 5 aa, Staphylococcus aureus
QQPNI

SEQ ID NO: 1561492 - protein, 4 aa, Staphylococcus aureus
QQRI

SEQ ID NO: 1561493 - protein, 4 aa, Staphylococcus aureus
QRYT

SEQ ID NO: 1561494 - protein, 7 aa, Staphylococcus aureus
QSKVGLN

SEQ ID NO: 1561495 - protein, 8 aa, Staphylococcus aureus
QSLSQSVA

SEQ ID NO: 1561496 - protein, 8 aa, Staphylococcus aureus
QSVTANTE

SEQ ID NO: 1561497 - protein, 4 aa, Staphylococcus aureus
QTVT

SEQ ID NO: 1561498 - protein, 4 aa, Staphylococcus aureus
QVIE

SEQ ID NO: 1561499 - protein, 15 aa, Staphylococcus aureus
RATMQNENKDPYGEK

SEQ ID NO: 1561500 - protein, 11 aa, Staphylococcus aureus
RGKRYGKKKRS

SEQ ID NO: 1561501 - protein, 10 aa, Staphylococcus aureus
RIPKTRRTAG

SEQ ID NO: 1561502 - protein, 35 aa, Staphylococcus aureus
RKDSRDKLKAEYNKYKQDPQSYKDNAKDKATQLGT

SEQ ID NO: 1561503 - protein, 5 aa, Staphylococcus aureus
RMSQT

SEQ ID NO: 1561504 - protein, 7 aa, Staphylococcus aureus
RNGLADP

SEQ ID NO: 1561505 - protein, 4 aa, Staphylococcus aureus
RSAY

SEQ ID NO: 1561506 - protein, 14 aa, Staphylococcus aureus
RVTTVSKDPKNNSR

SEQ ID NO: 1561507 - protein, 15 aa, Staphylococcus aureus
SDKEKVRHNHKTSLK

SEQ ID NO: 1561508 - protein, 8 aa, Staphylococcus aureus
SENATKVN

SEQ ID NO: 1561509 - protein, 5 aa, Staphylococcus aureus
SGLTS

SEQ ID NO: 1561510 - protein, 6 aa, Staphylococcus aureus
SHAFGT

SEQ ID NO: 1561511 - protein, 6 aa, Staphylococcus aureus
SIDKTG

SEQ ID NO: 1561512 - protein, 8 aa, Staphylococcus aureus
SKDLKRAN

SEQ ID NO: 1561513 - protein, 12 aa, Staphylococcus aureus
SNVGESKTVGRY

SEQ ID NO: 1561514 - protein, 10 aa, Staphylococcus aureus
SSESSSKGRI

SEQ ID NO: 1561515 - protein, 6 aa, Staphylococcus aureus
STKLKA

SEQ ID NO: 1561516 - protein, 26 aa, Staphylococcus aureus
TAPTKQPIVKPKEKTKYEFKSGGKKK

SEQ ID NO: 1561517 - protein, 10 aa, Staphylococcus aureus
TASIDPENEQ

SEQ ID NO: 1561518 - protein, 5 aa, Staphylococcus aureus
TASTW

SEQ ID NO: 1561519 - protein, 11 aa, Staphylococcus aureus
TGENETKNDYK

SEQ ID NO: 1561520 - protein, 4 aa, Staphylococcus aureus
TGIN

SEQ ID NO: 1561521 - protein, 4 aa, Staphylococcus aureus
TIKN

SEQ ID NO: 1561522 - protein, 7 aa, Staphylococcus aureus
TKQSYTK

SEQ ID NO: 1561523 - protein, 6 aa, Staphylococcus aureus
TSALDL

SEQ ID NO: 1561524 - protein, 12 aa, Staphylococcus aureus
TVTNRESSSGLK

SEQ ID NO: 1561525 - protein, 10 aa, Staphylococcus aureus
TYSSGDGYHL

SEQ ID NO: 1561526 - protein, 5 aa, Staphylococcus aureus
VAKTP

SEQ ID NO: 1561527 - protein, 5 aa, Staphylococcus aureus
VDDTV

SEQ ID NO: 1561528 - protein, 12 aa, Staphylococcus aureus
VKRRNKQHQEGL

SEQ ID NO: 1561529 - protein, 6 aa, Staphylococcus aureus
VLDQPG

SEQ ID NO: 1561530 - protein, 4 aa, Staphylococcus aureus
VSRL

SEQ ID NO: 1561531 - protein, 16 aa, Staphylococcus aureus
VSTEQINATKDKLGLN

SEQ ID NO: 1561532 - protein, 10 aa, Staphylococcus aureus
VTDQNEARKI

SEQ ID NO: 1561533 - protein, 6 aa, Staphylococcus aureus
YGNTGH

SEQ ID NO: 1561534 - protein, 4 aa, Staphylococcus aureus
YPGL

SEQ ID NO: 1561535 - protein, 8 aa, Staphylococcus aureus
YPKPKRKS

SEQ ID NO: 1561536 - protein, 8 aa, Staphylococcus aureus
YRQQADDL

SEQ ID NO: 1561537 - protein, 11 aa, Staphylococcus aureus
AAGSASIGISA

SEQ ID NO: 1561538 - protein, 11 aa, Staphylococcus aureus
AAINPGNSGGA

SEQ ID NO: 1561539 - protein, 9 aa, Staphylococcus aureus
ADGGGATRI

SEQ ID NO: 1561540 - protein, 14 aa, Staphylococcus aureus
ADGSFYGSDAGAGF

SEQ ID NO: 1561541 - protein, 7 aa, Staphylococcus aureus
ADSDIDL

SEQ ID NO: 1561542 - protein, 14 aa, Staphylococcus aureus
AEQINQADQTFRAQ

SEQ ID NO: 1561543 - protein, 9 aa, Staphylococcus aureus
AKENTSLKS

SEQ ID NO: 1561544 - protein, 9 aa, Staphylococcus aureus
AKGKETPRN

SEQ ID NO: 1561545 - protein, 6 aa, Staphylococcus aureus
ANDGYR

SEQ ID NO: 1561546 - protein, 5 aa, Staphylococcus aureus
ASEDI

SEQ ID NO: 1561547 - protein, 6 aa, Staphylococcus aureus
ATDRRG

SEQ ID NO: 1561548 - protein, 9 aa, Staphylococcus aureus
DDDEHKRNI

SEQ ID NO: 1561549 - protein, 7 aa, Staphylococcus aureus
DENESED

SEQ ID NO: 1561550 - protein, 13 aa, Staphylococcus aureus
DENITVNESVPRG

SEQ ID NO: 1561551 - protein, 8 aa, Staphylococcus aureus
DGKTKEVK

SEQ ID NO: 1561552 - protein, 6 aa, Staphylococcus aureus
DKDKSI

SEQ ID NO: 1561553 - protein, 4 aa, Staphylococcus aureus
EDSI

SEQ ID NO: 1561554 - protein, 7 aa, Staphylococcus aureus
EDTAGGI

SEQ ID NO: 1561555 - protein, 10 aa, Staphylococcus aureus
EGGEMLSGGQ

SEQ ID NO: 1561556 - protein, 8 aa, Staphylococcus aureus
EKLEKGDL

SEQ ID NO: 1561557 - protein, 13 aa, Staphylococcus aureus
EKTVEDNRTSLTD

SEQ ID NO: 1561558 - protein, 6 aa, Staphylococcus aureus
ENSRWS

SEQ ID NO: 1561559 - protein, 9 aa, Staphylococcus aureus
ENVTPNKAL

SEQ ID NO: 1561560 - protein, 6 aa, Staphylococcus aureus
ERLDIG

SEQ ID NO: 1561561 - protein, 10 aa, Staphylococcus aureus
ESLDTNKKIE

SEQ ID NO: 1561562 - protein, 8 aa, Staphylococcus aureus
ESNRSNLI

SEQ ID NO: 1561563 - protein, 6 aa, Staphylococcus aureus
ETDRPE

SEQ ID NO: 1561564 - protein, 13 aa, Staphylococcus aureus
ETYAEQMKSNNYM

SEQ ID NO: 1561565 - protein, 15 aa, Staphylococcus aureus
FTSTANRNETTSSGM

SEQ ID NO: 1561566 - protein, 5 aa, Staphylococcus aureus
GAPNS

SEQ ID NO: 1561567 - protein, 6 aa, Staphylococcus aureus
GGGGLI

SEQ ID NO: 1561568 - protein, 8 aa, Staphylococcus aureus
GKKDPAVL

SEQ ID NO: 1561569 - protein, 8 aa, Staphylococcus aureus
GKKIKDDV

SEQ ID NO: 1561570 - protein, 4 aa, Staphylococcus aureus
GNIE

SEQ ID NO: 1561571 - protein, 5 aa, Staphylococcus aureus
GNYKG

SEQ ID NO: 1561572 - protein, 6 aa, Staphylococcus aureus
GPTTAD

SEQ ID NO: 1561573 - protein, 4 aa, Staphylococcus aureus
GQER

SEQ ID NO: 1561574 - protein, 7 aa, Staphylococcus aureus
GQKPPVD

SEQ ID NO: 1561575 - protein, 24 aa, Staphylococcus aureus
GSITESSTYGDNDTPAPPTDELGG

SEQ ID NO: 1561576 - protein, 12 aa, Staphylococcus aureus
GTPETKSKSISL

SEQ ID NO: 1561577 - protein, 4 aa, Staphylococcus aureus
HQQN

SEQ ID NO: 1561578 - protein, 7 aa, Staphylococcus aureus
HRSDSSV

SEQ ID NO: 1561579 - protein, 13 aa, Staphylococcus aureus
IGKSQLDELSSKD

SEQ ID NO: 1561580 - protein, 16 aa, Staphylococcus aureus
IQTNKQGLEKDKKENL

SEQ ID NO: 1561581 - protein, 7 aa, Staphylococcus aureus
KASSVDD

SEQ ID NO: 1561582 - protein, 15 aa, Staphylococcus aureus
KDIDGTYKPFTAETR

SEQ ID NO: 1561583 - protein, 4 aa, Staphylococcus aureus
KDRT

SEQ ID NO: 1561584 - protein, 4 aa, Staphylococcus aureus
KEDL

SEQ ID NO: 1561585 - protein, 5 aa, Staphylococcus aureus
KESFA

SEQ ID NO: 1561586 - protein, 9 aa, Staphylococcus aureus
KGEQRINGK

SEQ ID NO: 1561587 - protein, 8 aa, Staphylococcus aureus
KGFSKSTK

SEQ ID NO: 1561588 - protein, 14 aa, Staphylococcus aureus
KGKSSKPSEAGVGS

SEQ ID NO: 1561589 - protein, 7 aa, Staphylococcus aureus
KGPVASS

SEQ ID NO: 1561590 - protein, 4 aa, Staphylococcus aureus
KGSD

SEQ ID NO: 1561591 - protein, 11 aa, Staphylococcus aureus
KHFNQDSEKAQ

SEQ ID NO: 1561592 - protein, 7 aa, Staphylococcus aureus
KIDRPSI

SEQ ID NO: 1561593 - protein, 5 aa, Staphylococcus aureus
KKPQH

SEQ ID NO: 1561594 - protein, 8 aa, Staphylococcus aureus
KKQVKAKL

SEQ ID NO: 1561595 - protein, 4 aa, Staphylococcus aureus
KPTN

SEQ ID NO: 1561596 - protein, 6 aa, Staphylococcus aureus
KQKQRG

SEQ ID NO: 1561597 - protein, 11 aa, Staphylococcus aureus
KQNYDKSKLKY

SEQ ID NO: 1561598 - protein, 4 aa, Staphylococcus aureus
KQTY

SEQ ID NO: 1561599 - protein, 13 aa, Staphylococcus aureus
KSEMEKTSWPTKE

SEQ ID NO: 1561600 - protein, 5 aa, Staphylococcus aureus
KSQSL

SEQ ID NO: 1561601 - protein, 21 aa, Staphylococcus aureus
KTPGREDKAAAQQVEATERAQ

SEQ ID NO: 1561602 - protein, 4 aa, Staphylococcus aureus
KVGV

SEQ ID NO: 1561603 - protein, 15 aa, Staphylococcus aureus
LGNPEATDEAVEKAA

SEQ ID NO: 1561604 - protein, 8 aa, Staphylococcus aureus
LNAASDTS

SEQ ID NO: 1561605 - protein, 10 aa, Staphylococcus aureus
LNADPKNTDY

SEQ ID NO: 1561606 - protein, 11 aa, Staphylococcus aureus
LREITKDSKMQ

SEQ ID NO: 1561607 - protein, 8 aa, Staphylococcus aureus
LSNKEQDV

SEQ ID NO: 1561608 - protein, 14 aa, Staphylococcus aureus
LTKEQTKSFNEGVS

SEQ ID NO: 1561609 - protein, 9 aa, Staphylococcus aureus
LTRERSQAL

SEQ ID NO: 1561610 - protein, 4 aa, Staphylococcus aureus
NEIY

SEQ ID NO: 1561611 - protein, 15 aa, Staphylococcus aureus
NEKGSNLSGGEKQRI

SEQ ID NO: 1561612 - protein, 4 aa, Staphylococcus aureus
NGHI

SEQ ID NO: 1561613 - protein, 9 aa, Staphylococcus aureus
NGLGIDKTT

SEQ ID NO: 1561614 - protein, 10 aa, Staphylococcus aureus
NIANAKDKKL

SEQ ID NO: 1561615 - protein, 4 aa, Staphylococcus aureus
NKED

SEQ ID NO: 1561616 - protein, 8 aa, Staphylococcus aureus
NKKPGESV

SEQ ID NO: 1561617 - protein, 10 aa, Staphylococcus aureus
NKNVTEEQQL

SEQ ID NO: 1561618 - protein, 17 aa, Staphylococcus aureus
NLTTEKATVEYNPDQHD

SEQ ID NO: 1561619 - protein, 11 aa, Staphylococcus aureus
NNQAPKGYIAN

SEQ ID NO: 1561620 - protein, 6 aa, Staphylococcus aureus
NNQLQK

SEQ ID NO: 1561621 - protein, 16 aa, Staphylococcus aureus
PDDGVKPADSTQKKAY

SEQ ID NO: 1561622 - protein, 6 aa, Staphylococcus aureus
PNKTIE

SEQ ID NO: 1561623 - protein, 12 aa, Staphylococcus aureus
PNTVSDLSPKGI

SEQ ID NO: 1561624 - protein, 5 aa, Staphylococcus aureus
QDIPQ

SEQ ID NO: 1561625 - protein, 5 aa, Staphylococcus aureus
QIPGD

SEQ ID NO: 1561626 - protein, 5 aa, Staphylococcus aureus
QKTSA

SEQ ID NO: 1561627 - protein, 7 aa, Staphylococcus aureus
QQQGNIP

SEQ ID NO: 1561628 - protein, 5 aa, Staphylococcus aureus
RAGAV

SEQ ID NO: 1561629 - protein, 12 aa, Staphylococcus aureus
RAHAAGKASTLG

SEQ ID NO: 1561630 - protein, 6 aa, Staphylococcus aureus
RDFSQG

SEQ ID NO: 1561631 - protein, 8 aa, Staphylococcus aureus
RERSRSNE

SEQ ID NO: 1561632 - protein, 8 aa, Staphylococcus aureus
RKLESTNQ

SEQ ID NO: 1561633 - protein, 9 aa, Staphylococcus aureus
RTEQTEKHI

SEQ ID NO: 1561634 - protein, 10 aa, Staphylococcus aureus
SGHAMGSTAY

SEQ ID NO: 1561635 - protein, 9 aa, Staphylococcus aureus
SGKKLGTIK

SEQ ID NO: 1561636 - protein, 11 aa, Staphylococcus aureus
SKLSYEPSSQE

SEQ ID NO: 1561637 - protein, 7 aa, Staphylococcus aureus
SKSHESI

SEQ ID NO: 1561638 - protein, 22 aa, Staphylococcus aureus
SNLEKTSESDKSPYIQNKQEKK

SEQ ID NO: 1561639 - protein, 5 aa, Staphylococcus aureus
SNQSG

SEQ ID NO: 1561640 - protein, 5 aa, Staphylococcus aureus
SQEWK

SEQ ID NO: 1561641 - protein, 9 aa, Staphylococcus aureus
SQYDKLKGK

SEQ ID NO: 1561642 - protein, 15 aa, Staphylococcus aureus
SSSLSEKTTAQLEEE

SEQ ID NO: 1561643 - protein, 15 aa, Staphylococcus aureus
SVATGTAWGSASTAG

SEQ ID NO: 1561644 - protein, 8 aa, Staphylococcus aureus
SYNKDKDD

SEQ ID NO: 1561645 - protein, 5 aa, Staphylococcus aureus
SYTTN

SEQ ID NO: 1561646 - protein, 8 aa, Staphylococcus aureus
TEDAQRGM

SEQ ID NO: 1561647 - protein, 19 aa, Staphylococcus aureus
TFDSTNNTISGTPTNIGTS

SEQ ID NO: 1561648 - protein, 34 aa, Staphylococcus aureus
TIRDAEDKVKLSGSDIKQGSAKQEFKQETNQPTV

SEQ ID NO: 1561649 - protein, 4 aa, Staphylococcus aureus
TIRN

SEQ ID NO: 1561650 - protein, 11 aa, Staphylococcus aureus
TNHSQTPRYRR

SEQ ID NO: 1561651 - protein, 27 aa, Staphylococcus aureus
TRKNKQPASSEKGSSGHHGNAAMPQTK

SEQ ID NO: 1561652 - protein, 10 aa, Staphylococcus aureus
TTAKSLTDSF

SEQ ID NO: 1561653 - protein, 12 aa, Staphylococcus aureus
TYPDEDKQYFSS

SEQ ID NO: 1561654 - protein, 23 aa, Staphylococcus aureus
VARDGQRKGNSNDSQEKLSPGKA

SEQ ID NO: 1561655 - protein, 4 aa, Staphylococcus aureus
VEQT

SEQ ID NO: 1561656 - protein, 6 aa, Staphylococcus aureus
VHADYP

SEQ ID NO: 1561657 - protein, 16 aa, Staphylococcus aureus
VKRGKDKENKKNSKDF

SEQ ID NO: 1561658 - protein, 5 aa, Staphylococcus aureus
VNVGN

SEQ ID NO: 1561659 - protein, 16 aa, Staphylococcus aureus
VQQDEDSIYLYHQKPT

SEQ ID NO: 1561660 - protein, 16 aa, Staphylococcus aureus
VSQTSLKDGSRDNVKS

SEQ ID NO: 1561661 - protein, 5 aa, Staphylococcus aureus
VTSGI

SEQ ID NO: 1561662 - protein, 10 aa, Staphylococcus aureus
YNKNAESGKM

SEQ ID NO: 1561663 - protein, 10 aa, Staphylococcus aureus
YNSQQNGQVT

SEQ ID NO: 1561664 - protein, 5 aa, Staphylococcus aureus
YTGLK

SEQ ID NO: 1561665 - protein, 7 aa, Staphylococcus aureus
AATKQNS

SEQ ID NO: 1561666 - protein, 4 aa, Staphylococcus aureus
ADNI

SEQ ID NO: 1561667 - protein, 6 aa, Staphylococcus aureus
AEGLSV

SEQ ID NO: 1561668 - protein, 6 aa, Staphylococcus aureus
AKDKHV

SEQ ID NO: 1561669 - protein, 6 aa, Staphylococcus aureus
ALTTDE

SEQ ID NO: 1561670 - protein, 22 aa, Staphylococcus aureus
APIYQSETNYHSKDRGKSKSGI

SEQ ID NO: 1561671 - protein, 17 aa, Staphylococcus aureus
ASERTIDAETTGGNTKV

SEQ ID NO: 1561672 - protein, 9 aa, Staphylococcus aureus
ASESITNPS

SEQ ID NO: 1561673 - protein, 12 aa, Staphylococcus aureus
ASSQIKKGSLRK

SEQ ID NO: 1561674 - protein, 17 aa, Staphylococcus aureus
DISEERNSSEVKDKKEQ

SEQ ID NO: 1561675 - protein, 28 aa, Staphylococcus aureus
DKDPIKTGAEYAKKHGWDTPEKAISGGA

SEQ ID NO: 1561676 - protein, 5 aa, Staphylococcus aureus
DKNGV

SEQ ID NO: 1561677 - protein, 7 aa, Staphylococcus aureus
DLDNGNY

SEQ ID NO: 1561678 - protein, 5 aa, Staphylococcus aureus
DNATY

SEQ ID NO: 1561679 - protein, 7 aa, Staphylococcus aureus
DPAKDGG

SEQ ID NO: 1561680 - protein, 5 aa, Staphylococcus aureus
DTAEK

SEQ ID NO: 1561681 - protein, 12 aa, Staphylococcus aureus
EDGSKKKMSTTA

SEQ ID NO: 1561682 - protein, 8 aa, Staphylococcus aureus
EKYSLKEN

SEQ ID NO: 1561683 - protein, 14 aa, Staphylococcus aureus
ENPTTMEDDKDETV

SEQ ID NO: 1561684 - protein, 19 aa, Staphylococcus aureus
EQKRIKKAIERNELPQTQD

SEQ ID NO: 1561685 - protein, 8 aa, Staphylococcus aureus
ERDGYSQE

SEQ ID NO: 1561686 - protein, 8 aa, Staphylococcus aureus
ESETIEDT

SEQ ID NO: 1561687 - protein, 9 aa, Staphylococcus aureus
EYKKKGKVG

SEQ ID NO: 1561688 - protein, 20 aa, Staphylococcus aureus
FAEGRGKAQADSLRQAQSNL

SEQ ID NO: 1561689 - protein, 8 aa, Staphylococcus aureus
FPNTNIET

SEQ ID NO: 1561690 - protein, 13 aa, Staphylococcus aureus
GASNRAKGVKWST

SEQ ID NO: 1561691 - protein, 5 aa, Staphylococcus aureus
GITKT

SEQ ID NO: 1561692 - protein, 14 aa, Staphylococcus aureus
GKVIDDTKQPSYSI

SEQ ID NO: 1561693 - protein, 7 aa, Staphylococcus aureus
GNKLPDP

SEQ ID NO: 1561694 - protein, 4 aa, Staphylococcus aureus
GNSR

SEQ ID NO: 1561695 - protein, 10 aa, Staphylococcus aureus
GNVESMGGAV

SEQ ID NO: 1561696 - protein, 6 aa, Staphylococcus aureus
GSAYTS

SEQ ID NO: 1561697 - protein, 6 aa, Staphylococcus aureus
HEIKES

SEQ ID NO: 1561698 - protein, 4 aa, Staphylococcus aureus
HGSG

SEQ ID NO: 1561699 - protein, 6 aa, Staphylococcus aureus
IGASGV

SEQ ID NO: 1561700 - protein, 4 aa, Staphylococcus aureus
IKTL

SEQ ID NO: 1561701 - protein, 7 aa, Staphylococcus aureus
IQPAQGV

SEQ ID NO: 1561702 - protein, 5 aa, Staphylococcus aureus
KEVQP

SEQ ID NO: 1561703 - protein, 13 aa, Staphylococcus aureus
KLTQNHKGQGHSK

SEQ ID NO: 1561704 - protein, 34 aa, Staphylococcus aureus
KMSERNQEKQLKREEKARLKEEQKARQNEQPQIK

SEQ ID NO: 1561705 - protein, 6 aa, Staphylococcus aureus
KQHQSI

SEQ ID NO: 1561706 - protein, 26 aa, Staphylococcus aureus
KQQKEQPKRQSRSERQSPGQGDRDFF

SEQ ID NO: 1561707 - protein, 31 aa, Staphylococcus aureus
KSKFTEYDNKTDESIEKGKFDDEGGAAPNNN

SEQ ID NO: 1561708 - protein, 7 aa, Staphylococcus aureus
KSTQEIR

SEQ ID NO: 1561709 - protein, 7 aa, Staphylococcus aureus
LAETPFQ

SEQ ID NO: 1561710 - protein, 7 aa, Staphylococcus aureus
LANEKTR

SEQ ID NO: 1561711 - protein, 7 aa, Staphylococcus aureus
LESESGV

SEQ ID NO: 1561712 - protein, 12 aa, Staphylococcus aureus
LPQLSAGSNMQD

SEQ ID NO: 1561713 - protein, 8 aa, Staphylococcus aureus
LSDRRQLS

SEQ ID NO: 1561714 - protein, 6 aa, Staphylococcus aureus
MKTEGK

SEQ ID NO: 1561715 - protein, 5 aa, Staphylococcus aureus
NAGDS

SEQ ID NO: 1561716 - protein, 11 aa, Staphylococcus aureus
NATGKDYSGTA

SEQ ID NO: 1561717 - protein, 14 aa, Staphylococcus aureus
NEDVSEKEYAAVSQ

SEQ ID NO: 1561718 - protein, 9 aa, Staphylococcus aureus
NKNYADDQT

SEQ ID NO: 1561719 - protein, 7 aa, Staphylococcus aureus
NNVKTDL

SEQ ID NO: 1561720 - protein, 11 aa, Staphylococcus aureus
NPKNPGEHQYA

SEQ ID NO: 1561721 - protein, 6 aa, Staphylococcus aureus
NTTLRN

SEQ ID NO: 1561722 - protein, 7 aa, Staphylococcus aureus
PANKVYT

SEQ ID NO: 1561723 - protein, 5 aa, Staphylococcus aureus
PASEH

SEQ ID NO: 1561724 - protein, 23 aa, Staphylococcus aureus
PDGYDTNVGTVGDKLSGGEKQRV

SEQ ID NO: 1561725 - protein, 8 aa, Staphylococcus aureus
PITECSGN

SEQ ID NO: 1561726 - protein, 4 aa, Staphylococcus aureus
PKGI

SEQ ID NO: 1561727 - protein, 10 aa, Staphylococcus aureus
PQSGGMSNYA

SEQ ID NO: 1561728 - protein, 20 aa, Staphylococcus aureus
QAQQARGYDNSKKAKFTSRV

SEQ ID NO: 1561729 - protein, 6 aa, Staphylococcus aureus
QGGAQY

SEQ ID NO: 1561730 - protein, 6 aa, Staphylococcus aureus
QGQRLV

SEQ ID NO: 1561731 - protein, 8 aa, Staphylococcus aureus
QKQRNAFQ

SEQ ID NO: 1561732 - protein, 20 aa, Staphylococcus aureus
QPAKQKATSKAEVQRKGQVL

SEQ ID NO: 1561733 - protein, 13 aa, Staphylococcus aureus
QQFQSKKPKKDDQ

SEQ ID NO: 1561734 - protein, 8 aa, Staphylococcus aureus
RKGEPGLL

SEQ ID NO: 1561735 - protein, 10 aa, Staphylococcus aureus
RKSRQNAPAY

SEQ ID NO: 1561736 - protein, 32 aa, Staphylococcus aureus
RNTSKKRRQRKRSKATHFSNQNKDDTSQQADF

SEQ ID NO: 1561737 - protein, 4 aa, Staphylococcus aureus
RPGV

SEQ ID NO: 1561738 - protein, 7 aa, Staphylococcus aureus
SAGAITE

SEQ ID NO: 1561739 - protein, 5 aa, Staphylococcus aureus
SANLG

SEQ ID NO: 1561740 - protein, 5 aa, Staphylococcus aureus
SDDRT

SEQ ID NO: 1561741 - protein, 7 aa, Staphylococcus aureus
SGKNWVK

SEQ ID NO: 1561742 - protein, 12 aa, Staphylococcus aureus
SGLNKTDQANLN

SEQ ID NO: 1561743 - protein, 15 aa, Staphylococcus aureus
SGSQTDKNETTEELK

SEQ ID NO: 1561744 - protein, 13 aa, Staphylococcus aureus
SNKYFKDNQKESM

SEQ ID NO: 1561745 - protein, 15 aa, Staphylococcus aureus
SRTYSRHNNEEKAQA

SEQ ID NO: 1561746 - protein, 11 aa, Staphylococcus aureus
SSELTKARYAK

SEQ ID NO: 1561747 - protein, 11 aa, Staphylococcus aureus
TAGQFGVPSVS

SEQ ID NO: 1561748 - protein, 19 aa, Staphylococcus aureus
TDVSTTVNGEVDPVDAETA

SEQ ID NO: 1561749 - protein, 8 aa, Staphylococcus aureus
TKLEPPLD

SEQ ID NO: 1561750 - protein, 8 aa, Staphylococcus aureus
TNAPKFDN

SEQ ID NO: 1561751 - protein, 4 aa, Staphylococcus aureus
TRRQ

SEQ ID NO: 1561752 - protein, 9 aa, Staphylococcus aureus
TTGSNEAVD

SEQ ID NO: 1561753 - protein, 21 aa, Staphylococcus aureus
VIGPQKGSKPRQVLIDLNNDE

SEQ ID NO: 1561754 - protein, 12 aa, Staphylococcus aureus
VKQNKQTDWSED

SEQ ID NO: 1561755 - protein, 13 aa, Staphylococcus aureus
YERPQPKDDYYDV

SEQ ID NO: 1561756 - protein, 15 aa, Staphylococcus aureus
YQKQKKEGKNPVFKP

SEQ ID NO: 1561757 - protein, 4 aa, Staphylococcus aureus
AATS

SEQ ID NO: 1561758 - protein, 8 aa, Staphylococcus aureus
AEKASTAL

SEQ ID NO: 1561759 - protein, 9 aa, Staphylococcus aureus
AKDYSKSKF

SEQ ID NO: 1561760 - protein, 8 aa, Staphylococcus aureus
AKTPSKIS

SEQ ID NO: 1561761 - protein, 15 aa, Staphylococcus aureus
ALDKQSNAKTGKYEL

SEQ ID NO: 1561762 - protein, 9 aa, Staphylococcus aureus
ANVKRTSYR

SEQ ID NO: 1561763 - protein, 10 aa, Staphylococcus aureus
AQISTTNNKA

SEQ ID NO: 1561764 - protein, 13 aa, Staphylococcus aureus
ARPKKPENVENKS

SEQ ID NO: 1561765 - protein, 5 aa, Staphylococcus aureus
ATFPD

SEQ ID NO: 1561766 - protein, 10 aa, Staphylococcus aureus
ATKNTDTYNA

SEQ ID NO: 1561767 - protein, 15 aa, Staphylococcus aureus
ATPSTDTAIANAPLE

SEQ ID NO: 1561768 - protein, 15 aa, Staphylococcus aureus
DGVEGQVQGITRETT

SEQ ID NO: 1561769 - protein, 6 aa, Staphylococcus aureus
DKNEEF

SEQ ID NO: 1561770 - protein, 8 aa, Staphylococcus aureus
DKSLGEGI

SEQ ID NO: 1561771 - protein, 9 aa, Staphylococcus aureus
DNGKGFNVD

SEQ ID NO: 1561772 - protein, 11 aa, Staphylococcus aureus
DQIKDKNSNIT

SEQ ID NO: 1561773 - protein, 8 aa, Staphylococcus aureus
DVDTTPRI

SEQ ID NO: 1561774 - protein, 8 aa, Staphylococcus aureus
EASTSPIT

SEQ ID NO: 1561775 - protein, 14 aa, Staphylococcus aureus
EASVQSVADNANQY

SEQ ID NO: 1561776 - protein, 4 aa, Staphylococcus aureus
EDNG

SEQ ID NO: 1561777 - protein, 7 aa, Staphylococcus aureus
EKSVGYR

SEQ ID NO: 1561778 - protein, 4 aa, Staphylococcus aureus
ELSN

SEQ ID NO: 1561779 - protein, 6 aa, Staphylococcus aureus
FGPSGV

SEQ ID NO: 1561780 - protein, 15 aa, Staphylococcus aureus
GAVKSELANGVEIDG

SEQ ID NO: 1561781 - protein, 15 aa, Staphylococcus aureus
GGGGHLTNAATQLKG

SEQ ID NO: 1561782 - protein, 5 aa, Staphylococcus aureus
GGSGF

SEQ ID NO: 1561783 - protein, 10 aa, Staphylococcus aureus
GHKATKDNEV

SEQ ID NO: 1561784 - protein, 8 aa, Staphylococcus aureus
GKSQGRDI

SEQ ID NO: 1561785 - protein, 7 aa, Staphylococcus aureus
GQAIPQA

SEQ ID NO: 1561786 - protein, 7 aa, Staphylococcus aureus
GSLNPSS

SEQ ID NO: 1561787 - protein, 10 aa, Staphylococcus aureus
GTDSGGRDNF

SEQ ID NO: 1561788 - protein, 4 aa, Staphylococcus aureus
GTVD

SEQ ID NO: 1561789 - protein, 17 aa, Staphylococcus aureus
GVTPAANAAQHDEAQQN

SEQ ID NO: 1561790 - protein, 11 aa, Staphylococcus aureus
HTGKQSEGASD

SEQ ID NO: 1561791 - protein, 8 aa, Staphylococcus aureus
IEQGGKSG

SEQ ID NO: 1561792 - protein, 4 aa, Staphylococcus aureus
IGPT

SEQ ID NO: 1561793 - protein, 10 aa, Staphylococcus aureus
IKNKGKEALT

SEQ ID NO: 1561794 - protein, 4 aa, Staphylococcus aureus
IPKD

SEQ ID NO: 1561795 - protein, 6 aa, Staphylococcus aureus
IQDADS

SEQ ID NO: 1561796 - protein, 4 aa, Staphylococcus aureus
IVPS

SEQ ID NO: 1561797 - protein, 8 aa, Staphylococcus aureus
KAVEAGKA

SEQ ID NO: 1561798 - protein, 7 aa, Staphylococcus aureus
KDTIDRT

SEQ ID NO: 1561799 - protein, 9 aa, Staphylococcus aureus
KEGKNEPSS

SEQ ID NO: 1561800 - protein, 7 aa, Staphylococcus aureus
KETGKFE

SEQ ID NO: 1561801 - protein, 9 aa, Staphylococcus aureus
KGHSNDKQI

SEQ ID NO: 1561802 - protein, 11 aa, Staphylococcus aureus
KGYSRNDRVGK

SEQ ID NO: 1561803 - protein, 8 aa, Staphylococcus aureus
KIKNAGAV

SEQ ID NO: 1561804 - protein, 8 aa, Staphylococcus aureus
KKLNEVNG

SEQ ID NO: 1561805 - protein, 9 aa, Staphylococcus aureus
KPAKYIKKN

SEQ ID NO: 1561806 - protein, 7 aa, Staphylococcus aureus
KQAPRIA

SEQ ID NO: 1561807 - protein, 11 aa, Staphylococcus aureus
KQGPNAESTND

SEQ ID NO: 1561808 - protein, 6 aa, Staphylococcus aureus
KRGPMG

SEQ ID NO: 1561809 - protein, 9 aa, Staphylococcus aureus
KYDAEKGSK

SEQ ID NO: 1561810 - protein, 7 aa, Staphylococcus aureus
LEENDKT

SEQ ID NO: 1561811 - protein, 7 aa, Staphylococcus aureus
LSAHDSG

SEQ ID NO: 1561812 - protein, 11 aa, Staphylococcus aureus
LSQQKSSTQIH

SEQ ID NO: 1561813 - protein, 15 aa, Staphylococcus aureus
LSRKISNKELTIDEA

SEQ ID NO: 1561814 - protein, 8 aa, Staphylococcus aureus
NGEEDNSY

SEQ ID NO: 1561815 - protein, 4 aa, Staphylococcus aureus
NKAN

SEQ ID NO: 1561816 - protein, 4 aa, Staphylococcus aureus
NYLR

SEQ ID NO: 1561817 - protein, 7 aa, Staphylococcus aureus
PDSGTRI

SEQ ID NO: 1561818 - protein, 15 aa, Staphylococcus aureus
PMKGSPAERAGIRPK

SEQ ID NO: 1561819 - protein, 13 aa, Staphylococcus aureus
PNGVTADHPAYRP

SEQ ID NO: 1561820 - protein, 12 aa, Staphylococcus aureus
PNSVREASYGLG

SEQ ID NO: 1561821 - protein, 6 aa, Staphylococcus aureus
QGKEAQ

SEQ ID NO: 1561822 - protein, 4 aa, Staphylococcus aureus
QMSP

SEQ ID NO: 1561823 - protein, 7 aa, Staphylococcus aureus
RDSSLPF

SEQ ID NO: 1561824 - protein, 7 aa, Staphylococcus aureus
RIPPSAS

SEQ ID NO: 1561825 - protein, 25 aa, Staphylococcus aureus
RNDIDAQERKAKEAQFQKQQNEEIA

SEQ ID NO: 1561826 - protein, 5 aa, Staphylococcus aureus
RPDLD

SEQ ID NO: 1561827 - protein, 4 aa, Staphylococcus aureus
RYNP

SEQ ID NO: 1561828 - protein, 9 aa, Staphylococcus aureus
SDKVPQKVK

SEQ ID NO: 1561829 - protein, 9 aa, Staphylococcus aureus
SDNNYDERQ

SEQ ID NO: 1561830 - protein, 8 aa, Staphylococcus aureus
SEAYANQH

SEQ ID NO: 1561831 - protein, 7 aa, Staphylococcus aureus
SEDIEDY

SEQ ID NO: 1561832 - protein, 25 aa, Staphylococcus aureus
SGDKTFEADNTGSMSANQSDNGSIE

SEQ ID NO: 1561833 - protein, 6 aa, Staphylococcus aureus
SHQSLN

SEQ ID NO: 1561834 - protein, 6 aa, Staphylococcus aureus
SKSEQL

SEQ ID NO: 1561835 - protein, 5 aa, Staphylococcus aureus
SNVAE

SEQ ID NO: 1561836 - protein, 17 aa, Staphylococcus aureus
SPKNKDDLNKSKEDMNY

SEQ ID NO: 1561837 - protein, 10 aa, Staphylococcus aureus
SQKKVVGEPL

SEQ ID NO: 1561838 - protein, 4 aa, Staphylococcus aureus
SRYQ

SEQ ID NO: 1561839 - protein, 6 aa, Staphylococcus aureus
SSRTVK

SEQ ID NO: 1561840 - protein, 6 aa, Staphylococcus aureus
STGFGS

SEQ ID NO: 1561841 - protein, 4 aa, Staphylococcus aureus
TIPE

SEQ ID NO: 1561842 - protein, 5 aa, Staphylococcus aureus
TKLYP

SEQ ID NO: 1561843 - protein, 8 aa, Staphylococcus aureus
TTIKNGQN

SEQ ID NO: 1561844 - protein, 6 aa, Staphylococcus aureus
TVSDQA

SEQ ID NO: 1561845 - protein, 6 aa, Staphylococcus aureus
VDHDDV

SEQ ID NO: 1561846 - protein, 19 aa, Staphylococcus aureus
VNSQVGKGSTFKVILKDYK

SEQ ID NO: 1561847 - protein, 10 aa, Staphylococcus aureus
VSQNPNDPHL

SEQ ID NO: 1561848 - protein, 18 aa, Staphylococcus aureus
YGDQSEKGSQSVSNKNNK

SEQ ID NO: 1561849 - protein, 5 aa, Staphylococcus aureus
YGGTA

SEQ ID NO: 1561850 - protein, 6 aa, Staphylococcus aureus
YNGDTK

SEQ ID NO: 1561851 - protein, 12 aa, Staphylococcus aureus
ADETLKNKGFKI

SEQ ID NO: 1561852 - protein, 8 aa, Staphylococcus aureus
AGNSGMYA

SEQ ID NO: 1561853 - protein, 11 aa, Staphylococcus aureus
AGSSPTASLSL

SEQ ID NO: 1561854 - protein, 6 aa, Staphylococcus aureus
ALAEGG

SEQ ID NO: 1561855 - protein, 7 aa, Staphylococcus aureus
ANIKENN

SEQ ID NO: 1561856 - protein, 5 aa, Staphylococcus aureus
APKAF

SEQ ID NO: 1561857 - protein, 12 aa, Staphylococcus aureus
APTVTVGNQTIE

SEQ ID NO: 1561858 - protein, 4 aa, Staphylococcus aureus
ASAG

SEQ ID NO: 1561859 - protein, 29 aa, Staphylococcus aureus
ASALGDSGSPASDSTLGPTAGLNVDGQHD

SEQ ID NO: 1561860 - protein, 6 aa, Staphylococcus aureus
ASGKTI

SEQ ID NO: 1561861 - protein, 8 aa, Staphylococcus aureus
DANPDKVH

SEQ ID NO: 1561862 - protein, 21 aa, Staphylococcus aureus
DESAITGESAPVIKESGGDFD

SEQ ID NO: 1561863 - protein, 8 aa, Staphylococcus aureus
DIQGSVNA

SEQ ID NO: 1561864 - protein, 11 aa, Staphylococcus aureus
DKGQRTDKYGR

SEQ ID NO: 1561865 - protein, 12 aa, Staphylococcus aureus
DTETKKSLKTAK

SEQ ID NO: 1561866 - protein, 9 aa, Staphylococcus aureus
DVNSGGTIG

SEQ ID NO: 1561867 - protein, 6 aa, Staphylococcus aureus
EAKTQL

SEQ ID NO: 1561868 - protein, 12 aa, Staphylococcus aureus
ERSMEGETVGIN

SEQ ID NO: 1561869 - protein, 8 aa, Staphylococcus aureus
FTEVPQER

SEQ ID NO: 1561870 - protein, 4 aa, Staphylococcus aureus
GGTE

SEQ ID NO: 1561871 - protein, 4 aa, Staphylococcus aureus
GGVE

SEQ ID NO: 1561872 - protein, 11 aa, Staphylococcus aureus
IGRGENELVDP

SEQ ID NO: 1561873 - protein, 4 aa, Staphylococcus aureus
ISER

SEQ ID NO: 1561874 - protein, 9 aa, Staphylococcus aureus
KAVNPPNVM

SEQ ID NO: 1561875 - protein, 6 aa, Staphylococcus aureus
KDIDTP

SEQ ID NO: 1561876 - protein, 15 aa, Staphylococcus aureus
KKDELYKKSGKNPII

SEQ ID NO: 1561877 - protein, 22 aa, Staphylococcus aureus
KKLNDAQAPKADNKFNKEQQNA

SEQ ID NO: 1561878 - protein, 5 aa, Staphylococcus aureus
KLDDV

SEQ ID NO: 1561879 - protein, 5 aa, Staphylococcus aureus
KNRAY

SEQ ID NO: 1561880 - protein, 14 aa, Staphylococcus aureus
KQEDNKKSASTAYS

SEQ ID NO: 1561881 - protein, 10 aa, Staphylococcus aureus
KSEAQAKKEK

SEQ ID NO: 1561882 - protein, 5 aa, Staphylococcus aureus
LQGKI

SEQ ID NO: 1561883 - protein, 28 aa, Staphylococcus aureus
LQKLQAQSKVDNKVISNDEVDKVSEGQK

SEQ ID NO: 1561884 - protein, 5 aa, Staphylococcus aureus
LRGQL

SEQ ID NO: 1561885 - protein, 6 aa, Staphylococcus aureus
LRPEQT

SEQ ID NO: 1561886 - protein, 8 aa, Staphylococcus aureus
LTEEQRNG

SEQ ID NO: 1561887 - protein, 7 aa, Staphylococcus aureus
NDETHRT

SEQ ID NO: 1561888 - protein, 12 aa, Staphylococcus aureus
NEDKGDTIRGKK

SEQ ID NO: 1561889 - protein, 27 aa, Staphylococcus aureus
NKDGSTVQTTNNKGGNQLDGQSKKFGT

SEQ ID NO: 1561890 - protein, 9 aa, Staphylococcus aureus
NNEYRGGPA

SEQ ID NO: 1561891 - protein, 5 aa, Staphylococcus aureus
NPEKL

SEQ ID NO: 1561892 - protein, 4 aa, Staphylococcus aureus
NQGS

SEQ ID NO: 1561893 - protein, 8 aa, Staphylococcus aureus
NTNDTSIA

SEQ ID NO: 1561894 - protein, 4 aa, Staphylococcus aureus
PSHF

SEQ ID NO: 1561895 - protein, 8 aa, Staphylococcus aureus
PTKTHSDI

SEQ ID NO: 1561896 - protein, 10 aa, Staphylococcus aureus
QEEEFNQRRD

SEQ ID NO: 1561897 - protein, 20 aa, Staphylococcus aureus
QQSHKNLSSTIGEPNANAYA

SEQ ID NO: 1561898 - protein, 15 aa, Staphylococcus aureus
QSLSRDSSGKLKTRG

SEQ ID NO: 1561899 - protein, 13 aa, Staphylococcus aureus
QVQTNELYENSKP

SEQ ID NO: 1561900 - protein, 28 aa, Staphylococcus aureus
RKERKARKLEKQIEKYGYEGAELRRKDK

SEQ ID NO: 1561901 - protein, 4 aa, Staphylococcus aureus
RKNI

SEQ ID NO: 1561902 - protein, 4 aa, Staphylococcus aureus
RLGY

SEQ ID NO: 1561903 - protein, 4 aa, Staphylococcus aureus
RSHI

SEQ ID NO: 1561904 - protein, 7 aa, Staphylococcus aureus
SATSLSS

SEQ ID NO: 1561905 - protein, 4 aa, Staphylococcus aureus
SGMS

SEQ ID NO: 1561906 - protein, 7 aa, Staphylococcus aureus
SHKDNDM

SEQ ID NO: 1561907 - protein, 5 aa, Staphylococcus aureus
SKGAS

SEQ ID NO: 1561908 - protein, 12 aa, Staphylococcus aureus
TEKDKANRYKTI

SEQ ID NO: 1561909 - protein, 4 aa, Staphylococcus aureus
TNDD

SEQ ID NO: 1561910 - protein, 21 aa, Staphylococcus aureus
TPETKHPKKGVEKYGPEASAF

SEQ ID NO: 1561911 - protein, 39 aa, Staphylococcus aureus
TRNSMSDSVSTSGSTQQSQSVSTSKADSQSASTSTSGSI

SEQ ID NO: 1561912 - protein, 11 aa, Staphylococcus aureus
ALKGKAYTSAK

SEQ ID NO: 1561913 - protein, 5 aa, Staphylococcus aureus
ANGEL

SEQ ID NO: 1561914 - protein, 4 aa, Staphylococcus aureus
AQGI

SEQ ID NO: 1561915 - protein, 6 aa, Staphylococcus aureus
ASSTAE

SEQ ID NO: 1561916 - protein, 6 aa, Staphylococcus aureus
ATQNIA

SEQ ID NO: 1561917 - protein, 10 aa, Staphylococcus aureus
ATTDAKKEKA

SEQ ID NO: 1561918 - protein, 8 aa, Staphylococcus aureus
DAPKKNPK

SEQ ID NO: 1561919 - protein, 6 aa, Staphylococcus aureus
DDVLSG

SEQ ID NO: 1561920 - protein, 6 aa, Staphylococcus aureus
DFTGTT

SEQ ID NO: 1561921 - protein, 6 aa, Staphylococcus aureus
DKDDAV

SEQ ID NO: 1561922 - protein, 9 aa, Staphylococcus aureus
DKDQSSETK

SEQ ID NO: 1561923 - protein, 8 aa, Staphylococcus aureus
DKEGNFSE

SEQ ID NO: 1561924 - protein, 9 aa, Staphylococcus aureus
DKKETAKKL

SEQ ID NO: 1561925 - protein, 5 aa, Staphylococcus aureus
DSADI

SEQ ID NO: 1561926 - protein, 30 aa, Staphylococcus aureus
DSQQVNAATEATNATNNQSTQVSQATSQPI

SEQ ID NO: 1561927 - protein, 10 aa, Staphylococcus aureus
DTASGQNTYK

SEQ ID NO: 1561928 - protein, 7 aa, Staphylococcus aureus
EDERQRL

SEQ ID NO: 1561929 - protein, 16 aa, Staphylococcus aureus
EGAFDPDKKYKSGHRD

SEQ ID NO: 1561930 - protein, 7 aa, Staphylococcus aureus
EHERDRL

SEQ ID NO: 1561931 - protein, 8 aa, Staphylococcus aureus
EISEQDQK

SEQ ID NO: 1561932 - protein, 16 aa, Staphylococcus aureus
ELQQKTSSFGQSTTVT

SEQ ID NO: 1561933 - protein, 25 aa, Staphylococcus aureus
EVEGKTGTAQVAAPNGGGYVKGPNP

SEQ ID NO: 1561934 - protein, 12 aa, Staphylococcus aureus
GDNEGKPFSRND

SEQ ID NO: 1561935 - protein, 17 aa, Staphylococcus aureus
GKSTKGMFDGEAPGQIG

SEQ ID NO: 1561936 - protein, 7 aa, Staphylococcus aureus
GRGGDQV

SEQ ID NO: 1561937 - protein, 6 aa, Staphylococcus aureus
GRNLGS

SEQ ID NO: 1561938 - protein, 14 aa, Staphylococcus aureus
GTKNTAEAAKNAEV

SEQ ID NO: 1561939 - protein, 9 aa, Staphylococcus aureus
GVSSPTEIT

SEQ ID NO: 1561940 - protein, 14 aa, Staphylococcus aureus
HMPKSQTPNINKGI

SEQ ID NO: 1561941 - protein, 6 aa, Staphylococcus aureus
HSNGQD

SEQ ID NO: 1561942 - protein, 18 aa, Staphylococcus aureus
HYEQKSDSSNAHTLNSSS

SEQ ID NO: 1561943 - protein, 4 aa, Staphylococcus aureus
IDTA

SEQ ID NO: 1561944 - protein, 17 aa, Staphylococcus aureus
IKNAPELDENGKNLTIK

SEQ ID NO: 1561945 - protein, 10 aa, Staphylococcus aureus
IKTEEDVESQ

SEQ ID NO: 1561946 - protein, 4 aa, Staphylococcus aureus
ISQA

SEQ ID NO: 1561947 - protein, 15 aa, Staphylococcus aureus
ITSSRDIHPIYFMTK

SEQ ID NO: 1561948 - protein, 9 aa, Staphylococcus aureus
KGLAKAGTW

SEQ ID NO: 1561949 - protein, 8 aa, Staphylococcus aureus
KGVSEDMK

SEQ ID NO: 1561950 - protein, 5 aa, Staphylococcus aureus
KMGPE

SEQ ID NO: 1561951 - protein, 8 aa, Staphylococcus aureus
KPNNTHEQ

SEQ ID NO: 1561952 - protein, 4 aa, Staphylococcus aureus
KRQI

SEQ ID NO: 1561953 - protein, 7 aa, Staphylococcus aureus
KRQSQHS

SEQ ID NO: 1561954 - protein, 4 aa, Staphylococcus aureus
KTGE

SEQ ID NO: 1561955 - protein, 6 aa, Staphylococcus aureus
KYVPDG

SEQ ID NO: 1561956 - protein, 11 aa, Staphylococcus aureus
LAASGKLVTPD

SEQ ID NO: 1561957 - protein, 7 aa, Staphylococcus aureus
LGGKDNI

SEQ ID NO: 1561958 - protein, 6 aa, Staphylococcus aureus
LKEKEK

SEQ ID NO: 1561959 - protein, 4 aa, Staphylococcus aureus
LPGD

SEQ ID NO: 1561960 - protein, 11 aa, Staphylococcus aureus
LQQTSDKTLRQ

SEQ ID NO: 1561961 - protein, 8 aa, Staphylococcus aureus
LSGSKGSL

SEQ ID NO: 1561962 - protein, 5 aa, Staphylococcus aureus
LTGSD

SEQ ID NO: 1561963 - protein, 6 aa, Staphylococcus aureus
MESTTA

SEQ ID NO: 1561964 - protein, 4 aa, Staphylococcus aureus
NKPD

SEQ ID NO: 1561965 - protein, 5 aa, Staphylococcus aureus
NSPEF

SEQ ID NO: 1561966 - protein, 5 aa, Staphylococcus aureus
NTKGI

SEQ ID NO: 1561967 - protein, 12 aa, Staphylococcus aureus
PEEIEKRLSQKK

SEQ ID NO: 1561968 - protein, 5 aa, Staphylococcus aureus
PGHGI

SEQ ID NO: 1561969 - protein, 22 aa, Staphylococcus aureus
PLNKGDKIDKKALQSTAQTLEN

SEQ ID NO: 1561970 - protein, 6 aa, Staphylococcus aureus
QGLGPK

SEQ ID NO: 1561971 - protein, 6 aa, Staphylococcus aureus
QLGQKP

SEQ ID NO: 1561972 - protein, 7 aa, Staphylococcus aureus
QPTEQRL

SEQ ID NO: 1561973 - protein, 16 aa, Staphylococcus aureus
QRPTFNPETGKDFGKK

SEQ ID NO: 1561974 - protein, 4 aa, Staphylococcus aureus
RKYE

SEQ ID NO: 1561975 - protein, 6 aa, Staphylococcus aureus
RSKGLS

SEQ ID NO: 1561976 - protein, 6 aa, Staphylococcus aureus
RTASTS

SEQ ID NO: 1561977 - protein, 8 aa, Staphylococcus aureus
RTNVNGGA

SEQ ID NO: 1561978 - protein, 9 aa, Staphylococcus aureus
SKKSHAANY

SEQ ID NO: 1561979 - protein, 4 aa, Staphylococcus aureus
SLGS

SEQ ID NO: 1561980 - protein, 9 aa, Staphylococcus aureus
SLNSKEEIE

SEQ ID NO: 1561981 - protein, 10 aa, Staphylococcus aureus
SQIREEEAKL

SEQ ID NO: 1561982 - protein, 4 aa, Staphylococcus aureus
SSSV

SEQ ID NO: 1561983 - protein, 8 aa, Staphylococcus aureus
SSVAYGPE

SEQ ID NO: 1561984 - protein, 7 aa, Staphylococcus aureus
TKNTAVK

SEQ ID NO: 1561985 - protein, 9 aa, Staphylococcus aureus
TNPDKLAKA

SEQ ID NO: 1561986 - protein, 4 aa, Staphylococcus aureus
TNQN

SEQ ID NO: 1561987 - protein, 10 aa, Staphylococcus aureus
TQNLTNENYN

SEQ ID NO: 1561988 - protein, 20 aa, Staphylococcus aureus
TTAPTVTPIGDQSSEVYSPI

SEQ ID NO: 1561989 - protein, 12 aa, Staphylococcus aureus
VEPYKTINSPNR

SEQ ID NO: 1561990 - protein, 7 aa, Staphylococcus aureus
YQGIDKN

SEQ ID NO: 1561991 - protein, 8 aa, Staphylococcus aureus
AAKRKSNV

SEQ ID NO: 1561992 - protein, 16 aa, Staphylococcus aureus
AANNDAQIHKQKSLSP

SEQ ID NO: 1561993 - protein, 7 aa, Staphylococcus aureus
AFKDENL

SEQ ID NO: 1561994 - protein, 13 aa, Staphylococcus aureus
AHTRLAKEANTSI

SEQ ID NO: 1561995 - protein, 10 aa, Staphylococcus aureus
ANGGTYNNAH

SEQ ID NO: 1561996 - protein, 5 aa, Staphylococcus aureus
AQRPL

SEQ ID NO: 1561997 - protein, 4 aa, Staphylococcus aureus
ASKA

SEQ ID NO: 1561998 - protein, 10 aa, Staphylococcus aureus
DEKEKQKSIY

SEQ ID NO: 1561999 - protein, 13 aa, Staphylococcus aureus
DGNVSLPKAGETI

SEQ ID NO: 1562000 - protein, 6 aa, Staphylococcus aureus
DKNGEL

SEQ ID NO: 1562001 - protein, 7 aa, Staphylococcus aureus
DSKTGGL

SEQ ID NO: 1562002 - protein, 7 aa, Staphylococcus aureus
DVPKSMK

SEQ ID NO: 1562003 - protein, 6 aa, Staphylococcus aureus
EDVKPK

SEQ ID NO: 1562004 - protein, 22 aa, Staphylococcus aureus
EGDIGPSEVLGGSASEFSPTQL

SEQ ID NO: 1562005 - protein, 7 aa, Staphylococcus aureus
EKVNEEI

SEQ ID NO: 1562006 - protein, 8 aa, Staphylococcus aureus
EPTAKASL

SEQ ID NO: 1562007 - protein, 9 aa, Staphylococcus aureus
EYLGKSKKF

SEQ ID NO: 1562008 - protein, 12 aa, Staphylococcus aureus
FKPYGSAYGHGV

SEQ ID NO: 1562009 - protein, 8 aa, Staphylococcus aureus
GLALTTNQ

SEQ ID NO: 1562010 - protein, 8 aa, Staphylococcus aureus
GPRPERPE

SEQ ID NO: 1562011 - protein, 5 aa, Staphylococcus aureus
HEGAL

SEQ ID NO: 1562012 - protein, 8 aa, Staphylococcus aureus
HKPGEEFE

SEQ ID NO: 1562013 - protein, 10 aa, Staphylococcus aureus
HPKAAEDRKN

SEQ ID NO: 1562014 - protein, 10 aa, Staphylococcus aureus
IATGSTISYA

SEQ ID NO: 1562015 - protein, 9 aa, Staphylococcus aureus
IEETDSSAI

SEQ ID NO: 1562016 - protein, 4 aa, Staphylococcus aureus
IQKL

SEQ ID NO: 1562017 - protein, 9 aa, Staphylococcus aureus
KAKDSHGEY

SEQ ID NO: 1562018 - protein, 7 aa, Staphylococcus aureus
KDHPRQE

SEQ ID NO: 1562019 - protein, 6 aa, Staphylococcus aureus
KGSEYQ

SEQ ID NO: 1562020 - protein, 10 aa, Staphylococcus aureus
KGTVKAVDET

SEQ ID NO: 1562021 - protein, 13 aa, Staphylococcus aureus
KKASANSKKPRHV

SEQ ID NO: 1562022 - protein, 20 aa, Staphylococcus aureus
KNAEKNGAQWADKDDDRITN

SEQ ID NO: 1562023 - protein, 7 aa, Staphylococcus aureus
KNAITAL

SEQ ID NO: 1562024 - protein, 8 aa, Staphylococcus aureus
KNDKGERQ

SEQ ID NO: 1562025 - protein, 18 aa, Staphylococcus aureus
KNGNNGGKSNSKKNRNVK

SEQ ID NO: 1562026 - protein, 4 aa, Staphylococcus aureus
KQNY

SEQ ID NO: 1562027 - protein, 7 aa, Staphylococcus aureus
KQYGENS

SEQ ID NO: 1562028 - protein, 11 aa, Staphylococcus aureus
KSIGRKAQEAY

SEQ ID NO: 1562029 - protein, 8 aa, Staphylococcus aureus
LDNGQRHE

SEQ ID NO: 1562030 - protein, 4 aa, Staphylococcus aureus
LKKD

SEQ ID NO: 1562031 - protein, 7 aa, Staphylococcus aureus
LQDPIPA

SEQ ID NO: 1562032 - protein, 6 aa, Staphylococcus aureus
NKVTPI

SEQ ID NO: 1562033 - protein, 9 aa, Staphylococcus aureus
NLGSNDKLN

SEQ ID NO: 1562034 - protein, 15 aa, Staphylococcus aureus
NRNQATDPHPTGSSL

SEQ ID NO: 1562035 - protein, 11 aa, Staphylococcus aureus
NTYEPGSTFKS

SEQ ID NO: 1562036 - protein, 11 aa, Staphylococcus aureus
NYSQYKKSSDQ

SEQ ID NO: 1562037 - protein, 4 aa, Staphylococcus aureus
PDQV

SEQ ID NO: 1562038 - protein, 16 aa, Staphylococcus aureus
PKGDSVDNDNFSPDEG

SEQ ID NO: 1562039 - protein, 5 aa, Staphylococcus aureus
PQVPN

SEQ ID NO: 1562040 - protein, 12 aa, Staphylococcus aureus
QGAKTRGGHMEA

SEQ ID NO: 1562041 - protein, 4 aa, Staphylococcus aureus
QLKR

SEQ ID NO: 1562042 - protein, 6 aa, Staphylococcus aureus
QNPKLG

SEQ ID NO: 1562043 - protein, 10 aa, Staphylococcus aureus
QPNRKSNDEN

SEQ ID NO: 1562044 - protein, 9 aa, Staphylococcus aureus
QQKRAKQHR

SEQ ID NO: 1562045 - protein, 8 aa, Staphylococcus aureus
QSGMSYGA

SEQ ID NO: 1562046 - protein, 8 aa, Staphylococcus aureus
QSGQRITT

SEQ ID NO: 1562047 - protein, 6 aa, Staphylococcus aureus
QTRESM

SEQ ID NO: 1562048 - protein, 12 aa, Staphylococcus aureus
RAKAPKSGTYDA

SEQ ID NO: 1562049 - protein, 13 aa, Staphylococcus aureus
SISKGQKLTEKDK

SEQ ID NO: 1562050 - protein, 10 aa, Staphylococcus aureus
SLRDQVAEQV

SEQ ID NO: 1562051 - protein, 12 aa, Staphylococcus aureus
SNTIAESLNTQY

SEQ ID NO: 1562052 - protein, 13 aa, Staphylococcus aureus
SPEKYQQLKTQNN

SEQ ID NO: 1562053 - protein, 7 aa, Staphylococcus aureus
SPGNPIY

SEQ ID NO: 1562054 - protein, 5 aa, Staphylococcus aureus
SQSHL

SEQ ID NO: 1562055 - protein, 32 aa, Staphylococcus aureus
SSENVDSNSTNNSDSNSDDKKKSDSKTDKDKS

SEQ ID NO: 1562056 - protein, 4 aa, Staphylococcus aureus
SSFP

SEQ ID NO: 1562057 - protein, 15 aa, Staphylococcus aureus
SVKQNAGNDAPKKFA

SEQ ID NO: 1562058 - protein, 6 aa, Staphylococcus aureus
TEISGQ

SEQ ID NO: 1562059 - protein, 9 aa, Staphylococcus aureus
TIKEVKDKG

SEQ ID NO: 1562060 - protein, 7 aa, Staphylococcus aureus
TKKPGAF

SEQ ID NO: 1562061 - protein, 9 aa, Staphylococcus aureus
TPQESFTSA

SEQ ID NO: 1562062 - protein, 38 aa, Staphylococcus aureus
TVDKTVKTKEKAGTPSKENKLSQSKMLPKTGETTSSQS

SEQ ID NO: 1562063 - protein, 15 aa, Staphylococcus aureus
VEKEEVPKKALDKLS

SEQ ID NO: 1562064 - protein, 12 aa, Staphylococcus aureus
VSKGGYLGETLF

SEQ ID NO: 1562065 - protein, 10 aa, Staphylococcus aureus
YDDTPEGKSI

SEQ ID NO: 1562066 - protein, 12 aa, Staphylococcus aureus
YSGNTGKQTTGA

SEQ ID NO: 1562067 - protein, 7 aa, Staphylococcus aureus
ADKYDKG

SEQ ID NO: 1562068 - protein, 7 aa, Staphylococcus aureus
AGDPYYS

SEQ ID NO: 1562069 - protein, 7 aa, Staphylococcus aureus
AHGGPVS

SEQ ID NO: 1562070 - protein, 10 aa, Staphylococcus aureus
AQKNDQEAYE

SEQ ID NO: 1562071 - protein, 4 aa, Staphylococcus aureus
ASYP

SEQ ID NO: 1562072 - protein, 14 aa, Staphylococcus aureus
AVEIGKADTTSNKF

SEQ ID NO: 1562073 - protein, 11 aa, Staphylococcus aureus
DGTDDRTGNFE

SEQ ID NO: 1562074 - protein, 11 aa, Staphylococcus aureus
FHQTSLGGDVK

SEQ ID NO: 1562075 - protein, 8 aa, Staphylococcus aureus
GAATTFSD

SEQ ID NO: 1562076 - protein, 10 aa, Staphylococcus aureus
GEEKAKTHQK

SEQ ID NO: 1562077 - protein, 9 aa, Staphylococcus aureus
GPKSDQIKH

SEQ ID NO: 1562078 - protein, 6 aa, Staphylococcus aureus
GSKFGE

SEQ ID NO: 1562079 - protein, 13 aa, Staphylococcus aureus
HQRAYDAQRDGRF

SEQ ID NO: 1562080 - protein, 7 aa, Staphylococcus aureus
IKAEREP

SEQ ID NO: 1562081 - protein, 6 aa, Staphylococcus aureus
ITKKQT

SEQ ID NO: 1562082 - protein, 19 aa, Staphylococcus aureus
ITNESTEYYNGQEGEQEVA

SEQ ID NO: 1562083 - protein, 5 aa, Staphylococcus aureus
KLPTK

SEQ ID NO: 1562084 - protein, 7 aa, Staphylococcus aureus
KNESGQL

SEQ ID NO: 1562085 - protein, 7 aa, Staphylococcus aureus
KQATGNL

SEQ ID NO: 1562086 - protein, 7 aa, Staphylococcus aureus
KRSYFNK

SEQ ID NO: 1562087 - protein, 16 aa, Staphylococcus aureus
NAQANFPKVKSDVAKA

SEQ ID NO: 1562088 - protein, 15 aa, Staphylococcus aureus
NAQAQQSDYSKIAEK

SEQ ID NO: 1562089 - protein, 7 aa, Staphylococcus aureus
NGIGISE

SEQ ID NO: 1562090 - protein, 4 aa, Staphylococcus aureus
NLNQ

SEQ ID NO: 1562091 - protein, 16 aa, Staphylococcus aureus
NLTGGFGSEGASTLTQ

SEQ ID NO: 1562092 - protein, 29 aa, Staphylococcus aureus
NVKQGDKLDKGDKVATVTVQGQDGETKDM

SEQ ID NO: 1562093 - protein, 14 aa, Staphylococcus aureus
PNTKKEKQPKRGDD

SEQ ID NO: 1562094 - protein, 6 aa, Staphylococcus aureus
QAIETT

SEQ ID NO: 1562095 - protein, 6 aa, Staphylococcus aureus
QEYSKD

SEQ ID NO: 1562096 - protein, 5 aa, Staphylococcus aureus
RGESF

SEQ ID NO: 1562097 - protein, 10 aa, Staphylococcus aureus
RQSPEFGNPD

SEQ ID NO: 1562098 - protein, 9 aa, Staphylococcus aureus
RTGSRTFDA

SEQ ID NO: 1562099 - protein, 6 aa, Staphylococcus aureus
SGGRDF

SEQ ID NO: 1562100 - protein, 9 aa, Staphylococcus aureus
SKLPGVNTS

SEQ ID NO: 1562101 - protein, 13 aa, Staphylococcus aureus
SQSVKVSDNNLKD

SEQ ID NO: 1562102 - protein, 6 aa, Staphylococcus aureus
SRESLN

SEQ ID NO: 1562103 - protein, 15 aa, Staphylococcus aureus
SYAKNPKETKDSYIS

SEQ ID NO: 1562104 - protein, 5 aa, Staphylococcus aureus
TATEV

SEQ ID NO: 1562105 - protein, 6 aa, Staphylococcus aureus
TDIDPT

SEQ ID NO: 1562106 - protein, 7 aa, Staphylococcus aureus
TGGLEKG

SEQ ID NO: 1562107 - protein, 6 aa, Staphylococcus aureus
TIEPNT

SEQ ID NO: 1562108 - protein, 13 aa, Staphylococcus aureus
TPRLSEIKKDSRQ

SEQ ID NO: 1562109 - protein, 26 aa, Staphylococcus aureus
TTTQVSTANENTQNITDKDVKSMEAA

SEQ ID NO: 1562110 - protein, 11 aa, Staphylococcus aureus
TVEMSRGNYTQ

SEQ ID NO: 1562111 - protein, 19 aa, Staphylococcus aureus
VKEAQEESKKKNKSNPKID

SEQ ID NO: 1562112 - protein, 9 aa, Staphylococcus aureus
YASKDMTIK

SEQ ID NO: 1562113 - protein, 11 aa, Staphylococcus aureus
YDNTGKNLKTQ

SEQ ID NO: 1562114 - protein, 7 aa, Staphylococcus aureus
ASISEDQ

SEQ ID NO: 1562115 - protein, 14 aa, Staphylococcus aureus
DIANKQRDKDELQA

SEQ ID NO: 1562116 - protein, 7 aa, Staphylococcus aureus
DNPEEAV

SEQ ID NO: 1562117 - protein, 11 aa, Staphylococcus aureus
EESTHENSKHH

SEQ ID NO: 1562118 - protein, 9 aa, Staphylococcus aureus
ESKRKVRRD

SEQ ID NO: 1562119 - protein, 4 aa, Staphylococcus aureus
FSDN

SEQ ID NO: 1562120 - protein, 15 aa, Staphylococcus aureus
GNARGGIKGAVAGAA

SEQ ID NO: 1562121 - protein, 11 aa, Staphylococcus aureus
GTINPRKSNQL

SEQ ID NO: 1562122 - protein, 6 aa, Staphylococcus aureus
GVTGIK

SEQ ID NO: 1562123 - protein, 10 aa, Staphylococcus aureus
HDNNQHDSRQ

SEQ ID NO: 1562124 - protein, 9 aa, Staphylococcus aureus
HDPEGDFGR

SEQ ID NO: 1562125 - protein, 7 aa, Staphylococcus aureus
HSQQEYP

SEQ ID NO: 1562126 - protein, 5 aa, Staphylococcus aureus
HVSIN

SEQ ID NO: 1562127 - protein, 8 aa, Staphylococcus aureus
IEEGGPVT

SEQ ID NO: 1562128 - protein, 13 aa, Staphylococcus aureus
ITQNMNDTQRSEI

SEQ ID NO: 1562129 - protein, 26 aa, Staphylococcus aureus
KDVQKTLQNDVDNGSFYKNKDQQVGA

SEQ ID NO: 1562130 - protein, 7 aa, Staphylococcus aureus
KDYHGIK

SEQ ID NO: 1562131 - protein, 5 aa, Staphylococcus aureus
KGKYR

SEQ ID NO: 1562132 - protein, 10 aa, Staphylococcus aureus
KGLDDHESVG

SEQ ID NO: 1562133 - protein, 4 aa, Staphylococcus aureus
KGSG

SEQ ID NO: 1562134 - protein, 7 aa, Staphylococcus aureus
KGVYDRG

SEQ ID NO: 1562135 - protein, 10 aa, Staphylococcus aureus
KIENKSSFVS

SEQ ID NO: 1562136 - protein, 8 aa, Staphylococcus aureus
KIPEDATR

SEQ ID NO: 1562137 - protein, 6 aa, Staphylococcus aureus
KQAQHS

SEQ ID NO: 1562138 - protein, 13 aa, Staphylococcus aureus
KQNQELDEKQPEL

SEQ ID NO: 1562139 - protein, 11 aa, Staphylococcus aureus
LAGTGTAKLTK

SEQ ID NO: 1562140 - protein, 13 aa, Staphylococcus aureus
LTETEIEASKSMD

SEQ ID NO: 1562141 - protein, 26 aa, Staphylococcus aureus
MGAKTGTGTYGAETYSQYNLPDNAAK

SEQ ID NO: 1562142 - protein, 15 aa, Staphylococcus aureus
NALKNGSSGTAEATK

SEQ ID NO: 1562143 - protein, 4 aa, Staphylococcus aureus
NEKQ

SEQ ID NO: 1562144 - protein, 11 aa, Staphylococcus aureus
NFREPSANNAV

SEQ ID NO: 1562145 - protein, 6 aa, Staphylococcus aureus
NQNYSY

SEQ ID NO: 1562146 - protein, 11 aa, Staphylococcus aureus
NTLRHSNGTKV

SEQ ID NO: 1562147 - protein, 8 aa, Staphylococcus aureus
QQIGTSGS

SEQ ID NO: 1562148 - protein, 6 aa, Staphylococcus aureus
QSGPIA

SEQ ID NO: 1562149 - protein, 11 aa, Staphylococcus aureus
REFDGQYSTAE

SEQ ID NO: 1562150 - protein, 7 aa, Staphylococcus aureus
SDGTQEL

SEQ ID NO: 1562151 - protein, 20 aa, Staphylococcus aureus
SIREEGPQSHMKKTGTPTMG

SEQ ID NO: 1562152 - protein, 7 aa, Staphylococcus aureus
VGEGTEN

SEQ ID NO: 1562153 - protein, 7 aa, Staphylococcus aureus
VKKPASI

SEQ ID NO: 1562154 - protein, 5 aa, Staphylococcus aureus
VNEGM

SEQ ID NO: 1562155 - protein, 26 aa, Staphylococcus aureus
AIQDESSYQVDGSTFRNYDTKSHGTV

SEQ ID NO: 1562156 - protein, 7 aa, Staphylococcus aureus
AKINDQE

SEQ ID NO: 1562157 - protein, 5 aa, Staphylococcus aureus
AKSGV

SEQ ID NO: 1562158 - protein, 8 aa, Staphylococcus aureus
ASKNKKMS

SEQ ID NO: 1562159 - protein, 27 aa, Staphylococcus aureus
AVAPTKQKQSKKSELPETGGEESTNKG

SEQ ID NO: 1562160 - protein, 5 aa, Staphylococcus aureus
DAEYS

SEQ ID NO: 1562161 - protein, 5 aa, Staphylococcus aureus
DANDI

SEQ ID NO: 1562162 - protein, 8 aa, Staphylococcus aureus
DNTQDGAV

SEQ ID NO: 1562163 - protein, 26 aa, Staphylococcus aureus
DQATRVSEGDYSYKPSVTTKDEIGQL

SEQ ID NO: 1562164 - protein, 8 aa, Staphylococcus aureus
DQTTASKS

SEQ ID NO: 1562165 - protein, 17 aa, Staphylococcus aureus
EIEKNKNANIEEKFNDS

SEQ ID NO: 1562166 - protein, 8 aa, Staphylococcus aureus
EKFPSNNK

SEQ ID NO: 1562167 - protein, 18 aa, Staphylococcus aureus
ESFDKGNYGTDNKQVQKH

SEQ ID NO: 1562168 - protein, 12 aa, Staphylococcus aureus
ETENAIREDARR

SEQ ID NO: 1562169 - protein, 8 aa, Staphylococcus aureus
FPKYEQNY

SEQ ID NO: 1562170 - protein, 10 aa, Staphylococcus aureus
GGEGGTGATF

SEQ ID NO: 1562171 - protein, 13 aa, Staphylococcus aureus
GGKTDPMEKRTRV

SEQ ID NO: 1562172 - protein, 59 aa, Staphylococcus aureus
GKSKDDTSNAEYSKVPDVEGQDKQKAIDNVSAKSLEPVTIGSGTQIKAQSIKAGNKVLP

SEQ ID NO: 1562173 - protein, 8 aa, Staphylococcus aureus
IDNEKQKY

SEQ ID NO: 1562174 - protein, 5 aa, Staphylococcus aureus
IKENK

SEQ ID NO: 1562175 - protein, 7 aa, Staphylococcus aureus
IPGYGKH

SEQ ID NO: 1562176 - protein, 9 aa, Staphylococcus aureus
KARKSPNQT

SEQ ID NO: 1562177 - protein, 6 aa, Staphylococcus aureus
KNNETQ

SEQ ID NO: 1562178 - protein, 9 aa, Staphylococcus aureus
KPSTDGEAQ

SEQ ID NO: 1562179 - protein, 65 aa, Staphylococcus aureus
KTFAEEPQEPKIDKGKNDEFNTMSSNLDKEISRISEKSTQLLSDTQESKTIADSVSGQLNQLDNN

SEQ ID NO: 1562180 - protein, 11 aa, Staphylococcus aureus
KTGKESKKESY

SEQ ID NO: 1562181 - protein, 7 aa, Staphylococcus aureus
LEELEPN

SEQ ID NO: 1562182 - protein, 4 aa, Staphylococcus aureus
LGGE

SEQ ID NO: 1562183 - protein, 16 aa, Staphylococcus aureus
LSSIENDEKDTHKVYS

SEQ ID NO: 1562184 - protein, 7 aa, Staphylococcus aureus
NENNRMS

SEQ ID NO: 1562185 - protein, 6 aa, Staphylococcus aureus
NEPVTK

SEQ ID NO: 1562186 - protein, 17 aa, Staphylococcus aureus
NHSELRDKKVSLNDGDP

SEQ ID NO: 1562187 - protein, 8 aa, Staphylococcus aureus
NRRTASST

SEQ ID NO: 1562188 - protein, 9 aa, Staphylococcus aureus
NTGEGGLSE

SEQ ID NO: 1562189 - protein, 7 aa, Staphylococcus aureus
QAHRPQF

SEQ ID NO: 1562190 - protein, 9 aa, Staphylococcus aureus
QGSTPVVSK

SEQ ID NO: 1562191 - protein, 4 aa, Staphylococcus aureus
RITE

SEQ ID NO: 1562192 - protein, 5 aa, Staphylococcus aureus
SEKAR

SEQ ID NO: 1562193 - protein, 9 aa, Staphylococcus aureus
SENKDQDTI

SEQ ID NO: 1562194 - protein, 6 aa, Staphylococcus aureus
SFTKNE

SEQ ID NO: 1562195 - protein, 11 aa, Staphylococcus aureus
SIVPHGDTQLR

SEQ ID NO: 1562196 - protein, 5 aa, Staphylococcus aureus
SKIGR

SEQ ID NO: 1562197 - protein, 6 aa, Staphylococcus aureus
SPVPED

SEQ ID NO: 1562198 - protein, 8 aa, Staphylococcus aureus
SREKDDQE

SEQ ID NO: 1562199 - protein, 4 aa, Staphylococcus aureus
SSHN

SEQ ID NO: 1562200 - protein, 16 aa, Staphylococcus aureus
SSNNGAVENISKDLPK

SEQ ID NO: 1562201 - protein, 4 aa, Staphylococcus aureus
TAST

SEQ ID NO: 1562202 - protein, 10 aa, Staphylococcus aureus
TGEVTPLSEV

SEQ ID NO: 1562203 - protein, 8 aa, Staphylococcus aureus
TKHQNQTI

SEQ ID NO: 1562204 - protein, 10 aa, Staphylococcus aureus
TKRWGGKTKT

SEQ ID NO: 1562205 - protein, 24 aa, Staphylococcus aureus
VITPNTDTTAYLPKGSKVYNGAQT

SEQ ID NO: 1562206 - protein, 9 aa, Staphylococcus aureus
VSPTTAGTM

SEQ ID NO: 1562207 - protein, 16 aa, Staphylococcus aureus
YNSRMTSFGTTKDYQD

SEQ ID NO: 1562208 - protein, 5 aa, Staphylococcus aureus
AGSGV

SEQ ID NO: 1562209 - protein, 8 aa, Staphylococcus aureus
AKPENKKV

SEQ ID NO: 1562210 - protein, 14 aa, Staphylococcus aureus
ANNNKAKADSHSKQ

SEQ ID NO: 1562211 - protein, 6 aa, Staphylococcus aureus
ASPENN

SEQ ID NO: 1562212 - protein, 14 aa, Staphylococcus aureus
ASTAPGNFKDGTDI

SEQ ID NO: 1562213 - protein, 7 aa, Staphylococcus aureus
DDAKEVE

SEQ ID NO: 1562214 - protein, 4 aa, Staphylococcus aureus
DGPI

SEQ ID NO: 1562215 - protein, 5 aa, Staphylococcus aureus
DIIPP

SEQ ID NO: 1562216 - protein, 16 aa, Staphylococcus aureus
DRNPNLTDKEKQALKD

SEQ ID NO: 1562217 - protein, 7 aa, Staphylococcus aureus
GGAIHDA

SEQ ID NO: 1562218 - protein, 10 aa, Staphylococcus aureus
GGYDLTPQQK

SEQ ID NO: 1562219 - protein, 7 aa, Staphylococcus aureus
GKIGEYL

SEQ ID NO: 1562220 - protein, 4 aa, Staphylococcus aureus
GMEG

SEQ ID NO: 1562221 - protein, 6 aa, Staphylococcus aureus
GQMEGS

SEQ ID NO: 1562222 - protein, 27 aa, Staphylococcus aureus
GSMPDLKKPEDKPDSKQRSFEPHEKDD

SEQ ID NO: 1562223 - protein, 12 aa, Staphylococcus aureus
IEDAEKEVKKHK

SEQ ID NO: 1562224 - protein, 9 aa, Staphylococcus aureus
IGASQQEVT

SEQ ID NO: 1562225 - protein, 13 aa, Staphylococcus aureus
KDDPSQSTNVLGE

SEQ ID NO: 1562226 - protein, 4 aa, Staphylococcus aureus
KDNS

SEQ ID NO: 1562227 - protein, 17 aa, Staphylococcus aureus
KGDTKLNDSSKKVTIND

SEQ ID NO: 1562228 - protein, 5 aa, Staphylococcus aureus
KNDDY

SEQ ID NO: 1562229 - protein, 19 aa, Staphylococcus aureus
KNEDPYTVAKDYLKAKGLI

SEQ ID NO: 1562230 - protein, 6 aa, Staphylococcus aureus
KTTAFN

SEQ ID NO: 1562231 - protein, 6 aa, Staphylococcus aureus
KVSETY

SEQ ID NO: 1562232 - protein, 20 aa, Staphylococcus aureus
LAKRTKSSSLNSAAKDNLSD

SEQ ID NO: 1562233 - protein, 6 aa, Staphylococcus aureus
LATEDN

SEQ ID NO: 1562234 - protein, 8 aa, Staphylococcus aureus
LNADQRNG

SEQ ID NO: 1562235 - protein, 5 aa, Staphylococcus aureus
LSQSG

SEQ ID NO: 1562236 - protein, 4 aa, Staphylococcus aureus
LTEN

SEQ ID NO: 1562237 - protein, 18 aa, Staphylococcus aureus
NENKKDNFTAYATPEHNY

SEQ ID NO: 1562238 - protein, 10 aa, Staphylococcus aureus
NPENPAQHQY

SEQ ID NO: 1562239 - protein, 12 aa, Staphylococcus aureus
NQEPEMQRESKN

SEQ ID NO: 1562240 - protein, 18 aa, Staphylococcus aureus
NYSSPIAGIDKPNGANIS

SEQ ID NO: 1562241 - protein, 10 aa, Staphylococcus aureus
NYTKGQAPFV

SEQ ID NO: 1562242 - protein, 5 aa, Staphylococcus aureus
PADVY

SEQ ID NO: 1562243 - protein, 22 aa, Staphylococcus aureus
QITSGNERISSVNGPPGTGKTT

SEQ ID NO: 1562244 - protein, 24 aa, Staphylococcus aureus
QLSASSKAHYKAQLNEAKTASQID

SEQ ID NO: 1562245 - protein, 5 aa, Staphylococcus aureus
QNKYS

SEQ ID NO: 1562246 - protein, 10 aa, Staphylococcus aureus
RASSSISQSP

SEQ ID NO: 1562247 - protein, 71 aa, Staphylococcus aureus
RQAKYKQKSTEELGIEDDGYYAEPEVDPKELKAQQKREKAEIKAKKKEKRKAYNQRMKERRKNQPSAVSQR

SEQ ID NO: 1562248 - protein, 16 aa, Staphylococcus aureus
SDHTTVEDTKEYTTES

SEQ ID NO: 1562249 - protein, 5 aa, Staphylococcus aureus
SELDS

SEQ ID NO: 1562250 - protein, 16 aa, Staphylococcus aureus
SEQSKAESTKLLKDNL

SEQ ID NO: 1562251 - protein, 18 aa, Staphylococcus aureus
SKKEEMQQKVASGEIPPQ

SEQ ID NO: 1562252 - protein, 4 aa, Staphylococcus aureus
SNAV

SEQ ID NO: 1562253 - protein, 6 aa, Staphylococcus aureus
SPGEVN

SEQ ID NO: 1562254 - protein, 6 aa, Staphylococcus aureus
TNGDFT

SEQ ID NO: 1562255 - protein, 10 aa, Staphylococcus aureus
TRDGETIEYD

SEQ ID NO: 1562256 - protein, 9 aa, Staphylococcus aureus
VDNESTQFD

SEQ ID NO: 1562257 - protein, 7 aa, Staphylococcus aureus
VTPNSNK

SEQ ID NO: 1562258 - protein, 78 aa, Staphylococcus aureus
VVKDEDSEFNDGKFGKSYEEIRKEQLEDGQRDESEDRKEEKDIAEDKKEADKSDEKDEPAHRQAPNIEKPYDPNHPDN

SEQ ID NO: 1562259 - protein, 9 aa, Staphylococcus aureus
YKRNQEEIE

SEQ ID NO: 1562260 - protein, 8 aa, Staphylococcus aureus
ANASKVHG

SEQ ID NO: 1562261 - protein, 6 aa, Staphylococcus aureus
EGIDKW

SEQ ID NO: 1562262 - protein, 12 aa, Staphylococcus aureus
ERKEASNAKNLR

SEQ ID NO: 1562263 - protein, 8 aa, Staphylococcus aureus
GAKNDAES

SEQ ID NO: 1562264 - protein, 7 aa, Staphylococcus aureus
IHNPNGT

SEQ ID NO: 1562265 - protein, 10 aa, Staphylococcus aureus
IKGRKETNFP

SEQ ID NO: 1562266 - protein, 28 aa, Staphylococcus aureus
IYSNKNNELITTQPADFEKNKKQVEKDL

SEQ ID NO: 1562267 - protein, 14 aa, Staphylococcus aureus
KDTFESNDNAALTS

SEQ ID NO: 1562268 - protein, 9 aa, Staphylococcus aureus
KEEAEEEAV

SEQ ID NO: 1562269 - protein, 6 aa, Staphylococcus aureus
KEQQER

SEQ ID NO: 1562270 - protein, 10 aa, Staphylococcus aureus
KKRQLSKAQQ

SEQ ID NO: 1562271 - protein, 5 aa, Staphylococcus aureus
KSETF

SEQ ID NO: 1562272 - protein, 13 aa, Staphylococcus aureus
KSGHKQDSEKIAN

SEQ ID NO: 1562273 - protein, 12 aa, Staphylococcus aureus
KVDSNSYGNASG

SEQ ID NO: 1562274 - protein, 5 aa, Staphylococcus aureus
LQSNF

SEQ ID NO: 1562275 - protein, 10 aa, Staphylococcus aureus
NAINDLEEDP

SEQ ID NO: 1562276 - protein, 8 aa, Staphylococcus aureus
NERPELDG

SEQ ID NO: 1562277 - protein, 12 aa, Staphylococcus aureus
NGVTSTAKVPPI

SEQ ID NO: 1562278 - protein, 6 aa, Staphylococcus aureus
NPSGDN

SEQ ID NO: 1562279 - protein, 12 aa, Staphylococcus aureus
NVAESGLKNGGY

SEQ ID NO: 1562280 - protein, 24 aa, Staphylococcus aureus
PAGLTQTGTNTTEDDKDADGGEVD

SEQ ID NO: 1562281 - protein, 24 aa, Staphylococcus aureus
QFYKGQKQIAGKPITKDTAEKVEK

SEQ ID NO: 1562282 - protein, 7 aa, Staphylococcus aureus
RKDIPQS

SEQ ID NO: 1562283 - protein, 5 aa, Staphylococcus aureus
SHGIT

SEQ ID NO: 1562284 - protein, 8 aa, Staphylococcus aureus
SKATTITP

SEQ ID NO: 1562285 - protein, 13 aa, Staphylococcus aureus
SRLPDGRWPSQTE

SEQ ID NO: 1562286 - protein, 12 aa, Staphylococcus aureus
SSELGKDDPFNP

SEQ ID NO: 1562287 - protein, 9 aa, Staphylococcus aureus
STRALTPKT

SEQ ID NO: 1562288 - protein, 9 aa, Staphylococcus aureus
TIENNGYEA

SEQ ID NO: 1562289 - protein, 22 aa, Staphylococcus aureus
VDSEAGHVGGYTESSEESNPID

SEQ ID NO: 1562290 - protein, 6 aa, Staphylococcus aureus
YSVNNS

SEQ ID NO: 1562291 - protein, 10 aa, Staphylococcus aureus
AASGKAFAEV

SEQ ID NO: 1562292 - protein, 8 aa, Staphylococcus aureus
AASGPASD

SEQ ID NO: 1562293 - protein, 12 aa, Staphylococcus aureus
ADKFKTEEDYKA

SEQ ID NO: 1562294 - protein, 7 aa, Staphylococcus aureus
AKGKVTR

SEQ ID NO: 1562295 - protein, 23 aa, Staphylococcus aureus
AKKLNESQAPKADNNFNKEQQNA

SEQ ID NO: 1562296 - protein, 4 aa, Staphylococcus aureus
AKNE

SEQ ID NO: 1562297 - protein, 6 aa, Staphylococcus aureus
ALGETA

SEQ ID NO: 1562298 - protein, 12 aa, Staphylococcus aureus
AYVDPDNEQKIQ

SEQ ID NO: 1562299 - protein, 6 aa, Staphylococcus aureus
DMSKNI

SEQ ID NO: 1562300 - protein, 18 aa, Staphylococcus aureus
EKDATIEKSNTGDATVDG

SEQ ID NO: 1562301 - protein, 5 aa, Staphylococcus aureus
ENNQK

SEQ ID NO: 1562302 - protein, 4 aa, Staphylococcus aureus
ESAV

SEQ ID NO: 1562303 - protein, 10 aa, Staphylococcus aureus
ETQKELPGQF

SEQ ID NO: 1562304 - protein, 6 aa, Staphylococcus aureus
FASDSK

SEQ ID NO: 1562305 - protein, 19 aa, Staphylococcus aureus
FSKKTDFAVTNGGGIRASI

SEQ ID NO: 1562306 - protein, 11 aa, Staphylococcus aureus
FSTKGEGRGLG

SEQ ID NO: 1562307 - protein, 13 aa, Staphylococcus aureus
GGKENIKDVTNCT

SEQ ID NO: 1562308 - protein, 15 aa, Staphylococcus aureus
GSPFNDAKLNAEQKE

SEQ ID NO: 1562309 - protein, 6 aa, Staphylococcus aureus
HKKDIT

SEQ ID NO: 1562310 - protein, 5 aa, Staphylococcus aureus
IDSDG

SEQ ID NO: 1562311 - protein, 4 aa, Staphylococcus aureus
IGDS

SEQ ID NO: 1562312 - protein, 11 aa, Staphylococcus aureus
IIGPSGSGKST

SEQ ID NO: 1562313 - protein, 7 aa, Staphylococcus aureus
IKGRYHG

SEQ ID NO: 1562314 - protein, 8 aa, Staphylococcus aureus
IPKSSIKP

SEQ ID NO: 1562315 - protein, 8 aa, Staphylococcus aureus
IPTQTSTA

SEQ ID NO: 1562316 - protein, 6 aa, Staphylococcus aureus
KHNANK

SEQ ID NO: 1562317 - protein, 9 aa, Staphylococcus aureus
KKAKKTVVA

SEQ ID NO: 1562318 - protein, 10 aa, Staphylococcus aureus
KQLTLTETTT

SEQ ID NO: 1562319 - protein, 5 aa, Staphylococcus aureus
KRAYT

SEQ ID NO: 1562320 - protein, 6 aa, Staphylococcus aureus
KSGVNT

SEQ ID NO: 1562321 - protein, 10 aa, Staphylococcus aureus
KSQQEDYESD

SEQ ID NO: 1562322 - protein, 8 aa, Staphylococcus aureus
KSTNGDVV

SEQ ID NO: 1562323 - protein, 9 aa, Staphylococcus aureus
LNGGKKVDT

SEQ ID NO: 1562324 - protein, 5 aa, Staphylococcus aureus
NAAGE

SEQ ID NO: 1562325 - protein, 15 aa, Staphylococcus aureus
NQSQSSYKKYKDAVD

SEQ ID NO: 1562326 - protein, 8 aa, Staphylococcus aureus
NTIEGGKD

SEQ ID NO: 1562327 - protein, 6 aa, Staphylococcus aureus
QNYPVN

SEQ ID NO: 1562328 - protein, 10 aa, Staphylococcus aureus
QTPALQKEAE

SEQ ID NO: 1562329 - protein, 10 aa, Staphylococcus aureus
RAKRDKFKKK

SEQ ID NO: 1562330 - protein, 6 aa, Staphylococcus aureus
SAGHPE

SEQ ID NO: 1562331 - protein, 26 aa, Staphylococcus aureus
SETALTAANKTKFKTEADKGDKKAKG

SEQ ID NO: 1562332 - protein, 14 aa, Staphylococcus aureus
SGAINKPVSIPNTY

SEQ ID NO: 1562333 - protein, 9 aa, Staphylococcus aureus
SNEAGSANG

SEQ ID NO: 1562334 - protein, 7 aa, Staphylococcus aureus
SSTDQNT

SEQ ID NO: 1562335 - protein, 11 aa, Staphylococcus aureus
TDLGRNFSGTV

SEQ ID NO: 1562336 - protein, 15 aa, Staphylococcus aureus
TMKSVGPSLAPTNAK

SEQ ID NO: 1562337 - protein, 6 aa, Staphylococcus aureus
VPQTTT

SEQ ID NO: 1562338 - protein, 5 aa, Staphylococcus aureus
VSRGK

SEQ ID NO: 1562339 - protein, 6 aa, Staphylococcus aureus
VTSKQI

SEQ ID NO: 1562340 - protein, 5 aa, Staphylococcus aureus
YNDPS

SEQ ID NO: 1562341 - protein, 12 aa, Staphylococcus aureus
AANAMNDDSGFI

SEQ ID NO: 1562342 - protein, 4 aa, Staphylococcus aureus
AELR

SEQ ID NO: 1562343 - protein, 8 aa, Staphylococcus aureus
AKKNDGAV

SEQ ID NO: 1562344 - protein, 20 aa, Staphylococcus aureus
ATQDNSGNAVTNTVTGLPSG

SEQ ID NO: 1562345 - protein, 8 aa, Staphylococcus aureus
DIASYTPH

SEQ ID NO: 1562346 - protein, 5 aa, Staphylococcus aureus
DKISQ

SEQ ID NO: 1562347 - protein, 20 aa, Staphylococcus aureus
DQEIQRGPVNHEAPSHENHV

SEQ ID NO: 1562348 - protein, 4 aa, Staphylococcus aureus
DSRQ

SEQ ID NO: 1562349 - protein, 12 aa, Staphylococcus aureus
ENGSDSGRTNSI

SEQ ID NO: 1562350 - protein, 11 aa, Staphylococcus aureus
GVNKNISESNF

SEQ ID NO: 1562351 - protein, 18 aa, Staphylococcus aureus
IEKRHKEEQKAREKNEIQ

SEQ ID NO: 1562352 - protein, 6 aa, Staphylococcus aureus
IKGGRF

SEQ ID NO: 1562353 - protein, 5 aa, Staphylococcus aureus
KGYNH

SEQ ID NO: 1562354 - protein, 6 aa, Staphylococcus aureus
KLTGNN

SEQ ID NO: 1562355 - protein, 19 aa, Staphylococcus aureus
KQQNYINETQYQQAMSQLN

SEQ ID NO: 1562356 - protein, 6 aa, Staphylococcus aureus
LAQQQF

SEQ ID NO: 1562357 - protein, 11 aa, Staphylococcus aureus
MSNKDENVKQL

SEQ ID NO: 1562358 - protein, 11 aa, Staphylococcus aureus
NANKSNSFNEQ

SEQ ID NO: 1562359 - protein, 41 aa, Staphylococcus aureus
NDAAKKQINNYTSQQVSNKKNDAWRDASATEIKSAMDSGTF

SEQ ID NO: 1562360 - protein, 10 aa, Staphylococcus aureus
NISRDRHEKR

SEQ ID NO: 1562361 - protein, 5 aa, Staphylococcus aureus
NMPEY

SEQ ID NO: 1562362 - protein, 12 aa, Staphylococcus aureus
PKKNGPLGNSPI

SEQ ID NO: 1562363 - protein, 6 aa, Staphylococcus aureus
PLASPD

SEQ ID NO: 1562364 - protein, 6 aa, Staphylococcus aureus
QNGHEA

SEQ ID NO: 1562365 - protein, 28 aa, Staphylococcus aureus
REFNPKLQPGEERVKQEGQPGSKTITTP

SEQ ID NO: 1562366 - protein, 7 aa, Staphylococcus aureus
SDLPQPE

SEQ ID NO: 1562367 - protein, 7 aa, Staphylococcus aureus
SKTNHGY

SEQ ID NO: 1562368 - protein, 5 aa, Staphylococcus aureus
SLQAQ

SEQ ID NO: 1562369 - protein, 20 aa, Staphylococcus aureus
SNDNSTSKQHVSISNQGIIT

SEQ ID NO: 1562370 - protein, 5 aa, Staphylococcus aureus
SSTGS

SEQ ID NO: 1562371 - protein, 7 aa, Staphylococcus aureus
TGTGIAP

SEQ ID NO: 1562372 - protein, 5 aa, Staphylococcus aureus
VATEP

SEQ ID NO: 1562373 - protein, 9 aa, Staphylococcus aureus
VSTEDTYKK

SEQ ID NO: 1562374 - protein, 5 aa, Staphylococcus aureus
YDTYT

SEQ ID NO: 1562375 - protein, 8 aa, Staphylococcus aureus
AAQASGIS

SEQ ID NO: 1562376 - protein, 12 aa, Staphylococcus aureus
AARTRGKQGTGL

SEQ ID NO: 1562377 - protein, 5 aa, Staphylococcus aureus
AKNRD

SEQ ID NO: 1562378 - protein, 11 aa, Staphylococcus aureus
ARKLNKNNGNV

SEQ ID NO: 1562379 - protein, 5 aa, Staphylococcus aureus
ASHEK

SEQ ID NO: 1562380 - protein, 5 aa, Staphylococcus aureus
DKDYE

SEQ ID NO: 1562381 - protein, 7 aa, Staphylococcus aureus
DMYSGNE

SEQ ID NO: 1562382 - protein, 9 aa, Staphylococcus aureus
DSITKYGAP

SEQ ID NO: 1562383 - protein, 5 aa, Staphylococcus aureus
DVQRK

SEQ ID NO: 1562384 - protein, 20 aa, Staphylococcus aureus
EDSQGTVNQTFKDSESGSER

SEQ ID NO: 1562385 - protein, 8 aa, Staphylococcus aureus
ENRANEDV

SEQ ID NO: 1562386 - protein, 5 aa, Staphylococcus aureus
FGENE

SEQ ID NO: 1562387 - protein, 6 aa, Staphylococcus aureus
GRSTVD

SEQ ID NO: 1562388 - protein, 4 aa, Staphylococcus aureus
GSRG

SEQ ID NO: 1562389 - protein, 4 aa, Staphylococcus aureus
GTAG

SEQ ID NO: 1562390 - protein, 6 aa, Staphylococcus aureus
IADNAD

SEQ ID NO: 1562391 - protein, 8 aa, Staphylococcus aureus
IDGEGGYV

SEQ ID NO: 1562392 - protein, 13 aa, Staphylococcus aureus
IETEENQDNTPLD

SEQ ID NO: 1562393 - protein, 6 aa, Staphylococcus aureus
KDFNVT

SEQ ID NO: 1562394 - protein, 6 aa, Staphylococcus aureus
KKTKGH

SEQ ID NO: 1562395 - protein, 6 aa, Staphylococcus aureus
KTSIDE

SEQ ID NO: 1562396 - protein, 12 aa, Staphylococcus aureus
LHTGTEHTHTTT

SEQ ID NO: 1562397 - protein, 7 aa, Staphylococcus aureus
LSDGSKR

SEQ ID NO: 1562398 - protein, 4 aa, Staphylococcus aureus
NEVE

SEQ ID NO: 1562399 - protein, 5 aa, Staphylococcus aureus
QEELE

SEQ ID NO: 1562400 - protein, 4 aa, Staphylococcus aureus
QQQQ

SEQ ID NO: 1562401 - protein, 4 aa, Staphylococcus aureus
QRTA

SEQ ID NO: 1562402 - protein, 25 aa, Staphylococcus aureus
QVDAKDAAMTKAIKDKNKAELESLN

SEQ ID NO: 1562403 - protein, 13 aa, Staphylococcus aureus
SKNFSPTMSDYNG

SEQ ID NO: 1562404 - protein, 10 aa, Staphylococcus aureus
SNNTKDVNTH

SEQ ID NO: 1562405 - protein, 7 aa, Staphylococcus aureus
VTTSQKI

SEQ ID NO: 1562406 - protein, 9 aa, Staphylococcus aureus
AEKDSEHPL

SEQ ID NO: 1562407 - protein, 20 aa, Staphylococcus aureus
AKSALSNNSISNDNKQKAIE

SEQ ID NO: 1562408 - protein, 17 aa, Staphylococcus aureus
AQVEAQRMAESGWGKTS

SEQ ID NO: 1562409 - protein, 4 aa, Staphylococcus aureus
EVKS

SEQ ID NO: 1562410 - protein, 6 aa, Staphylococcus aureus
GEDGHP

SEQ ID NO: 1562411 - protein, 9 aa, Staphylococcus aureus
GKELESATE

SEQ ID NO: 1562412 - protein, 7 aa, Staphylococcus aureus
GTQALRP

SEQ ID NO: 1562413 - protein, 4 aa, Staphylococcus aureus
HSNE

SEQ ID NO: 1562414 - protein, 17 aa, Staphylococcus aureus
IKDQQKANQLASELNNQ

SEQ ID NO: 1562415 - protein, 6 aa, Staphylococcus aureus
KEINEQ

SEQ ID NO: 1562416 - protein, 8 aa, Staphylococcus aureus
KPVAKNDL

SEQ ID NO: 1562417 - protein, 7 aa, Staphylococcus aureus
KSDELQL

SEQ ID NO: 1562418 - protein, 6 aa, Staphylococcus aureus
KSRDYP

SEQ ID NO: 1562419 - protein, 8 aa, Staphylococcus aureus
LAVSSEQL

SEQ ID NO: 1562420 - protein, 6 aa, Staphylococcus aureus
LEQSYG

SEQ ID NO: 1562421 - protein, 6 aa, Staphylococcus aureus
LGGGGM

SEQ ID NO: 1562422 - protein, 8 aa, Staphylococcus aureus
NDTPNFDV

SEQ ID NO: 1562423 - protein, 7 aa, Staphylococcus aureus
NMSTELK

SEQ ID NO: 1562424 - protein, 27 aa, Staphylococcus aureus
QITGRSKDFSSKAKGDSDLTTSDGGKL

SEQ ID NO: 1562425 - protein, 11 aa, Staphylococcus aureus
QPGITTPTQKT

SEQ ID NO: 1562426 - protein, 8 aa, Staphylococcus aureus
SRSSAGAL

SEQ ID NO: 1562427 - protein, 7 aa, Staphylococcus aureus
SSIAGPA

SEQ ID NO: 1562428 - protein, 4 aa, Staphylococcus aureus
TPSY

SEQ ID NO: 1562429 - protein, 15 aa, Staphylococcus aureus
YMTTSGNATYDQSTG

SEQ ID NO: 1562430 - protein, 12 aa, Staphylococcus aureus
AAYTAATGRPFH

SEQ ID NO: 1562431 - protein, 5 aa, Staphylococcus aureus
AFTTG

SEQ ID NO: 1562432 - protein, 10 aa, Staphylococcus aureus
AKAGPDLADA

SEQ ID NO: 1562433 - protein, 9 aa, Staphylococcus aureus
AQRGDPSRG

SEQ ID NO: 1562434 - protein, 7 aa, Staphylococcus aureus
DDYSSKN

SEQ ID NO: 1562435 - protein, 10 aa, Staphylococcus aureus
DKAGKLSDVA

SEQ ID NO: 1562436 - protein, 10 aa, Staphylococcus aureus
DNKATSYKQS

SEQ ID NO: 1562437 - protein, 5 aa, Staphylococcus aureus
DPVGP

SEQ ID NO: 1562438 - protein, 16 aa, Staphylococcus aureus
DQNPNLTDKEKQALKD

SEQ ID NO: 1562439 - protein, 7 aa, Staphylococcus aureus
EAMGGGD

SEQ ID NO: 1562440 - protein, 6 aa, Staphylococcus aureus
EIETSR

SEQ ID NO: 1562441 - protein, 9 aa, Staphylococcus aureus
EKDLTGNIA

SEQ ID NO: 1562442 - protein, 5 aa, Staphylococcus aureus
ENPFR

SEQ ID NO: 1562443 - protein, 11 aa, Staphylococcus aureus
ESALSAPKDKY

SEQ ID NO: 1562444 - protein, 6 aa, Staphylococcus aureus
ETDTTL

SEQ ID NO: 1562445 - protein, 7 aa, Staphylococcus aureus
ETGKKHK

SEQ ID NO: 1562446 - protein, 9 aa, Staphylococcus aureus
FKTKDNQRI

SEQ ID NO: 1562447 - protein, 5 aa, Staphylococcus aureus
GGVQT

SEQ ID NO: 1562448 - protein, 6 aa, Staphylococcus aureus
GIPPGM

SEQ ID NO: 1562449 - protein, 8 aa, Staphylococcus aureus
GKGSERHE

SEQ ID NO: 1562450 - protein, 14 aa, Staphylococcus aureus
GKTYTISEDERADI

SEQ ID NO: 1562451 - protein, 9 aa, Staphylococcus aureus
GVSGGNHQI

SEQ ID NO: 1562452 - protein, 59 aa, Staphylococcus aureus
HSNKAKERMLNEQKQEQKEKRQKENAEKERKKKQQEEKEQNELDSQANQYQQLPQQNQY

SEQ ID NO: 1562453 - protein, 4 aa, Staphylococcus aureus
IQES

SEQ ID NO: 1562454 - protein, 5 aa, Staphylococcus aureus
KGKPF

SEQ ID NO: 1562455 - protein, 7 aa, Staphylococcus aureus
KKNKAID

SEQ ID NO: 1562456 - protein, 13 aa, Staphylococcus aureus
KNFYANNSEISEI

SEQ ID NO: 1562457 - protein, 7 aa, Staphylococcus aureus
KPDHQAQ

SEQ ID NO: 1562458 - protein, 4 aa, Staphylococcus aureus
KSIA

SEQ ID NO: 1562459 - protein, 11 aa, Staphylococcus aureus
LDETAENNNKI

SEQ ID NO: 1562460 - protein, 12 aa, Staphylococcus aureus
LNNEQKIQSNRL

SEQ ID NO: 1562461 - protein, 4 aa, Staphylococcus aureus
LRKD

SEQ ID NO: 1562462 - protein, 10 aa, Staphylococcus aureus
NKKEDQITNY

SEQ ID NO: 1562463 - protein, 5 aa, Staphylococcus aureus
NPQSA

SEQ ID NO: 1562464 - protein, 7 aa, Staphylococcus aureus
NTTYGTE

SEQ ID NO: 1562465 - protein, 26 aa, Staphylococcus aureus
PAHHQQFQKPEGTVYEPKPKKKSTRK

SEQ ID NO: 1562466 - protein, 6 aa, Staphylococcus aureus
PEDMAQ

SEQ ID NO: 1562467 - protein, 12 aa, Staphylococcus aureus
PKNIGDPASGYA

SEQ ID NO: 1562468 - protein, 16 aa, Staphylococcus aureus
PKYEKTYVDAKGKTYH

SEQ ID NO: 1562469 - protein, 15 aa, Staphylococcus aureus
QKSRGSEISSGNIAT

SEQ ID NO: 1562470 - protein, 4 aa, Staphylococcus aureus
QSNE

SEQ ID NO: 1562471 - protein, 5 aa, Staphylococcus aureus
QSNQL

SEQ ID NO: 1562472 - protein, 14 aa, Staphylococcus aureus
QVKDGDNSKNKGPV

SEQ ID NO: 1562473 - protein, 6 aa, Staphylococcus aureus
RPLNEN

SEQ ID NO: 1562474 - protein, 5 aa, Staphylococcus aureus
RSYNK

SEQ ID NO: 1562475 - protein, 6 aa, Staphylococcus aureus
RTPMGG

SEQ ID NO: 1562476 - protein, 5 aa, Staphylococcus aureus
SNAPI

SEQ ID NO: 1562477 - protein, 6 aa, Staphylococcus aureus
SNGAPC

SEQ ID NO: 1562478 - protein, 12 aa, Staphylococcus aureus
SQEINNRESEKG

SEQ ID NO: 1562479 - protein, 5 aa, Staphylococcus aureus
SRAMP

SEQ ID NO: 1562480 - protein, 9 aa, Staphylococcus aureus
STYSSDVGT

SEQ ID NO: 1562481 - protein, 4 aa, Staphylococcus aureus
TDYN

SEQ ID NO: 1562482 - protein, 6 aa, Staphylococcus aureus
TRQPKF

SEQ ID NO: 1562483 - protein, 6 aa, Staphylococcus aureus
TSGRYS

SEQ ID NO: 1562484 - protein, 8 aa, Staphylococcus aureus
TSYITKTG

SEQ ID NO: 1562485 - protein, 9 aa, Staphylococcus aureus
TVKEQEKPD

SEQ ID NO: 1562486 - protein, 8 aa, Staphylococcus aureus
VKDQLKPG

SEQ ID NO: 1562487 - protein, 21 aa, Staphylococcus aureus
YKTPGREDKQSQAATASATEL

SEQ ID NO: 1562488 - protein, 6 aa, Staphylococcus aureus
AKNNKF

SEQ ID NO: 1562489 - protein, 9 aa, Staphylococcus aureus
ANNGNTDVI

SEQ ID NO: 1562490 - protein, 8 aa, Staphylococcus aureus
ASHTHSPA

SEQ ID NO: 1562491 - protein, 13 aa, Staphylococcus aureus
CGTEQHTANHFPG

SEQ ID NO: 1562492 - protein, 6 aa, Staphylococcus aureus
DGVQNA

SEQ ID NO: 1562493 - protein, 7 aa, Staphylococcus aureus
DKHINDN

SEQ ID NO: 1562494 - protein, 7 aa, Staphylococcus aureus
DKKPELR

SEQ ID NO: 1562495 - protein, 8 aa, Staphylococcus aureus
DMNQSSQA

SEQ ID NO: 1562496 - protein, 4 aa, Staphylococcus aureus
DNLP

SEQ ID NO: 1562497 - protein, 9 aa, Staphylococcus aureus
DSDPFESQN

SEQ ID NO: 1562498 - protein, 7 aa, Staphylococcus aureus
EAAQASQ

SEQ ID NO: 1562499 - protein, 7 aa, Staphylococcus aureus
EMSAKDT

SEQ ID NO: 1562500 - protein, 8 aa, Staphylococcus aureus
ESKVADTE

SEQ ID NO: 1562501 - protein, 7 aa, Staphylococcus aureus
FKPAKNN

SEQ ID NO: 1562502 - protein, 9 aa, Staphylococcus aureus
GDSAGAQLA

SEQ ID NO: 1562503 - protein, 11 aa, Staphylococcus aureus
GISDKQGEKVA

SEQ ID NO: 1562504 - protein, 10 aa, Staphylococcus aureus
HRQSTASLSN

SEQ ID NO: 1562505 - protein, 10 aa, Staphylococcus aureus
IAGDKQYKNP

SEQ ID NO: 1562506 - protein, 25 aa, Staphylococcus aureus
IEKNENVDLSKEIDKVKAANNRINE

SEQ ID NO: 1562507 - protein, 6 aa, Staphylococcus aureus
IGPNAY

SEQ ID NO: 1562508 - protein, 16 aa, Staphylococcus aureus
KAIDDVKETKKDEFAK

SEQ ID NO: 1562509 - protein, 14 aa, Staphylococcus aureus
KDKPSTYISKTATK

SEQ ID NO: 1562510 - protein, 8 aa, Staphylococcus aureus
KEKQALDQ

SEQ ID NO: 1562511 - protein, 7 aa, Staphylococcus aureus
KELKDKF

SEQ ID NO: 1562512 - protein, 6 aa, Staphylococcus aureus
KERGEL

SEQ ID NO: 1562513 - protein, 9 aa, Staphylococcus aureus
KIKKSATDW

SEQ ID NO: 1562514 - protein, 7 aa, Staphylococcus aureus
KPESIDN

SEQ ID NO: 1562515 - protein, 5 aa, Staphylococcus aureus
KSQIK

SEQ ID NO: 1562516 - protein, 4 aa, Staphylococcus aureus
KTPE

SEQ ID NO: 1562517 - protein, 15 aa, Staphylococcus aureus
LAATPKLASKGAIRE

SEQ ID NO: 1562518 - protein, 21 aa, Staphylococcus aureus
LESEPSKQVVPGMNAEVKIHK

SEQ ID NO: 1562519 - protein, 4 aa, Staphylococcus aureus
LGGR

SEQ ID NO: 1562520 - protein, 4 aa, Staphylococcus aureus
LKQG

SEQ ID NO: 1562521 - protein, 9 aa, Staphylococcus aureus
LKSKDRNIG

SEQ ID NO: 1562522 - protein, 11 aa, Staphylococcus aureus
NASQSEIDDAN

SEQ ID NO: 1562523 - protein, 11 aa, Staphylococcus aureus
NRQYKDSQKQV

SEQ ID NO: 1562524 - protein, 8 aa, Staphylococcus aureus
NVAQGGAA

SEQ ID NO: 1562525 - protein, 6 aa, Staphylococcus aureus
NYAPSA

SEQ ID NO: 1562526 - protein, 21 aa, Staphylococcus aureus
PLTGEKVGEGQPTEEITKQPV

SEQ ID NO: 1562527 - protein, 11 aa, Staphylococcus aureus
PTFNKEGSNQI

SEQ ID NO: 1562528 - protein, 4 aa, Staphylococcus aureus
QALE

SEQ ID NO: 1562529 - protein, 9 aa, Staphylococcus aureus
QEKLSGKNF

SEQ ID NO: 1562530 - protein, 6 aa, Staphylococcus aureus
QYKYPT

SEQ ID NO: 1562531 - protein, 14 aa, Staphylococcus aureus
RKKKKDENDQDDSQ

SEQ ID NO: 1562532 - protein, 11 aa, Staphylococcus aureus
RKLRRKRQKRI

SEQ ID NO: 1562533 - protein, 10 aa, Staphylococcus aureus
SDATDSNQKT

SEQ ID NO: 1562534 - protein, 5 aa, Staphylococcus aureus
SENDL

SEQ ID NO: 1562535 - protein, 7 aa, Staphylococcus aureus
SFKPSQI

SEQ ID NO: 1562536 - protein, 10 aa, Staphylococcus aureus
SLKASGANKI

SEQ ID NO: 1562537 - protein, 6 aa, Staphylococcus aureus
SLNERS

SEQ ID NO: 1562538 - protein, 22 aa, Staphylococcus aureus
SNEENQSHSNRLTDKLQGSDKI

SEQ ID NO: 1562539 - protein, 6 aa, Staphylococcus aureus
STREAP

SEQ ID NO: 1562540 - protein, 7 aa, Staphylococcus aureus
TKSGAPW

SEQ ID NO: 1562541 - protein, 7 aa, Staphylococcus aureus
TNSHTVE

SEQ ID NO: 1562542 - protein, 12 aa, Staphylococcus aureus
VDMQGDKQVTIP

SEQ ID NO: 1562543 - protein, 6 aa, Staphylococcus aureus
VGSKNV

SEQ ID NO: 1562544 - protein, 22 aa, Staphylococcus aureus
VKDSGLKADQIQINGKDNKVAT

SEQ ID NO: 1562545 - protein, 17 aa, Staphylococcus aureus
VKGFGSKTFDKLKSYFT

SEQ ID NO: 1562546 - protein, 17 aa, Staphylococcus aureus
VQQEEEKRINNDLNQYD

SEQ ID NO: 1562547 - protein, 24 aa, Staphylococcus aureus
VTIDGQKASIKGKVDSIGKATAAS

SEQ ID NO: 1562548 - protein, 9 aa, Staphylococcus aureus
YHKHTPESK

SEQ ID NO: 1562549 - protein, 23 aa, Staphylococcus aureus
YQNKEVHQGTITDKYNKRQDKED

SEQ ID NO: 1562550 - protein, 7 aa, Staphylococcus aureus
AAWQSPT

SEQ ID NO: 1562551 - protein, 6 aa, Staphylococcus aureus
AGGTRI

SEQ ID NO: 1562552 - protein, 6 aa, Staphylococcus aureus
AKQAFG

SEQ ID NO: 1562553 - protein, 20 aa, Staphylococcus aureus
AQKTCKSGETITISNGEAVA

SEQ ID NO: 1562554 - protein, 9 aa, Staphylococcus aureus
ARSEDANKL

SEQ ID NO: 1562555 - protein, 8 aa, Staphylococcus aureus
ASRANAMK

SEQ ID NO: 1562556 - protein, 28 aa, Staphylococcus aureus
ATSDNKDTQQQNQPEEDERQGLNGYRKT

SEQ ID NO: 1562557 - protein, 11 aa, Staphylococcus aureus
ATTSKKTSETF

SEQ ID NO: 1562558 - protein, 5 aa, Staphylococcus aureus
AVKHP

SEQ ID NO: 1562559 - protein, 13 aa, Staphylococcus aureus
DESKVDKDALSNN

SEQ ID NO: 1562560 - protein, 16 aa, Staphylococcus aureus
DKGTTIQDKNVNIGKK

SEQ ID NO: 1562561 - protein, 12 aa, Staphylococcus aureus
DKKDDPQGLQQD

SEQ ID NO: 1562562 - protein, 4 aa, Staphylococcus aureus
DKNE

SEQ ID NO: 1562563 - protein, 9 aa, Staphylococcus aureus
DNTTQQHEQ

SEQ ID NO: 1562564 - protein, 17 aa, Staphylococcus aureus
DRNQVKQSDDKRHASRY

SEQ ID NO: 1562565 - protein, 15 aa, Staphylococcus aureus
EARPTIGQSDEDEKS

SEQ ID NO: 1562566 - protein, 7 aa, Staphylococcus aureus
EENDKTM

SEQ ID NO: 1562567 - protein, 6 aa, Staphylococcus aureus
EEVNRT

SEQ ID NO: 1562568 - protein, 11 aa, Staphylococcus aureus
EHKAEKETLNK

SEQ ID NO: 1562569 - protein, 21 aa, Staphylococcus aureus
EKGKDTEAIQTSNDALKEAKD

SEQ ID NO: 1562570 - protein, 20 aa, Staphylococcus aureus
EKLPEKYKAEYKKKLDQTRV

SEQ ID NO: 1562571 - protein, 13 aa, Staphylococcus aureus
EKNNNKKGKHNDK

SEQ ID NO: 1562572 - protein, 5 aa, Staphylococcus aureus
EKRFD

SEQ ID NO: 1562573 - protein, 27 aa, Staphylococcus aureus
ENGKQVDKEYELEQGSQDRLQLIKTSE

SEQ ID NO: 1562574 - protein, 12 aa, Staphylococcus aureus
ESTNKDEVGPLK

SEQ ID NO: 1562575 - protein, 8 aa, Staphylococcus aureus
FKDKPLNE

SEQ ID NO: 1562576 - protein, 10 aa, Staphylococcus aureus
FSTEQQDETY

SEQ ID NO: 1562577 - protein, 10 aa, Staphylococcus aureus
GDEDEKAFQE

SEQ ID NO: 1562578 - protein, 16 aa, Staphylococcus aureus
GEDYTTLKDASNSLEA

SEQ ID NO: 1562579 - protein, 16 aa, Staphylococcus aureus
GLTRPQTINKLSSSSN

SEQ ID NO: 1562580 - protein, 6 aa, Staphylococcus aureus
GMYNKR

SEQ ID NO: 1562581 - protein, 9 aa, Staphylococcus aureus
GQKNVEPQI

SEQ ID NO: 1562582 - protein, 17 aa, Staphylococcus aureus
HTENESKSQSQPSRKKR

SEQ ID NO: 1562583 - protein, 6 aa, Staphylococcus aureus
IENSKK

SEQ ID NO: 1562584 - protein, 4 aa, Staphylococcus aureus
ISDK

SEQ ID NO: 1562585 - protein, 11 aa, Staphylococcus aureus
ISPSHQKAKNF

SEQ ID NO: 1562586 - protein, 17 aa, Staphylococcus aureus
ISQMSKNNQVKETNHNK

SEQ ID NO: 1562587 - protein, 4 aa, Staphylococcus aureus
KAAS

SEQ ID NO: 1562588 - protein, 16 aa, Staphylococcus aureus
KHDETKSYNDQINDEV

SEQ ID NO: 1562589 - protein, 19 aa, Staphylococcus aureus
KISDPYENKQISKDKTTAF

SEQ ID NO: 1562590 - protein, 5 aa, Staphylococcus aureus
KKEPL

SEQ ID NO: 1562591 - protein, 7 aa, Staphylococcus aureus
KNEFKTY

SEQ ID NO: 1562592 - protein, 6 aa, Staphylococcus aureus
KVNEYK

SEQ ID NO: 1562593 - protein, 6 aa, Staphylococcus aureus
LGASIG

SEQ ID NO: 1562594 - protein, 9 aa, Staphylococcus aureus
LGQKTQEQV

SEQ ID NO: 1562595 - protein, 9 aa, Staphylococcus aureus
LGTNGGGFL

SEQ ID NO: 1562596 - protein, 8 aa, Staphylococcus aureus
NDLKKQAG

SEQ ID NO: 1562597 - protein, 8 aa, Staphylococcus aureus
NGEVSNIK

SEQ ID NO: 1562598 - protein, 10 aa, Staphylococcus aureus
NGKKQDEPYL

SEQ ID NO: 1562599 - protein, 29 aa, Staphylococcus aureus
NKNDRMNDNNDADAQKYTTTMKNANNTVK

SEQ ID NO: 1562600 - protein, 6 aa, Staphylococcus aureus
NNEVER

SEQ ID NO: 1562601 - protein, 10 aa, Staphylococcus aureus
NSDNTNVNDI

SEQ ID NO: 1562602 - protein, 9 aa, Staphylococcus aureus
PKGSKFNSN

SEQ ID NO: 1562603 - protein, 13 aa, Staphylococcus aureus
PNVPRSNANKKRE

SEQ ID NO: 1562604 - protein, 8 aa, Staphylococcus aureus
QEETSPLQ

SEQ ID NO: 1562605 - protein, 5 aa, Staphylococcus aureus
QGSVA

SEQ ID NO: 1562606 - protein, 7 aa, Staphylococcus aureus
QTDGLSS

SEQ ID NO: 1562607 - protein, 13 aa, Staphylococcus aureus
RNVKDKKGTASVI

SEQ ID NO: 1562608 - protein, 9 aa, Staphylococcus aureus
RSLNDDEKA

SEQ ID NO: 1562609 - protein, 11 aa, Staphylococcus aureus
SDATELNTSDQ

SEQ ID NO: 1562610 - protein, 5 aa, Staphylococcus aureus
SDLSN

SEQ ID NO: 1562611 - protein, 12 aa, Staphylococcus aureus
SEPDNQNTKELK

SEQ ID NO: 1562612 - protein, 4 aa, Staphylococcus aureus
SFTK

SEQ ID NO: 1562613 - protein, 7 aa, Staphylococcus aureus
SGKVEGA

SEQ ID NO: 1562614 - protein, 7 aa, Staphylococcus aureus
SNKSKAL

SEQ ID NO: 1562615 - protein, 5 aa, Staphylococcus aureus
SNPKE

SEQ ID NO: 1562616 - protein, 5 aa, Staphylococcus aureus
SSDDN

SEQ ID NO: 1562617 - protein, 8 aa, Staphylococcus aureus
SSENPREI

SEQ ID NO: 1562618 - protein, 6 aa, Staphylococcus aureus
SSGEFK

SEQ ID NO: 1562619 - protein, 32 aa, Staphylococcus aureus
SSHLEQRNRDVNENKAEESKSNQDSKSAYNRD

SEQ ID NO: 1562620 - protein, 4 aa, Staphylococcus aureus
TDEI

SEQ ID NO: 1562621 - protein, 12 aa, Staphylococcus aureus
TDQSSGGSTITQ

SEQ ID NO: 1562622 - protein, 6 aa, Staphylococcus aureus
TKNDYE

SEQ ID NO: 1562623 - protein, 7 aa, Staphylococcus aureus
VKDSPFQ

SEQ ID NO: 1562624 - protein, 5 aa, Staphylococcus aureus
VKNKS

SEQ ID NO: 1562625 - protein, 6 aa, Staphylococcus aureus
YEDYRE

SEQ ID NO: 1562626 - protein, 46 aa, Staphylococcus aureus
YEKELDKSNTVYDQEQERDKYDQFPKRAVESEYNHDERTEEEPSVL

SEQ ID NO: 1562627 - protein, 7 aa, Staphylococcus aureus
YSDETGG

SEQ ID NO: 1562628 - protein, 7 aa, Staphylococcus aureus
YTPIPNE

SEQ ID NO: 1562629 - protein, 6 aa, Staphylococcus aureus
AEERED

SEQ ID NO: 1562630 - protein, 10 aa, Staphylococcus aureus
AGERQGFAGG

SEQ ID NO: 1562631 - protein, 26 aa, Staphylococcus aureus
AHADTTSMNVSNKQSQNVQNHRPYGG

SEQ ID NO: 1562632 - protein, 9 aa, Staphylococcus aureus
AKNKAEELA

SEQ ID NO: 1562633 - protein, 10 aa, Staphylococcus aureus
AKSTKPLKEQ

SEQ ID NO: 1562634 - protein, 7 aa, Staphylococcus aureus
DEKDEAV

SEQ ID NO: 1562635 - protein, 13 aa, Staphylococcus aureus
DLQEANTNQTSIQ

SEQ ID NO: 1562636 - protein, 18 aa, Staphylococcus aureus
DQITNENHANKDKINIKN

SEQ ID NO: 1562637 - protein, 7 aa, Staphylococcus aureus
DYQEIRK

SEQ ID NO: 1562638 - protein, 8 aa, Staphylococcus aureus
EANNNEIA

SEQ ID NO: 1562639 - protein, 7 aa, Staphylococcus aureus
EDLASAN

SEQ ID NO: 1562640 - protein, 9 aa, Staphylococcus aureus
EGPGISLEE

SEQ ID NO: 1562641 - protein, 4 aa, Staphylococcus aureus
ELND

SEQ ID NO: 1562642 - protein, 9 aa, Staphylococcus aureus
EQVGQSQGF

SEQ ID NO: 1562643 - protein, 15 aa, Staphylococcus aureus
FKSSVPKSRIDGKVG

SEQ ID NO: 1562644 - protein, 9 aa, Staphylococcus aureus
GEPESSKAL

SEQ ID NO: 1562645 - protein, 13 aa, Staphylococcus aureus
GLRPFRNKGGHAE

SEQ ID NO: 1562646 - protein, 8 aa, Staphylococcus aureus
GPNMEGKE

SEQ ID NO: 1562647 - protein, 10 aa, Staphylococcus aureus
GPSGAGKSTL

SEQ ID NO: 1562648 - protein, 5 aa, Staphylococcus aureus
GRENE

SEQ ID NO: 1562649 - protein, 4 aa, Staphylococcus aureus
IADK

SEQ ID NO: 1562650 - protein, 21 aa, Staphylococcus aureus
IDLPNETRGQIEPLTNNPGNY

SEQ ID NO: 1562651 - protein, 4 aa, Staphylococcus aureus
IGEN

SEQ ID NO: 1562652 - protein, 8 aa, Staphylococcus aureus
KDKEIEEI

SEQ ID NO: 1562653 - protein, 14 aa, Staphylococcus aureus
KEIEASNATDQDKL

SEQ ID NO: 1562654 - protein, 7 aa, Staphylococcus aureus
KEPDTDT

SEQ ID NO: 1562655 - protein, 6 aa, Staphylococcus aureus
KGHIPG

SEQ ID NO: 1562656 - protein, 7 aa, Staphylococcus aureus
KKKKQTF

SEQ ID NO: 1562657 - protein, 6 aa, Staphylococcus aureus
KLTGET

SEQ ID NO: 1562658 - protein, 15 aa, Staphylococcus aureus
KNKTFTNGKVGKSDN

SEQ ID NO: 1562659 - protein, 7 aa, Staphylococcus aureus
KRLGNGY

SEQ ID NO: 1562660 - protein, 11 aa, Staphylococcus aureus
KSGNASQREEL

SEQ ID NO: 1562661 - protein, 6 aa, Staphylococcus aureus
KTKDGS

SEQ ID NO: 1562662 - protein, 5 aa, Staphylococcus aureus
KYRPQ

SEQ ID NO: 1562663 - protein, 11 aa, Staphylococcus aureus
LGKDYGEVTDE

SEQ ID NO: 1562664 - protein, 16 aa, Staphylococcus aureus
LKKHASDNQQAISSNQ

SEQ ID NO: 1562665 - protein, 12 aa, Staphylococcus aureus
LKQNANKQQVDQ

SEQ ID NO: 1562666 - protein, 10 aa, Staphylococcus aureus
LNEDEANKYE

SEQ ID NO: 1562667 - protein, 5 aa, Staphylococcus aureus
LQTSK

SEQ ID NO: 1562668 - protein, 7 aa, Staphylococcus aureus
LSNTDRE

SEQ ID NO: 1562669 - protein, 4 aa, Staphylococcus aureus
NAQR

SEQ ID NO: 1562670 - protein, 6 aa, Staphylococcus aureus
NDAHTH

SEQ ID NO: 1562671 - protein, 22 aa, Staphylococcus aureus
NDMSQTATTKHGEKDDKNDEAM

SEQ ID NO: 1562672 - protein, 18 aa, Staphylococcus aureus
NEIPKAKIDANKDVDKQV

SEQ ID NO: 1562673 - protein, 8 aa, Staphylococcus aureus
NFGSPKEI

SEQ ID NO: 1562674 - protein, 10 aa, Staphylococcus aureus
NGDKHAGETL

SEQ ID NO: 1562675 - protein, 10 aa, Staphylococcus aureus
NKGQTALSNV

SEQ ID NO: 1562676 - protein, 9 aa, Staphylococcus aureus
NKNNKENKL

SEQ ID NO: 1562677 - protein, 5 aa, Staphylococcus aureus
NNEAI

SEQ ID NO: 1562678 - protein, 8 aa, Staphylococcus aureus
NNNSSKGK

SEQ ID NO: 1562679 - protein, 5 aa, Staphylococcus aureus
NPQTL

SEQ ID NO: 1562680 - protein, 13 aa, Staphylococcus aureus
NQYKDDVYQKNTA

SEQ ID NO: 1562681 - protein, 19 aa, Staphylococcus aureus
NVDNTDSKKSETKPLTTPM

SEQ ID NO: 1562682 - protein, 12 aa, Staphylococcus aureus
PTIGTISTNQRD

SEQ ID NO: 1562683 - protein, 9 aa, Staphylococcus aureus
QEKNQERKQ

SEQ ID NO: 1562684 - protein, 12 aa, Staphylococcus aureus
QLPKTSKDELKQ

SEQ ID NO: 1562685 - protein, 5 aa, Staphylococcus aureus
QLSSK

SEQ ID NO: 1562686 - protein, 14 aa, Staphylococcus aureus
QNKSKKSNKKRSKT

SEQ ID NO: 1562687 - protein, 7 aa, Staphylococcus aureus
RNPIASP

SEQ ID NO: 1562688 - protein, 14 aa, Staphylococcus aureus
RSLEENKIEDNAVH

SEQ ID NO: 1562689 - protein, 6 aa, Staphylococcus aureus
SAAQSG

SEQ ID NO: 1562690 - protein, 6 aa, Staphylococcus aureus
SKKEFD

SEQ ID NO: 1562691 - protein, 8 aa, Staphylococcus aureus
SQQQQIEN

SEQ ID NO: 1562692 - protein, 9 aa, Staphylococcus aureus
SSDKKAPQF

SEQ ID NO: 1562693 - protein, 11 aa, Staphylococcus aureus
SSISDDDSVNL

SEQ ID NO: 1562694 - protein, 8 aa, Staphylococcus aureus
STVGKGTT

SEQ ID NO: 1562695 - protein, 5 aa, Staphylococcus aureus
TDSQV

SEQ ID NO: 1562696 - protein, 7 aa, Staphylococcus aureus
TEPDEIK

SEQ ID NO: 1562697 - protein, 24 aa, Staphylococcus aureus
TKEPLKSKEEKKVYEQAKQSLEKK

SEQ ID NO: 1562698 - protein, 9 aa, Staphylococcus aureus
TLSDLTKQA

SEQ ID NO: 1562699 - protein, 8 aa, Staphylococcus aureus
TTNPKADI

SEQ ID NO: 1562700 - protein, 7 aa, Staphylococcus aureus
TTRTAGF

SEQ ID NO: 1562701 - protein, 10 aa, Staphylococcus aureus
VAKPEVEKIQ

SEQ ID NO: 1562702 - protein, 25 aa, Staphylococcus aureus
VNASIEKRERQESTKVKFRKGGIAI

SEQ ID NO: 1562703 - protein, 5 aa, Staphylococcus aureus
VSPGT

SEQ ID NO: 1562704 - protein, 32 aa, Staphylococcus aureus
ADDEVTKEEEAEAEAQQVATAEQSSKQSNEPY

SEQ ID NO: 1562705 - protein, 7 aa, Staphylococcus aureus
AEDKDTI

SEQ ID NO: 1562706 - protein, 31 aa, Staphylococcus aureus
AGITGNLGGNSSKETNKTHKIGETVKNGDLE

SEQ ID NO: 1562707 - protein, 5 aa, Staphylococcus aureus
AGNPI

SEQ ID NO: 1562708 - protein, 10 aa, Staphylococcus aureus
AGSTLSREAD

SEQ ID NO: 1562709 - protein, 7 aa, Staphylococcus aureus
AKRPDTM

SEQ ID NO: 1562710 - protein, 13 aa, Staphylococcus aureus
ALMGGSDNVATSP

SEQ ID NO: 1562711 - protein, 7 aa, Staphylococcus aureus
ANNAEPV

SEQ ID NO: 1562712 - protein, 9 aa, Staphylococcus aureus
DASDAEKGV

SEQ ID NO: 1562713 - protein, 4 aa, Staphylococcus aureus
DFEF

SEQ ID NO: 1562714 - protein, 14 aa, Staphylococcus aureus
DHEETSSHITDKEA

SEQ ID NO: 1562715 - protein, 8 aa, Staphylococcus aureus
DKEDKKGL

SEQ ID NO: 1562716 - protein, 16 aa, Staphylococcus aureus
DKIEESSGKVSATDTK

SEQ ID NO: 1562717 - protein, 26 aa, Staphylococcus aureus
DKLPEKLKAEYKKKLEDTKKALDEQV

SEQ ID NO: 1562718 - protein, 18 aa, Staphylococcus aureus
DSINRSLSKGQPQEHQFS

SEQ ID NO: 1562719 - protein, 9 aa, Staphylococcus aureus
DSLRTQEKI

SEQ ID NO: 1562720 - protein, 10 aa, Staphylococcus aureus
DTNGDLGQGE

SEQ ID NO: 1562721 - protein, 14 aa, Staphylococcus aureus
EDLQKELGAKYTPT

SEQ ID NO: 1562722 - protein, 4 aa, Staphylococcus aureus
EELE

SEQ ID NO: 1562723 - protein, 8 aa, Staphylococcus aureus
EKVGTTLT

SEQ ID NO: 1562724 - protein, 19 aa, Staphylococcus aureus
EKYELYGKTGTGIVNGKYN

SEQ ID NO: 1562725 - protein, 5 aa, Staphylococcus aureus
EYSNK

SEQ ID NO: 1562726 - protein, 16 aa, Staphylococcus aureus
GEVIGTTKTDENGKYR

SEQ ID NO: 1562727 - protein, 8 aa, Staphylococcus aureus
GFAGGELK

SEQ ID NO: 1562728 - protein, 5 aa, Staphylococcus aureus
GIAER

SEQ ID NO: 1562729 - protein, 9 aa, Staphylococcus aureus
GKSYSPEAF

SEQ ID NO: 1562730 - protein, 6 aa, Staphylococcus aureus
GPVSPR

SEQ ID NO: 1562731 - protein, 4 aa, Staphylococcus aureus
GRIA

SEQ ID NO: 1562732 - protein, 6 aa, Staphylococcus aureus
GVGSHT

SEQ ID NO: 1562733 - protein, 17 aa, Staphylococcus aureus
GVPNHENSHPHQSSNGR

SEQ ID NO: 1562734 - protein, 11 aa, Staphylococcus aureus
KAIPNSDSYIQ

SEQ ID NO: 1562735 - protein, 7 aa, Staphylococcus aureus
KDGEEVN

SEQ ID NO: 1562736 - protein, 8 aa, Staphylococcus aureus
KEHTADNW

SEQ ID NO: 1562737 - protein, 5 aa, Staphylococcus aureus
KEKSQ

SEQ ID NO: 1562738 - protein, 6 aa, Staphylococcus aureus
KGNINK

SEQ ID NO: 1562739 - protein, 7 aa, Staphylococcus aureus
KHASNTI

SEQ ID NO: 1562740 - protein, 6 aa, Staphylococcus aureus
KKAEVE

SEQ ID NO: 1562741 - protein, 7 aa, Staphylococcus aureus
KKDGTQQ

SEQ ID NO: 1562742 - protein, 5 aa, Staphylococcus aureus
KKHSS

SEQ ID NO: 1562743 - protein, 12 aa, Staphylococcus aureus
KLPSDSDVKVKK

SEQ ID NO: 1562744 - protein, 18 aa, Staphylococcus aureus
KNKYGTKQYDKTFKDDAF

SEQ ID NO: 1562745 - protein, 6 aa, Staphylococcus aureus
KPGAQA

SEQ ID NO: 1562746 - protein, 9 aa, Staphylococcus aureus
KPSSEKSSF

SEQ ID NO: 1562747 - protein, 10 aa, Staphylococcus aureus
KQLSQNGGKV

SEQ ID NO: 1562748 - protein, 9 aa, Staphylococcus aureus
KSEPPVEKH

SEQ ID NO: 1562749 - protein, 7 aa, Staphylococcus aureus
KSLKPDA

SEQ ID NO: 1562750 - protein, 8 aa, Staphylococcus aureus
KSNTVGKA

SEQ ID NO: 1562751 - protein, 4 aa, Staphylococcus aureus
KVPN

SEQ ID NO: 1562752 - protein, 8 aa, Staphylococcus aureus
LEKEGDTY

SEQ ID NO: 1562753 - protein, 4 aa, Staphylococcus aureus
LGAT

SEQ ID NO: 1562754 - protein, 26 aa, Staphylococcus aureus
LQKNIEKRHKEEQKRQQEADKARIKS

SEQ ID NO: 1562755 - protein, 5 aa, Staphylococcus aureus
LTDSS

SEQ ID NO: 1562756 - protein, 19 aa, Staphylococcus aureus
LTKSTETKTLNGKTGKPKK

SEQ ID NO: 1562757 - protein, 19 aa, Staphylococcus aureus
MEPDAPVDKSEMKSEDALY

SEQ ID NO: 1562758 - protein, 10 aa, Staphylococcus aureus
MKSTENGDFA

SEQ ID NO: 1562759 - protein, 17 aa, Staphylococcus aureus
NATKSIGRLAGNDESLN

SEQ ID NO: 1562760 - protein, 61 aa, Staphylococcus aureus
NDDEETNHTEAEKSSSNIKDAEKTGVATASTVGVAKNDTENTVADEPSIHEGTEKTEPQHH

SEQ ID NO: 1562761 - protein, 9 aa, Staphylococcus aureus
NGDSSQTRI

SEQ ID NO: 1562762 - protein, 13 aa, Staphylococcus aureus
NHFSKKAKNQLSS

SEQ ID NO: 1562763 - protein, 9 aa, Staphylococcus aureus
NQGLSTEEA

SEQ ID NO: 1562764 - protein, 4 aa, Staphylococcus aureus
NTTI

SEQ ID NO: 1562765 - protein, 7 aa, Staphylococcus aureus
NVETHGI

SEQ ID NO: 1562766 - protein, 16 aa, Staphylococcus aureus
PTVKETPNAKSWAENE

SEQ ID NO: 1562767 - protein, 8 aa, Staphylococcus aureus
QALNGDER

SEQ ID NO: 1562768 - protein, 6 aa, Staphylococcus aureus
QHAQSI

SEQ ID NO: 1562769 - protein, 4 aa, Staphylococcus aureus
QIYN

SEQ ID NO: 1562770 - protein, 7 aa, Staphylococcus aureus
QNELEKY

SEQ ID NO: 1562771 - protein, 10 aa, Staphylococcus aureus
QREMDGPFEK

SEQ ID NO: 1562772 - protein, 9 aa, Staphylococcus aureus
QSGETADSR

SEQ ID NO: 1562773 - protein, 58 aa, Staphylococcus aureus
REPKQDLEAATAQMENTKGKKSSVASKLVSSDKNVNTEENASGNVSETSSSDDDPEAL

SEQ ID NO: 1562774 - protein, 40 aa, Staphylococcus aureus
RKKGKRQQKEQQFTTRQSNQSKFKASDLDKTTDQSTQRMT

SEQ ID NO: 1562775 - protein, 8 aa, Staphylococcus aureus
RNQQGAFQ

SEQ ID NO: 1562776 - protein, 8 aa, Staphylococcus aureus
RPPDKNNR

SEQ ID NO: 1562777 - protein, 15 aa, Staphylococcus aureus
SESFGSKPKDGSARK

SEQ ID NO: 1562778 - protein, 5 aa, Staphylococcus aureus
SETDT

SEQ ID NO: 1562779 - protein, 7 aa, Staphylococcus aureus
SGAGDGF

SEQ ID NO: 1562780 - protein, 7 aa, Staphylococcus aureus
SHPKART

SEQ ID NO: 1562781 - protein, 5 aa, Staphylococcus aureus
SKGNG

SEQ ID NO: 1562782 - protein, 14 aa, Staphylococcus aureus
SMSQHTKSATPKII

SEQ ID NO: 1562783 - protein, 15 aa, Staphylococcus aureus
SNTNAEKVVSEKDGL

SEQ ID NO: 1562784 - protein, 8 aa, Staphylococcus aureus
SSGFPTGT

SEQ ID NO: 1562785 - protein, 7 aa, Staphylococcus aureus
STKAYTA

SEQ ID NO: 1562786 - protein, 11 aa, Staphylococcus aureus
STPQITAETRD

SEQ ID NO: 1562787 - protein, 8 aa, Staphylococcus aureus
TTYKGNEV

SEQ ID NO: 1562788 - protein, 11 aa, Staphylococcus aureus
VADSSDFDGPV

SEQ ID NO: 1562789 - protein, 13 aa, Staphylococcus aureus
VDKPRNLAKSVTV

SEQ ID NO: 1562790 - protein, 12 aa, Staphylococcus aureus
VNDNKKADTRTI

SEQ ID NO: 1562791 - protein, 6 aa, Staphylococcus aureus
VTVPTK

SEQ ID NO: 1562792 - protein, 9 aa, Staphylococcus aureus
YQDAEGNLK

SEQ ID NO: 1562793 - protein, 4 aa, Staphylococcus aureus
YSTG

SEQ ID NO: 1562794 - protein, 7 aa, Staphylococcus aureus
AMRGPLG

SEQ ID NO: 1562795 - protein, 27 aa, Staphylococcus aureus
ANMHSSNHQMNQSNKKVLPAAGESMTS

SEQ ID NO: 1562796 - protein, 6 aa, Staphylococcus aureus
AQTPGM

SEQ ID NO: 1562797 - protein, 14 aa, Staphylococcus aureus
ARTDLTDKEKQEAI

SEQ ID NO: 1562798 - protein, 4 aa, Staphylococcus aureus
DADD

SEQ ID NO: 1562799 - protein, 7 aa, Staphylococcus aureus
DGNVVER

SEQ ID NO: 1562800 - protein, 15 aa, Staphylococcus aureus
DGSTDETARVARSYG

SEQ ID NO: 1562801 - protein, 17 aa, Staphylococcus aureus
DKVQGNAIAKAEAEQLK

SEQ ID NO: 1562802 - protein, 6 aa, Staphylococcus aureus
DRKTQI

SEQ ID NO: 1562803 - protein, 6 aa, Staphylococcus aureus
DSDKDY

SEQ ID NO: 1562804 - protein, 6 aa, Staphylococcus aureus
EAIRAV

SEQ ID NO: 1562805 - protein, 16 aa, Staphylococcus aureus
EDDSYVKTTEVSTRMD

SEQ ID NO: 1562806 - protein, 8 aa, Staphylococcus aureus
EHNKAHVK

SEQ ID NO: 1562807 - protein, 20 aa, Staphylococcus aureus
EKGVDRYEKARAHKQSLERD

SEQ ID NO: 1562808 - protein, 16 aa, Staphylococcus aureus
ELGTDNVESMKGVPED

SEQ ID NO: 1562809 - protein, 10 aa, Staphylococcus aureus
EPQIDDSNDG

SEQ ID NO: 1562810 - protein, 8 aa, Staphylococcus aureus
EQAKNGGA

SEQ ID NO: 1562811 - protein, 4 aa, Staphylococcus aureus
ESNA

SEQ ID NO: 1562812 - protein, 10 aa, Staphylococcus aureus
ESTHENSKHH

SEQ ID NO: 1562813 - protein, 4 aa, Staphylococcus aureus
ETGK

SEQ ID NO: 1562814 - protein, 10 aa, Staphylococcus aureus
ETQGGVGAEN

SEQ ID NO: 1562815 - protein, 4 aa, Staphylococcus aureus
ETTL

SEQ ID NO: 1562816 - protein, 23 aa, Staphylococcus aureus
FKHPGEWKNQDLGTGAGNKSVEV

SEQ ID NO: 1562817 - protein, 4 aa, Staphylococcus aureus
FTNN

SEQ ID NO: 1562818 - protein, 10 aa, Staphylococcus aureus
GASGSGKSTI

SEQ ID NO: 1562819 - protein, 14 aa, Staphylococcus aureus
GHDNPHYENNDQDT

SEQ ID NO: 1562820 - protein, 6 aa, Staphylococcus aureus
GKDAVT

SEQ ID NO: 1562821 - protein, 9 aa, Staphylococcus aureus
GQQVSPNTE

SEQ ID NO: 1562822 - protein, 9 aa, Staphylococcus aureus
GRGISKKDM

SEQ ID NO: 1562823 - protein, 13 aa, Staphylococcus aureus
GSLKARKKTEFSP

SEQ ID NO: 1562824 - protein, 6 aa, Staphylococcus aureus
GTAGVT

SEQ ID NO: 1562825 - protein, 5 aa, Staphylococcus aureus
GVSDA

SEQ ID NO: 1562826 - protein, 15 aa, Staphylococcus aureus
HLDRDKDKRACEPDK

SEQ ID NO: 1562827 - protein, 9 aa, Staphylococcus aureus
HPTGPNTVT

SEQ ID NO: 1562828 - protein, 4 aa, Staphylococcus aureus
HQMM

SEQ ID NO: 1562829 - protein, 11 aa, Staphylococcus aureus
IDDNQLSDADA

SEQ ID NO: 1562830 - protein, 4 aa, Staphylococcus aureus
ISDD

SEQ ID NO: 1562831 - protein, 6 aa, Staphylococcus aureus
KDDYTT

SEQ ID NO: 1562832 - protein, 4 aa, Staphylococcus aureus
KIPL

SEQ ID NO: 1562833 - protein, 6 aa, Staphylococcus aureus
KKGQFA

SEQ ID NO: 1562834 - protein, 20 aa, Staphylococcus aureus
KKTTSKKRTNSRKKKNDNPI

SEQ ID NO: 1562835 - protein, 8 aa, Staphylococcus aureus
KNGKTRID

SEQ ID NO: 1562836 - protein, 8 aa, Staphylococcus aureus
KPDAVDPT

SEQ ID NO: 1562837 - protein, 15 aa, Staphylococcus aureus
KQTSQKEKAQAIAKQ

SEQ ID NO: 1562838 - protein, 8 aa, Staphylococcus aureus
KSGASSAF

SEQ ID NO: 1562839 - protein, 6 aa, Staphylococcus aureus
KSGKSI

SEQ ID NO: 1562840 - protein, 6 aa, Staphylococcus aureus
KSTNIN

SEQ ID NO: 1562841 - protein, 6 aa, Staphylococcus aureus
KVFSSG

SEQ ID NO: 1562842 - protein, 4 aa, Staphylococcus aureus
LEQV

SEQ ID NO: 1562843 - protein, 4 aa, Staphylococcus aureus
LPNT

SEQ ID NO: 1562844 - protein, 5 aa, Staphylococcus aureus
LQQQS

SEQ ID NO: 1562845 - protein, 9 aa, Staphylococcus aureus
LSSGAGSVR

SEQ ID NO: 1562846 - protein, 15 aa, Staphylococcus aureus
LTGTIEESNDSKPID

SEQ ID NO: 1562847 - protein, 7 aa, Staphylococcus aureus
MPQKGTI

SEQ ID NO: 1562848 - protein, 9 aa, Staphylococcus aureus
NAAPTRTEV

SEQ ID NO: 1562849 - protein, 5 aa, Staphylococcus aureus
NDSMD

SEQ ID NO: 1562850 - protein, 56 aa, Staphylococcus aureus
NGPTDVAGANAPGKDDKNSASGSDKGSDGTTTGQSESNSSNKDKVENPQTNAGTPA

SEQ ID NO: 1562851 - protein, 7 aa, Staphylococcus aureus
NGVDEGE

SEQ ID NO: 1562852 - protein, 19 aa, Staphylococcus aureus
NITDSSSGIVNKSEYNSVE

SEQ ID NO: 1562853 - protein, 7 aa, Staphylococcus aureus
NKETKSY

SEQ ID NO: 1562854 - protein, 7 aa, Staphylococcus aureus
NKHKSLE

SEQ ID NO: 1562855 - protein, 12 aa, Staphylococcus aureus
NLAKYDTTEPQR

SEQ ID NO: 1562856 - protein, 25 aa, Staphylococcus aureus
NLDALDSKTNNSSTYISKSNIKNSN

SEQ ID NO: 1562857 - protein, 4 aa, Staphylococcus aureus
NNTI

SEQ ID NO: 1562858 - protein, 9 aa, Staphylococcus aureus
NPGATKEEI

SEQ ID NO: 1562859 - protein, 107 aa, Staphylococcus aureus
NRQSIDTNSHQDHTEDVEKDQSELEHQDTIENTEQQFPPRNAQRRKRRRDLATNHNKQVHNESQTSEDNVQNEAGTIDDRQVESSHSTESQEPSHQDSTPQHEEEYY

SEQ ID NO: 1562860 - protein, 16 aa, Staphylococcus aureus
PKTFDDNNIKHPKDAI

SEQ ID NO: 1562861 - protein, 7 aa, Staphylococcus aureus
PLGDENA

SEQ ID NO: 1562862 - protein, 7 aa, Staphylococcus aureus
PSDKNGT

SEQ ID NO: 1562863 - protein, 5 aa, Staphylococcus aureus
PTPEL

SEQ ID NO: 1562864 - protein, 4 aa, Staphylococcus aureus
PYTR

SEQ ID NO: 1562865 - protein, 10 aa, Staphylococcus aureus
QAKSNAIKSI

SEQ ID NO: 1562866 - protein, 10 aa, Staphylococcus aureus
QGMTQAQYTE

SEQ ID NO: 1562867 - protein, 5 aa, Staphylococcus aureus
QTATE

SEQ ID NO: 1562868 - protein, 9 aa, Staphylococcus aureus
QTNGNQYIE

SEQ ID NO: 1562869 - protein, 5 aa, Staphylococcus aureus
RATNP

SEQ ID NO: 1562870 - protein, 27 aa, Staphylococcus aureus
RRKEDEEEELEIRDNNKDSIKETLDDT

SEQ ID NO: 1562871 - protein, 8 aa, Staphylococcus aureus
SAEDTNEK

SEQ ID NO: 1562872 - protein, 6 aa, Staphylococcus aureus
SEVSNV

SEQ ID NO: 1562873 - protein, 5 aa, Staphylococcus aureus
SHELR

SEQ ID NO: 1562874 - protein, 4 aa, Staphylococcus aureus
SIST

SEQ ID NO: 1562875 - protein, 9 aa, Staphylococcus aureus
SKKANPDIE

SEQ ID NO: 1562876 - protein, 6 aa, Staphylococcus aureus
SKNGTR

SEQ ID NO: 1562877 - protein, 7 aa, Staphylococcus aureus
SKPEIEL

SEQ ID NO: 1562878 - protein, 14 aa, Staphylococcus aureus
SKSNTDQTLTSMAP

SEQ ID NO: 1562879 - protein, 13 aa, Staphylococcus aureus
SNSANAADSGTLN

SEQ ID NO: 1562880 - protein, 4 aa, Staphylococcus aureus
SSNA

SEQ ID NO: 1562881 - protein, 9 aa, Staphylococcus aureus
THATTPPTV

SEQ ID NO: 1562882 - protein, 16 aa, Staphylococcus aureus
THSHSHNHHAHHHAHV

SEQ ID NO: 1562883 - protein, 15 aa, Staphylococcus aureus
TSYVTTDNAKVNGDQ

SEQ ID NO: 1562884 - protein, 13 aa, Staphylococcus aureus
TYGSSRSEPLITG

SEQ ID NO: 1562885 - protein, 8 aa, Staphylococcus aureus
VERQTLST

SEQ ID NO: 1562886 - protein, 4 aa, Staphylococcus aureus
VPTE

SEQ ID NO: 1562887 - protein, 4 aa, Staphylococcus aureus
YDDS

SEQ ID NO: 1562888 - protein, 8 aa, Staphylococcus aureus
YTDGQEKF

SEQ ID NO: 1562889 - protein, 15 aa, Staphylococcus aureus
YYKKQDSDKLSKAAI

SEQ ID NO: 1562890 - protein, 8 aa, Staphylococcus aureus
AAEQHTPM

SEQ ID NO: 1562891 - protein, 169 aa, Staphylococcus aureus
AFTKANTDKSNKKEQQDNSAKKEATPATPSKPTPSPVEKESQKQDSQKDDNKQLPSVEKENDASSESGKDKTPATKPTKGEVESSSTTPTKVVSTTQNVAKPTTASSKTTKDVVQTSAGSSEAKDSAPLQKANIKNTNDGHTQSQNNKNTQENKAKSLPQTGEESNKDM

SEQ ID NO: 1562892 - protein, 12 aa, Staphylococcus aureus
ARTDDKKYATQS

SEQ ID NO: 1562893 - protein, 8 aa, Staphylococcus aureus
ASVGTANM

SEQ ID NO: 1562894 - protein, 7 aa, Staphylococcus aureus
ATQLNQS

SEQ ID NO: 1562895 - protein, 9 aa, Staphylococcus aureus
CKKNKHEDL

SEQ ID NO: 1562896 - protein, 4 aa, Staphylococcus aureus
DEPY

SEQ ID NO: 1562897 - protein, 20 aa, Staphylococcus aureus
DERAEIATSNQDQETNSSKR

SEQ ID NO: 1562898 - protein, 8 aa, Staphylococcus aureus
DQLSPEIS

SEQ ID NO: 1562899 - protein, 5 aa, Staphylococcus aureus
DYNRY

SEQ ID NO: 1562900 - protein, 4 aa, Staphylococcus aureus
EHGE

SEQ ID NO: 1562901 - protein, 5 aa, Staphylococcus aureus
EIKQQ

SEQ ID NO: 1562902 - protein, 8 aa, Staphylococcus aureus
ENIDNVEK

SEQ ID NO: 1562903 - protein, 7 aa, Staphylococcus aureus
ESEAGTS

SEQ ID NO: 1562904 - protein, 10 aa, Staphylococcus aureus
ETIPGEGFSG

SEQ ID NO: 1562905 - protein, 12 aa, Staphylococcus aureus
ETLRDNKEIEDL

SEQ ID NO: 1562906 - protein, 9 aa, Staphylococcus aureus
EYTNAGPKV

SEQ ID NO: 1562907 - protein, 4 aa, Staphylococcus aureus
GEIP

SEQ ID NO: 1562908 - protein, 10 aa, Staphylococcus aureus
GEYQSEDNNV

SEQ ID NO: 1562909 - protein, 5 aa, Staphylococcus aureus
GGRGG

SEQ ID NO: 1562910 - protein, 6 aa, Staphylococcus aureus
GHGTEL

SEQ ID NO: 1562911 - protein, 6 aa, Staphylococcus aureus
GISESG

SEQ ID NO: 1562912 - protein, 12 aa, Staphylococcus aureus
GKLSNDNPNVKQ

SEQ ID NO: 1562913 - protein, 5 aa, Staphylococcus aureus
GNAVQ

SEQ ID NO: 1562914 - protein, 4 aa, Staphylococcus aureus
GNEA

SEQ ID NO: 1562915 - protein, 65 aa, Staphylococcus aureus
GQKITKDKVKTADKNKKVVTEPKNTKVENDKVTTSVETKTEKAQDSLNDNTTKTMTSDKPEDNQP

SEQ ID NO: 1562916 - protein, 4 aa, Staphylococcus aureus
GQSS

SEQ ID NO: 1562917 - protein, 4 aa, Staphylococcus aureus
GRMK

SEQ ID NO: 1562918 - protein, 7 aa, Staphylococcus aureus
GSNTRTF

SEQ ID NO: 1562919 - protein, 9 aa, Staphylococcus aureus
HKKHGKAII

SEQ ID NO: 1562920 - protein, 54 aa, Staphylococcus aureus
HSTSTSRLSSEATTSTSESQSTLSATSEVTKHNGTPAQSEKRLPDTGDSIKQNG

SEQ ID NO: 1562921 - protein, 13 aa, Staphylococcus aureus
IDEKDIKDVEVGK

SEQ ID NO: 1562922 - protein, 61 aa, Staphylococcus aureus
IGNQTESNHDEDHDITSESVESAESVKQAPQSDDLTNDSNEDEIEQSLKEPATYKEDRRSS

SEQ ID NO: 1562923 - protein, 8 aa, Staphylococcus aureus
IKESNKGF

SEQ ID NO: 1562924 - protein, 20 aa, Staphylococcus aureus
ITDKENNKTKIKGTNTLEDD

SEQ ID NO: 1562925 - protein, 17 aa, Staphylococcus aureus
ITKSKQLTKESYANRPL

SEQ ID NO: 1562926 - protein, 19 aa, Staphylococcus aureus
KAANPTAKELAKRKQEAIS

SEQ ID NO: 1562927 - protein, 7 aa, Staphylococcus aureus
KDEADKI

SEQ ID NO: 1562928 - protein, 39 aa, Staphylococcus aureus
KGKTPEEAALEHDDNNKNHYNENTRYEYDEDSNATHQRT

SEQ ID NO: 1562929 - protein, 6 aa, Staphylococcus aureus
KKINGT

SEQ ID NO: 1562930 - protein, 38 aa, Staphylococcus aureus
KKSQKYEEKAGLTPNKLDEKTEKKGDKLAEKNRKEIAK

SEQ ID NO: 1562931 - protein, 4 aa, Staphylococcus aureus
KRDT

SEQ ID NO: 1562932 - protein, 25 aa, Staphylococcus aureus
KTSKVTQTDNQQDVSNDSTDEADTS

SEQ ID NO: 1562933 - protein, 46 aa, Staphylococcus aureus
KVQHDDAKEVPSKHQNQENNQDQLKKDIDDKKDSQKSDTKERRTSL

SEQ ID NO: 1562934 - protein, 4 aa, Staphylococcus aureus
LATS

SEQ ID NO: 1562935 - protein, 10 aa, Staphylococcus aureus
LDDGRTNQHA

SEQ ID NO: 1562936 - protein, 5 aa, Staphylococcus aureus
LGDPI

SEQ ID NO: 1562937 - protein, 4 aa, Staphylococcus aureus
LQNS

SEQ ID NO: 1562938 - protein, 5 aa, Staphylococcus aureus
LQNSF

SEQ ID NO: 1562939 - protein, 5 aa, Staphylococcus aureus
MSRNE

SEQ ID NO: 1562940 - protein, 9 aa, Staphylococcus aureus
NESDNIKKQ

SEQ ID NO: 1562941 - protein, 20 aa, Staphylococcus aureus
NEVSSNVDRGQQSGEDDLNA

SEQ ID NO: 1562942 - protein, 11 aa, Staphylococcus aureus
NFPADAETVGG

SEQ ID NO: 1562943 - protein, 103 aa, Staphylococcus aureus
NHNNGTKENKIANTNKNNADESKDKDTSKDASKDKSKSTDSDKSKEDQDKATKDESDNDQNNANQANNQAQNNQNQQQANQNQQQQQQRQGGGQRHTVNGQEN

SEQ ID NO: 1562944 - protein, 19 aa, Staphylococcus aureus
NNAQQDGFKGRIDQSNDLN

SEQ ID NO: 1562945 - protein, 6 aa, Staphylococcus aureus
NNPDGQ

SEQ ID NO: 1562946 - protein, 18 aa, Staphylococcus aureus
NSEEDESYKDHNKEKQQL

SEQ ID NO: 1562947 - protein, 9 aa, Staphylococcus aureus
NSEKTSIEE

SEQ ID NO: 1562948 - protein, 9 aa, Staphylococcus aureus
PDKEEKLAK

SEQ ID NO: 1562949 - protein, 4 aa, Staphylococcus aureus
PHNQ

SEQ ID NO: 1562950 - protein, 7 aa, Staphylococcus aureus
QDNSDHN

SEQ ID NO: 1562951 - protein, 10 aa, Staphylococcus aureus
QLIQPRTPQG

SEQ ID NO: 1562952 - protein, 22 aa, Staphylococcus aureus
QLNSNSTSEEHNKRPVEQNPNQ

SEQ ID NO: 1562953 - protein, 19 aa, Staphylococcus aureus
QNQQNQQNQQYGQKKSKKG

SEQ ID NO: 1562954 - protein, 8 aa, Staphylococcus aureus
RLAEEKGR

SEQ ID NO: 1562955 - protein, 19 aa, Staphylococcus aureus
RRDKEEDEKNKEKNAKNIR

SEQ ID NO: 1562956 - protein, 22 aa, Staphylococcus aureus
RRKDKEEDVETTTSIESKDEDV

SEQ ID NO: 1562957 - protein, 17 aa, Staphylococcus aureus
SAAANNGSGFEGLKDDT

SEQ ID NO: 1562958 - protein, 9 aa, Staphylococcus aureus
SDMSDNNHF

SEQ ID NO: 1562959 - protein, 11 aa, Staphylococcus aureus
SFNPKSSEYNA

SEQ ID NO: 1562960 - protein, 5 aa, Staphylococcus aureus
SGSGS

SEQ ID NO: 1562961 - protein, 12 aa, Staphylococcus aureus
SQYKDYAKKGQK

SEQ ID NO: 1562962 - protein, 14 aa, Staphylococcus aureus
SSPYTSLENEGQSI

SEQ ID NO: 1562963 - protein, 7 aa, Staphylococcus aureus
TFSTGGQ

SEQ ID NO: 1562964 - protein, 7 aa, Staphylococcus aureus
TGSDGVQ

SEQ ID NO: 1562965 - protein, 4 aa, Staphylococcus aureus
TISE

SEQ ID NO: 1562966 - protein, 5 aa, Staphylococcus aureus
TNQSS

SEQ ID NO: 1562967 - protein, 6 aa, Staphylococcus aureus
TTGSVN

SEQ ID NO: 1562968 - protein, 12 aa, Staphylococcus aureus
VDNQDDHSQVSL

SEQ ID NO: 1562969 - protein, 11 aa, Staphylococcus aureus
VKDPALKQKIE

SEQ ID NO: 1562970 - protein, 10 aa, Staphylococcus aureus
VTHDPTTDYY

SEQ ID NO: 1562971 - protein, 7 aa, Staphylococcus aureus
YDDSTQF

SEQ ID NO: 1562972 - protein, 5 aa, Staphylococcus aureus
YDPNT

SEQ ID NO: 1562973 - protein, 8 aa, Staphylococcus aureus
YSDKHNKK

SEQ ID NO: 1562974 - protein, 23 aa, Staphylococcus aureus
AKKLNESQAPKADNKFNKEQQNA

SEQ ID NO: 1562975 - protein, 5 aa, Staphylococcus aureus
AKKSI

SEQ ID NO: 1562976 - protein, 13 aa, Staphylococcus aureus
ASLSSEIKYTAPH

SEQ ID NO: 1562977 - protein, 9 aa, Staphylococcus aureus
DDTDGKWYG

SEQ ID NO: 1562978 - protein, 8 aa, Staphylococcus aureus
DKERRQAV

SEQ ID NO: 1562979 - protein, 9 aa, Staphylococcus aureus
DLKGSSVGY

SEQ ID NO: 1562980 - protein, 17 aa, Staphylococcus aureus
DRYSKDTINGKSNKSRN

SEQ ID NO: 1562981 - protein, 10 aa, Staphylococcus aureus
DTANAVATAV

SEQ ID NO: 1562982 - protein, 11 aa, Staphylococcus aureus
DYAEQNVEHRN

SEQ ID NO: 1562983 - protein, 10 aa, Staphylococcus aureus
EKKYYDEQKE

SEQ ID NO: 1562984 - protein, 10 aa, Staphylococcus aureus
EKNNEDTSSI

SEQ ID NO: 1562985 - protein, 10 aa, Staphylococcus aureus
EQDGQKQTTL

SEQ ID NO: 1562986 - protein, 9 aa, Staphylococcus aureus
ERQKGESKW

SEQ ID NO: 1562987 - protein, 144 aa, Staphylococcus aureus
FAASDAPLTSELNTQSETVGNQNSTTIEASTSTADSTSVTKNSSSVQTSNSDTVSSEKSEKVTSTTNSTSNQQEKLTSTSESTSSKNTTSSSDTKSVASTSSTEQPINTSTNQSTASNNTSQSTTPSSVNLNKTSTTSTSTAPV

SEQ ID NO: 1562988 - protein, 12 aa, Staphylococcus aureus
FKVGDDDKNIKT

SEQ ID NO: 1562989 - protein, 6 aa, Staphylococcus aureus
HETKQS

SEQ ID NO: 1562990 - protein, 6 aa, Staphylococcus aureus
HKEKVV

SEQ ID NO: 1562991 - protein, 24 aa, Staphylococcus aureus
IDKQSSENSALQSEIKKNSSYERI

SEQ ID NO: 1562992 - protein, 4 aa, Staphylococcus aureus
IEGL

SEQ ID NO: 1562993 - protein, 21 aa, Staphylococcus aureus
IKYPSAKFNQPEAKDKTELTT

SEQ ID NO: 1562994 - protein, 19 aa, Staphylococcus aureus
KATNKNKEIETVDNTNITE

SEQ ID NO: 1562995 - protein, 9 aa, Staphylococcus aureus
KENKNGAPV

SEQ ID NO: 1562996 - protein, 8 aa, Staphylococcus aureus
KISKDTRF

SEQ ID NO: 1562997 - protein, 8 aa, Staphylococcus aureus
KLQQQGKK

SEQ ID NO: 1562998 - protein, 18 aa, Staphylococcus aureus
KNDPKASYSYEDKDAFEQ

SEQ ID NO: 1562999 - protein, 5 aa, Staphylococcus aureus
KPAKK

SEQ ID NO: 1563000 - protein, 4 aa, Staphylococcus aureus
KQQA

SEQ ID NO: 1563001 - protein, 8 aa, Staphylococcus aureus
KTSLKSTA

SEQ ID NO: 1563002 - protein, 8 aa, Staphylococcus aureus
KVNYSPKD

SEQ ID NO: 1563003 - protein, 8 aa, Staphylococcus aureus
LNEAQRNG

SEQ ID NO: 1563004 - protein, 10 aa, Staphylococcus aureus
LTQQQRDELN

SEQ ID NO: 1563005 - protein, 19 aa, Staphylococcus aureus
NALNGDQNLANAKDKANAF

SEQ ID NO: 1563006 - protein, 15 aa, Staphylococcus aureus
NAQQPERGKIYDRNG

SEQ ID NO: 1563007 - protein, 15 aa, Staphylococcus aureus
NELGQNLQLKPENAY

SEQ ID NO: 1563008 - protein, 8 aa, Staphylococcus aureus
NENEKNKI

SEQ ID NO: 1563009 - protein, 12 aa, Staphylococcus aureus
NLEGTSGRGPIY

SEQ ID NO: 1563010 - protein, 12 aa, Staphylococcus aureus
NQAVNESKRINT

SEQ ID NO: 1563011 - protein, 7 aa, Staphylococcus aureus
NTRLSNK

SEQ ID NO: 1563012 - protein, 9 aa, Staphylococcus aureus
QFESTSSGT

SEQ ID NO: 1563013 - protein, 4 aa, Staphylococcus aureus
QNDK

SEQ ID NO: 1563014 - protein, 11 aa, Staphylococcus aureus
QQFKDQPENEI

SEQ ID NO: 1563015 - protein, 4 aa, Staphylococcus aureus
QQQI

SEQ ID NO: 1563016 - protein, 28 aa, Staphylococcus aureus
RRRKEDEEDVEVTNENTDEKVLKDNEHS

SEQ ID NO: 1563017 - protein, 4 aa, Staphylococcus aureus
SAES

SEQ ID NO: 1563018 - protein, 9 aa, Staphylococcus aureus
SGKKEDDIR

SEQ ID NO: 1563019 - protein, 12 aa, Staphylococcus aureus
SGNSAGKGNEAL

SEQ ID NO: 1563020 - protein, 9 aa, Staphylococcus aureus
SKEVDYSEA

SEQ ID NO: 1563021 - protein, 10 aa, Staphylococcus aureus
SKKKKPFSAG

SEQ ID NO: 1563022 - protein, 10 aa, Staphylococcus aureus
SRKNPDLHKN

SEQ ID NO: 1563023 - protein, 9 aa, Staphylococcus aureus
SSGDINPKS

SEQ ID NO: 1563024 - protein, 7 aa, Staphylococcus aureus
SSGRFSR

SEQ ID NO: 1563025 - protein, 13 aa, Staphylococcus aureus
STQIDDGEETNYD

SEQ ID NO: 1563026 - protein, 5 aa, Staphylococcus aureus
STSSY

SEQ ID NO: 1563027 - protein, 9 aa, Staphylococcus aureus
STTDDTELV

SEQ ID NO: 1563028 - protein, 7 aa, Staphylococcus aureus
TDGLDGL

SEQ ID NO: 1563029 - protein, 13 aa, Staphylococcus aureus
TIDQIDKTNNTYR

SEQ ID NO: 1563030 - protein, 6 aa, Staphylococcus aureus
TKGPEL

SEQ ID NO: 1563031 - protein, 12 aa, Staphylococcus aureus
VAQKNEEKTLAQ

SEQ ID NO: 1563032 - protein, 12 aa, Staphylococcus aureus
VDESQSSLHHTE

SEQ ID NO: 1563033 - protein, 8 aa, Staphylococcus aureus
VNGKHSTQ

SEQ ID NO: 1563034 - protein, 7 aa, Staphylococcus aureus
VSKGQYA

SEQ ID NO: 1563035 - protein, 7 aa, Staphylococcus aureus
YHGDNQT

SEQ ID NO: 1563036 - protein, 25 aa, Staphylococcus aureus
YHNTSKPNSAAKANADPSNVAGGGA

SEQ ID NO: 1563037 - protein, 8 aa, Staphylococcus aureus
YNIPTDKA

SEQ ID NO: 1563038 - protein, 9 aa, Staphylococcus aureus
YQPDPNKLP

SEQ ID NO: 1563039 - protein, 8 aa, Staphylococcus aureus
ADDQEDVA

SEQ ID NO: 1563040 - protein, 47 aa, Staphylococcus aureus
AGGQGQSQSQSDNKQNSAMSDVNQASPQQNSKASAPNNISGMPTAKL

SEQ ID NO: 1563041 - protein, 11 aa, Staphylococcus aureus
APAKELGPVEE

SEQ ID NO: 1563042 - protein, 9 aa, Staphylococcus aureus
ATSTTNNKE

SEQ ID NO: 1563043 - protein, 11 aa, Staphylococcus aureus
DDKKVPTGNEY

SEQ ID NO: 1563044 - protein, 10 aa, Staphylococcus aureus
DEVGQPELRR

SEQ ID NO: 1563045 - protein, 6 aa, Staphylococcus aureus
DEVHPE

SEQ ID NO: 1563046 - protein, 6 aa, Staphylococcus aureus
DKNGWS

SEQ ID NO: 1563047 - protein, 5 aa, Staphylococcus aureus
EGIKA

SEQ ID NO: 1563048 - protein, 5 aa, Staphylococcus aureus
EQPAV

SEQ ID NO: 1563049 - protein, 9 aa, Staphylococcus aureus
EVSEQDLPN

SEQ ID NO: 1563050 - protein, 5 aa, Staphylococcus aureus
FYPNG

SEQ ID NO: 1563051 - protein, 25 aa, Staphylococcus aureus
GDTVGKPSNNPLMPPVDTGESIGLG

SEQ ID NO: 1563052 - protein, 28 aa, Staphylococcus aureus
GEAQKLNDSQAPKADAQQNNFNKDQQSA

SEQ ID NO: 1563053 - protein, 14 aa, Staphylococcus aureus
GEKLGNPKSGSAIL

SEQ ID NO: 1563054 - protein, 4 aa, Staphylococcus aureus
GEMP

SEQ ID NO: 1563055 - protein, 11 aa, Staphylococcus aureus
GGVGDRVAHGG

SEQ ID NO: 1563056 - protein, 4 aa, Staphylococcus aureus
GHKE

SEQ ID NO: 1563057 - protein, 17 aa, Staphylococcus aureus
GKDPSEVQTTKARNTMT

SEQ ID NO: 1563058 - protein, 7 aa, Staphylococcus aureus
GKIARDT

SEQ ID NO: 1563059 - protein, 8 aa, Staphylococcus aureus
HSKEDFSE

SEQ ID NO: 1563060 - protein, 13 aa, Staphylococcus aureus
IDAATSSGSGLDP

SEQ ID NO: 1563061 - protein, 14 aa, Staphylococcus aureus
IDTPSTATISDSLT

SEQ ID NO: 1563062 - protein, 16 aa, Staphylococcus aureus
IPEEEREQLHTDREDG

SEQ ID NO: 1563063 - protein, 5 aa, Staphylococcus aureus
ISRAS

SEQ ID NO: 1563064 - protein, 8 aa, Staphylococcus aureus
KDKEINNT

SEQ ID NO: 1563065 - protein, 10 aa, Staphylococcus aureus
KEQDLNTAMQ

SEQ ID NO: 1563066 - protein, 6 aa, Staphylococcus aureus
KLGHKS

SEQ ID NO: 1563067 - protein, 5 aa, Staphylococcus aureus
KLPQF

SEQ ID NO: 1563068 - protein, 10 aa, Staphylococcus aureus
LSDTVPGQTV

SEQ ID NO: 1563069 - protein, 8 aa, Staphylococcus aureus
MPKPNRNK

SEQ ID NO: 1563070 - protein, 9 aa, Staphylococcus aureus
NVSDTTSSV

SEQ ID NO: 1563071 - protein, 11 aa, Staphylococcus aureus
PYKSDDTDVEI

SEQ ID NO: 1563072 - protein, 9 aa, Staphylococcus aureus
QHYNGESDV

SEQ ID NO: 1563073 - protein, 8 aa, Staphylococcus aureus
QQKYPNPF

SEQ ID NO: 1563074 - protein, 35 aa, Staphylococcus aureus
QYDNQNQNHRRQSEDASYRQQYAKGDPEEHPERYY

SEQ ID NO: 1563075 - protein, 36 aa, Staphylococcus aureus
RKFNPDLAPGTEKVTREGQKGEKTITTPTLKNPLTG

SEQ ID NO: 1563076 - protein, 10 aa, Staphylococcus aureus
SDAPISKQYQ

SEQ ID NO: 1563077 - protein, 11 aa, Staphylococcus aureus
SGGQGPDEPIS

SEQ ID NO: 1563078 - protein, 10 aa, Staphylococcus aureus
SNEQNSTEAL

SEQ ID NO: 1563079 - protein, 4 aa, Staphylococcus aureus
SNID

SEQ ID NO: 1563080 - protein, 7 aa, Staphylococcus aureus
SQYRRKR

SEQ ID NO: 1563081 - protein, 8 aa, Staphylococcus aureus
SSFQPENN

SEQ ID NO: 1563082 - protein, 9 aa, Staphylococcus aureus
SSKVQTGDS

SEQ ID NO: 1563083 - protein, 12 aa, Staphylococcus aureus
VSSLKSSRKDME

SEQ ID NO: 1563084 - protein, 4 aa, Staphylococcus aureus
YAEH

SEQ ID NO: 1563085 - protein, 7 aa, Staphylococcus aureus
AAEKRSN

SEQ ID NO: 1563086 - protein, 7 aa, Staphylococcus aureus
AEELRKT

SEQ ID NO: 1563087 - protein, 9 aa, Staphylococcus aureus
AEKKNLDNK

SEQ ID NO: 1563088 - protein, 6 aa, Staphylococcus aureus
AIANQG

SEQ ID NO: 1563089 - protein, 16 aa, Staphylococcus aureus
APTKYKDQERTVTTAR

SEQ ID NO: 1563090 - protein, 6 aa, Staphylococcus aureus
ARGSRE

SEQ ID NO: 1563091 - protein, 8 aa, Staphylococcus aureus
AVDSFKAS

SEQ ID NO: 1563092 - protein, 9 aa, Staphylococcus aureus
DAGIEADEY

SEQ ID NO: 1563093 - protein, 9 aa, Staphylococcus aureus
DEKEKQKAI

SEQ ID NO: 1563094 - protein, 6 aa, Staphylococcus aureus
DNSNTI

SEQ ID NO: 1563095 - protein, 5 aa, Staphylococcus aureus
DPTFS

SEQ ID NO: 1563096 - protein, 20 aa, Staphylococcus aureus
EDAMASVPNKIREGAYGLGA

SEQ ID NO: 1563097 - protein, 8 aa, Staphylococcus aureus
ENNGNINA

SEQ ID NO: 1563098 - protein, 5 aa, Staphylococcus aureus
ENPSE

SEQ ID NO: 1563099 - protein, 14 aa, Staphylococcus aureus
ESTGAKGVIQQGTG

SEQ ID NO: 1563100 - protein, 4 aa, Staphylococcus aureus
FGKE

SEQ ID NO: 1563101 - protein, 4 aa, Staphylococcus aureus
FKRT

SEQ ID NO: 1563102 - protein, 5 aa, Staphylococcus aureus
GAYKY

SEQ ID NO: 1563103 - protein, 5 aa, Staphylococcus aureus
GEQRT

SEQ ID NO: 1563104 - protein, 8 aa, Staphylococcus aureus
GGDYAGKM

SEQ ID NO: 1563105 - protein, 17 aa, Staphylococcus aureus
GLDTVTQATGATGGELK

SEQ ID NO: 1563106 - protein, 5 aa, Staphylococcus aureus
GLMND

SEQ ID NO: 1563107 - protein, 8 aa, Staphylococcus aureus
GMGSSAMG

SEQ ID NO: 1563108 - protein, 7 aa, Staphylococcus aureus
GPSRSKL

SEQ ID NO: 1563109 - protein, 5 aa, Staphylococcus aureus
GQTWT

SEQ ID NO: 1563110 - protein, 4 aa, Staphylococcus aureus
GTAD

SEQ ID NO: 1563111 - protein, 8 aa, Staphylococcus aureus
GTKAITQK

SEQ ID NO: 1563112 - protein, 6 aa, Staphylococcus aureus
IESKQL

SEQ ID NO: 1563113 - protein, 14 aa, Staphylococcus aureus
IKTDATTAKVTTAE

SEQ ID NO: 1563114 - protein, 14 aa, Staphylococcus aureus
INGMPRAKYKSYKD

SEQ ID NO: 1563115 - protein, 17 aa, Staphylococcus aureus
INQTGNPTLDKSQVEQL

SEQ ID NO: 1563116 - protein, 5 aa, Staphylococcus aureus
IRPGE

SEQ ID NO: 1563117 - protein, 6 aa, Staphylococcus aureus
ISASTG

SEQ ID NO: 1563118 - protein, 5 aa, Staphylococcus aureus
ISVDN

SEQ ID NO: 1563119 - protein, 8 aa, Staphylococcus aureus
KEHGREAD

SEQ ID NO: 1563120 - protein, 8 aa, Staphylococcus aureus
KGETPNDI

SEQ ID NO: 1563121 - protein, 6 aa, Staphylococcus aureus
KGLEKA

SEQ ID NO: 1563122 - protein, 7 aa, Staphylococcus aureus
KGLGNSA

SEQ ID NO: 1563123 - protein, 7 aa, Staphylococcus aureus
KGRARTK

SEQ ID NO: 1563124 - protein, 7 aa, Staphylococcus aureus
KKAKAMM

SEQ ID NO: 1563125 - protein, 7 aa, Staphylococcus aureus
KKFEKGM

SEQ ID NO: 1563126 - protein, 10 aa, Staphylococcus aureus
KKKKDGKDIQ

SEQ ID NO: 1563127 - protein, 7 aa, Staphylococcus aureus
KLDELGD

SEQ ID NO: 1563128 - protein, 7 aa, Staphylococcus aureus
KLTTSQI

SEQ ID NO: 1563129 - protein, 15 aa, Staphylococcus aureus
KNDYGSGTAIHPQTG

SEQ ID NO: 1563130 - protein, 11 aa, Staphylococcus aureus
KNVSKKDYKAI

SEQ ID NO: 1563131 - protein, 8 aa, Staphylococcus aureus
KRKRHEQS

SEQ ID NO: 1563132 - protein, 7 aa, Staphylococcus aureus
KSERGKI

SEQ ID NO: 1563133 - protein, 20 aa, Staphylococcus aureus
KSNYEKYSQVRSTSGKTGRE

SEQ ID NO: 1563134 - protein, 8 aa, Staphylococcus aureus
KTHKEDIY

SEQ ID NO: 1563135 - protein, 12 aa, Staphylococcus aureus
KTTFDPNQSGNT

SEQ ID NO: 1563136 - protein, 15 aa, Staphylococcus aureus
LFETSNDNTVRVEPG

SEQ ID NO: 1563137 - protein, 15 aa, Staphylococcus aureus
LGNKYEGHGNGGDGI

SEQ ID NO: 1563138 - protein, 7 aa, Staphylococcus aureus
LKESGPV

SEQ ID NO: 1563139 - protein, 10 aa, Staphylococcus aureus
LNVQPTNNTF

SEQ ID NO: 1563140 - protein, 6 aa, Staphylococcus aureus
LQHEDG

SEQ ID NO: 1563141 - protein, 6 aa, Staphylococcus aureus
MIKPGQ

SEQ ID NO: 1563142 - protein, 21 aa, Staphylococcus aureus
NAETLNKASRAINRATKLDNA

SEQ ID NO: 1563143 - protein, 15 aa, Staphylococcus aureus
NEEYNKLTEDKKEPL

SEQ ID NO: 1563144 - protein, 20 aa, Staphylococcus aureus
NKAKALPETGSENNGSNNAT

SEQ ID NO: 1563145 - protein, 26 aa, Staphylococcus aureus
NKTLDDKTSYKIDGKGWQKDKSWGGY

SEQ ID NO: 1563146 - protein, 15 aa, Staphylococcus aureus
NNQAPTVESKSHDLN

SEQ ID NO: 1563147 - protein, 8 aa, Staphylococcus aureus
NSSGGSVF

SEQ ID NO: 1563148 - protein, 7 aa, Staphylococcus aureus
NTRTAKG

SEQ ID NO: 1563149 - protein, 17 aa, Staphylococcus aureus
NYINADDNLKANYDNAI

SEQ ID NO: 1563150 - protein, 6 aa, Staphylococcus aureus
PAFTEA

SEQ ID NO: 1563151 - protein, 9 aa, Staphylococcus aureus
PGDKVEYKN

SEQ ID NO: 1563152 - protein, 4 aa, Staphylococcus aureus
PNYN

SEQ ID NO: 1563153 - protein, 7 aa, Staphylococcus aureus
QAIESSD

SEQ ID NO: 1563154 - protein, 6 aa, Staphylococcus aureus
QEGRLN

SEQ ID NO: 1563155 - protein, 8 aa, Staphylococcus aureus
QGAERQRA

SEQ ID NO: 1563156 - protein, 5 aa, Staphylococcus aureus
QVINP

SEQ ID NO: 1563157 - protein, 12 aa, Staphylococcus aureus
RAGDYAYATGGK

SEQ ID NO: 1563158 - protein, 8 aa, Staphylococcus aureus
RKSKSKGE

SEQ ID NO: 1563159 - protein, 8 aa, Staphylococcus aureus
RNGNAESI

SEQ ID NO: 1563160 - protein, 4 aa, Staphylococcus aureus
RSGA

SEQ ID NO: 1563161 - protein, 7 aa, Staphylococcus aureus
SAGASDM

SEQ ID NO: 1563162 - protein, 5 aa, Staphylococcus aureus
SDNTP

SEQ ID NO: 1563163 - protein, 8 aa, Staphylococcus aureus
SGAKKNNV

SEQ ID NO: 1563164 - protein, 6 aa, Staphylococcus aureus
SNKNLD

SEQ ID NO: 1563165 - protein, 10 aa, Staphylococcus aureus
TDKQWEDAKK

SEQ ID NO: 1563166 - protein, 6 aa, Staphylococcus aureus
TKRTAN

SEQ ID NO: 1563167 - protein, 9 aa, Staphylococcus aureus
TKVGKTGWY

SEQ ID NO: 1563168 - protein, 5 aa, Staphylococcus aureus
TPIGG

SEQ ID NO: 1563169 - protein, 4 aa, Staphylococcus aureus
TSSH

SEQ ID NO: 1563170 - protein, 4 aa, Staphylococcus aureus
TSYH

SEQ ID NO: 1563171 - protein, 9 aa, Staphylococcus aureus
TTSPGSTQK

SEQ ID NO: 1563172 - protein, 4 aa, Staphylococcus aureus
VEKY

SEQ ID NO: 1563173 - protein, 12 aa, Staphylococcus aureus
VKNPTTKNLEGF

SEQ ID NO: 1563174 - protein, 7 aa, Staphylococcus aureus
VTATDFK

SEQ ID NO: 1563175 - protein, 12 aa, Staphylococcus aureus
YVDELKQELEFY

SEQ ID NO: 1563176 - protein, 101 aa, Staphylococcus aureus
YVPPQQQAPTKQRPAKEENDDKASKDESKDKDDKASQDKSDDNQKKTDDNKQPAQPKPQPQQPTPKPNNNQQNNQSNQQAKPQAPQQNSQSTTNKQNNAND

SEQ ID NO: 1563177 - protein, 23 aa, Staphylococcus aureus
ANHPFNSSTIGHKKKLDEDDDID

SEQ ID NO: 1563178 - protein, 11 aa, Staphylococcus aureus
AQDKQTAGNSL

SEQ ID NO: 1563179 - protein, 27 aa, Staphylococcus aureus
AREHDPAYIEKKGEKLAKQNRKDADKM

SEQ ID NO: 1563180 - protein, 5 aa, Staphylococcus aureus
ATKNQ

SEQ ID NO: 1563181 - protein, 11 aa, Staphylococcus aureus
DKNNHTGKAAK

SEQ ID NO: 1563182 - protein, 5 aa, Staphylococcus aureus
DKRLP

SEQ ID NO: 1563183 - protein, 15 aa, Staphylococcus aureus
DRPDLAQQFKQTIPN

SEQ ID NO: 1563184 - protein, 16 aa, Staphylococcus aureus
DSSYISKSDNGEVEMT

SEQ ID NO: 1563185 - protein, 17 aa, Staphylococcus aureus
DVQDKGMASYNAKISGK

SEQ ID NO: 1563186 - protein, 5 aa, Staphylococcus aureus
EKGNY

SEQ ID NO: 1563187 - protein, 4 aa, Staphylococcus aureus
ETPL

SEQ ID NO: 1563188 - protein, 12 aa, Staphylococcus aureus
FTTNATNADNIK

SEQ ID NO: 1563189 - protein, 12 aa, Staphylococcus aureus
GDGTNDAPALAQ

SEQ ID NO: 1563190 - protein, 5 aa, Staphylococcus aureus
GTSVG

SEQ ID NO: 1563191 - protein, 15 aa, Staphylococcus aureus
HQLKSPDDIKKELNK

SEQ ID NO: 1563192 - protein, 19 aa, Staphylococcus aureus
HQTKSPDEIKKELESKKND

SEQ ID NO: 1563193 - protein, 29 aa, Staphylococcus aureus
IKGVSSKEKDNKYSDKYEFGKKTEYDESK

SEQ ID NO: 1563194 - protein, 72 aa, Staphylococcus aureus
INTKDDDTSQNNTSEPLNVQTGQEGKVADTDVAENSSTATNPKDASDKADVIEPESDVVKDADNNIDKDVQH

SEQ ID NO: 1563195 - protein, 7 aa, Staphylococcus aureus
IPSGGQK

SEQ ID NO: 1563196 - protein, 4 aa, Staphylococcus aureus
IRSN

SEQ ID NO: 1563197 - protein, 7 aa, Staphylococcus aureus
ISSGKNN

SEQ ID NO: 1563198 - protein, 5 aa, Staphylococcus aureus
KDNPN

SEQ ID NO: 1563199 - protein, 11 aa, Staphylococcus aureus
KRESNYQSNAV

SEQ ID NO: 1563200 - protein, 6 aa, Staphylococcus aureus
LATKNQ

SEQ ID NO: 1563201 - protein, 13 aa, Staphylococcus aureus
LQNDKDHAKQTVS

SEQ ID NO: 1563202 - protein, 6 aa, Staphylococcus aureus
LSPTKQ

SEQ ID NO: 1563203 - protein, 12 aa, Staphylococcus aureus
LYENGNKKYDID

SEQ ID NO: 1563204 - protein, 26 aa, Staphylococcus aureus
MSQSTSGSTSTSTSTSLSDSTSTSLS

SEQ ID NO: 1563205 - protein, 99 aa, Staphylococcus aureus
NDIPVQKDKVQQDSNKKIENERPKASGTLKVENSPPTIKKVENNHKEQPKHKDEKSKKEKKKVVEKEKALPAFNRDDDSKNSSQLSSDIKELDEPNHKK

SEQ ID NO: 1563206 - protein, 7 aa, Staphylococcus aureus
NNAPDVH

SEQ ID NO: 1563207 - protein, 6 aa, Staphylococcus aureus
NNTSIA

SEQ ID NO: 1563208 - protein, 10 aa, Staphylococcus aureus
PNTPIKCGGA

SEQ ID NO: 1563209 - protein, 16 aa, Staphylococcus aureus
RANAKRGYTNYNNPVH

SEQ ID NO: 1563210 - protein, 25 aa, Staphylococcus aureus
RRKEDEEDVTVEEKDSLNNGESLDK

SEQ ID NO: 1563211 - protein, 12 aa, Staphylococcus aureus
SGAEGTRVEDTM

SEQ ID NO: 1563212 - protein, 5 aa, Staphylococcus aureus
SGSFE

SEQ ID NO: 1563213 - protein, 13 aa, Staphylococcus aureus
SMGPTAVSEVTEQ

SEQ ID NO: 1563214 - protein, 10 aa, Staphylococcus aureus
SNAKTASLSP

SEQ ID NO: 1563215 - protein, 13 aa, Staphylococcus aureus
STDASGNKTTTTF

SEQ ID NO: 1563216 - protein, 8 aa, Staphylococcus aureus
STSTQSEI

SEQ ID NO: 1563217 - protein, 7 aa, Staphylococcus aureus
SVEGQGT

SEQ ID NO: 1563218 - protein, 6 aa, Staphylococcus aureus
TDKIED

SEQ ID NO: 1563219 - protein, 4 aa, Staphylococcus aureus
TGSS

SEQ ID NO: 1563220 - protein, 18 aa, Staphylococcus aureus
TVEAKDNLNGEKPTTNLN

SEQ ID NO: 1563221 - protein, 18 aa, Staphylococcus aureus
VPSTNGKKRLNDKYDATN

SEQ ID NO: 1563222 - protein, 20 aa, Staphylococcus aureus
YDASIKDNNKDQTSRKAEAL

SEQ ID NO: 1563223 - protein, 5 aa, Staphylococcus aureus
YDDTG

SEQ ID NO: 1563224 - protein, 28 aa, Staphylococcus aureus
YQKADDLKVKEQELSQKFEERKTQLEET

SEQ ID NO: 1563225 - protein, 5 aa, Staphylococcus aureus
YTKER

SEQ ID NO: 1563226 - protein, 6 aa, Staphylococcus aureus
ALGGPE

SEQ ID NO: 1563227 - protein, 20 aa, Staphylococcus aureus
AQATNSDVTPVQAANQYGYA

SEQ ID NO: 1563228 - protein, 5 aa, Staphylococcus aureus
AQKHM

SEQ ID NO: 1563229 - protein, 28 aa, Staphylococcus aureus
AREHDPAYIEKKGEKLAKQNRKDADKMN

SEQ ID NO: 1563230 - protein, 11 aa, Staphylococcus aureus
DAQKQSFESQI

SEQ ID NO: 1563231 - protein, 4 aa, Staphylococcus aureus
DDTG

SEQ ID NO: 1563232 - protein, 9 aa, Staphylococcus aureus
DGKGIDSDC

SEQ ID NO: 1563233 - protein, 7 aa, Staphylococcus aureus
DTTEFNN

SEQ ID NO: 1563234 - protein, 8 aa, Staphylococcus aureus
DTTEFNNI

SEQ ID NO: 1563235 - protein, 8 aa, Staphylococcus aureus
EGAERQRA

SEQ ID NO: 1563236 - protein, 7 aa, Staphylococcus aureus
EQKNSTI

SEQ ID NO: 1563237 - protein, 8 aa, Staphylococcus aureus
EQNANTLN

SEQ ID NO: 1563238 - protein, 31 aa, Staphylococcus aureus
ESITNEVNAAKQALNGNDNLANAKQQAKQQL

SEQ ID NO: 1563239 - protein, 9 aa, Staphylococcus aureus
ESTLSDSEG

SEQ ID NO: 1563240 - protein, 84 aa, Staphylococcus aureus
GGEKPKDPKGPENPEKPSRPTHPSGPVNPNNPGLSKDRAKPNGPVHSMDKNDKVKKSKIAKESVANQEKKRAELPKTGLESTQK

SEQ ID NO: 1563241 - protein, 4 aa, Staphylococcus aureus
GIGI

SEQ ID NO: 1563242 - protein, 6 aa, Staphylococcus aureus
GLADKY

SEQ ID NO: 1563243 - protein, 9 aa, Staphylococcus aureus
GQQSSVTKD

SEQ ID NO: 1563244 - protein, 13 aa, Staphylococcus aureus
GTPETKSEVTNTH

SEQ ID NO: 1563245 - protein, 16 aa, Staphylococcus aureus
IANTQLPKNQKSDLMS

SEQ ID NO: 1563246 - protein, 17 aa, Staphylococcus aureus
IANTQLPKNQKSDLMSE

SEQ ID NO: 1563247 - protein, 15 aa, Staphylococcus aureus
IISKNTAKDERTSEF

SEQ ID NO: 1563248 - protein, 9 aa, Staphylococcus aureus
INPPKSDLN

SEQ ID NO: 1563249 - protein, 5 aa, Staphylococcus aureus
IRPLP

SEQ ID NO: 1563250 - protein, 30 aa, Staphylococcus aureus
KADASTQNSSSVQDKQLQKVEEVPNNSEKA

SEQ ID NO: 1563251 - protein, 58 aa, Staphylococcus aureus
KAKEDAKNAIKALANAKRDQINSNPDLTPEQKAKALKEIDEAEKRALQNVENAQTIDQ

SEQ ID NO: 1563252 - protein, 6 aa, Staphylococcus aureus
KEPDTF

SEQ ID NO: 1563253 - protein, 7 aa, Staphylococcus aureus
KGLEKAS

SEQ ID NO: 1563254 - protein, 14 aa, Staphylococcus aureus
KHQLNSKQQATNIE

SEQ ID NO: 1563255 - protein, 7 aa, Staphylococcus aureus
KTEAEVE

SEQ ID NO: 1563256 - protein, 4 aa, Staphylococcus aureus
KTVN

SEQ ID NO: 1563257 - protein, 103 aa, Staphylococcus aureus
KVKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTS

SEQ ID NO: 1563258 - protein, 4 aa, Staphylococcus aureus
LDNG

SEQ ID NO: 1563259 - protein, 19 aa, Staphylococcus aureus
LKENIGKNGVCSNYSPDYV

SEQ ID NO: 1563260 - protein, 7 aa, Staphylococcus aureus
NADDLGG

SEQ ID NO: 1563261 - protein, 7 aa, Staphylococcus aureus
NASDLLS

SEQ ID NO: 1563262 - protein, 15 aa, Staphylococcus aureus
NKQTGQNANQTEVEQ

SEQ ID NO: 1563263 - protein, 5 aa, Staphylococcus aureus
PPMGP

SEQ ID NO: 1563264 - protein, 7 aa, Staphylococcus aureus
QAKERRS

SEQ ID NO: 1563265 - protein, 21 aa, Staphylococcus aureus
QGYDTEVGERGVKLSGGQKQR

SEQ ID NO: 1563266 - protein, 22 aa, Staphylococcus aureus
QGYDTEVGERGVKLSGGQKQRL

SEQ ID NO: 1563267 - protein, 5 aa, Staphylococcus aureus
QLTKD

SEQ ID NO: 1563268 - protein, 8 aa, Staphylococcus aureus
QSHSLTKT

SEQ ID NO: 1563269 - protein, 5 aa, Staphylococcus aureus
RSGAF

SEQ ID NO: 1563270 - protein, 4 aa, Staphylococcus aureus
SLGN

SEQ ID NO: 1563271 - protein, 7 aa, Staphylococcus aureus
SLSQSDE

SEQ ID NO: 1563272 - protein, 8 aa, Staphylococcus aureus
SLSQSDEK

SEQ ID NO: 1563273 - protein, 7 aa, Staphylococcus aureus
TGRAAEN

SEQ ID NO: 1563274 - protein, 8 aa, Staphylococcus aureus
TGRAAENG

SEQ ID NO: 1563275 - protein, 7 aa, Staphylococcus aureus
TISVGAS

SEQ ID NO: 1563276 - protein, 13 aa, Staphylococcus aureus
TKQRQTEPNPEYY

SEQ ID NO: 1563277 - protein, 14 aa, Staphylococcus aureus
TKQRQTEPNPEYYG

SEQ ID NO: 1563278 - protein, 4 aa, Staphylococcus aureus
TSVG

SEQ ID NO: 1563279 - protein, 8 aa, Staphylococcus aureus
TTISVGAS

SEQ ID NO: 1563280 - protein, 7 aa, Staphylococcus aureus
VDSTNGT

SEQ ID NO: 1563281 - protein, 6 aa, Staphylococcus aureus
VEKGNY

SEQ ID NO: 1563282 - protein, 9 aa, Staphylococcus aureus
VGEDIPSDY

SEQ ID NO: 1563283 - protein, 7 aa, Staphylococcus aureus
VKELDQN

SEQ ID NO: 1563284 - protein, 6 aa, Staphylococcus aureus
VKKTAT

SEQ ID NO: 1563285 - protein, 10 aa, Staphylococcus aureus
AGNPTKGNET

SEQ ID NO: 1563286 - protein, 34 aa, Staphylococcus aureus
AIADKDATKATVNFTDADQAKQQAYNTAVTNAEN

SEQ ID NO: 1563287 - protein, 10 aa, Staphylococcus aureus
AINPPKSDLN

SEQ ID NO: 1563288 - protein, 10 aa, Staphylococcus aureus
AKDNANTAID

SEQ ID NO: 1563289 - protein, 20 aa, Staphylococcus aureus
AQAANSDVTPVQAANQYGYA

SEQ ID NO: 1563290 - protein, 13 aa, Staphylococcus aureus
AQSSNTSSKNIEQ

SEQ ID NO: 1563291 - protein, 10 aa, Staphylococcus aureus
ASISKEQYKR

SEQ ID NO: 1563292 - protein, 8 aa, Staphylococcus aureus
ASNATYEE

SEQ ID NO: 1563293 - protein, 6 aa, Staphylococcus aureus
ASNSNL

SEQ ID NO: 1563294 - protein, 5 aa, Staphylococcus aureus
AYETI

SEQ ID NO: 1563295 - protein, 4 aa, Staphylococcus aureus
DPTF

SEQ ID NO: 1563296 - protein, 7 aa, Staphylococcus aureus
DSGYGQG

SEQ ID NO: 1563297 - protein, 18 aa, Staphylococcus aureus
DTNKDGKQDSTEKGISGV

SEQ ID NO: 1563298 - protein, 18 aa, Staphylococcus aureus
DTNKNGVQDKDEKGISGV

SEQ ID NO: 1563299 - protein, 8 aa, Staphylococcus aureus
EEKSETGE

SEQ ID NO: 1563300 - protein, 7 aa, Staphylococcus aureus
EFSEEQL

SEQ ID NO: 1563301 - protein, 9 aa, Staphylococcus aureus
EKSPNGISS

SEQ ID NO: 1563302 - protein, 4 aa, Staphylococcus aureus
EYNG

SEQ ID NO: 1563303 - protein, 17 aa, Staphylococcus aureus
FAPTKYKDQERTVTTAR

SEQ ID NO: 1563304 - protein, 6 aa, Staphylococcus aureus
FNGKKS

SEQ ID NO: 1563305 - protein, 8 aa, Staphylococcus aureus
GKGLGNSA

SEQ ID NO: 1563306 - protein, 7 aa, Staphylococcus aureus
GLADKYG

SEQ ID NO: 1563307 - protein, 9 aa, Staphylococcus aureus
GLNQQQQDL

SEQ ID NO: 1563308 - protein, 6 aa, Staphylococcus aureus
HVSTSR

SEQ ID NO: 1563309 - protein, 10 aa, Staphylococcus aureus
IDHKRKRRTT

SEQ ID NO: 1563310 - protein, 6 aa, Staphylococcus aureus
IHETDD

SEQ ID NO: 1563311 - protein, 12 aa, Staphylococcus aureus
IKQNADALNNAM

SEQ ID NO: 1563312 - protein, 43 aa, Staphylococcus aureus
KALDKVKDNKTTVKFERDGKTKSVELTPKKTERKLTKVSSETK

SEQ ID NO: 1563313 - protein, 21 aa, Staphylococcus aureus
KNENGEVLQTTKTDKDGKYQF

SEQ ID NO: 1563314 - protein, 4 aa, Staphylococcus aureus
KPTY

SEQ ID NO: 1563315 - protein, 14 aa, Staphylococcus aureus
KQTTNPTMDPNTIQ

SEQ ID NO: 1563316 - protein, 8 aa, Staphylococcus aureus
KYEETPDV

SEQ ID NO: 1563317 - protein, 9 aa, Staphylococcus aureus
KYEETPDVI

SEQ ID NO: 1563318 - protein, 4 aa, Staphylococcus aureus
LEKL

SEQ ID NO: 1563319 - protein, 6 aa, Staphylococcus aureus
LENGTY

SEQ ID NO: 1563320 - protein, 8 aa, Staphylococcus aureus
LGTNGGGF

SEQ ID NO: 1563321 - protein, 8 aa, Staphylococcus aureus
LKDENDKV

SEQ ID NO: 1563322 - protein, 14 aa, Staphylococcus aureus
LSDSTSTSTSASEV

SEQ ID NO: 1563323 - protein, 110 aa, Staphylococcus aureus
LSTSVSTSESGSTSESTSESDSTSTSLSDSQSTSRSTSASGSASTSTSTSDSRSTSASTSTSMRTSTSDSQSMSLSTSTSTSMSDSTSLSDSVSDSTSDSTSASTSGSMS

SEQ ID NO: 1563324 - protein, 7 aa, Staphylococcus aureus
NASNSNL

SEQ ID NO: 1563325 - protein, 19 aa, Staphylococcus aureus
NDAQKQALTTQVEQAPDIA

SEQ ID NO: 1563326 - protein, 13 aa, Staphylococcus aureus
NGMPRAKYKSYKD

SEQ ID NO: 1563327 - protein, 6 aa, Staphylococcus aureus
NKQLGT

SEQ ID NO: 1563328 - protein, 5 aa, Staphylococcus aureus
NNGTY

SEQ ID NO: 1563329 - protein, 24 aa, Staphylococcus aureus
NSEDNKSLPKLESVRSSLANNSDI

SEQ ID NO: 1563330 - protein, 6 aa, Staphylococcus aureus
NTDKHG

SEQ ID NO: 1563331 - protein, 10 aa, Staphylococcus aureus
NVKQTAQELN

SEQ ID NO: 1563332 - protein, 5 aa, Staphylococcus aureus
PSEIT

SEQ ID NO: 1563333 - protein, 34 aa, Staphylococcus aureus
QGIANKAQIKGSENYHDADTDKQTAYDNAVTKAE

SEQ ID NO: 1563334 - protein, 7 aa, Staphylococcus aureus
QKGHKTF

SEQ ID NO: 1563335 - protein, 19 aa, Staphylococcus aureus
QNYNNTDKVTDKKTTEHLP

SEQ ID NO: 1563336 - protein, 13 aa, Staphylococcus aureus
QQIQANSQVPQSV

SEQ ID NO: 1563337 - protein, 7 aa, Staphylococcus aureus
RTGKGTK

SEQ ID NO: 1563338 - protein, 8 aa, Staphylococcus aureus
RTGKGTKH

SEQ ID NO: 1563339 - protein, 5 aa, Staphylococcus aureus
SASTG

SEQ ID NO: 1563340 - protein, 12 aa, Staphylococcus aureus
SDAPISKQYQSN

SEQ ID NO: 1563341 - protein, 16 aa, Staphylococcus aureus
SDHTTIEDTKEYTTES

SEQ ID NO: 1563342 - protein, 6 aa, Staphylococcus aureus
SGSFES

SEQ ID NO: 1563343 - protein, 15 aa, Staphylococcus aureus
SKANGSNASQTEVEQ

SEQ ID NO: 1563344 - protein, 5 aa, Staphylococcus aureus
SKGLS

SEQ ID NO: 1563345 - protein, 6 aa, Staphylococcus aureus
SKKDGL

SEQ ID NO: 1563346 - protein, 12 aa, Staphylococcus aureus
SMGPTAVSEVTE

SEQ ID NO: 1563347 - protein, 12 aa, Staphylococcus aureus
SNDVIADKDYQP

SEQ ID NO: 1563348 - protein, 43 aa, Staphylococcus aureus
SSSKTYGPYPQNKDITISASGKAKGKTFTTQTKTIKASDLKYN

SEQ ID NO: 1563349 - protein, 6 aa, Staphylococcus aureus
STSSYS

SEQ ID NO: 1563350 - protein, 13 aa, Staphylococcus aureus
TGDGTNDAPALAQ

SEQ ID NO: 1563351 - protein, 12 aa, Staphylococcus aureus
TIKQTAQDLNQA

SEQ ID NO: 1563352 - protein, 22 aa, Staphylococcus aureus
TMPGATPQSTQDEISSKIDNQV

SEQ ID NO: 1563353 - protein, 9 aa, Staphylococcus aureus
TVKGPSMDA

SEQ ID NO: 1563354 - protein, 12 aa, Staphylococcus aureus
TVTTDENGKYQF

SEQ ID NO: 1563355 - protein, 6 aa, Staphylococcus aureus
VEGQGT

SEQ ID NO: 1563356 - protein, 11 aa, Staphylococcus aureus
VKQNAQNLNNA

SEQ ID NO: 1563357 - protein, 10 aa, Staphylococcus aureus
VPNSAVKGDT

SEQ ID NO: 1563358 - protein, 19 aa, Staphylococcus aureus
VSKTKQGYTITKNKNSSGY

SEQ ID NO: 1563359 - protein, 4 aa, Staphylococcus aureus
YAPP

SEQ ID NO: 1563360 - protein, 7 aa, Staphylococcus aureus
ADDQEDV

SEQ ID NO: 1563361 - protein, 6 aa, Staphylococcus aureus
AEKRSN

SEQ ID NO: 1563362 - protein, 6 aa, Staphylococcus aureus
AGASDM

SEQ ID NO: 1563363 - protein, 15 aa, Staphylococcus aureus
AKASEVNENVKKQNH

SEQ ID NO: 1563364 - protein, 12 aa, Staphylococcus aureus
AQKNPDTGELKG

SEQ ID NO: 1563365 - protein, 58 aa, Staphylococcus aureus
DDVSKKQNSLDSVDQDTEKSKYYEQNSEATLSTKSTDKVESTEMRKLSSDKNKVGHEE

SEQ ID NO: 1563366 - protein, 6 aa, Staphylococcus aureus
DKRLPQ

SEQ ID NO: 1563367 - protein, 15 aa, Staphylococcus aureus
DKYPAQQAGLQKGDK

SEQ ID NO: 1563368 - protein, 5 aa, Staphylococcus aureus
DRKTI

SEQ ID NO: 1563369 - protein, 16 aa, Staphylococcus aureus
DTNKDGIQDANEPGIK

SEQ ID NO: 1563370 - protein, 18 aa, Staphylococcus aureus
DTNKNGIQDQDEKGISGV

SEQ ID NO: 1563371 - protein, 4 aa, Staphylococcus aureus
DTTI

SEQ ID NO: 1563372 - protein, 19 aa, Staphylococcus aureus
EDAMASVPNKIREGAYGLG

SEQ ID NO: 1563373 - protein, 8 aa, Staphylococcus aureus
EKSPNGIS

SEQ ID NO: 1563374 - protein, 4 aa, Staphylococcus aureus
EQRT

SEQ ID NO: 1563375 - protein, 5 aa, Staphylococcus aureus
ERHRI

SEQ ID NO: 1563376 - protein, 13 aa, Staphylococcus aureus
ESTGAKGVIQQGT

SEQ ID NO: 1563377 - protein, 5 aa, Staphylococcus aureus
ETIQS

SEQ ID NO: 1563378 - protein, 8 aa, Staphylococcus aureus
FESTSSGT

SEQ ID NO: 1563379 - protein, 14 aa, Staphylococcus aureus
FETSNDNTVRVEPG

SEQ ID NO: 1563380 - protein, 11 aa, Staphylococcus aureus
FKNGAKQAQLQ

SEQ ID NO: 1563381 - protein, 13 aa, Staphylococcus aureus
FTNNQSGGAGQEV

SEQ ID NO: 1563382 - protein, 7 aa, Staphylococcus aureus
GMGSSAM

SEQ ID NO: 1563383 - protein, 11 aa, Staphylococcus aureus
HKDAQDKYGFK

SEQ ID NO: 1563384 - protein, 34 aa, Staphylococcus aureus
HNDSEKMDYKSYAADKAKANKEAHKAKQKNGKLN

SEQ ID NO: 1563385 - protein, 4 aa, Staphylococcus aureus
INTE

SEQ ID NO: 1563386 - protein, 7 aa, Staphylococcus aureus
KDENGNV

SEQ ID NO: 1563387 - protein, 6 aa, Staphylococcus aureus
KEPKYN

SEQ ID NO: 1563388 - protein, 6 aa, Staphylococcus aureus
KESGPV

SEQ ID NO: 1563389 - protein, 22 aa, Staphylococcus aureus
LKDSTGKVIGTTTTDASGKYKF

SEQ ID NO: 1563390 - protein, 6 aa, Staphylococcus aureus
LPNGDY

SEQ ID NO: 1563391 - protein, 38 aa, Staphylococcus aureus
LSSSANASQTDNGVNRSGSEDPTVYSATSTKKLHKEPA

SEQ ID NO: 1563392 - protein, 7 aa, Staphylococcus aureus
NKQLGTT

SEQ ID NO: 1563393 - protein, 14 aa, Staphylococcus aureus
NQGMKATSGDQSLK

SEQ ID NO: 1563394 - protein, 11 aa, Staphylococcus aureus
NVTPTNDQLTD

SEQ ID NO: 1563395 - protein, 7 aa, Staphylococcus aureus
PKDSPKL

SEQ ID NO: 1563396 - protein, 17 aa, Staphylococcus aureus
PKNEGDVTISNYNQNSA

SEQ ID NO: 1563397 - protein, 9 aa, Staphylococcus aureus
PKSQYRRKR

SEQ ID NO: 1563398 - protein, 5 aa, Staphylococcus aureus
QDKRA

SEQ ID NO: 1563399 - protein, 5 aa, Staphylococcus aureus
QEGRL

SEQ ID NO: 1563400 - protein, 29 aa, Staphylococcus aureus
QGIADKDQTKANGNFVNADTDKQNAYNNA

SEQ ID NO: 1563401 - protein, 16 aa, Staphylococcus aureus
QIATAKQNIDQATKLQ

SEQ ID NO: 1563402 - protein, 19 aa, Staphylococcus aureus
QKEREIDEKNKKENDKNIR

SEQ ID NO: 1563403 - protein, 6 aa, Staphylococcus aureus
QPNNNN

SEQ ID NO: 1563404 - protein, 4 aa, Staphylococcus aureus
SAKW

SEQ ID NO: 1563405 - protein, 5 aa, Staphylococcus aureus
SGSVR

SEQ ID NO: 1563406 - protein, 5 aa, Staphylococcus aureus
SKNLS

SEQ ID NO: 1563407 - protein, 4 aa, Staphylococcus aureus
SNTT

SEQ ID NO: 1563408 - protein, 6 aa, Staphylococcus aureus
SSGKNN

SEQ ID NO: 1563409 - protein, 21 aa, Staphylococcus aureus
TAGKSLKGSYPNVDNEQDRAY

SEQ ID NO: 1563410 - protein, 7 aa, Staphylococcus aureus
TGEKVNV

SEQ ID NO: 1563411 - protein, 10 aa, Staphylococcus aureus
TGTITNGRPV

SEQ ID NO: 1563412 - protein, 10 aa, Staphylococcus aureus
TIGSSKHHTE

SEQ ID NO: 1563413 - protein, 16 aa, Staphylococcus aureus
TVEQTKQNAQNVNTAM

SEQ ID NO: 1563414 - protein, 10 aa, Staphylococcus aureus
TVKGPSMDAI

SEQ ID NO: 1563415 - protein, 21 aa, Staphylococcus aureus
VKSNYEKYSQVRSTSGKTGRE

SEQ ID NO: 1563416 - protein, 11 aa, Staphylococcus aureus
VTTDADGKYKF

SEQ ID NO: 1563417 - protein, 27 aa, Staphylococcus aureus
YQKADDLKVKEQELSQKFEERKTQLEE

SEQ ID NO: 1563418 - protein, 14 aa, Staphylococcus aureus
AKKREEHRKKWYQN

SEQ ID NO: 1563419 - protein, 4 aa, Staphylococcus aureus
AYKY

SEQ ID NO: 1563420 - protein, 7 aa, Staphylococcus aureus
DDNTTVF

SEQ ID NO: 1563421 - protein, 4 aa, Staphylococcus aureus
DKAY

SEQ ID NO: 1563422 - protein, 10 aa, Staphylococcus aureus
DKKVPTGNEY

SEQ ID NO: 1563423 - protein, 20 aa, Staphylococcus aureus
DSNGKELDRTTTDENGKYQF

SEQ ID NO: 1563424 - protein, 7 aa, Staphylococcus aureus
EAEINDG

SEQ ID NO: 1563425 - protein, 8 aa, Staphylococcus aureus
EFSEEQLN

SEQ ID NO: 1563426 - protein, 9 aa, Staphylococcus aureus
EGTKAITQK

SEQ ID NO: 1563427 - protein, 6 aa, Staphylococcus aureus
ENPVSK

SEQ ID NO: 1563428 - protein, 10 aa, Staphylococcus aureus
FNTPDDQITT

SEQ ID NO: 1563429 - protein, 6 aa, Staphylococcus aureus
FPNPNQ

SEQ ID NO: 1563430 - protein, 25 aa, Staphylococcus aureus
FSNEKINSIRNSEIGTADEKQAAMN

SEQ ID NO: 1563431 - protein, 8 aa, Staphylococcus aureus
GHNGINNA

SEQ ID NO: 1563432 - protein, 4 aa, Staphylococcus aureus
GLMN

SEQ ID NO: 1563433 - protein, 10 aa, Staphylococcus aureus
GVGDRVAHGG

SEQ ID NO: 1563434 - protein, 7 aa, Staphylococcus aureus
HDKNGWS

SEQ ID NO: 1563435 - protein, 5 aa, Staphylococcus aureus
HETKQ

SEQ ID NO: 1563436 - protein, 9 aa, Staphylococcus aureus
HTSHKAMSD

SEQ ID NO: 1563437 - protein, 10 aa, Staphylococcus aureus
IDPNSKGDLA

SEQ ID NO: 1563438 - protein, 10 aa, Staphylococcus aureus
IDSGTTVYPH

SEQ ID NO: 1563439 - protein, 15 aa, Staphylococcus aureus
ISGTPNANVDPQQVA

SEQ ID NO: 1563440 - protein, 4 aa, Staphylococcus aureus
KERK

SEQ ID NO: 1563441 - protein, 7 aa, Staphylococcus aureus
KKYKENP

SEQ ID NO: 1563442 - protein, 8 aa, Staphylococcus aureus
KLPGKVKN

SEQ ID NO: 1563443 - protein, 4 aa, Staphylococcus aureus
KREE

SEQ ID NO: 1563444 - protein, 7 aa, Staphylococcus aureus
LAEEKGR

SEQ ID NO: 1563445 - protein, 50 aa, Staphylococcus aureus
LKTEVAQKSSAEKNDNCNHDIEGNVEDIAEGRLDEVQNTDSMLNQKNKRI

SEQ ID NO: 1563446 - protein, 9 aa, Staphylococcus aureus
LNQPQRDAL

SEQ ID NO: 1563447 - protein, 11 aa, Staphylococcus aureus
LTQQQRDELNK

SEQ ID NO: 1563448 - protein, 8 aa, Staphylococcus aureus
NKENINGQ

SEQ ID NO: 1563449 - protein, 4 aa, Staphylococcus aureus
NPNF

SEQ ID NO: 1563450 - protein, 6 aa, Staphylococcus aureus
NQINQA

SEQ ID NO: 1563451 - protein, 5 aa, Staphylococcus aureus
NQNLK

SEQ ID NO: 1563452 - protein, 12 aa, Staphylococcus aureus
NSEDNKTLPKLE

SEQ ID NO: 1563453 - protein, 4 aa, Staphylococcus aureus
NSNV

SEQ ID NO: 1563454 - protein, 29 aa, Staphylococcus aureus
NTKDGGKYTLESHKELQKDRENVKINTAD

SEQ ID NO: 1563455 - protein, 7 aa, Staphylococcus aureus
QQKYPNP

SEQ ID NO: 1563456 - protein, 6 aa, Staphylococcus aureus
QTNDRL

SEQ ID NO: 1563457 - protein, 29 aa, Staphylococcus aureus
RGNTSSQSESDKNVTKSSQEENQAKEELQ

SEQ ID NO: 1563458 - protein, 9 aa, Staphylococcus aureus
RKGTNLTYQ

SEQ ID NO: 1563459 - protein, 6 aa, Staphylococcus aureus
RPDDVA

SEQ ID NO: 1563460 - protein, 14 aa, Staphylococcus aureus
SANEGIGPSGVHED

SEQ ID NO: 1563461 - protein, 13 aa, Staphylococcus aureus
SKPSEHDKETRID

SEQ ID NO: 1563462 - protein, 16 aa, Staphylococcus aureus
SLNDPQKTALKDQVTA

SEQ ID NO: 1563463 - protein, 12 aa, Staphylococcus aureus
TDASGNKTTTTF

SEQ ID NO: 1563464 - protein, 8 aa, Staphylococcus aureus
TEKEYNDA

SEQ ID NO: 1563465 - protein, 5 aa, Staphylococcus aureus
TKRTA

SEQ ID NO: 1563466 - protein, 15 aa, Staphylococcus aureus
TTNETESRNYPLGKA

SEQ ID NO: 1563467 - protein, 17 aa, Staphylococcus aureus
TVEAKDNLNGEKPTTNL

SEQ ID NO: 1563468 - protein, 12 aa, Staphylococcus aureus
TVKQSTKNYPPT

SEQ ID NO: 1563469 - protein, 8 aa, Staphylococcus aureus
VKELDQNE

SEQ ID NO: 1563470 - protein, 8 aa, Staphylococcus aureus
VQARQQQE

SEQ ID NO: 1563471 - protein, 10 aa, Staphylococcus aureus
VYQPDPNKLP

SEQ ID NO: 1563472 - protein, 11 aa, Staphylococcus aureus
YSEALNSTSVS

SEQ ID NO: 1563473 - protein, 8 aa, Staphylococcus aureus
YTGEEDWE

SEQ ID NO: 1563474 - protein, 17 aa, Staphylococcus aureus
AADAKGTNVNDKVTASN

SEQ ID NO: 1563475 - protein, 5 aa, Staphylococcus aureus
ADNMT

SEQ ID NO: 1563476 - protein, 9 aa, Staphylococcus aureus
AHAEQDQTW

SEQ ID NO: 1563477 - protein, 27 aa, Staphylococcus aureus
AKANGTTADKIAADNKLADKNMIKPGQ

SEQ ID NO: 1563478 - protein, 11 aa, Staphylococcus aureus
AMGRGTEATSG

SEQ ID NO: 1563479 - protein, 4 aa, Staphylococcus aureus
DELE

SEQ ID NO: 1563480 - protein, 12 aa, Staphylococcus aureus
DEVGQPELRRNS

SEQ ID NO: 1563481 - protein, 6 aa, Staphylococcus aureus
DKEETK

SEQ ID NO: 1563482 - protein, 23 aa, Staphylococcus aureus
DKQSSENSALQSEIKKNSSYERI

SEQ ID NO: 1563483 - protein, 16 aa, Staphylococcus aureus
DTNKDGKQDANEKGIK

SEQ ID NO: 1563484 - protein, 10 aa, Staphylococcus aureus
ESTTDDTELV

SEQ ID NO: 1563485 - protein, 5 aa, Staphylococcus aureus
FTNEN

SEQ ID NO: 1563486 - protein, 9 aa, Staphylococcus aureus
GEYDQNAKD

SEQ ID NO: 1563487 - protein, 17 aa, Staphylococcus aureus
GKDPSEVQTTKARNIKT

SEQ ID NO: 1563488 - protein, 9 aa, Staphylococcus aureus
GKSKEGVDY

SEQ ID NO: 1563489 - protein, 11 aa, Staphylococcus aureus
GLSDTVPGQTV

SEQ ID NO: 1563490 - protein, 8 aa, Staphylococcus aureus
GRHFDPEP

SEQ ID NO: 1563491 - protein, 12 aa, Staphylococcus aureus
GTPETKSEITNT

SEQ ID NO: 1563492 - protein, 5 aa, Staphylococcus aureus
HISTS

SEQ ID NO: 1563493 - protein, 9 aa, Staphylococcus aureus
HKKHGKAVI

SEQ ID NO: 1563494 - protein, 15 aa, Staphylococcus aureus
HMSTEQLEISHIQHN

SEQ ID NO: 1563495 - protein, 12 aa, Staphylococcus aureus
IDEKDIKDVEVG

SEQ ID NO: 1563496 - protein, 12 aa, Staphylococcus aureus
INATNNPNMDAN

SEQ ID NO: 1563497 - protein, 10 aa, Staphylococcus aureus
INNADTVSDV

SEQ ID NO: 1563498 - protein, 24 aa, Staphylococcus aureus
INSEELKQKEYKGYKDDAVIGKKG

SEQ ID NO: 1563499 - protein, 16 aa, Staphylococcus aureus
KNGNTNNTKVNLNTAS

SEQ ID NO: 1563500 - protein, 27 aa, Staphylococcus aureus
KQDYKNKKGDSVDSKRASTGNEYEDKA

SEQ ID NO: 1563501 - protein, 5 aa, Staphylococcus aureus
KQNEW

SEQ ID NO: 1563502 - protein, 7 aa, Staphylococcus aureus
KTSLKST

SEQ ID NO: 1563503 - protein, 15 aa, Staphylococcus aureus
LDADESKRNAYTQAV

SEQ ID NO: 1563504 - protein, 4 aa, Staphylococcus aureus
LQPS

SEQ ID NO: 1563505 - protein, 4 aa, Staphylococcus aureus
LTMP

SEQ ID NO: 1563506 - protein, 5 aa, Staphylococcus aureus
NDSID

SEQ ID NO: 1563507 - protein, 6 aa, Staphylococcus aureus
NENKKA

SEQ ID NO: 1563508 - protein, 7 aa, Staphylococcus aureus
NGKHSTQ

SEQ ID NO: 1563509 - protein, 8 aa, Staphylococcus aureus
NKKDLTAE

SEQ ID NO: 1563510 - protein, 16 aa, Staphylococcus aureus
NKQTGGNTSKADVDNA

SEQ ID NO: 1563511 - protein, 16 aa, Staphylococcus aureus
NLNNAQKGAVTGNINQ

SEQ ID NO: 1563512 - protein, 16 aa, Staphylococcus aureus
NLNQAQRDEYSKQITQ

SEQ ID NO: 1563513 - protein, 18 aa, Staphylococcus aureus
NNAQRTAANAEVDQAPNL

SEQ ID NO: 1563514 - protein, 6 aa, Staphylococcus aureus
NNPDGR

SEQ ID NO: 1563515 - protein, 15 aa, Staphylococcus aureus
NQANGTNANQSQVEA

SEQ ID NO: 1563516 - protein, 20 aa, Staphylococcus aureus
NRTPEERQNIDTNQDSEYNS

SEQ ID NO: 1563517 - protein, 9 aa, Staphylococcus aureus
PAAVASNNV

SEQ ID NO: 1563518 - protein, 20 aa, Staphylococcus aureus
PDSLTGNGDVDYSNSNNTMP

SEQ ID NO: 1563519 - protein, 10 aa, Staphylococcus aureus
QDKDQVKQSV

SEQ ID NO: 1563520 - protein, 6 aa, Staphylococcus aureus
QEDKIA

SEQ ID NO: 1563521 - protein, 10 aa, Staphylococcus aureus
QSNSETVDVT

SEQ ID NO: 1563522 - protein, 4 aa, Staphylococcus aureus
QTWT

SEQ ID NO: 1563523 - protein, 28 aa, Staphylococcus aureus
QVTTAKNALNGDANVRQAKSDAKANLGT

SEQ ID NO: 1563524 - protein, 19 aa, Staphylococcus aureus
RGRQTTKRSVKDNSGKKQS

SEQ ID NO: 1563525 - protein, 6 aa, Staphylococcus aureus
RKQKEP

SEQ ID NO: 1563526 - protein, 7 aa, Staphylococcus aureus
RKRHEQS

SEQ ID NO: 1563527 - protein, 10 aa, Staphylococcus aureus
RLPSQTQNLY

SEQ ID NO: 1563528 - protein, 9 aa, Staphylococcus aureus
RSQGHSEYF

SEQ ID NO: 1563529 - protein, 11 aa, Staphylococcus aureus
SGAEGTRVEDT

SEQ ID NO: 1563530 - protein, 17 aa, Staphylococcus aureus
SQNKLPDVEKDLKKANK

SEQ ID NO: 1563531 - protein, 9 aa, Staphylococcus aureus
SRGDINPKS

SEQ ID NO: 1563532 - protein, 14 aa, Staphylococcus aureus
SSPYTSLENEGQSV

SEQ ID NO: 1563533 - protein, 29 aa, Staphylococcus aureus
STVTTTKQALNGDRKVTDAKNNANQTLST

SEQ ID NO: 1563534 - protein, 9 aa, Staphylococcus aureus
TANAVATAV

SEQ ID NO: 1563535 - protein, 5 aa, Staphylococcus aureus
TPLGG

SEQ ID NO: 1563536 - protein, 48 aa, Staphylococcus aureus
TPLPGNVKEKESAKTVSAKLKQELKNTVTPTKVEENEAIQEDQVQYEN

SEQ ID NO: 1563537 - protein, 6 aa, Staphylococcus aureus
TQAESY

SEQ ID NO: 1563538 - protein, 11 aa, Staphylococcus aureus
VAAPQQGTNVN

SEQ ID NO: 1563539 - protein, 7 aa, Staphylococcus aureus
VDPVTNR

SEQ ID NO: 1563540 - protein, 14 aa, Staphylococcus aureus
VEESQRIEVDENKE

SEQ ID NO: 1563541 - protein, 4 aa, Staphylococcus aureus
VINP

SEQ ID NO: 1563542 - protein, 7 aa, Staphylococcus aureus
YHGDDQT

SEQ ID NO: 1563543 - protein, 7 aa, Staphylococcus aureus
YTPKRNI

SEQ ID NO: 1563544 - protein, 11 aa, Staphylococcus aureus
AKQNANTAIDG

SEQ ID NO: 1563545 - protein, 5 aa, Staphylococcus aureus
AQTPG

SEQ ID NO: 1563546 - protein, 14 aa, Staphylococcus aureus
DAQAASEKDTEISK

SEQ ID NO: 1563547 - protein, 5 aa, Staphylococcus aureus
DEPYN

SEQ ID NO: 1563548 - protein, 14 aa, Staphylococcus aureus
DIIGEKANSFDTTI

SEQ ID NO: 1563549 - protein, 16 aa, Staphylococcus aureus
DKDGVQGTDSKEKPMA

SEQ ID NO: 1563550 - protein, 7 aa, Staphylococcus aureus
DNSDENV

SEQ ID NO: 1563551 - protein, 8 aa, Staphylococcus aureus
EASTEIDD

SEQ ID NO: 1563552 - protein, 4 aa, Staphylococcus aureus
EDAL

SEQ ID NO: 1563553 - protein, 30 aa, Staphylococcus aureus
EHKQHHNELRESHKELKDKQDKVVDENLEQ

SEQ ID NO: 1563554 - protein, 7 aa, Staphylococcus aureus
ENPVSKR

SEQ ID NO: 1563555 - protein, 31 aa, Staphylococcus aureus
ETSIRDKDTTLQSQNYQDADDAKRTAYSQAV

SEQ ID NO: 1563556 - protein, 8 aa, Staphylococcus aureus
FDSDRKSI

SEQ ID NO: 1563557 - protein, 9 aa, Staphylococcus aureus
GGGAGTAVA

SEQ ID NO: 1563558 - protein, 7 aa, Staphylococcus aureus
GKAESIK

SEQ ID NO: 1563559 - protein, 4 aa, Staphylococcus aureus
GSGS

SEQ ID NO: 1563560 - protein, 7 aa, Staphylococcus aureus
GSPEHNY

SEQ ID NO: 1563561 - protein, 4 aa, Staphylococcus aureus
IAAG

SEQ ID NO: 1563562 - protein, 20 aa, Staphylococcus aureus
IAASQSVSTSTSDSMSTSEI

SEQ ID NO: 1563563 - protein, 6 aa, Staphylococcus aureus
IDATDQ

SEQ ID NO: 1563564 - protein, 8 aa, Staphylococcus aureus
KESAQKYK

SEQ ID NO: 1563565 - protein, 7 aa, Staphylococcus aureus
KGISESG

SEQ ID NO: 1563566 - protein, 13 aa, Staphylococcus aureus
KHQLNSKQQVTNI

SEQ ID NO: 1563567 - protein, 12 aa, Staphylococcus aureus
KITKSWRKRDLY

SEQ ID NO: 1563568 - protein, 18 aa, Staphylococcus aureus
KKDPKASYSYEDKDAFEQ

SEQ ID NO: 1563569 - protein, 6 aa, Staphylococcus aureus
KLPQFG

SEQ ID NO: 1563570 - protein, 12 aa, Staphylococcus aureus
KLTKMGDGLKSI

SEQ ID NO: 1563571 - protein, 6 aa, Staphylococcus aureus
KNKGRN

SEQ ID NO: 1563572 - protein, 4 aa, Staphylococcus aureus
KNLS

SEQ ID NO: 1563573 - protein, 10 aa, Staphylococcus aureus
KRSQGHSEYF

SEQ ID NO: 1563574 - protein, 15 aa, Staphylococcus aureus
LGNKYEGNGNGGDGI

SEQ ID NO: 1563575 - protein, 11 aa, Staphylococcus aureus
LIDGTKDPNVI

SEQ ID NO: 1563576 - protein, 11 aa, Staphylococcus aureus
LKENKEEGIEA

SEQ ID NO: 1563577 - protein, 17 aa, Staphylococcus aureus
LRSYSQSAFNKEGKETQ

SEQ ID NO: 1563578 - protein, 10 aa, Staphylococcus aureus
LTKDGNFYQT

SEQ ID NO: 1563579 - protein, 19 aa, Staphylococcus aureus
LTKSTETKSVNGKTGKPKK

SEQ ID NO: 1563580 - protein, 6 aa, Staphylococcus aureus
LYSDSS

SEQ ID NO: 1563581 - protein, 15 aa, Staphylococcus aureus
MKNREYQKEIAEKNR

SEQ ID NO: 1563582 - protein, 4 aa, Staphylococcus aureus
MQGE

SEQ ID NO: 1563583 - protein, 12 aa, Staphylococcus aureus
MSDLKGNNHQDQ

SEQ ID NO: 1563584 - protein, 5 aa, Staphylococcus aureus
NFKDA

SEQ ID NO: 1563585 - protein, 12 aa, Staphylococcus aureus
NGIQDQNTIKQG

SEQ ID NO: 1563586 - protein, 13 aa, Staphylococcus aureus
NKADGNGKNGQII

SEQ ID NO: 1563587 - protein, 4 aa, Staphylococcus aureus
NKIK

SEQ ID NO: 1563588 - protein, 9 aa, Staphylococcus aureus
NKTTDPTLA

SEQ ID NO: 1563589 - protein, 15 aa, Staphylococcus aureus
NQGMKATSGDQSLKV

SEQ ID NO: 1563590 - protein, 12 aa, Staphylococcus aureus
NVTPTNDQLTDV

SEQ ID NO: 1563591 - protein, 20 aa, Staphylococcus aureus
PDSVTGNGDVDYSNSNNTMP

SEQ ID NO: 1563592 - protein, 11 aa, Staphylococcus aureus
PYKSDDSDVEI

SEQ ID NO: 1563593 - protein, 12 aa, Staphylococcus aureus
QNGINDQNTVKQ

SEQ ID NO: 1563594 - protein, 16 aa, Staphylococcus aureus
QNKLPDVEKDLKKANK

SEQ ID NO: 1563595 - protein, 24 aa, Staphylococcus aureus
QTSGIPSDITSEDAVTNKNNRLND

SEQ ID NO: 1563596 - protein, 11 aa, Staphylococcus aureus
QYKDYAKKGQK

SEQ ID NO: 1563597 - protein, 12 aa, Staphylococcus aureus
RAASKKELIDII

SEQ ID NO: 1563598 - protein, 9 aa, Staphylococcus aureus
RDSFSAGTD

SEQ ID NO: 1563599 - protein, 11 aa, Staphylococcus aureus
RGFDKEDNELR

SEQ ID NO: 1563600 - protein, 8 aa, Staphylococcus aureus
RKGTNLTY

SEQ ID NO: 1563601 - protein, 8 aa, Staphylococcus aureus
RNPIASPG

SEQ ID NO: 1563602 - protein, 12 aa, Staphylococcus aureus
RQPDANYPGPVS

SEQ ID NO: 1563603 - protein, 7 aa, Staphylococcus aureus
RTSNSYR

SEQ ID NO: 1563604 - protein, 8 aa, Staphylococcus aureus
SDANTKSI

SEQ ID NO: 1563605 - protein, 10 aa, Staphylococcus aureus
SEAGLSETSL

SEQ ID NO: 1563606 - protein, 7 aa, Staphylococcus aureus
SEQSAQQ

SEQ ID NO: 1563607 - protein, 5 aa, Staphylococcus aureus
SGKSI

SEQ ID NO: 1563608 - protein, 11 aa, Staphylococcus aureus
SGKTKLTTSQI

SEQ ID NO: 1563609 - protein, 5 aa, Staphylococcus aureus
SKNGT

SEQ ID NO: 1563610 - protein, 9 aa, Staphylococcus aureus
SKNQGGSPF

SEQ ID NO: 1563611 - protein, 34 aa, Staphylococcus aureus
SLEDNSEGNAVKSDVRKLEDAKANDNQKDTLSQL

SEQ ID NO: 1563612 - protein, 6 aa, Staphylococcus aureus
SLKPKY

SEQ ID NO: 1563613 - protein, 4 aa, Staphylococcus aureus
SPGT

SEQ ID NO: 1563614 - protein, 9 aa, Staphylococcus aureus
SVKNSERRG

SEQ ID NO: 1563615 - protein, 14 aa, Staphylococcus aureus
SYITTDNAKVNGDQ

SEQ ID NO: 1563616 - protein, 9 aa, Staphylococcus aureus
SYTSNGGYT

SEQ ID NO: 1563617 - protein, 6 aa, Staphylococcus aureus
TNVQKK

SEQ ID NO: 1563618 - protein, 12 aa, Staphylococcus aureus
TSTSSNDKLSRR

SEQ ID NO: 1563619 - protein, 27 aa, Staphylococcus aureus
VNEAKQALNGNDNVQRAKDAAKQVITN

SEQ ID NO: 1563620 - protein, 11 aa, Staphylococcus aureus
VRSSLANNSDI

SEQ ID NO: 1563621 - protein, 4 aa, Staphylococcus aureus
VVGS

SEQ ID NO: 1563622 - protein, 18 aa, Staphylococcus aureus
YPDGTTKSVRTDANGHYE

SEQ ID NO: 1563623 - protein, 9 aa, Staphylococcus aureus
AKLNNPKDA

SEQ ID NO: 1563624 - protein, 8 aa, Staphylococcus aureus
AMRGPLGG

SEQ ID NO: 1563625 - protein, 7 aa, Staphylococcus aureus
ANLKKQS

SEQ ID NO: 1563626 - protein, 9 aa, Staphylococcus aureus
ARQKGESKW

SEQ ID NO: 1563627 - protein, 4 aa, Staphylococcus aureus
AYRN

SEQ ID NO: 1563628 - protein, 8 aa, Staphylococcus aureus
DADGKWYG

SEQ ID NO: 1563629 - protein, 9 aa, Staphylococcus aureus
DDGRTNQHA

SEQ ID NO: 1563630 - protein, 15 aa, Staphylococcus aureus
DHVDKKSDTSANDQY

SEQ ID NO: 1563631 - protein, 7 aa, Staphylococcus aureus
DIESKQL

SEQ ID NO: 1563632 - protein, 7 aa, Staphylococcus aureus
DKERRQA

SEQ ID NO: 1563633 - protein, 26 aa, Staphylococcus aureus
DKLPEKLKAEYKKKLEETKKALDEQV

SEQ ID NO: 1563634 - protein, 6 aa, Staphylococcus aureus
DQLTKD

SEQ ID NO: 1563635 - protein, 5 aa, Staphylococcus aureus
DRMPK

SEQ ID NO: 1563636 - protein, 4 aa, Staphylococcus aureus
EDFE

SEQ ID NO: 1563637 - protein, 11 aa, Staphylococcus aureus
EEVDNEETDQY

SEQ ID NO: 1563638 - protein, 19 aa, Staphylococcus aureus
EKGVDRYEKARAHKQSLER

SEQ ID NO: 1563639 - protein, 21 aa, Staphylococcus aureus
EKTDAVSNSAYLDKAKDLDQE

SEQ ID NO: 1563640 - protein, 9 aa, Staphylococcus aureus
EKVGTTLTN

SEQ ID NO: 1563641 - protein, 13 aa, Staphylococcus aureus
EMDKKEKEKLSQQ

SEQ ID NO: 1563642 - protein, 5 aa, Staphylococcus aureus
ENPGE

SEQ ID NO: 1563643 - protein, 5 aa, Staphylococcus aureus
ERTEE

SEQ ID NO: 1563644 - protein, 9 aa, Staphylococcus aureus
ETQGGVGAE

SEQ ID NO: 1563645 - protein, 43 aa, Staphylococcus aureus
FKNPTTKNLEGLNEEVHKDEATTKVDSDNTEPPIESKDHVSKK

SEQ ID NO: 1563646 - protein, 21 aa, Staphylococcus aureus
FTDADQGKKDAYTNAVTNAQG

SEQ ID NO: 1563647 - protein, 5 aa, Staphylococcus aureus
FTLSG

SEQ ID NO: 1563648 - protein, 7 aa, Staphylococcus aureus
FTTGSVN

SEQ ID NO: 1563649 - protein, 10 aa, Staphylococcus aureus
FVKTEKSHDQ

SEQ ID NO: 1563650 - protein, 6 aa, Staphylococcus aureus
GAKSRD

SEQ ID NO: 1563651 - protein, 14 aa, Staphylococcus aureus
GEKLGNPKSGSAVL

SEQ ID NO: 1563652 - protein, 5 aa, Staphylococcus aureus
GHIRP

SEQ ID NO: 1563653 - protein, 6 aa, Staphylococcus aureus
GLQQQS

SEQ ID NO: 1563654 - protein, 5 aa, Staphylococcus aureus
GSIST

SEQ ID NO: 1563655 - protein, 6 aa, Staphylococcus aureus
GTVSEV

SEQ ID NO: 1563656 - protein, 4 aa, Staphylococcus aureus
HELR

SEQ ID NO: 1563657 - protein, 16 aa, Staphylococcus aureus
HVEGENDQQRRSKPRR

SEQ ID NO: 1563658 - protein, 5 aa, Staphylococcus aureus
IADKI

SEQ ID NO: 1563659 - protein, 8 aa, Staphylococcus aureus
IKSLKPDA

SEQ ID NO: 1563660 - protein, 21 aa, Staphylococcus aureus
IKYPSAKFNQPEAKDKTELTS

SEQ ID NO: 1563661 - protein, 4 aa, Staphylococcus aureus
IRPL

SEQ ID NO: 1563662 - protein, 21 aa, Staphylococcus aureus
ITDKENNKTKIKGTNTLEDDK

SEQ ID NO: 1563663 - protein, 4 aa, Staphylococcus aureus
ITPV

SEQ ID NO: 1563664 - protein, 6 aa, Staphylococcus aureus
KAKAMM

SEQ ID NO: 1563665 - protein, 8 aa, Staphylococcus aureus
KAKRPDTM

SEQ ID NO: 1563666 - protein, 14 aa, Staphylococcus aureus
KELPKTGVNNESNT

SEQ ID NO: 1563667 - protein, 8 aa, Staphylococcus aureus
KGRARTKP

SEQ ID NO: 1563668 - protein, 13 aa, Staphylococcus aureus
KHGPKTGTPETKT

SEQ ID NO: 1563669 - protein, 8 aa, Staphylococcus aureus
KKANPDIE

SEQ ID NO: 1563670 - protein, 36 aa, Staphylococcus aureus
KKNQKDNQSKDKKSASKNTSKKVAAKKKKKKSKKNK

SEQ ID NO: 1563671 - protein, 12 aa, Staphylococcus aureus
KLPSDADVSVKK

SEQ ID NO: 1563672 - protein, 27 aa, Staphylococcus aureus
KLQKNIEKRHKEEQKRQQEADKARIKS

SEQ ID NO: 1563673 - protein, 4 aa, Staphylococcus aureus
KVEM

SEQ ID NO: 1563674 - protein, 12 aa, Staphylococcus aureus
KYPDNKKTDDVE

SEQ ID NO: 1563675 - protein, 6 aa, Staphylococcus aureus
KYPFNQ

SEQ ID NO: 1563676 - protein, 6 aa, Staphylococcus aureus
KYRPQQ

SEQ ID NO: 1563677 - protein, 8 aa, Staphylococcus aureus
LANTGTAY

SEQ ID NO: 1563678 - protein, 11 aa, Staphylococcus aureus
LDNGRISKITR

SEQ ID NO: 1563679 - protein, 12 aa, Staphylococcus aureus
LDSKSKSVHKQQ

SEQ ID NO: 1563680 - protein, 15 aa, Staphylococcus aureus
LGTDNVESMKGVPED

SEQ ID NO: 1563681 - protein, 9 aa, Staphylococcus aureus
LIQPRTPQG

SEQ ID NO: 1563682 - protein, 6 aa, Staphylococcus aureus
LKPDGL

SEQ ID NO: 1563683 - protein, 18 aa, Staphylococcus aureus
LNGDQRLQDAKDKAIQSI

SEQ ID NO: 1563684 - protein, 21 aa, Staphylococcus aureus
LQNEKGEVIGTTETDENGKYR

SEQ ID NO: 1563685 - protein, 10 aa, Staphylococcus aureus
LTEQDIKNAT

SEQ ID NO: 1563686 - protein, 16 aa, Staphylococcus aureus
NATKSIGRLAGNDESL

SEQ ID NO: 1563687 - protein, 7 aa, Staphylococcus aureus
NGVDEEE

SEQ ID NO: 1563688 - protein, 43 aa, Staphylococcus aureus
NGYTKGSEKDQEAFTNNNGEEAVAAKNPESEEYKVNEKIKKEH

SEQ ID NO: 1563689 - protein, 9 aa, Staphylococcus aureus
NKHKSLEPV

SEQ ID NO: 1563690 - protein, 19 aa, Staphylococcus aureus
NKKAKATAQKIDADNSINH

SEQ ID NO: 1563691 - protein, 9 aa, Staphylococcus aureus
NKKGSGSVL

SEQ ID NO: 1563692 - protein, 15 aa, Staphylococcus aureus
NKQTGSNSDKAAVDR

SEQ ID NO: 1563693 - protein, 8 aa, Staphylococcus aureus
NTITVNKD

SEQ ID NO: 1563694 - protein, 8 aa, Staphylococcus aureus
NTKLTGNN

SEQ ID NO: 1563695 - protein, 7 aa, Staphylococcus aureus
PIGDENA

SEQ ID NO: 1563696 - protein, 29 aa, Staphylococcus aureus
PNLPTDQTEKVPGKPGIKNPDTGKVIEEP

SEQ ID NO: 1563697 - protein, 8 aa, Staphylococcus aureus
PTGPNTVT

SEQ ID NO: 1563698 - protein, 15 aa, Staphylococcus aureus
PTKNSAKITQSSARD

SEQ ID NO: 1563699 - protein, 7 aa, Staphylococcus aureus
PYQQSLS

SEQ ID NO: 1563700 - protein, 6 aa, Staphylococcus aureus
QAGNPI

SEQ ID NO: 1563701 - protein, 11 aa, Staphylococcus aureus
QDAKQFETKLS

SEQ ID NO: 1563702 - protein, 6 aa, Staphylococcus aureus
QGRENE

SEQ ID NO: 1563703 - protein, 10 aa, Staphylococcus aureus
QHYNGESGVT

SEQ ID NO: 1563704 - protein, 5 aa, Staphylococcus aureus
QNKNG

SEQ ID NO: 1563705 - protein, 14 aa, Staphylococcus aureus
QNKSKKGNKKRSKT

SEQ ID NO: 1563706 - protein, 34 aa, Staphylococcus aureus
QYDNQNQNHRRQSEDASYRQQYAKGDPEEHPERY

SEQ ID NO: 1563707 - protein, 15 aa, Staphylococcus aureus
RAKQSSSTGNESNSH

SEQ ID NO: 1563708 - protein, 29 aa, Staphylococcus aureus
RGNTSTQSESDKNVTKSSQEENQAKEELQ

SEQ ID NO: 1563709 - protein, 8 aa, Staphylococcus aureus
RLNQTKKD

SEQ ID NO: 1563710 - protein, 8 aa, Staphylococcus aureus
RLSNTDRE

SEQ ID NO: 1563711 - protein, 4 aa, Staphylococcus aureus
RTAS

SEQ ID NO: 1563712 - protein, 8 aa, Staphylococcus aureus
RTNTIGKA

SEQ ID NO: 1563713 - protein, 8 aa, Staphylococcus aureus
RVGDYQDA

SEQ ID NO: 1563714 - protein, 7 aa, Staphylococcus aureus
SAAQSGL

SEQ ID NO: 1563715 - protein, 9 aa, Staphylococcus aureus
SAEDTNEKW

SEQ ID NO: 1563716 - protein, 12 aa, Staphylococcus aureus
SDGKPSGKNAEL

SEQ ID NO: 1563717 - protein, 12 aa, Staphylococcus aureus
SGGQGPDEPIPE

SEQ ID NO: 1563718 - protein, 6 aa, Staphylococcus aureus
SKPEIE

SEQ ID NO: 1563719 - protein, 15 aa, Staphylococcus aureus
SKSNTDQTLTSMAPN

SEQ ID NO: 1563720 - protein, 7 aa, Staphylococcus aureus
SNATYEE

SEQ ID NO: 1563721 - protein, 16 aa, Staphylococcus aureus
SNKDGKQDSTEKGIKG

SEQ ID NO: 1563722 - protein, 11 aa, Staphylococcus aureus
SQDAQQFESKL

SEQ ID NO: 1563723 - protein, 12 aa, Staphylococcus aureus
SRLKSGENMKYT

SEQ ID NO: 1563724 - protein, 8 aa, Staphylococcus aureus
SRYDNETI

SEQ ID NO: 1563725 - protein, 11 aa, Staphylococcus aureus
STIGSSKHHTE

SEQ ID NO: 1563726 - protein, 6 aa, Staphylococcus aureus
SYTDEL

SEQ ID NO: 1563727 - protein, 9 aa, Staphylococcus aureus
THATTPPTI

SEQ ID NO: 1563728 - protein, 7 aa, Staphylococcus aureus
TISRSSP

SEQ ID NO: 1563729 - protein, 6 aa, Staphylococcus aureus
TKKIPL

SEQ ID NO: 1563730 - protein, 8 aa, Staphylococcus aureus
TPGKSAVD

SEQ ID NO: 1563731 - protein, 9 aa, Staphylococcus aureus
TQQTSPNTE

SEQ ID NO: 1563732 - protein, 24 aa, Staphylococcus aureus
TSLNGPQKAKLKEQVGQATTLPNV

SEQ ID NO: 1563733 - protein, 5 aa, Staphylococcus aureus
TVNQG

SEQ ID NO: 1563734 - protein, 5 aa, Staphylococcus aureus
VGSHT

SEQ ID NO: 1563735 - protein, 14 aa, Staphylococcus aureus
VQQQSAKVKQQTQI

SEQ ID NO: 1563736 - protein, 6 aa, Staphylococcus aureus
YDDVRS

SEQ ID NO: 1563737 - protein, 7 aa, Staphylococcus aureus
YGTTVET

SEQ ID NO: 1563738 - protein, 4 aa, Staphylococcus aureus
YSTK

SEQ ID NO: 1563739 - protein, 13 aa, Staphylococcus aureus
YTIDDSVKEGDTF

SEQ ID NO: 1563740 - protein, 8 aa, Staphylococcus aureus
AGNTLPSA

SEQ ID NO: 1563741 - protein, 6 aa, Staphylococcus aureus
AHGGEI

SEQ ID NO: 1563742 - protein, 4 aa, Staphylococcus aureus
AISN

SEQ ID NO: 1563743 - protein, 6 aa, Staphylococcus aureus
AKKSIY

SEQ ID NO: 1563744 - protein, 12 aa, Staphylococcus aureus
AKSNKQGGLSNE

SEQ ID NO: 1563745 - protein, 10 aa, Staphylococcus aureus
AKSSKPLKEQ

SEQ ID NO: 1563746 - protein, 13 aa, Staphylococcus aureus
ALMGGGNDVATSP

SEQ ID NO: 1563747 - protein, 13 aa, Staphylococcus aureus
APAATKKKPIPAR

SEQ ID NO: 1563748 - protein, 5 aa, Staphylococcus aureus
AQPAV

SEQ ID NO: 1563749 - protein, 19 aa, Staphylococcus aureus
ASAATTSAVTANTITVNKD

SEQ ID NO: 1563750 - protein, 6 aa, Staphylococcus aureus
ATDSQV

SEQ ID NO: 1563751 - protein, 18 aa, Staphylococcus aureus
ATPHNGSQAADKFGNTEA

SEQ ID NO: 1563752 - protein, 9 aa, Staphylococcus aureus
ATSTTNNKD

SEQ ID NO: 1563753 - protein, 4 aa, Staphylococcus aureus
DEIQ

SEQ ID NO: 1563754 - protein, 7 aa, Staphylococcus aureus
DFPSKDL

SEQ ID NO: 1563755 - protein, 6 aa, Staphylococcus aureus
DGLKRG

SEQ ID NO: 1563756 - protein, 36 aa, Staphylococcus aureus
DKLNGQKTNTKTSANNNQKKATSKLNKGRATNNNYS

SEQ ID NO: 1563757 - protein, 6 aa, Staphylococcus aureus
DNAPAL

SEQ ID NO: 1563758 - protein, 5 aa, Staphylococcus aureus
DNNNS

SEQ ID NO: 1563759 - protein, 8 aa, Staphylococcus aureus
DPKTNTEK

SEQ ID NO: 1563760 - protein, 11 aa, Staphylococcus aureus
DQAKSNAIKSI

SEQ ID NO: 1563761 - protein, 5 aa, Staphylococcus aureus
DRKTQ

SEQ ID NO: 1563762 - protein, 20 aa, Staphylococcus aureus
DSYGVATTYTSSSTADNAAK

SEQ ID NO: 1563763 - protein, 6 aa, Staphylococcus aureus
DTKNKV

SEQ ID NO: 1563764 - protein, 24 aa, Staphylococcus aureus
DTSKLSDSYYADPNDSNLKEVTDQ

SEQ ID NO: 1563765 - protein, 8 aa, Staphylococcus aureus
EAPRPTKI

SEQ ID NO: 1563766 - protein, 8 aa, Staphylococcus aureus
EESEDAPY

SEQ ID NO: 1563767 - protein, 8 aa, Staphylococcus aureus
EHANNTID

SEQ ID NO: 1563768 - protein, 9 aa, Staphylococcus aureus
EHNKSHVKD

SEQ ID NO: 1563769 - protein, 14 aa, Staphylococcus aureus
EKESRKRYSPNSTY

SEQ ID NO: 1563770 - protein, 7 aa, Staphylococcus aureus
EKYTKDL

SEQ ID NO: 1563771 - protein, 6 aa, Staphylococcus aureus
ENNTVE

SEQ ID NO: 1563772 - protein, 10 aa, Staphylococcus aureus
EQAQKSGIKK

SEQ ID NO: 1563773 - protein, 7 aa, Staphylococcus aureus
ERPDDVA

SEQ ID NO: 1563774 - protein, 5 aa, Staphylococcus aureus
EVNRT

SEQ ID NO: 1563775 - protein, 16 aa, Staphylococcus aureus
EYKEDTAKGTMSGQYD

SEQ ID NO: 1563776 - protein, 6 aa, Staphylococcus aureus
FFTNED

SEQ ID NO: 1563777 - protein, 13 aa, Staphylococcus aureus
FKQTNNKSKHDAI

SEQ ID NO: 1563778 - protein, 11 aa, Staphylococcus aureus
FKVGDDDKNIK

SEQ ID NO: 1563779 - protein, 9 aa, Staphylococcus aureus
FSTEQQDET

SEQ ID NO: 1563780 - protein, 13 aa, Staphylococcus aureus
FTSTLDKKELQEM

SEQ ID NO: 1563781 - protein, 5 aa, Staphylococcus aureus
GAHAP

SEQ ID NO: 1563782 - protein, 8 aa, Staphylococcus aureus
GGKENLEA

SEQ ID NO: 1563783 - protein, 8 aa, Staphylococcus aureus
GKEPKKQG

SEQ ID NO: 1563784 - protein, 5 aa, Staphylococcus aureus
GNVRD

SEQ ID NO: 1563785 - protein, 5 aa, Staphylococcus aureus
GPVSA

SEQ ID NO: 1563786 - protein, 13 aa, Staphylococcus aureus
GQSSTGKSTAASL

SEQ ID NO: 1563787 - protein, 4 aa, Staphylococcus aureus
GSIF

SEQ ID NO: 1563788 - protein, 4 aa, Staphylococcus aureus
GYAT

SEQ ID NO: 1563789 - protein, 4 aa, Staphylococcus aureus
HETE

SEQ ID NO: 1563790 - protein, 5 aa, Staphylococcus aureus
HFEGY

SEQ ID NO: 1563791 - protein, 21 aa, Staphylococcus aureus
HIDGQNSPEKPTDKNTDNKQL

SEQ ID NO: 1563792 - protein, 4 aa, Staphylococcus aureus
HLED

SEQ ID NO: 1563793 - protein, 6 aa, Staphylococcus aureus
HPSNQP

SEQ ID NO: 1563794 - protein, 16 aa, Staphylococcus aureus
HVEGDNNQQRRSKPRR

SEQ ID NO: 1563795 - protein, 28 aa, Staphylococcus aureus
IDDENATKQTQKYRDAEQSKKTAYDQAV

SEQ ID NO: 1563796 - protein, 10 aa, Staphylococcus aureus
IDGTKDPDVI

SEQ ID NO: 1563797 - protein, 7 aa, Staphylococcus aureus
IFGSNSG

SEQ ID NO: 1563798 - protein, 17 aa, Staphylococcus aureus
IPEEEREQLHTDSEDGI

SEQ ID NO: 1563799 - protein, 14 aa, Staphylococcus aureus
ISELSKHNQAKQMN

SEQ ID NO: 1563800 - protein, 15 aa, Staphylococcus aureus
ISNWGKAGKNPREEF

SEQ ID NO: 1563801 - protein, 9 aa, Staphylococcus aureus
ISSGAGSVR

SEQ ID NO: 1563802 - protein, 13 aa, Staphylococcus aureus
KAKEDAKQDVDKQ

SEQ ID NO: 1563803 - protein, 6 aa, Staphylococcus aureus
KALNRA

SEQ ID NO: 1563804 - protein, 22 aa, Staphylococcus aureus
KATNKVDKSIETRSEAISSISS

SEQ ID NO: 1563805 - protein, 4 aa, Staphylococcus aureus
KDAL

SEQ ID NO: 1563806 - protein, 19 aa, Staphylococcus aureus
KDDNEVPNNAVKAKDSKIV

SEQ ID NO: 1563807 - protein, 6 aa, Staphylococcus aureus
KDGEEV

SEQ ID NO: 1563808 - protein, 4 aa, Staphylococcus aureus
KETL

SEQ ID NO: 1563809 - protein, 11 aa, Staphylococcus aureus
KIKHKDTDSTM

SEQ ID NO: 1563810 - protein, 9 aa, Staphylococcus aureus
KKDELPQSV

SEQ ID NO: 1563811 - protein, 8 aa, Staphylococcus aureus
KKDNNYNN

SEQ ID NO: 1563812 - protein, 4 aa, Staphylococcus aureus
KKEP

SEQ ID NO: 1563813 - protein, 6 aa, Staphylococcus aureus
KKSQFA

SEQ ID NO: 1563814 - protein, 33 aa, Staphylococcus aureus
KNANGTSNNSAVNPSIKANDIHTKSNKQMAKQQ

SEQ ID NO: 1563815 - protein, 17 aa, Staphylococcus aureus
KNKYGTKQYDKTFKDDA

SEQ ID NO: 1563816 - protein, 6 aa, Staphylococcus aureus
KQGYNV

SEQ ID NO: 1563817 - protein, 5 aa, Staphylococcus aureus
KQKEP

SEQ ID NO: 1563818 - protein, 10 aa, Staphylococcus aureus
KQLSQNGGNV

SEQ ID NO: 1563819 - protein, 14 aa, Staphylococcus aureus
KQTGPNTAKTAVEQ

SEQ ID NO: 1563820 - protein, 7 aa, Staphylococcus aureus
KRLGSGY

SEQ ID NO: 1563821 - protein, 6 aa, Staphylococcus aureus
KTGPMG

SEQ ID NO: 1563822 - protein, 5 aa, Staphylococcus aureus
KTIHT

SEQ ID NO: 1563823 - protein, 6 aa, Staphylococcus aureus
KTNDGS

SEQ ID NO: 1563824 - protein, 45 aa, Staphylococcus aureus
KVQHDDAKEVPSKHQNQENNQDQLKKDIDDKKDSQKSDIKERRTS

SEQ ID NO: 1563825 - protein, 14 aa, Staphylococcus aureus
KVQQRNSEETNRGC

SEQ ID NO: 1563826 - protein, 7 aa, Staphylococcus aureus
KYVEEQS

SEQ ID NO: 1563827 - protein, 7 aa, Staphylococcus aureus
LFNNNGK

SEQ ID NO: 1563828 - protein, 10 aa, Staphylococcus aureus
LNEGEANKYE

SEQ ID NO: 1563829 - protein, 5 aa, Staphylococcus aureus
LPNES

SEQ ID NO: 1563830 - protein, 7 aa, Staphylococcus aureus
LQGSDQV

SEQ ID NO: 1563831 - protein, 13 aa, Staphylococcus aureus
LTKEGKVNYRTKK

SEQ ID NO: 1563832 - protein, 28 aa, Staphylococcus aureus
MNGNQSNTVSVTGTLTEGSNLAGGQPTV

SEQ ID NO: 1563833 - protein, 6 aa, Staphylococcus aureus
MSRNEA

SEQ ID NO: 1563834 - protein, 11 aa, Staphylococcus aureus
NDATELNTNDQ

SEQ ID NO: 1563835 - protein, 5 aa, Staphylococcus aureus
NEVER

SEQ ID NO: 1563836 - protein, 8 aa, Staphylococcus aureus
NFGSPKDI

SEQ ID NO: 1563837 - protein, 6 aa, Staphylococcus aureus
NGFDDP

SEQ ID NO: 1563838 - protein, 8 aa, Staphylococcus aureus
NGNKEEIA

SEQ ID NO: 1563839 - protein, 6 aa, Staphylococcus aureus
NKGRMK

SEQ ID NO: 1563840 - protein, 9 aa, Staphylococcus aureus
NKNNKESKL

SEQ ID NO: 1563841 - protein, 25 aa, Staphylococcus aureus
NLDALDSKTNNSPTYISKSNIKNSN

SEQ ID NO: 1563842 - protein, 7 aa, Staphylococcus aureus
NNTSIAN

SEQ ID NO: 1563843 - protein, 4 aa, Staphylococcus aureus
NPQA

SEQ ID NO: 1563844 - protein, 7 aa, Staphylococcus aureus
NQQGAFQ

SEQ ID NO: 1563845 - protein, 20 aa, Staphylococcus aureus
NRTAEERQNIDTNQDSEYNS

SEQ ID NO: 1563846 - protein, 15 aa, Staphylococcus aureus
NSGQSILKNGKTRID

SEQ ID NO: 1563847 - protein, 10 aa, Staphylococcus aureus
NSSKVQTGDS

SEQ ID NO: 1563848 - protein, 8 aa, Staphylococcus aureus
NTRPSNKQ

SEQ ID NO: 1563849 - protein, 5 aa, Staphylococcus aureus
NWEPG

SEQ ID NO: 1563850 - protein, 24 aa, Staphylococcus aureus
PGVSNSYTNVNGSIETFNKESNKF

SEQ ID NO: 1563851 - protein, 4 aa, Staphylococcus aureus
PKGA

SEQ ID NO: 1563852 - protein, 8 aa, Staphylococcus aureus
PNTADEEK

SEQ ID NO: 1563853 - protein, 13 aa, Staphylococcus aureus
PNVPRSKVNKKRE

SEQ ID NO: 1563854 - protein, 10 aa, Staphylococcus aureus
PPSKNNLTTY

SEQ ID NO: 1563855 - protein, 4 aa, Staphylococcus aureus
PQYR

SEQ ID NO: 1563856 - protein, 17 aa, Staphylococcus aureus
PTVKETPNAKSWAENEL

SEQ ID NO: 1563857 - protein, 5 aa, Staphylococcus aureus
QHQEQ

SEQ ID NO: 1563858 - protein, 7 aa, Staphylococcus aureus
QRPDADV

SEQ ID NO: 1563859 - protein, 24 aa, Staphylococcus aureus
QTSGIPSDITSEDSVTNKNNRLND

SEQ ID NO: 1563860 - protein, 4 aa, Staphylococcus aureus
SEND

SEQ ID NO: 1563861 - protein, 11 aa, Staphylococcus aureus
SGNSAGKGNEA

SEQ ID NO: 1563862 - protein, 6 aa, Staphylococcus aureus
SHPKAR

SEQ ID NO: 1563863 - protein, 12 aa, Staphylococcus aureus
SIQQTANELNTA

SEQ ID NO: 1563864 - protein, 10 aa, Staphylococcus aureus
SKITDSQRKV

SEQ ID NO: 1563865 - protein, 9 aa, Staphylococcus aureus
SQAGAVAKG

SEQ ID NO: 1563866 - protein, 9 aa, Staphylococcus aureus
SSDKKAPKF

SEQ ID NO: 1563867 - protein, 4 aa, Staphylococcus aureus
SSQA

SEQ ID NO: 1563868 - protein, 11 aa, Staphylococcus aureus
STDRPGKTFSY

SEQ ID NO: 1563869 - protein, 7 aa, Staphylococcus aureus
SVGTANM

SEQ ID NO: 1563870 - protein, 14 aa, Staphylococcus aureus
SYLGNGSYLGPDYT

SEQ ID NO: 1563871 - protein, 9 aa, Staphylococcus aureus
TAVDSFKAS

SEQ ID NO: 1563872 - protein, 8 aa, Staphylococcus aureus
TDEKDEAV

SEQ ID NO: 1563873 - protein, 4 aa, Staphylococcus aureus
TEGA

SEQ ID NO: 1563874 - protein, 23 aa, Staphylococcus aureus
TEGQGRQRSNVHGEVKTPKNWGT

SEQ ID NO: 1563875 - protein, 8 aa, Staphylococcus aureus
TEQDIENA

SEQ ID NO: 1563876 - protein, 24 aa, Staphylococcus aureus
TKEPLKSKEEKKVYDQAKQSLEKK

SEQ ID NO: 1563877 - protein, 26 aa, Staphylococcus aureus
TPAGYTPTVKNTTAEDKDSNGLTTTG

SEQ ID NO: 1563878 - protein, 9 aa, Staphylococcus aureus
TQANTALNG

SEQ ID NO: 1563879 - protein, 51 aa, Staphylococcus aureus
TQVTSTKNALDGTHNLTQAKQTATNAIDGATNLNKAQKDALKAQVTSAQRV

SEQ ID NO: 1563880 - protein, 11 aa, Staphylococcus aureus
TSNSCRKSSFR

SEQ ID NO: 1563881 - protein, 34 aa, Staphylococcus aureus
TTAQKDKLKQQVQQAQNVAGVDTVKSSANTLNGA

SEQ ID NO: 1563882 - protein, 9 aa, Staphylococcus aureus
TTNPKADIP

SEQ ID NO: 1563883 - protein, 13 aa, Staphylococcus aureus
VDESQSSLHHTEK

SEQ ID NO: 1563884 - protein, 9 aa, Staphylococcus aureus
VERQKLSTD

SEQ ID NO: 1563885 - protein, 10 aa, Staphylococcus aureus
VNNPKQVGLN

SEQ ID NO: 1563886 - protein, 17 aa, Staphylococcus aureus
VNTYGVSTARKVPEIKN

SEQ ID NO: 1563887 - protein, 7 aa, Staphylococcus aureus
VQANHDK

SEQ ID NO: 1563888 - protein, 4 aa, Staphylococcus aureus
VTKD

SEQ ID NO: 1563889 - protein, 8 aa, Staphylococcus aureus
YANNAEPV

SEQ ID NO: 1563890 - protein, 6 aa, Staphylococcus aureus
YNKKTV

SEQ ID NO: 1563891 - protein, 11 aa, Staphylococcus aureus
YNKNTKETMPF

SEQ ID NO: 1563892 - protein, 5 aa, Staphylococcus aureus
YPERA

SEQ ID NO: 1563893 - protein, 17 aa, Staphylococcus aureus
YTGVSSHTGPLGYENPD

SEQ ID NO: 1563894 - protein, 15 aa, Staphylococcus aureus
YYKKQNSDKLSKAAI

SEQ ID NO: 1563895 - protein, 7 aa, Staphylococcus aureus
AAGGFGD

SEQ ID NO: 1563896 - protein, 13 aa, Staphylococcus aureus
AAKYGHERYGKTY

SEQ ID NO: 1563897 - protein, 5 aa, Staphylococcus aureus
ADGLA

SEQ ID NO: 1563898 - protein, 10 aa, Staphylococcus aureus
AGDRQGFAGG

SEQ ID NO: 1563899 - protein, 10 aa, Staphylococcus aureus
AKLNNPKDAF

SEQ ID NO: 1563900 - protein, 10 aa, Staphylococcus aureus
AKTNGKHDID

SEQ ID NO: 1563901 - protein, 6 aa, Staphylococcus aureus
AKYTPT

SEQ ID NO: 1563902 - protein, 9 aa, Staphylococcus aureus
ANNGNTEVI

SEQ ID NO: 1563903 - protein, 10 aa, Staphylococcus aureus
ANSAAGENSI

SEQ ID NO: 1563904 - protein, 9 aa, Staphylococcus aureus
ASKQANKPV

SEQ ID NO: 1563905 - protein, 32 aa, Staphylococcus aureus
DANGVNHGGSEMVQNKTGHMNQNTHMNQQPHM

SEQ ID NO: 1563906 - protein, 45 aa, Staphylococcus aureus
DGTITGYKKNVDDLAKQYGKVSQEQGENSAEAQKLRQEYNKQANE

SEQ ID NO: 1563907 - protein, 7 aa, Staphylococcus aureus
DKEIEEI

SEQ ID NO: 1563908 - protein, 8 aa, Staphylococcus aureus
DKENINGQ

SEQ ID NO: 1563909 - protein, 31 aa, Staphylococcus aureus
DKHKQNADSSETVGYQSQSSASHRSTEKRNM

SEQ ID NO: 1563910 - protein, 7 aa, Staphylococcus aureus
DKNGELN

SEQ ID NO: 1563911 - protein, 5 aa, Staphylococcus aureus
DKSNF

SEQ ID NO: 1563912 - protein, 14 aa, Staphylococcus aureus
DKYPAQQAGLQKGD

SEQ ID NO: 1563913 - protein, 7 aa, Staphylococcus aureus
DPARRND

SEQ ID NO: 1563914 - protein, 8 aa, Staphylococcus aureus
DQEDKIAK

SEQ ID NO: 1563915 - protein, 8 aa, Staphylococcus aureus
DSKDKYDL

SEQ ID NO: 1563916 - protein, 4 aa, Staphylococcus aureus
DSKL

SEQ ID NO: 1563917 - protein, 17 aa, Staphylococcus aureus
DTNKNGVQELGEKGVGN

SEQ ID NO: 1563918 - protein, 5 aa, Staphylococcus aureus
DYQEI

SEQ ID NO: 1563919 - protein, 7 aa, Staphylococcus aureus
EAGGTRI

SEQ ID NO: 1563920 - protein, 7 aa, Staphylococcus aureus
EARILKD

SEQ ID NO: 1563921 - protein, 17 aa, Staphylococcus aureus
EDKGTTIQDKNVNIGKK

SEQ ID NO: 1563922 - protein, 4 aa, Staphylococcus aureus
EGDQ

SEQ ID NO: 1563923 - protein, 6 aa, Staphylococcus aureus
ELSSAS

SEQ ID NO: 1563924 - protein, 8 aa, Staphylococcus aureus
ESEAGTSF

SEQ ID NO: 1563925 - protein, 4 aa, Staphylococcus aureus
ESHS

SEQ ID NO: 1563926 - protein, 40 aa, Staphylococcus aureus
ETPSGYTPTQVGSGTDEGIDSNGTSTTGVIKDKDNDTIDS

SEQ ID NO: 1563927 - protein, 28 aa, Staphylococcus aureus
ETPSGYTPTSVTSGNDTEKDSNGLTTTG

SEQ ID NO: 1563928 - protein, 16 aa, Staphylococcus aureus
FSDNSKSQIERQQTIE

SEQ ID NO: 1563929 - protein, 10 aa, Staphylococcus aureus
FSKGEKSDLS

SEQ ID NO: 1563930 - protein, 4 aa, Staphylococcus aureus
GDKV

SEQ ID NO: 1563931 - protein, 20 aa, Staphylococcus aureus
GFKKTAADQFSDAGAGKQEA

SEQ ID NO: 1563932 - protein, 5 aa, Staphylococcus aureus
GHIPG

SEQ ID NO: 1563933 - protein, 9 aa, Staphylococcus aureus
GKKQDEPYL

SEQ ID NO: 1563934 - protein, 4 aa, Staphylococcus aureus
GNSG

SEQ ID NO: 1563935 - protein, 8 aa, Staphylococcus aureus
GSRSSAIK

SEQ ID NO: 1563936 - protein, 8 aa, Staphylococcus aureus
GTFSTGGQ

SEQ ID NO: 1563937 - protein, 6 aa, Staphylococcus aureus
HGAHAK

SEQ ID NO: 1563938 - protein, 10 aa, Staphylococcus aureus
HGRGISKKDM

SEQ ID NO: 1563939 - protein, 4 aa, Staphylococcus aureus
HHNN

SEQ ID NO: 1563940 - protein, 5 aa, Staphylococcus aureus
HPATA

SEQ ID NO: 1563941 - protein, 21 aa, Staphylococcus aureus
IDLPNETKGQIEPLTNNPGNY

SEQ ID NO: 1563942 - protein, 11 aa, Staphylococcus aureus
IDNNQLSDADA

SEQ ID NO: 1563943 - protein, 7 aa, Staphylococcus aureus
ISESTYD

SEQ ID NO: 1563944 - protein, 5 aa, Staphylococcus aureus
KAASD

SEQ ID NO: 1563945 - protein, 17 aa, Staphylococcus aureus
KALPETGSENNGSNNAT

SEQ ID NO: 1563946 - protein, 14 aa, Staphylococcus aureus
KDSSFKSKAPQIKP

SEQ ID NO: 1563947 - protein, 5 aa, Staphylococcus aureus
KEAAI

SEQ ID NO: 1563948 - protein, 15 aa, Staphylococcus aureus
KKHASDNQQAISSNQ

SEQ ID NO: 1563949 - protein, 4 aa, Staphylococcus aureus
KKHS

SEQ ID NO: 1563950 - protein, 4 aa, Staphylococcus aureus
KPAK

SEQ ID NO: 1563951 - protein, 10 aa, Staphylococcus aureus
KQKKERQQQI

SEQ ID NO: 1563952 - protein, 4 aa, Staphylococcus aureus
KREI

SEQ ID NO: 1563953 - protein, 18 aa, Staphylococcus aureus
KRQSKTVISDEEKQIREV

SEQ ID NO: 1563954 - protein, 6 aa, Staphylococcus aureus
KSENNK

SEQ ID NO: 1563955 - protein, 9 aa, Staphylococcus aureus
KTGETSNRL

SEQ ID NO: 1563956 - protein, 12 aa, Staphylococcus aureus
KVKDNKGTASVI

SEQ ID NO: 1563957 - protein, 9 aa, Staphylococcus aureus
LEKTTTEFE

SEQ ID NO: 1563958 - protein, 9 aa, Staphylococcus aureus
LKASGANKI

SEQ ID NO: 1563959 - protein, 10 aa, Staphylococcus aureus
LKTYNSAGSD

SEQ ID NO: 1563960 - protein, 7 aa, Staphylococcus aureus
LNQTKKD

SEQ ID NO: 1563961 - protein, 12 aa, Staphylococcus aureus
LPVTKDGNFYQT

SEQ ID NO: 1563962 - protein, 6 aa, Staphylococcus aureus
LSEHNS

SEQ ID NO: 1563963 - protein, 4 aa, Staphylococcus aureus
MGGQ

SEQ ID NO: 1563964 - protein, 39 aa, Staphylococcus aureus
MKKSQKYEVKAGLTPNKLDEKTEKKGDKLAEKNRKEIAK

SEQ ID NO: 1563965 - protein, 9 aa, Staphylococcus aureus
MKSTENGDF

SEQ ID NO: 1563966 - protein, 9 aa, Staphylococcus aureus
NAKTASLSP

SEQ ID NO: 1563967 - protein, 16 aa, Staphylococcus aureus
NANAENNKPEGVNENS

SEQ ID NO: 1563968 - protein, 4 aa, Staphylococcus aureus
NAPI

SEQ ID NO: 1563969 - protein, 6 aa, Staphylococcus aureus
NDDHTH

SEQ ID NO: 1563970 - protein, 6 aa, Staphylococcus aureus
NELEKY

SEQ ID NO: 1563971 - protein, 30 aa, Staphylococcus aureus
NGINDETQTKQTQKYLDAEPSKKSAYDQAV

SEQ ID NO: 1563972 - protein, 12 aa, Staphylococcus aureus
NGRNAKRNSEYY

SEQ ID NO: 1563973 - protein, 103 aa, Staphylococcus aureus
NHNNGTKENKIANTNKNNADESKDKDTSKDASKDKSKSTDSDKSKDDQDKATKDESDNDQNNANQANNQAQNNQNQQQANQNQQQQQQRQGGGQRHTVNGQEN

SEQ ID NO: 1563974 - protein, 19 aa, Staphylococcus aureus
NKKAKATAQKLEASSNNNH

SEQ ID NO: 1563975 - protein, 7 aa, Staphylococcus aureus
NKVNGRK

SEQ ID NO: 1563976 - protein, 18 aa, Staphylococcus aureus
NNAQKQQLQSQITQSSDI

SEQ ID NO: 1563977 - protein, 5 aa, Staphylococcus aureus
NNEAM

SEQ ID NO: 1563978 - protein, 17 aa, Staphylococcus aureus
NNTNTKVGEAVTKEDGS

SEQ ID NO: 1563979 - protein, 6 aa, Staphylococcus aureus
NPEDIK

SEQ ID NO: 1563980 - protein, 31 aa, Staphylococcus aureus
NQEAKAAESTNKELNEATTSASDNQSSDKVD

SEQ ID NO: 1563981 - protein, 8 aa, Staphylococcus aureus
NSKNIESM

SEQ ID NO: 1563982 - protein, 15 aa, Staphylococcus aureus
NSTYPINEQSTYKRH

SEQ ID NO: 1563983 - protein, 9 aa, Staphylococcus aureus
NTKDDVKAT

SEQ ID NO: 1563984 - protein, 10 aa, Staphylococcus aureus
PAATKKQPIP

SEQ ID NO: 1563985 - protein, 17 aa, Staphylococcus aureus
PEEHGQAQGPVEEITEN

SEQ ID NO: 1563986 - protein, 17 aa, Staphylococcus aureus
PEEKAAQITKLQQQGKK

SEQ ID NO: 1563987 - protein, 13 aa, Staphylococcus aureus
PHQRDETNALAEQ

SEQ ID NO: 1563988 - protein, 22 aa, Staphylococcus aureus
PKGSAHEKQLPKTGTNQSSSPA

SEQ ID NO: 1563989 - protein, 22 aa, Staphylococcus aureus
PKGYEVTPSKQGNNEELDSNGL

SEQ ID NO: 1563990 - protein, 5 aa, Staphylococcus aureus
PKSFD

SEQ ID NO: 1563991 - protein, 21 aa, Staphylococcus aureus
PQGATNVSKHQDVHGQDDARS

SEQ ID NO: 1563992 - protein, 6 aa, Staphylococcus aureus
PQKGTI

SEQ ID NO: 1563993 - protein, 22 aa, Staphylococcus aureus
PTLNAPDISSITGNLSNLGGNI

SEQ ID NO: 1563994 - protein, 9 aa, Staphylococcus aureus
QEENQERKQ

SEQ ID NO: 1563995 - protein, 11 aa, Staphylococcus aureus
QLPKTPKEELK

SEQ ID NO: 1563996 - protein, 28 aa, Staphylococcus aureus
QNVNSTKTALNGDAKLNEAKAAAKQTLG

SEQ ID NO: 1563997 - protein, 22 aa, Staphylococcus aureus
QQSTTVAEAQGNEQKANNVDAA

SEQ ID NO: 1563998 - protein, 18 aa, Staphylococcus aureus
RIETDGDDKIEHRQTSAQ

SEQ ID NO: 1563999 - protein, 23 aa, Staphylococcus aureus
RLQLGNPKNKTNTPLISESSDRH

SEQ ID NO: 1564000 - protein, 5 aa, Staphylococcus aureus
RPKLR

SEQ ID NO: 1564001 - protein, 9 aa, Staphylococcus aureus
RPPDKNNRY

SEQ ID NO: 1564002 - protein, 7 aa, Staphylococcus aureus
RREERAR

SEQ ID NO: 1564003 - protein, 27 aa, Staphylococcus aureus
RRKEDEEEELEIRDNSKDKKKGSIEGT

SEQ ID NO: 1564004 - protein, 5 aa, Staphylococcus aureus
RTQER

SEQ ID NO: 1564005 - protein, 8 aa, Staphylococcus aureus
RYSEKEDQ

SEQ ID NO: 1564006 - protein, 47 aa, Staphylococcus aureus
SATNNPEMNPDTINQKASQVNSAKSALNGDEKLAAAKQTAKSDIGRL

SEQ ID NO: 1564007 - protein, 17 aa, Staphylococcus aureus
SDHSKPSSNSDGQSNSH

SEQ ID NO: 1564008 - protein, 4 aa, Staphylococcus aureus
SDKM

SEQ ID NO: 1564009 - protein, 8 aa, Staphylococcus aureus
SDLPSNDE

SEQ ID NO: 1564010 - protein, 7 aa, Staphylococcus aureus
SDLTKQA

SEQ ID NO: 1564011 - protein, 16 aa, Staphylococcus aureus
SFKSSVPKSRIDGKVG

SEQ ID NO: 1564012 - protein, 9 aa, Staphylococcus aureus
SIEEGTKEL

SEQ ID NO: 1564013 - protein, 9 aa, Staphylococcus aureus
SKNQGGTPY

SEQ ID NO: 1564014 - protein, 6 aa, Staphylococcus aureus
SNPKEI

SEQ ID NO: 1564015 - protein, 6 aa, Staphylococcus aureus
SSQINT

SEQ ID NO: 1564016 - protein, 13 aa, Staphylococcus aureus
STENKRHQNAQAK

SEQ ID NO: 1564017 - protein, 8 aa, Staphylococcus aureus
STIGKGTT

SEQ ID NO: 1564018 - protein, 13 aa, Staphylococcus aureus
TAINDKSGTLASQ

SEQ ID NO: 1564019 - protein, 8 aa, Staphylococcus aureus
TKKEYNDA

SEQ ID NO: 1564020 - protein, 6 aa, Staphylococcus aureus
TNSHTV

SEQ ID NO: 1564021 - protein, 5 aa, Staphylococcus aureus
TQKDM

SEQ ID NO: 1564022 - protein, 4 aa, Staphylococcus aureus
TREG

SEQ ID NO: 1564023 - protein, 6 aa, Staphylococcus aureus
TRTAGF

SEQ ID NO: 1564024 - protein, 7 aa, Staphylococcus aureus
TVKESPF

SEQ ID NO: 1564025 - protein, 5 aa, Staphylococcus aureus
TYESV

SEQ ID NO: 1564026 - protein, 13 aa, Staphylococcus aureus
TYGSNKSEPLITG

SEQ ID NO: 1564027 - protein, 11 aa, Staphylococcus aureus
VGPSGAGKSTL

SEQ ID NO: 1564028 - protein, 9 aa, Staphylococcus aureus
VPKDSPKLL

SEQ ID NO: 1564029 - protein, 11 aa, Staphylococcus aureus
VSPSHQKAKNF

SEQ ID NO: 1564030 - protein, 7 aa, Staphylococcus aureus
YALGGPE

SEQ ID NO: 1564031 - protein, 31 aa, Staphylococcus aureus
YANTSDTNKFKDVTKEMNGKLSVQDNGSYSL

SEQ ID NO: 1564032 - protein, 8 aa, Staphylococcus aureus
YDPKKDSY

SEQ ID NO: 1564033 - protein, 7 aa, Staphylococcus aureus
YDSDKDY

SEQ ID NO: 1564034 - protein, 9 aa, Staphylococcus aureus
YNKETGNSI

SEQ ID NO: 1564035 - protein, 5 aa, Staphylococcus aureus
YSENY

SEQ ID NO: 1564036 - protein, 10 aa, Staphylococcus aureus
AAQNAAKQHL

SEQ ID NO: 1564037 - protein, 16 aa, Staphylococcus aureus
AAVNGHKQTAESLNTA

SEQ ID NO: 1564038 - protein, 47 aa, Staphylococcus aureus
AEKDNTKRSVNYTDADQPKQQAYDTAVTQAEAITNANGSNANETQVQ

SEQ ID NO: 1564039 - protein, 11 aa, Staphylococcus aureus
AGHGYKGAQAA

SEQ ID NO: 1564040 - protein, 26 aa, Staphylococcus aureus
AHADTTSMNVPNKQSQNVQNHRPYGG

SEQ ID NO: 1564041 - protein, 6 aa, Staphylococcus aureus
AIGPTA

SEQ ID NO: 1564042 - protein, 9 aa, Staphylococcus aureus
AKPEVEKIQ

SEQ ID NO: 1564043 - protein, 14 aa, Staphylococcus aureus
AKSGYNNPLNPTHQ

SEQ ID NO: 1564044 - protein, 10 aa, Staphylococcus aureus
ANDNKTFGEA

SEQ ID NO: 1564045 - protein, 10 aa, Staphylococcus aureus
AREEWRKNDG

SEQ ID NO: 1564046 - protein, 15 aa, Staphylococcus aureus
ASKDLTDKEKQEAIS

SEQ ID NO: 1564047 - protein, 12 aa, Staphylococcus aureus
ATLTPEQKEAAI

SEQ ID NO: 1564048 - protein, 4 aa, Staphylococcus aureus
ATNP

SEQ ID NO: 1564049 - protein, 4 aa, Staphylococcus aureus
ATQR

SEQ ID NO: 1564050 - protein, 11 aa, Staphylococcus aureus
ATTSRKTSETF

SEQ ID NO: 1564051 - protein, 34 aa, Staphylococcus aureus
AVNKTAEKAVDSVGNAIGDATKSISNHINPMKWS

SEQ ID NO: 1564052 - protein, 24 aa, Staphylococcus aureus
AVNQAKDNLHGDQKLADDKQHAVT

SEQ ID NO: 1564053 - protein, 24 aa, Staphylococcus aureus
AVTAAKKALNGEERLNNRKAEALQ

SEQ ID NO: 1564054 - protein, 10 aa, Staphylococcus aureus
DDKVADTKGQ

SEQ ID NO: 1564055 - protein, 6 aa, Staphylococcus aureus
DDSTQF

SEQ ID NO: 1564056 - protein, 4 aa, Staphylococcus aureus
DEGI

SEQ ID NO: 1564057 - protein, 5 aa, Staphylococcus aureus
DENDL

SEQ ID NO: 1564058 - protein, 7 aa, Staphylococcus aureus
DGSRFQD

SEQ ID NO: 1564059 - protein, 8 aa, Staphylococcus aureus
DGSTDETA

SEQ ID NO: 1564060 - protein, 82 aa, Staphylococcus aureus
DKATTDKQQVTPTKEAAHQFGEEAATNVSASAQGTADEINNKVTSNAFSNKPSTAVSTKVNETHDVDTQQASTQKPTQSATF

SEQ ID NO: 1564061 - protein, 11 aa, Staphylococcus aureus
DKKDDPQGLQQ

SEQ ID NO: 1564062 - protein, 14 aa, Staphylococcus aureus
DLQEANTNQTSIQK

SEQ ID NO: 1564063 - protein, 6 aa, Staphylococcus aureus
DNHSSK

SEQ ID NO: 1564064 - protein, 10 aa, Staphylococcus aureus
DNKAASYKQS

SEQ ID NO: 1564065 - protein, 14 aa, Staphylococcus aureus
DNSTNTSDGKFHGQ

SEQ ID NO: 1564066 - protein, 8 aa, Staphylococcus aureus
DSSDYKIG

SEQ ID NO: 1564067 - protein, 27 aa, Staphylococcus aureus
DYTSRNFENKDTALKQSTSENNSLSKL

SEQ ID NO: 1564068 - protein, 8 aa, Staphylococcus aureus
EAEVNDGL

SEQ ID NO: 1564069 - protein, 5 aa, Staphylococcus aureus
EAIRA

SEQ ID NO: 1564070 - protein, 7 aa, Staphylococcus aureus
EANNNEI

SEQ ID NO: 1564071 - protein, 8 aa, Staphylococcus aureus
EASSEIDD

SEQ ID NO: 1564072 - protein, 12 aa, Staphylococcus aureus
EATESKGTQLKA

SEQ ID NO: 1564073 - protein, 4 aa, Staphylococcus aureus
EDTT

SEQ ID NO: 1564074 - protein, 8 aa, Staphylococcus aureus
EGQTYNER

SEQ ID NO: 1564075 - protein, 21 aa, Staphylococcus aureus
EKGKDTEAIQTSNDSLKEAKD

SEQ ID NO: 1564076 - protein, 7 aa, Staphylococcus aureus
EKQNGWR

SEQ ID NO: 1564077 - protein, 4 aa, Staphylococcus aureus
EKRF

SEQ ID NO: 1564078 - protein, 7 aa, Staphylococcus aureus
ERTTGTL

SEQ ID NO: 1564079 - protein, 6 aa, Staphylococcus aureus
ERYQTQ

SEQ ID NO: 1564080 - protein, 5 aa, Staphylococcus aureus
EVGTG

SEQ ID NO: 1564081 - protein, 12 aa, Staphylococcus aureus
EVSEQDLPNCST

SEQ ID NO: 1564082 - protein, 86 aa, Staphylococcus aureus
FKKEESNDENNGSASSHANDNNIDDSTDSNIENEDYRYNQEIDDQNESNGIAVGNEQPQSAPKEQNSDSNDEETVTKKERKSKVTQ

SEQ ID NO: 1564083 - protein, 13 aa, Staphylococcus aureus
FKYTEKSTHSYKQ

SEQ ID NO: 1564084 - protein, 8 aa, Staphylococcus aureus
FSGSGDGF

SEQ ID NO: 1564085 - protein, 14 aa, Staphylococcus aureus
FSKSPPSGTMVKPG

SEQ ID NO: 1564086 - protein, 4 aa, Staphylococcus aureus
FSNN

SEQ ID NO: 1564087 - protein, 10 aa, Staphylococcus aureus
GDIKGSSVGY

SEQ ID NO: 1564088 - protein, 9 aa, Staphylococcus aureus
GEPESSKAM

SEQ ID NO: 1564089 - protein, 11 aa, Staphylococcus aureus
GGAGTDTAIET

SEQ ID NO: 1564090 - protein, 11 aa, Staphylococcus aureus
GISDKQGEKVS

SEQ ID NO: 1564091 - protein, 10 aa, Staphylococcus aureus
GKEYGEVTDE

SEQ ID NO: 1564092 - protein, 11 aa, Staphylococcus aureus
GKTSSLSGSQG

SEQ ID NO: 1564093 - protein, 5 aa, Staphylococcus aureus
GMTED

SEQ ID NO: 1564094 - protein, 7 aa, Staphylococcus aureus
GMYNKRE

SEQ ID NO: 1564095 - protein, 7 aa, Staphylococcus aureus
GNAEEYL

SEQ ID NO: 1564096 - protein, 6 aa, Staphylococcus aureus
GNAREA

SEQ ID NO: 1564097 - protein, 7 aa, Staphylococcus aureus
GNSDSTY

SEQ ID NO: 1564098 - protein, 4 aa, Staphylococcus aureus
GPTT

SEQ ID NO: 1564099 - protein, 4 aa, Staphylococcus aureus
GQIR

SEQ ID NO: 1564100 - protein, 6 aa, Staphylococcus aureus
GRKQFQ

SEQ ID NO: 1564101 - protein, 11 aa, Staphylococcus aureus
GVNDAPALAAS

SEQ ID NO: 1564102 - protein, 7 aa, Staphylococcus aureus
GYDEEKL

SEQ ID NO: 1564103 - protein, 6 aa, Staphylococcus aureus
HGSDDK

SEQ ID NO: 1564104 - protein, 27 aa, Staphylococcus aureus
HKDEATTKVVSDNTEPPIESKGHVSKK

SEQ ID NO: 1564105 - protein, 6 aa, Staphylococcus aureus
HTHSPA

SEQ ID NO: 1564106 - protein, 11 aa, Staphylococcus aureus
IDHKRKRRTTL

SEQ ID NO: 1564107 - protein, 12 aa, Staphylococcus aureus
IEARKNGEKSIE

SEQ ID NO: 1564108 - protein, 12 aa, Staphylococcus aureus
IEQKAEKETLNK

SEQ ID NO: 1564109 - protein, 6 aa, Staphylococcus aureus
IGSNAY

SEQ ID NO: 1564110 - protein, 26 aa, Staphylococcus aureus
IHGQNKGDQSFEEDTEKDKPKYEHGG

SEQ ID NO: 1564111 - protein, 37 aa, Staphylococcus aureus
IHKSKDALKDASKDPAVSTTDSNHEVAKTPNNDGSGH

SEQ ID NO: 1564112 - protein, 17 aa, Staphylococcus aureus
INQTNNPTLDKAQVEQL

SEQ ID NO: 1564113 - protein, 4 aa, Staphylococcus aureus
IQET

SEQ ID NO: 1564114 - protein, 6 aa, Staphylococcus aureus
ISGTPD

SEQ ID NO: 1564115 - protein, 15 aa, Staphylococcus aureus
ISNWGKAGKDPREEF

SEQ ID NO: 1564116 - protein, 72 aa, Staphylococcus aureus
ISSRDGEDFKRPSSVSGSIPSINVSGSQDNNTTNRSTHGGSDTSANSSGTAQSNNNTRSQQSRNSGGLTGIF

SEQ ID NO: 1564117 - protein, 6 aa, Staphylococcus aureus
ITGGGK

SEQ ID NO: 1564118 - protein, 14 aa, Staphylococcus aureus
KDKPSTYISKTATN

SEQ ID NO: 1564119 - protein, 4 aa, Staphylococcus aureus
KDMA

SEQ ID NO: 1564120 - protein, 7 aa, Staphylococcus aureus
KDSERHE

SEQ ID NO: 1564121 - protein, 7 aa, Staphylococcus aureus
KEDKKGL

SEQ ID NO: 1564122 - protein, 60 aa, Staphylococcus aureus
KEETTQTQSVAPNTGEEGMSSASTQSTKTSDIHNESIDKQMEAKAHETAQNTDLKNEARS

SEQ ID NO: 1564123 - protein, 60 aa, Staphylococcus aureus
KEETTQTQSVAPNTGEEGMSSASTQSTKTSDIHNESINKQMEAKAHETAQNADLKTEARS

SEQ ID NO: 1564124 - protein, 11 aa, Staphylococcus aureus
KEKNKSINIEN

SEQ ID NO: 1564125 - protein, 5 aa, Staphylococcus aureus
KELDK

SEQ ID NO: 1564126 - protein, 8 aa, Staphylococcus aureus
KESARKYK

SEQ ID NO: 1564127 - protein, 19 aa, Staphylococcus aureus
KISDPYENKQINKDKTTAF

SEQ ID NO: 1564128 - protein, 6 aa, Staphylococcus aureus
KKSPMD

SEQ ID NO: 1564129 - protein, 6 aa, Staphylococcus aureus
KLKPDG

SEQ ID NO: 1564130 - protein, 35 aa, Staphylococcus aureus
KNSLNDKDTTLGSQNFADADPEKKNAYNEAVRNAE

SEQ ID NO: 1564131 - protein, 6 aa, Staphylococcus aureus
KPTEME

SEQ ID NO: 1564132 - protein, 5 aa, Staphylococcus aureus
KQAFG

SEQ ID NO: 1564133 - protein, 5 aa, Staphylococcus aureus
KQDGK

SEQ ID NO: 1564134 - protein, 15 aa, Staphylococcus aureus
KQTSQKKKAQAIAKQ

SEQ ID NO: 1564135 - protein, 10 aa, Staphylococcus aureus
KSGEVKVEKS

SEQ ID NO: 1564136 - protein, 12 aa, Staphylococcus aureus
KSGNASQREELA

SEQ ID NO: 1564137 - protein, 20 aa, Staphylococcus aureus
KSYSPGSSKYKKHLKNTTRL

SEQ ID NO: 1564138 - protein, 25 aa, Staphylococcus aureus
KTSKVTQTDNQQDVSKDSTDEADTS

SEQ ID NO: 1564139 - protein, 9 aa, Staphylococcus aureus
KVKNPQTVD

SEQ ID NO: 1564140 - protein, 10 aa, Staphylococcus aureus
KVQARQQQEQ

SEQ ID NO: 1564141 - protein, 7 aa, Staphylococcus aureus
LGASIGS

SEQ ID NO: 1564142 - protein, 5 aa, Staphylococcus aureus
LKSET

SEQ ID NO: 1564143 - protein, 21 aa, Staphylococcus aureus
LNSNSTSEEHNKRPVEQNPNQ

SEQ ID NO: 1564144 - protein, 30 aa, Staphylococcus aureus
LQAPKTRSTTNAAADAKKVRPLKANQVQPL

SEQ ID NO: 1564145 - protein, 9 aa, Staphylococcus aureus
LQKTSAEFE

SEQ ID NO: 1564146 - protein, 8 aa, Staphylococcus aureus
LSAPKDKY

SEQ ID NO: 1564147 - protein, 10 aa, Staphylococcus aureus
LTGNTGFSTG

SEQ ID NO: 1564148 - protein, 15 aa, Staphylococcus aureus
NADTDKQTAYNTAVN

SEQ ID NO: 1564149 - protein, 44 aa, Staphylococcus aureus
NATSQPTLDPSAVTQAANQVNTNKTALNGAQNLANKKQETTANI

SEQ ID NO: 1564150 - protein, 99 aa, Staphylococcus aureus
NDIPVQKDKVQQDSNKKIENERPKASGTLKVENSPPTVKKVENNHKEQPKHKDEKSKKEKKKVVEKEKALPAFNRDDDSKNSSQLSSDIKELDEPNHKK

SEQ ID NO: 1564151 - protein, 7 aa, Staphylococcus aureus
NDLKKQA

SEQ ID NO: 1564152 - protein, 8 aa, Staphylococcus aureus
NEDPNKSN

SEQ ID NO: 1564153 - protein, 8 aa, Staphylococcus aureus
NGEQESNT

SEQ ID NO: 1564154 - protein, 8 aa, Staphylococcus aureus
NGKDNLSA

SEQ ID NO: 1564155 - protein, 7 aa, Staphylococcus aureus
NLSNDGY

SEQ ID NO: 1564156 - protein, 12 aa, Staphylococcus aureus
NNHQSNTTGADG

SEQ ID NO: 1564157 - protein, 5 aa, Staphylococcus aureus
NNKDY

SEQ ID NO: 1564158 - protein, 71 aa, Staphylococcus aureus
NQPLNNENHSINRKEQKSVQTAYDTDVQKRQIQNATQNQQSRQSGNRNQPITRNSQSKDRLKEQKDINKHG

SEQ ID NO: 1564159 - protein, 27 aa, Staphylococcus aureus
NTSSSGIQTEEKPQMENPSNELPLNPL

SEQ ID NO: 1564160 - protein, 7 aa, Staphylococcus aureus
NVAQGGA

SEQ ID NO: 1564161 - protein, 20 aa, Staphylococcus aureus
NVDNTDSKKSETKPLTTPMT

SEQ ID NO: 1564162 - protein, 6 aa, Staphylococcus aureus
NYSPKD

SEQ ID NO: 1564163 - protein, 8 aa, Staphylococcus aureus
PAFDQSKD

SEQ ID NO: 1564164 - protein, 24 aa, Staphylococcus aureus
PAGLTQTVTNTTEDDKDADGGEVD

SEQ ID NO: 1564165 - protein, 10 aa, Staphylococcus aureus
PAKELGPVEE

SEQ ID NO: 1564166 - protein, 28 aa, Staphylococcus aureus
PGDPFSDLQNGKIKQEAINAQREKLGLN

SEQ ID NO: 1564167 - protein, 30 aa, Staphylococcus aureus
PGDPFSDLQNGKIKQEAINAQREKLGLNDS

SEQ ID NO: 1564168 - protein, 6 aa, Staphylococcus aureus
PKGDDY

SEQ ID NO: 1564169 - protein, 9 aa, Staphylococcus aureus
PKGNKFNSN

SEQ ID NO: 1564170 - protein, 9 aa, Staphylococcus aureus
PKNEGDVTI

SEQ ID NO: 1564171 - protein, 5 aa, Staphylococcus aureus
PQALE

SEQ ID NO: 1564172 - protein, 5 aa, Staphylococcus aureus
PRTGS

SEQ ID NO: 1564173 - protein, 7 aa, Staphylococcus aureus
PTTLQHK

SEQ ID NO: 1564174 - protein, 8 aa, Staphylococcus aureus
QAHSENKE

SEQ ID NO: 1564175 - protein, 7 aa, Staphylococcus aureus
QAVEQRG

SEQ ID NO: 1564176 - protein, 8 aa, Staphylococcus aureus
QEETSPIQ

SEQ ID NO: 1564177 - protein, 6 aa, Staphylococcus aureus
QERHRI

SEQ ID NO: 1564178 - protein, 4 aa, Staphylococcus aureus
QLSS

SEQ ID NO: 1564179 - protein, 19 aa, Staphylococcus aureus
QNQQNQQHQQYGQKKSKKG

SEQ ID NO: 1564180 - protein, 5 aa, Staphylococcus aureus
QTEYD

SEQ ID NO: 1564181 - protein, 26 aa, Staphylococcus aureus
QVNTTKAALNGTQNLEKAKQHANTAI

SEQ ID NO: 1564182 - protein, 33 aa, Staphylococcus aureus
RDSIANEATIKAGQNYTDASPNNRNEYDSAVTA

SEQ ID NO: 1564183 - protein, 28 aa, Staphylococcus aureus
RGTVSSGTEGSGRTLEGATVSSKSGNQL

SEQ ID NO: 1564184 - protein, 10 aa, Staphylococcus aureus
RGYKESPKEV

SEQ ID NO: 1564185 - protein, 6 aa, Staphylococcus aureus
RKGAEL

SEQ ID NO: 1564186 - protein, 25 aa, Staphylococcus aureus
RNAKKKGRLSIGGGDATSGSGATYA

SEQ ID NO: 1564187 - protein, 9 aa, Staphylococcus aureus
RNGEVSNIK

SEQ ID NO: 1564188 - protein, 8 aa, Staphylococcus aureus
RNTRTAKG

SEQ ID NO: 1564189 - protein, 4 aa, Staphylococcus aureus
RRAM

SEQ ID NO: 1564190 - protein, 8 aa, Staphylococcus aureus
RSKETKSY

SEQ ID NO: 1564191 - protein, 15 aa, Staphylococcus aureus
RSMSQHTKSATPKII

SEQ ID NO: 1564192 - protein, 5 aa, Staphylococcus aureus
SDIGR

SEQ ID NO: 1564193 - protein, 6 aa, Staphylococcus aureus
SENPFR

SEQ ID NO: 1564194 - protein, 16 aa, Staphylococcus aureus
SESFGSKPKDESSRKM

SEQ ID NO: 1564195 - protein, 11 aa, Staphylococcus aureus
SFDPKSSEYNA

SEQ ID NO: 1564196 - protein, 4 aa, Staphylococcus aureus
SFTQ

SEQ ID NO: 1564197 - protein, 204 aa, Staphylococcus aureus
SISDSQSMSESVNDSESVSESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFD

SEQ ID NO: 1564198 - protein, 6 aa, Staphylococcus aureus
SKGSGL

SEQ ID NO: 1564199 - protein, 10 aa, Staphylococcus aureus
SKKKKPFSTG

SEQ ID NO: 1564200 - protein, 4 aa, Staphylococcus aureus
SKLN

SEQ ID NO: 1564201 - protein, 34 aa, Staphylococcus aureus
SLEDNSEGNAVKSNVRKLEDAKANDDQKDTLSQL

SEQ ID NO: 1564202 - protein, 15 aa, Staphylococcus aureus
SMDKTEKQAGQGYRG

SEQ ID NO: 1564203 - protein, 7 aa, Staphylococcus aureus
SQGMTNA

SEQ ID NO: 1564204 - protein, 5 aa, Staphylococcus aureus
SQNTT

SEQ ID NO: 1564205 - protein, 6 aa, Staphylococcus aureus
SSREAP

SEQ ID NO: 1564206 - protein, 4 aa, Staphylococcus aureus
TDKI

SEQ ID NO: 1564207 - protein, 7 aa, Staphylococcus aureus
TGTITNG

SEQ ID NO: 1564208 - protein, 9 aa, Staphylococcus aureus
TIKEQEKPD

SEQ ID NO: 1564209 - protein, 12 aa, Staphylococcus aureus
TNQSSGGSTITQ

SEQ ID NO: 1564210 - protein, 13 aa, Staphylococcus aureus
TQSSNTNSKNIEQ

SEQ ID NO: 1564211 - protein, 9 aa, Staphylococcus aureus
TTYKGNDVV

SEQ ID NO: 1564212 - protein, 15 aa, Staphylococcus aureus
VDEKEIKAKGKDRID

SEQ ID NO: 1564213 - protein, 22 aa, Staphylococcus aureus
VDESAITGESAPVIKESGGDFD

SEQ ID NO: 1564214 - protein, 8 aa, Staphylococcus aureus
VGNESNGL

SEQ ID NO: 1564215 - protein, 9 aa, Staphylococcus aureus
VKEPDSDTT

SEQ ID NO: 1564216 - protein, 17 aa, Staphylococcus aureus
VKNGNTNNTKVNLNTAS

SEQ ID NO: 1564217 - protein, 14 aa, Staphylococcus aureus
VQQQSAKVQQQTQI

SEQ ID NO: 1564218 - protein, 18 aa, Staphylococcus aureus
VSNPVGEPSHAVKPKIEK

SEQ ID NO: 1564219 - protein, 5 aa, Staphylococcus aureus
VSSPF

SEQ ID NO: 1564220 - protein, 24 aa, Staphylococcus aureus
VTIDGQKASVKGKVDSIGKATAAS

SEQ ID NO: 1564221 - protein, 10 aa, Staphylococcus aureus
VTNSKTETNV

SEQ ID NO: 1564222 - protein, 7 aa, Staphylococcus aureus
YASSKDV

SEQ ID NO: 1564223 - protein, 20 aa, Staphylococcus aureus
YDASIKDNNRDQTSRKAEAL

SEQ ID NO: 1564224 - protein, 6 aa, Staphylococcus aureus
YITKTG

SEQ ID NO: 1564225 - protein, 21 aa, Staphylococcus aureus
YKTPGREDKQSQAVTASATEL

SEQ ID NO: 1564226 - protein, 12 aa, Staphylococcus aureus
YSAKVKNPQTVD

SEQ ID NO: 1564227 - protein, 6 aa, Staphylococcus aureus
YSDETG

SEQ ID NO: 1564228 - protein, 19 aa, Staphylococcus aureus
YSEKGDWNPFGQEEISRQI

SEQ ID NO: 1564229 - protein, 5 aa, Staphylococcus aureus
YSKAE

SEQ ID NO: 1564230 - protein, 4 aa, Staphylococcus aureus
AAEG

SEQ ID NO: 1564231 - protein, 6 aa, Staphylococcus aureus
AAQASQ

SEQ ID NO: 1564232 - protein, 32 aa, Staphylococcus aureus
ADDEATKEEEAEAEAQQVATAEQSSKQSNEPY

SEQ ID NO: 1564233 - protein, 9 aa, Staphylococcus aureus
AEKKDLDNK

SEQ ID NO: 1564234 - protein, 169 aa, Staphylococcus aureus
AFTKANADKTNKKEQQDNSAKKETTPAMPSKPTTPPVEKESQKQDSQKDDNKQSPSVEKENDASSESGKDKMPVTKPAKAEVESSSTTPTKVVSTTQNVAKPTTASSETTKDVVQTSAGSSEAKDSAPLQKANIKNTNDGHTQSQNNKNTQENKAKSLPQTGEESNKDM

SEQ ID NO: 1564235 - protein, 47 aa, Staphylococcus aureus
AGGQGQSQSQSDNKQNSAMSDVNQASPQQNSKTSASNNISGMPTAKL

SEQ ID NO: 1564236 - protein, 5 aa, Staphylococcus aureus
AGPST

SEQ ID NO: 1564237 - protein, 46 aa, Staphylococcus aureus
AIKEEASANNLSDTSQEAQEIQEAKKEAQAETDKSAAVSNEEPKAV

SEQ ID NO: 1564238 - protein, 5 aa, Staphylococcus aureus
AKTHQ

SEQ ID NO: 1564239 - protein, 7 aa, Staphylococcus aureus
ANMEGKE

SEQ ID NO: 1564240 - protein, 4 aa, Staphylococcus aureus
APPT

SEQ ID NO: 1564241 - protein, 13 aa, Staphylococcus aureus
AQAVSEKDTEISK

SEQ ID NO: 1564242 - protein, 6 aa, Staphylococcus aureus
AQSIDE

SEQ ID NO: 1564243 - protein, 12 aa, Staphylococcus aureus
ARTDDKKHATQR

SEQ ID NO: 1564244 - protein, 9 aa, Staphylococcus aureus
ASGSGKSTI

SEQ ID NO: 1564245 - protein, 6 aa, Staphylococcus aureus
ASNGNG

SEQ ID NO: 1564246 - protein, 28 aa, Staphylococcus aureus
ATSDNKDTQQQNQTEEDERQGLNGYRKT

SEQ ID NO: 1564247 - protein, 4 aa, Staphylococcus aureus
AVPS

SEQ ID NO: 1564248 - protein, 25 aa, Staphylococcus aureus
AVTTAKDNLHGDQKLARDQQQAVTT

SEQ ID NO: 1564249 - protein, 16 aa, Staphylococcus aureus
CEGEKRAKKELNEKGL

SEQ ID NO: 1564250 - protein, 111 aa, Staphylococcus aureus
DAKKTSKAKKDKQDTEVAVASSNSDNVNYEASATTPATTSSADTDSEDSEKSSKDEDKQNASKSDKSSVEKSESNEETATVEPMPQSKPTTSEAPPSQNNHNENNMYDAST

SEQ ID NO: 1564251 - protein, 111 aa, Staphylococcus aureus
DAKKTSKAKKDKQDTEVAVASSNSDNVSYEASATTPATTSSADTDSEDSEKSSKDEDKQNASKSDNSSVEKSESNEETAPVEPMPHSKPTTSEAPPSQNIHNEDSMYDAST

SEQ ID NO: 1564252 - protein, 47 aa, Staphylococcus aureus
DANGVNHGGSEMVQNKTGHMSQQDHMNQNTHMNQQPQIQQGHMQSSN

SEQ ID NO: 1564253 - protein, 6 aa, Staphylococcus aureus
DEIHPE

SEQ ID NO: 1564254 - protein, 7 aa, Staphylococcus aureus
DENSRMS

SEQ ID NO: 1564255 - protein, 20 aa, Staphylococcus aureus
DERAENATSNQDQQTNSSKR

SEQ ID NO: 1564256 - protein, 13 aa, Staphylococcus aureus
DESKVDKEALSNN

SEQ ID NO: 1564257 - protein, 4 aa, Staphylococcus aureus
DGTP

SEQ ID NO: 1564258 - protein, 15 aa, Staphylococcus aureus
DHVDKKSGTSANDQY

SEQ ID NO: 1564259 - protein, 17 aa, Staphylococcus aureus
DIKTKDDDTSQNNTIEP

SEQ ID NO: 1564260 - protein, 9 aa, Staphylococcus aureus
DKAGKLSDI

SEQ ID NO: 1564261 - protein, 19 aa, Staphylococcus aureus
DKEGYRDGEFKKGDKGTWT

SEQ ID NO: 1564262 - protein, 36 aa, Staphylococcus aureus
DKLNGQKPNTKTSANNNQKKATSKLNKGRATNNNYS

SEQ ID NO: 1564263 - protein, 20 aa, Staphylococcus aureus
DKLPEKYKAEYKKKLDQTRV

SEQ ID NO: 1564264 - protein, 18 aa, Staphylococcus aureus
DKPKYEKTYVDAKGKTYH

SEQ ID NO: 1564265 - protein, 8 aa, Staphylococcus aureus
DKSAFSQV

SEQ ID NO: 1564266 - protein, 9 aa, Staphylococcus aureus
DNKTQQHEQ

SEQ ID NO: 1564267 - protein, 21 aa, Staphylococcus aureus
DNMSQYSEDVTSYYSAPSDLS

SEQ ID NO: 1564268 - protein, 9 aa, Staphylococcus aureus
DPGATKEEI

SEQ ID NO: 1564269 - protein, 9 aa, Staphylococcus aureus
DSDTENAKA

SEQ ID NO: 1564270 - protein, 13 aa, Staphylococcus aureus
DTPSTATISDSLT

SEQ ID NO: 1564271 - protein, 7 aa, Staphylococcus aureus
EANNEME

SEQ ID NO: 1564272 - protein, 4 aa, Staphylococcus aureus
EDVT

SEQ ID NO: 1564273 - protein, 9 aa, Staphylococcus aureus
EEKDPDTKR

SEQ ID NO: 1564274 - protein, 12 aa, Staphylococcus aureus
EEQGTTKDFEKD

SEQ ID NO: 1564275 - protein, 9 aa, Staphylococcus aureus
EGPGISIEE

SEQ ID NO: 1564276 - protein, 12 aa, Staphylococcus aureus
EIEQAEKEMEKK

SEQ ID NO: 1564277 - protein, 8 aa, Staphylococcus aureus
EIKYKSKD

SEQ ID NO: 1564278 - protein, 9 aa, Staphylococcus aureus
EKDLTDNIA

SEQ ID NO: 1564279 - protein, 16 aa, Staphylococcus aureus
EKPNTLENYEPMSTKK

SEQ ID NO: 1564280 - protein, 10 aa, Staphylococcus aureus
EPQIDDTNDG

SEQ ID NO: 1564281 - protein, 6 aa, Staphylococcus aureus
EQEVKT

SEQ ID NO: 1564282 - protein, 8 aa, Staphylococcus aureus
EQKKSTIS

SEQ ID NO: 1564283 - protein, 8 aa, Staphylococcus aureus
ESKVEDTE

SEQ ID NO: 1564284 - protein, 24 aa, Staphylococcus aureus
ETGAQEASKDEAKQAAAKKGNPVQ

SEQ ID NO: 1564285 - protein, 6 aa, Staphylococcus aureus
ETGKKY

SEQ ID NO: 1564286 - protein, 8 aa, Staphylococcus aureus
EVESNKGT

SEQ ID NO: 1564287 - protein, 8 aa, Staphylococcus aureus
EVRETSKN

SEQ ID NO: 1564288 - protein, 13 aa, Staphylococcus aureus
FAKSNKQGEMNSE

SEQ ID NO: 1564289 - protein, 9 aa, Staphylococcus aureus
FDSENPNKA

SEQ ID NO: 1564290 - protein, 5 aa, Staphylococcus aureus
FGEPE

SEQ ID NO: 1564291 - protein, 86 aa, Staphylococcus aureus
FKKEQGNEENNDSASSHANDNNIDDSTDSNIENEDYRYNQETDDQNESNGIAVDNEQHQSAPNEQNSDSNDEETVTKKERKSKVTQ

SEQ ID NO: 1564292 - protein, 13 aa, Staphylococcus aureus
FKQNNNKSKHDAI

SEQ ID NO: 1564293 - protein, 12 aa, Staphylococcus aureus
FSKSPPSGTMVK

SEQ ID NO: 1564294 - protein, 7 aa, Staphylococcus aureus
GAGAGMT

SEQ ID NO: 1564295 - protein, 6 aa, Staphylococcus aureus
GDPSQI

SEQ ID NO: 1564296 - protein, 15 aa, Staphylococcus aureus
GEDYTTLKDASNSLE

SEQ ID NO: 1564297 - protein, 4 aa, Staphylococcus aureus
GEKI

SEQ ID NO: 1564298 - protein, 5 aa, Staphylococcus aureus
GGVQN

SEQ ID NO: 1564299 - protein, 5 aa, Staphylococcus aureus
GKDAV

SEQ ID NO: 1564300 - protein, 8 aa, Staphylococcus aureus
GKVGKSDS

SEQ ID NO: 1564301 - protein, 65 aa, Staphylococcus aureus
GQKITKDKVKTADKDKKVVTEPKNTKVENGKVTTSVETKTEKAQDSLNDNTTKTMTSDKPEDNQP

SEQ ID NO: 1564302 - protein, 8 aa, Staphylococcus aureus
GQSSATGI

SEQ ID NO: 1564303 - protein, 4 aa, Staphylococcus aureus
GTVA

SEQ ID NO: 1564304 - protein, 4 aa, Staphylococcus aureus
HGSM

SEQ ID NO: 1564305 - protein, 14 aa, Staphylococcus aureus
HNKQKKDHYIETQE

SEQ ID NO: 1564306 - protein, 21 aa, Staphylococcus aureus
HPFNSSPIGHKKKLDQDDEID

SEQ ID NO: 1564307 - protein, 17 aa, Staphylococcus aureus
HSGLNNDSELTASRNTF

SEQ ID NO: 1564308 - protein, 10 aa, Staphylococcus aureus
HSIETSPNMK

SEQ ID NO: 1564309 - protein, 16 aa, Staphylococcus aureus
HTENESKSQCQPSRKK

SEQ ID NO: 1564310 - protein, 6 aa, Staphylococcus aureus
HYSINN

SEQ ID NO: 1564311 - protein, 15 aa, Staphylococcus aureus
IESIENAAQQKINEI

SEQ ID NO: 1564312 - protein, 14 aa, Staphylococcus aureus
IGGNRSFEIFTNPI

SEQ ID NO: 1564313 - protein, 17 aa, Staphylococcus aureus
IKDQQKANQLASELNNR

SEQ ID NO: 1564314 - protein, 9 aa, Staphylococcus aureus
IKSKIENNH

SEQ ID NO: 1564315 - protein, 10 aa, Staphylococcus aureus
INGTPNATLT

SEQ ID NO: 1564316 - protein, 11 aa, Staphylococcus aureus
INNAQTPQQVE

SEQ ID NO: 1564317 - protein, 10 aa, Staphylococcus aureus
INPEPSFKVD

SEQ ID NO: 1564318 - protein, 45 aa, Staphylococcus aureus
IPNHDKAAPTSTTPPSNDKTAPKSTKEQDATTDKHPNQQDTHQPA

SEQ ID NO: 1564319 - protein, 4 aa, Staphylococcus aureus
IQGE

SEQ ID NO: 1564320 - protein, 6 aa, Staphylococcus aureus
IQQDKI

SEQ ID NO: 1564321 - protein, 5 aa, Staphylococcus aureus
ISPGM

SEQ ID NO: 1564322 - protein, 12 aa, Staphylococcus aureus
ISSTSNYAADTL

SEQ ID NO: 1564323 - protein, 10 aa, Staphylococcus aureus
ISTSTQSEIA

SEQ ID NO: 1564324 - protein, 26 aa, Staphylococcus aureus
ITGRSKDFSSKAKGDSDLTTSDGGKL

SEQ ID NO: 1564325 - protein, 12 aa, Staphylococcus aureus
ITVDDKVKSGDY

SEQ ID NO: 1564326 - protein, 15 aa, Staphylococcus aureus
KAPPTMKEPNKQDIK

SEQ ID NO: 1564327 - protein, 6 aa, Staphylococcus aureus
KCSENM

SEQ ID NO: 1564328 - protein, 6 aa, Staphylococcus aureus
KDGETY

SEQ ID NO: 1564329 - protein, 7 aa, Staphylococcus aureus
KDQLKPG

SEQ ID NO: 1564330 - protein, 7 aa, Staphylococcus aureus
KDSPLEN

SEQ ID NO: 1564331 - protein, 22 aa, Staphylococcus aureus
KEEQKTCKSGETITISNGEAVA

SEQ ID NO: 1564332 - protein, 8 aa, Staphylococcus aureus
KENPMDGY

SEQ ID NO: 1564333 - protein, 57 aa, Staphylococcus aureus
KEPKQDLEAATAQMETTKGKKSSVASKLVSSDKNVNTEENASGNVSETSSLDDDPEA

SEQ ID NO: 1564334 - protein, 4 aa, Staphylococcus aureus
KEVY

SEQ ID NO: 1564335 - protein, 24 aa, Staphylococcus aureus
KGEDNANGEKAQQISERILKEMEL

SEQ ID NO: 1564336 - protein, 14 aa, Staphylococcus aureus
KGIQINGSTEKNQL

SEQ ID NO: 1564337 - protein, 18 aa, Staphylococcus aureus
KGTKNETFRVTQEDKGRV

SEQ ID NO: 1564338 - protein, 5 aa, Staphylococcus aureus
KHIPE

SEQ ID NO: 1564339 - protein, 22 aa, Staphylococcus aureus
KHPGEWKNQDLGTGAGNKSVEV

SEQ ID NO: 1564340 - protein, 8 aa, Staphylococcus aureus
KIKERGEL

SEQ ID NO: 1564341 - protein, 5 aa, Staphylococcus aureus
KKEFD

SEQ ID NO: 1564342 - protein, 8 aa, Staphylococcus aureus
KKENGEQQ

SEQ ID NO: 1564343 - protein, 8 aa, Staphylococcus aureus
KKSIDETN

SEQ ID NO: 1564344 - protein, 28 aa, Staphylococcus aureus
KKSTEKAVDSVGEATKSISNHLNPMKWS

SEQ ID NO: 1564345 - protein, 20 aa, Staphylococcus aureus
KKTASKKRTNSRKKKNDNPI

SEQ ID NO: 1564346 - protein, 20 aa, Staphylococcus aureus
KNLNSERENVEDRKDNAQSG

SEQ ID NO: 1564347 - protein, 5 aa, Staphylococcus aureus
KNNKF

SEQ ID NO: 1564348 - protein, 17 aa, Staphylococcus aureus
KNPKSVSEIKKELNTSN

SEQ ID NO: 1564349 - protein, 28 aa, Staphylococcus aureus
KNTHKITGEYDTTTNDRKDATDSTYKSY

SEQ ID NO: 1564350 - protein, 27 aa, Staphylococcus aureus
KQDYKNKKGDNVDPKRASTGNEYEDKA

SEQ ID NO: 1564351 - protein, 8 aa, Staphylococcus aureus
KQNANTAI

SEQ ID NO: 1564352 - protein, 12 aa, Staphylococcus aureus
KRENATTDKTAY

SEQ ID NO: 1564353 - protein, 191 aa, Staphylococcus aureus
KSHPEPIEDNDKHETIKEAENNTEHSTVSDKSEAEQSQQPKPYFATGANQANTSKDKHDDVTVKQDKDESKDHHSGKKGAAIGAGTAGVAGAAGAMGVSKAKKHSNDAQNKSNSGKVNNSTEDKASEDKSKEHHNGKKGAAIGAGTAGLAGGAASNSASAASKPHASNNASQNNDEHDHHDRDKERKKGGM

SEQ ID NO: 1564354 - protein, 4 aa, Staphylococcus aureus
KSQI

SEQ ID NO: 1564355 - protein, 14 aa, Staphylococcus aureus
KTLEDIKKDDKHID

SEQ ID NO: 1564356 - protein, 9 aa, Staphylococcus aureus
KTPGKSAID

SEQ ID NO: 1564357 - protein, 7 aa, Staphylococcus aureus
KTRKEYR

SEQ ID NO: 1564358 - protein, 5 aa, Staphylococcus aureus
KTTEY

SEQ ID NO: 1564359 - protein, 24 aa, Staphylococcus aureus
KTVQSNGEQKITSKLNGEETEKTI

SEQ ID NO: 1564360 - protein, 5 aa, Staphylococcus aureus
KVGVD

SEQ ID NO: 1564361 - protein, 6 aa, Staphylococcus aureus
KVNDYK

SEQ ID NO: 1564362 - protein, 23 aa, Staphylococcus aureus
KVTQAKNDLNGNTNLATAKQNVQ

SEQ ID NO: 1564363 - protein, 12 aa, Staphylococcus aureus
KYEDNANTVQYS

SEQ ID NO: 1564364 - protein, 5 aa, Staphylococcus aureus
KYREA

SEQ ID NO: 1564365 - protein, 15 aa, Staphylococcus aureus
LAATTKLASKGAIRE

SEQ ID NO: 1564366 - protein, 20 aa, Staphylococcus aureus
LDALPNKKTTKVDVDTNGLK

SEQ ID NO: 1564367 - protein, 11 aa, Staphylococcus aureus
LDESAENNNKI

SEQ ID NO: 1564368 - protein, 19 aa, Staphylococcus aureus
LDKSEYEAEPPLFFFSGSL

SEQ ID NO: 1564369 - protein, 15 aa, Staphylococcus aureus
LEEKRKVRRKRQKRI

SEQ ID NO: 1564370 - protein, 9 aa, Staphylococcus aureus
LEQAKNGGA

SEQ ID NO: 1564371 - protein, 13 aa, Staphylococcus aureus
LGNNLTEKKGYRI

SEQ ID NO: 1564372 - protein, 7 aa, Staphylococcus aureus
LKQHDYH

SEQ ID NO: 1564373 - protein, 5 aa, Staphylococcus aureus
LQRGS

SEQ ID NO: 1564374 - protein, 7 aa, Staphylococcus aureus
LSNGTYS

SEQ ID NO: 1564375 - protein, 21 aa, Staphylococcus aureus
LTPAQQQALENQINNATTRDK

SEQ ID NO: 1564376 - protein, 18 aa, Staphylococcus aureus
MEPDAPVDKSEMKSEDAL

SEQ ID NO: 1564377 - protein, 22 aa, Staphylococcus aureus
NDMSQTATTKYGEKDDKNDEAM

SEQ ID NO: 1564378 - protein, 13 aa, Staphylococcus aureus
NEEISGNENYWNE

SEQ ID NO: 1564379 - protein, 8 aa, Staphylococcus aureus
NEKQALDQ

SEQ ID NO: 1564380 - protein, 16 aa, Staphylococcus aureus
NEPRPTIGQSDEDEKS

SEQ ID NO: 1564381 - protein, 20 aa, Staphylococcus aureus
NEVSSKVDRGQQSDEDDLNA

SEQ ID NO: 1564382 - protein, 56 aa, Staphylococcus aureus
NGPSDVAGANAPGKDDKNSASGSDKGSDGATTGQSESNSSNKDKVENPQTNAGTPA

SEQ ID NO: 1564383 - protein, 6 aa, Staphylococcus aureus
NGVQNA

SEQ ID NO: 1564384 - protein, 4 aa, Staphylococcus aureus
NIPG

SEQ ID NO: 1564385 - protein, 15 aa, Staphylococcus aureus
NKGQTALSNVQSKLN

SEQ ID NO: 1564386 - protein, 8 aa, Staphylococcus aureus
NKKPDINV

SEQ ID NO: 1564387 - protein, 9 aa, Staphylococcus aureus
NKNATGPFN

SEQ ID NO: 1564388 - protein, 14 aa, Staphylococcus aureus
NKQKKTITLRHKKS

SEQ ID NO: 1564389 - protein, 15 aa, Staphylococcus aureus
NLNQPQKTALKDQVS

SEQ ID NO: 1564390 - protein, 7 aa, Staphylococcus aureus
NLNTKTS

SEQ ID NO: 1564391 - protein, 13 aa, Staphylococcus aureus
NPNNRGIDKIACV

SEQ ID NO: 1564392 - protein, 7 aa, Staphylococcus aureus
NPQSAQT

SEQ ID NO: 1564393 - protein, 4 aa, Staphylococcus aureus
NPTV

SEQ ID NO: 1564394 - protein, 12 aa, Staphylococcus aureus
NQAVNGSKRINT

SEQ ID NO: 1564395 - protein, 10 aa, Staphylococcus aureus
NQDQNLNSSM

SEQ ID NO: 1564396 - protein, 6 aa, Staphylococcus aureus
NQNDKV

SEQ ID NO: 1564397 - protein, 13 aa, Staphylococcus aureus
NQYKDNVYQKNTA

SEQ ID NO: 1564398 - protein, 107 aa, Staphylococcus aureus
NRQSIDTNSHQDHTEDVEKDQSELEHQDTIENTEQQFPPRNAQRRKRRRDLATNHNKQVHNESQTSEDNVQNEAGTIDDRQVESSHSTESQEPSHQDSTPQHEEGYY

SEQ ID NO: 1564399 - protein, 10 aa, Staphylococcus aureus
NSDKHAGETL

SEQ ID NO: 1564400 - protein, 8 aa, Staphylococcus aureus
NTRTATGY

SEQ ID NO: 1564401 - protein, 7 aa, Staphylococcus aureus
PEEKAAQ

SEQ ID NO: 1564402 - protein, 12 aa, Staphylococcus aureus
PEGLEGTREVSQ

SEQ ID NO: 1564403 - protein, 4 aa, Staphylococcus aureus
PIDA

SEQ ID NO: 1564404 - protein, 6 aa, Staphylococcus aureus
PKDLSI

SEQ ID NO: 1564405 - protein, 13 aa, Staphylococcus aureus
PKLTKMGDGLKSI

SEQ ID NO: 1564406 - protein, 12 aa, Staphylococcus aureus
PKNVTDPASGYA

SEQ ID NO: 1564407 - protein, 19 aa, Staphylococcus aureus
PKTFDTENLSDPKSAIKDS

SEQ ID NO: 1564408 - protein, 19 aa, Staphylococcus aureus
PQGATNVSKHQDVHGQDDA

SEQ ID NO: 1564409 - protein, 24 aa, Staphylococcus aureus
PRYKSKKGWYKDKPPKEKGGMPTE

SEQ ID NO: 1564410 - protein, 16 aa, Staphylococcus aureus
PSVALGTNKLASSFGS

SEQ ID NO: 1564411 - protein, 17 aa, Staphylococcus aureus
PSVALGTNKLASSFGSL

SEQ ID NO: 1564412 - protein, 9 aa, Staphylococcus aureus
PTTQETKSK

SEQ ID NO: 1564413 - protein, 8 aa, Staphylococcus aureus
PYQQSLSS

SEQ ID NO: 1564414 - protein, 8 aa, Staphylococcus aureus
QAATTLND

SEQ ID NO: 1564415 - protein, 11 aa, Staphylococcus aureus
QGMTQAQYTEL

SEQ ID NO: 1564416 - protein, 5 aa, Staphylococcus aureus
QHAQA

SEQ ID NO: 1564417 - protein, 10 aa, Staphylococcus aureus
QIPKNYTATQ

SEQ ID NO: 1564418 - protein, 10 aa, Staphylococcus aureus
QQDKYETNVS

SEQ ID NO: 1564419 - protein, 11 aa, Staphylococcus aureus
QQFKDQPKNEI

SEQ ID NO: 1564420 - protein, 10 aa, Staphylococcus aureus
QYTNSESPTL

SEQ ID NO: 1564421 - protein, 4 aa, Staphylococcus aureus
RAMP

SEQ ID NO: 1564422 - protein, 4 aa, Staphylococcus aureus
REQA

SEQ ID NO: 1564423 - protein, 4 aa, Staphylococcus aureus
RGDK

SEQ ID NO: 1564424 - protein, 6 aa, Staphylococcus aureus
RKDKQT

SEQ ID NO: 1564425 - protein, 18 aa, Staphylococcus aureus
RKTKQGYTITKNKNSSGY

SEQ ID NO: 1564426 - protein, 25 aa, Staphylococcus aureus
RNAKKKGRLSIGGGGATSGSGATYA

SEQ ID NO: 1564427 - protein, 7 aa, Staphylococcus aureus
RNRSYNK

SEQ ID NO: 1564428 - protein, 102 aa, Staphylococcus aureus
RRKAKRQQKEQHFATRQSNQSKFKASDLDRTTDQSSQHTAREEARIDNKDNQNQVSLNKQTEGSEQDQASFTDNNESDEEVYAAKNPNSEEYKVNEKIKKEH

SEQ ID NO: 1564429 - protein, 13 aa, Staphylococcus aureus
RSLEENKIEDNAV

SEQ ID NO: 1564430 - protein, 10 aa, Staphylococcus aureus
RSLNDDEKAL

SEQ ID NO: 1564431 - protein, 7 aa, Staphylococcus aureus
RVDYGAA

SEQ ID NO: 1564432 - protein, 8 aa, Staphylococcus aureus
RVGDYQEA

SEQ ID NO: 1564433 - protein, 8 aa, Staphylococcus aureus
SAFGSNYD

SEQ ID NO: 1564434 - protein, 9 aa, Staphylococcus aureus
SAKNSERRG

SEQ ID NO: 1564435 - protein, 12 aa, Staphylococcus aureus
SEPNNQNTKELK

SEQ ID NO: 1564436 - protein, 64 aa, Staphylococcus aureus
SESDDEVNNQKPLTLPEEQKLKRQQSQNEQTKTYTYGDSEQNDKSNHENDLSHHTPSISDDKDY

SEQ ID NO: 1564437 - protein, 10 aa, Staphylococcus aureus
SGITTPTQKT

SEQ ID NO: 1564438 - protein, 9 aa, Staphylococcus aureus
SGNLGESEI

SEQ ID NO: 1564439 - protein, 32 aa, Staphylococcus aureus
SGTPTVVTTPSEVTAAANQVNSAKQELNGDER

SEQ ID NO: 1564440 - protein, 5 aa, Staphylococcus aureus
SIDRT

SEQ ID NO: 1564441 - protein, 11 aa, Staphylococcus aureus
SINPEPSFTVD

SEQ ID NO: 1564442 - protein, 15 aa, Staphylococcus aureus
SKANGGNATQTEVEQ

SEQ ID NO: 1564443 - protein, 12 aa, Staphylococcus aureus
SKDSKELESREK

SEQ ID NO: 1564444 - protein, 124 aa, Staphylococcus aureus
SKPSEHDKETRIDSESSRTDSDSSMQTEKIKKDSSDGNKSSNLKSEVISDKSNTVPKLSESDDEVNNQKPLTLPEEQKLKRQQSQNEQTKTYTYGDSEQNDKSNHENDLSHHTPSISDDKDNVM

SEQ ID NO: 1564445 - protein, 7 aa, Staphylococcus aureus
SKQNNLN

SEQ ID NO: 1564446 - protein, 6 aa, Staphylococcus aureus
SLKERS

SEQ ID NO: 1564447 - protein, 22 aa, Staphylococcus aureus
SNEENQSHSNQLTDKLQGSDKI

SEQ ID NO: 1564448 - protein, 6 aa, Staphylococcus aureus
SNGARE

SEQ ID NO: 1564449 - protein, 7 aa, Staphylococcus aureus
SNGTRDV

SEQ ID NO: 1564450 - protein, 8 aa, Staphylococcus aureus
SNYNQNSA

SEQ ID NO: 1564451 - protein, 6 aa, Staphylococcus aureus
SPGKNQ

SEQ ID NO: 1564452 - protein, 15 aa, Staphylococcus aureus
SQDNQSISKKMTGYG

SEQ ID NO: 1564453 - protein, 9 aa, Staphylococcus aureus
SRSSAGTLP

SEQ ID NO: 1564454 - protein, 5 aa, Staphylococcus aureus
SRSYK

SEQ ID NO: 1564455 - protein, 8 aa, Staphylococcus aureus
SSAWQSPT

SEQ ID NO: 1564456 - protein, 32 aa, Staphylococcus aureus
SSHLEQRNRDVNENKAEESKSNQGSKSAYNKD

SEQ ID NO: 1564457 - protein, 11 aa, Staphylococcus aureus
STGAGGTKPKI

SEQ ID NO: 1564458 - protein, 4 aa, Staphylococcus aureus
SVDN

SEQ ID NO: 1564459 - protein, 4 aa, Staphylococcus aureus
TASK

SEQ ID NO: 1564460 - protein, 59 aa, Staphylococcus aureus
TDDVSKKQNSLDSVDQDTEKSKYYEQNTEATLSTNSTDKVESTDMRKLSSDKNKVGHEE

SEQ ID NO: 1564461 - protein, 27 aa, Staphylococcus aureus
TDITQHDTEVDNVDNTAKHSHLNKPSH

SEQ ID NO: 1564462 - protein, 17 aa, Staphylococcus aureus
TDRPDLAQQFKQSINNK

SEQ ID NO: 1564463 - protein, 8 aa, Staphylococcus aureus
TEPDEIKE

SEQ ID NO: 1564464 - protein, 7 aa, Staphylococcus aureus
TGENVNV

SEQ ID NO: 1564465 - protein, 14 aa, Staphylococcus aureus
TGINSLKNEEISHG

SEQ ID NO: 1564466 - protein, 16 aa, Staphylococcus aureus
TGKMRAEYAGKTWETS

SEQ ID NO: 1564467 - protein, 9 aa, Staphylococcus aureus
TGNTGFSTG

SEQ ID NO: 1564468 - protein, 10 aa, Staphylococcus aureus
TGTEHTHTTT

SEQ ID NO: 1564469 - protein, 16 aa, Staphylococcus aureus
THSHSHSHHAHHHAHV

SEQ ID NO: 1564470 - protein, 9 aa, Staphylococcus aureus
TINQKAQTL

SEQ ID NO: 1564471 - protein, 5 aa, Staphylococcus aureus
TKDNT

SEQ ID NO: 1564472 - protein, 14 aa, Staphylococcus aureus
TKEEIEQAKAQLAQ

SEQ ID NO: 1564473 - protein, 17 aa, Staphylococcus aureus
TKKDGKYYVKNMTNSIG

SEQ ID NO: 1564474 - protein, 6 aa, Staphylococcus aureus
TKSGAP

SEQ ID NO: 1564475 - protein, 9 aa, Staphylococcus aureus
TNDEPATRR

SEQ ID NO: 1564476 - protein, 9 aa, Staphylococcus aureus
TNNKTETDV

SEQ ID NO: 1564477 - protein, 7 aa, Staphylococcus aureus
TNVSGSF

SEQ ID NO: 1564478 - protein, 7 aa, Staphylococcus aureus
TNYAPSA

SEQ ID NO: 1564479 - protein, 27 aa, Staphylococcus aureus
TQQEAEAAENNIENPTTLKDNVQSKEV

SEQ ID NO: 1564480 - protein, 15 aa, Staphylococcus aureus
TRANNDSKEAVNKTN

SEQ ID NO: 1564481 - protein, 8 aa, Staphylococcus aureus
TSHKAMSD

SEQ ID NO: 1564482 - protein, 23 aa, Staphylococcus aureus
TSMPGATPQSTQDEISSKIDNQV

SEQ ID NO: 1564483 - protein, 6 aa, Staphylococcus aureus
TSQIND

SEQ ID NO: 1564484 - protein, 11 aa, Staphylococcus aureus
TVRDNAQTLNT

SEQ ID NO: 1564485 - protein, 12 aa, Staphylococcus aureus
VDLQGDKQVTIP

SEQ ID NO: 1564486 - protein, 27 aa, Staphylococcus aureus
VDQVNTDKAQPNYTEASTDKKEAVDQA

SEQ ID NO: 1564487 - protein, 15 aa, Staphylococcus aureus
VKDREYKKEIEEKNR

SEQ ID NO: 1564488 - protein, 17 aa, Staphylococcus aureus
VKGFGSKTFDKLNSYFT

SEQ ID NO: 1564489 - protein, 8 aa, Staphylococcus aureus
VKTDVTTA

SEQ ID NO: 1564490 - protein, 5 aa, Staphylococcus aureus
VNFGA

SEQ ID NO: 1564491 - protein, 18 aa, Staphylococcus aureus
VPSTNGNKRLNDKYDATN

SEQ ID NO: 1564492 - protein, 4 aa, Staphylococcus aureus
VPTK

SEQ ID NO: 1564493 - protein, 16 aa, Staphylococcus aureus
VQQEEEKRINNDLNQY

SEQ ID NO: 1564494 - protein, 56 aa, Staphylococcus aureus
VQTGQEDKVTATDTAENSSTATNPKDASDKADVIEPESDVVKDADSSVDKDVQNDV

SEQ ID NO: 1564495 - protein, 4 aa, Staphylococcus aureus
VSDD

SEQ ID NO: 1564496 - protein, 8 aa, Staphylococcus aureus
VSGGNHQI

SEQ ID NO: 1564497 - protein, 7 aa, Staphylococcus aureus
VSSSTAQ

SEQ ID NO: 1564498 - protein, 14 aa, Staphylococcus aureus
VTAAQNTANELNTA

SEQ ID NO: 1564499 - protein, 23 aa, Staphylococcus aureus
VVKGSGLKADQIQINGKDNKVAT

SEQ ID NO: 1564500 - protein, 9 aa, Staphylococcus aureus
VYTDGQEKF

SEQ ID NO: 1564501 - protein, 16 aa, Staphylococcus aureus
YNEPESKQRYSPNSTY

SEQ ID NO: 1564502 - protein, 13 aa, Staphylococcus aureus
YNIPSNASTKVEL

SEQ ID NO: 1564503 - protein, 11 aa, Staphylococcus aureus
YNKDAQDKYGF

SEQ ID NO: 1564504 - protein, 7 aa, Staphylococcus aureus
YTNVGPK

SEQ ID NO: 1564505 - protein, 31 aa, Staphylococcus aureus
AADTTTIQKSKGNANQASHKDTCKKELDSQD

SEQ ID NO: 1564506 - protein, 6 aa, Staphylococcus aureus
ADDLGG

SEQ ID NO: 1564507 - protein, 29 aa, Staphylococcus aureus
ADKTNTLASSKYVNADSTKQNAYTTKVTN

SEQ ID NO: 1564508 - protein, 8 aa, Staphylococcus aureus
AEREATRS

SEQ ID NO: 1564509 - protein, 5 aa, Staphylococcus aureus
AESNA

SEQ ID NO: 1564510 - protein, 4 aa, Staphylococcus aureus
AGNL

SEQ ID NO: 1564511 - protein, 6 aa, Staphylococcus aureus
AKNTDI

SEQ ID NO: 1564512 - protein, 23 aa, Staphylococcus aureus
AKNVAKKALDAAKSALGIHSPSR

SEQ ID NO: 1564513 - protein, 18 aa, Staphylococcus aureus
AKQDDNVHQSNQKPQVGD

SEQ ID NO: 1564514 - protein, 42 aa, Staphylococcus aureus
ALDKVKDNKTTVKFERDGKTKSVELTPKKTERKLTKVSSETK

SEQ ID NO: 1564515 - protein, 9 aa, Staphylococcus aureus
AQGERAPAQ

SEQ ID NO: 1564516 - protein, 83 aa, Staphylococcus aureus
AQQAAIKEEASANNLSDTSQEAQEVQEAKKEAQAEKDSDTSTKDASAAKVEVSKPESQAERLANAAKQKQAKLTPGSKESQLT

SEQ ID NO: 1564517 - protein, 9 aa, Staphylococcus aureus
ASDALTNPQ

SEQ ID NO: 1564518 - protein, 5 aa, Staphylococcus aureus
ASDEQ

SEQ ID NO: 1564519 - protein, 173 aa, Staphylococcus aureus
ASMNQSGVDSNSASQSASNSTSTSTSESDSQSTSTYTSQSTSQSESTSTSTSLSDSTSISKSTSQSGSTSTSASLSGSESESDSQSISTSASESTSESASTSLSDSTSTSNSGSASTSTSLSNSASASESDSSSTSLSDSTSASMQSSESDSQSTSASLSDSLSTSTSNRMST

SEQ ID NO: 1564520 - protein, 15 aa, Staphylococcus aureus
ASNLNQAQQNNFTQQ

SEQ ID NO: 1564521 - protein, 6 aa, Staphylococcus aureus
ATFRDT

SEQ ID NO: 1564522 - protein, 6 aa, Staphylococcus aureus
CESYSK

SEQ ID NO: 1564523 - protein, 14 aa, Staphylococcus aureus
DHEEASSHITDKEA

SEQ ID NO: 1564524 - protein, 20 aa, Staphylococcus aureus
DIKDPNNGETIATAKHDTAN

SEQ ID NO: 1564525 - protein, 22 aa, Staphylococcus aureus
DKKVFSSGKLKPTKTIDNYSQK

SEQ ID NO: 1564526 - protein, 8 aa, Staphylococcus aureus
DKNNENFN

SEQ ID NO: 1564527 - protein, 7 aa, Staphylococcus aureus
DKNSRMS

SEQ ID NO: 1564528 - protein, 7 aa, Staphylococcus aureus
DKPQKDV

SEQ ID NO: 1564529 - protein, 16 aa, Staphylococcus aureus
DKPTNTPKQAQKSSRL

SEQ ID NO: 1564530 - protein, 7 aa, Staphylococcus aureus
DKSESSA

SEQ ID NO: 1564531 - protein, 5 aa, Staphylococcus aureus
DKYNR

SEQ ID NO: 1564532 - protein, 21 aa, Staphylococcus aureus
DLGGSEAKTSCSNGKGKSIKF

SEQ ID NO: 1564533 - protein, 4 aa, Staphylococcus aureus
DLKK

SEQ ID NO: 1564534 - protein, 9 aa, Staphylococcus aureus
DNDTPNFDV

SEQ ID NO: 1564535 - protein, 6 aa, Staphylococcus aureus
DNFQRQ

SEQ ID NO: 1564536 - protein, 9 aa, Staphylococcus aureus
DNKENVTAN

SEQ ID NO: 1564537 - protein, 7 aa, Staphylococcus aureus
DNLKGDI

SEQ ID NO: 1564538 - protein, 4 aa, Staphylococcus aureus
DPVG

SEQ ID NO: 1564539 - protein, 197 aa, Staphylococcus aureus
DSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSVSDSTSLSTSESDSISESTSTSDSISEAISASESTSISLSESNSTSDSESQSASA

SEQ ID NO: 1564540 - protein, 7 aa, Staphylococcus aureus
DSKPSNV

SEQ ID NO: 1564541 - protein, 6 aa, Staphylococcus aureus
EEQAKG

SEQ ID NO: 1564542 - protein, 11 aa, Staphylococcus aureus
EFPTDDDQITT

SEQ ID NO: 1564543 - protein, 8 aa, Staphylococcus aureus
EGVPSYNQ

SEQ ID NO: 1564544 - protein, 12 aa, Staphylococcus aureus
EHELNSKKMNVK

SEQ ID NO: 1564545 - protein, 13 aa, Staphylococcus aureus
EIERTPDIASATS

SEQ ID NO: 1564546 - protein, 26 aa, Staphylococcus aureus
EIPNAEQTVNYQNADDNAKTNFDDAK

SEQ ID NO: 1564547 - protein, 7 aa, Staphylococcus aureus
EIQQQEQ

SEQ ID NO: 1564548 - protein, 14 aa, Staphylococcus aureus
EKESRKRYSPDSTY

SEQ ID NO: 1564549 - protein, 6 aa, Staphylococcus aureus
EKSEIG

SEQ ID NO: 1564550 - protein, 5 aa, Staphylococcus aureus
ELTSL

SEQ ID NO: 1564551 - protein, 4 aa, Staphylococcus aureus
EPMS

SEQ ID NO: 1564552 - protein, 19 aa, Staphylococcus aureus
ESQWGKGENATRQNNPLSV

SEQ ID NO: 1564553 - protein, 44 aa, Staphylococcus aureus
ESSRTDSDSSMQTEKIKKDSSDGNKSSNLKSEVISDKSNSVPIL

SEQ ID NO: 1564554 - protein, 24 aa, Staphylococcus aureus
ETGAQEASKDEAKKAAAQKGNPVQ

SEQ ID NO: 1564555 - protein, 6 aa, Staphylococcus aureus
ETSPMG

SEQ ID NO: 1564556 - protein, 23 aa, Staphylococcus aureus
EVKAPKEAKEEKPAAKADNNTYP

SEQ ID NO: 1564557 - protein, 7 aa, Staphylococcus aureus
FEDGVTE

SEQ ID NO: 1564558 - protein, 4 aa, Staphylococcus aureus
FGEN

SEQ ID NO: 1564559 - protein, 8 aa, Staphylococcus aureus
FKGASTQT

SEQ ID NO: 1564560 - protein, 9 aa, Staphylococcus aureus
FKPDTVDPT

SEQ ID NO: 1564561 - protein, 21 aa, Staphylococcus aureus
FTDADEAKRNAYTNAVTQAEQ

SEQ ID NO: 1564562 - protein, 6 aa, Staphylococcus aureus
FTNRTK

SEQ ID NO: 1564563 - protein, 30 aa, Staphylococcus aureus
GAINDEQTTLNSQNYQDATPSKKTAYTNAV

SEQ ID NO: 1564564 - protein, 10 aa, Staphylococcus aureus
GATRKKTPNE

SEQ ID NO: 1564565 - protein, 9 aa, Staphylococcus aureus
GDEDEKAFQ

SEQ ID NO: 1564566 - protein, 12 aa, Staphylococcus aureus
GDGTNDAPALAE

SEQ ID NO: 1564567 - protein, 9 aa, Staphylococcus aureus
GEQIPNDGK

SEQ ID NO: 1564568 - protein, 11 aa, Staphylococcus aureus
GGNMEGKETRF

SEQ ID NO: 1564569 - protein, 6 aa, Staphylococcus aureus
GGTSVA

SEQ ID NO: 1564570 - protein, 8 aa, Staphylococcus aureus
GKSGTAEL

SEQ ID NO: 1564571 - protein, 5 aa, Staphylococcus aureus
GKTPI

SEQ ID NO: 1564572 - protein, 11 aa, Staphylococcus aureus
GKVYKKERLET

SEQ ID NO: 1564573 - protein, 8 aa, Staphylococcus aureus
GLTRPQTI

SEQ ID NO: 1564574 - protein, 13 aa, Staphylococcus aureus
GNNMDDYSDYPAR

SEQ ID NO: 1564575 - protein, 10 aa, Staphylococcus aureus
GQKNVEPQFG

SEQ ID NO: 1564576 - protein, 11 aa, Staphylococcus aureus
GQYGLGEKGTV

SEQ ID NO: 1564577 - protein, 7 aa, Staphylococcus aureus
GSDELAE

SEQ ID NO: 1564578 - protein, 12 aa, Staphylococcus aureus
GSLNARKQPAFS

SEQ ID NO: 1564579 - protein, 5 aa, Staphylococcus aureus
GSPEH

SEQ ID NO: 1564580 - protein, 10 aa, Staphylococcus aureus
GTFDKATKQI

SEQ ID NO: 1564581 - protein, 7 aa, Staphylococcus aureus
HAESHSE

SEQ ID NO: 1564582 - protein, 7 aa, Staphylococcus aureus
HCNNDDN

SEQ ID NO: 1564583 - protein, 7 aa, Staphylococcus aureus
HGSDDKI

SEQ ID NO: 1564584 - protein, 4 aa, Staphylococcus aureus
HKQQ

SEQ ID NO: 1564585 - protein, 30 aa, Staphylococcus aureus
HQADQQEQLTEQTHNSVESENTIEEAGEVT

SEQ ID NO: 1564586 - protein, 10 aa, Staphylococcus aureus
HQRDETNALA

SEQ ID NO: 1564587 - protein, 8 aa, Staphylococcus aureus
HQRPETNA

SEQ ID NO: 1564588 - protein, 4 aa, Staphylococcus aureus
HSLT

SEQ ID NO: 1564589 - protein, 54 aa, Staphylococcus aureus
HSTSTSRSSSEATTSTSESQSTLSATSEVTKHNGTPAQSEKRLPDTGDSIKQNG

SEQ ID NO: 1564590 - protein, 13 aa, Staphylococcus aureus
HWSNDDPGKGNLY

SEQ ID NO: 1564591 - protein, 27 aa, Staphylococcus aureus
IANKDQTKASENYIDADPTKKTAFDNA

SEQ ID NO: 1564592 - protein, 9 aa, Staphylococcus aureus
IDPASTGDL

SEQ ID NO: 1564593 - protein, 8 aa, Staphylococcus aureus
IDPATGKD

SEQ ID NO: 1564594 - protein, 7 aa, Staphylococcus aureus
IETEEDS

SEQ ID NO: 1564595 - protein, 29 aa, Staphylococcus aureus
IHKSEDSAVSTTDNNHEVAKTPNNDGSGH

SEQ ID NO: 1564596 - protein, 5 aa, Staphylococcus aureus
IKAQR

SEQ ID NO: 1564597 - protein, 6 aa, Staphylococcus aureus
IKESYS

SEQ ID NO: 1564598 - protein, 11 aa, Staphylococcus aureus
IKQNATNLNSA

SEQ ID NO: 1564599 - protein, 6 aa, Staphylococcus aureus
INNTRI

SEQ ID NO: 1564600 - protein, 9 aa, Staphylococcus aureus
INTTKPIQE

SEQ ID NO: 1564601 - protein, 10 aa, Staphylococcus aureus
INYNTKQLET

SEQ ID NO: 1564602 - protein, 16 aa, Staphylococcus aureus
IPPPTSKFSTSQHNQM

SEQ ID NO: 1564603 - protein, 21 aa, Staphylococcus aureus
IPSDLTDKNDPIDITDPSGEV

SEQ ID NO: 1564604 - protein, 8 aa, Staphylococcus aureus
IRDSNKGF

SEQ ID NO: 1564605 - protein, 7 aa, Staphylococcus aureus
ISNGAPC

SEQ ID NO: 1564606 - protein, 4 aa, Staphylococcus aureus
ISSS

SEQ ID NO: 1564607 - protein, 13 aa, Staphylococcus aureus
KAKENAKQDVDKQ

SEQ ID NO: 1564608 - protein, 19 aa, Staphylococcus aureus
KATNKNKKIETVDNTNITE

SEQ ID NO: 1564609 - protein, 21 aa, Staphylococcus aureus
KDSKEVNDAIAKQKKERQQQI

SEQ ID NO: 1564610 - protein, 7 aa, Staphylococcus aureus
KEAGGHI

SEQ ID NO: 1564611 - protein, 6 aa, Staphylococcus aureus
KELKDK

SEQ ID NO: 1564612 - protein, 7 aa, Staphylococcus aureus
KGIPEEE

SEQ ID NO: 1564613 - protein, 7 aa, Staphylococcus aureus
KGNSVQK

SEQ ID NO: 1564614 - protein, 19 aa, Staphylococcus aureus
KGTKNETFRVTQEDKGKVY

SEQ ID NO: 1564615 - protein, 9 aa, Staphylococcus aureus
KIDDDRKLD

SEQ ID NO: 1564616 - protein, 7 aa, Staphylococcus aureus
KIKNEDL

SEQ ID NO: 1564617 - protein, 17 aa, Staphylococcus aureus
KKGVKDVKGRAAINDDN

SEQ ID NO: 1564618 - protein, 22 aa, Staphylococcus aureus
KKLNESQAPKADNKFNKEQQNA

SEQ ID NO: 1564619 - protein, 36 aa, Staphylococcus aureus
KKNQKDNQSKGKKSASKKPSKKVAAKKKKKKSKKNK

SEQ ID NO: 1564620 - protein, 11 aa, Staphylococcus aureus
KKTYQQHTQDV

SEQ ID NO: 1564621 - protein, 4 aa, Staphylococcus aureus
KLKQ

SEQ ID NO: 1564622 - protein, 6 aa, Staphylococcus aureus
KLQRGI

SEQ ID NO: 1564623 - protein, 7 aa, Staphylococcus aureus
KMGKPVS

SEQ ID NO: 1564624 - protein, 25 aa, Staphylococcus aureus
KNDVSETVNTDNKDTVKQKEAKFEN

SEQ ID NO: 1564625 - protein, 13 aa, Staphylococcus aureus
KPTHSEEESTNSL

SEQ ID NO: 1564626 - protein, 9 aa, Staphylococcus aureus
KSGRSVETC

SEQ ID NO: 1564627 - protein, 7 aa, Staphylococcus aureus
KSHDRNI

SEQ ID NO: 1564628 - protein, 21 aa, Staphylococcus aureus
KSIHDSTYPTIEDGLNAGAKN

SEQ ID NO: 1564629 - protein, 63 aa, Staphylococcus aureus
KSKNEQAALKAQQAAIKEEASANNLSDTSQEAQEIQEAKREAQAEADKSVAVSNEESKASALK

SEQ ID NO: 1564630 - protein, 14 aa, Staphylococcus aureus
KSRGSEISSGNIAT

SEQ ID NO: 1564631 - protein, 8 aa, Staphylococcus aureus
KSSASSAF

SEQ ID NO: 1564632 - protein, 14 aa, Staphylococcus aureus
KTAGGNTPKADVER

SEQ ID NO: 1564633 - protein, 24 aa, Staphylococcus aureus
KVAASNSFGNRSISSSDKTHDAET

SEQ ID NO: 1564634 - protein, 13 aa, Staphylococcus aureus
KVSNELKSSNEKI

SEQ ID NO: 1564635 - protein, 24 aa, Staphylococcus aureus
KYTPTSDGELDIAQGTSMRTTDKY

SEQ ID NO: 1564636 - protein, 7 aa, Staphylococcus aureus
LESSDIQ

SEQ ID NO: 1564637 - protein, 11 aa, Staphylococcus aureus
LGNGSTIIDQN

SEQ ID NO: 1564638 - protein, 9 aa, Staphylococcus aureus
LKDGTKDRV

SEQ ID NO: 1564639 - protein, 8 aa, Staphylococcus aureus
LNDQQQAE

SEQ ID NO: 1564640 - protein, 17 aa, Staphylococcus aureus
LNKSNGQNKTKDQVTEA

SEQ ID NO: 1564641 - protein, 20 aa, Staphylococcus aureus
LNTPQKAKLKEQVGQANRLE

SEQ ID NO: 1564642 - protein, 6 aa, Staphylococcus aureus
LRQDEV

SEQ ID NO: 1564643 - protein, 7 aa, Staphylococcus aureus
LSKPNLD

SEQ ID NO: 1564644 - protein, 11 aa, Staphylococcus aureus
LSTGAGGTKPK

SEQ ID NO: 1564645 - protein, 8 aa, Staphylococcus aureus
NANDLSES

SEQ ID NO: 1564646 - protein, 9 aa, Staphylococcus aureus
NANFGERKH

SEQ ID NO: 1564647 - protein, 7 aa, Staphylococcus aureus
NDVYGEQ

SEQ ID NO: 1564648 - protein, 5 aa, Staphylococcus aureus
NEDAL

SEQ ID NO: 1564649 - protein, 7 aa, Staphylococcus aureus
NEDDASL

SEQ ID NO: 1564650 - protein, 28 aa, Staphylococcus aureus
NENGKQVDKEYELEQGPQDRLQLIKTSE

SEQ ID NO: 1564651 - protein, 7 aa, Staphylococcus aureus
NENKKDD

SEQ ID NO: 1564652 - protein, 14 aa, Staphylococcus aureus
NESRAGKLTDTFPG

SEQ ID NO: 1564653 - protein, 9 aa, Staphylococcus aureus
NGNPTVQNI

SEQ ID NO: 1564654 - protein, 7 aa, Staphylococcus aureus
NKEIEDL

SEQ ID NO: 1564655 - protein, 8 aa, Staphylococcus aureus
NKLSSSSN

SEQ ID NO: 1564656 - protein, 21 aa, Staphylococcus aureus
NNAQKQDLNTQVTNAPNISTV

SEQ ID NO: 1564657 - protein, 11 aa, Staphylococcus aureus
NNFKEEDAKAD

SEQ ID NO: 1564658 - protein, 8 aa, Staphylococcus aureus
NNKVTGNN

SEQ ID NO: 1564659 - protein, 27 aa, Staphylococcus aureus
NNPTINKGNVSSATQAVISSKNALDGV

SEQ ID NO: 1564660 - protein, 18 aa, Staphylococcus aureus
NSEEDERYKKHNAEKQQL

SEQ ID NO: 1564661 - protein, 13 aa, Staphylococcus aureus
NSELEYQPNTPQG

SEQ ID NO: 1564662 - protein, 11 aa, Staphylococcus aureus
NSGTMSAKEAA

SEQ ID NO: 1564663 - protein, 33 aa, Staphylococcus aureus
NSIQDQQQTEAGSKFINEDKPQKDAYQAAVQNA

SEQ ID NO: 1564664 - protein, 27 aa, Staphylococcus aureus
NTSSSGIQTEEKPQIENPSNELPLNPL

SEQ ID NO: 1564665 - protein, 7 aa, Staphylococcus aureus
NTTYDTE

SEQ ID NO: 1564666 - protein, 5 aa, Staphylococcus aureus
PAFTE

SEQ ID NO: 1564667 - protein, 29 aa, Staphylococcus aureus
PAVSEQPAKGQQSSKGSESGKDAQPIGKD

SEQ ID NO: 1564668 - protein, 5 aa, Staphylococcus aureus
PEDMA

SEQ ID NO: 1564669 - protein, 12 aa, Staphylococcus aureus
PEISTSSRKFGS

SEQ ID NO: 1564670 - protein, 12 aa, Staphylococcus aureus
PENVTKTGNVTL

SEQ ID NO: 1564671 - protein, 4 aa, Staphylococcus aureus
PESA

SEQ ID NO: 1564672 - protein, 4 aa, Staphylococcus aureus
PETD

SEQ ID NO: 1564673 - protein, 4 aa, Staphylococcus aureus
PSKE

SEQ ID NO: 1564674 - protein, 18 aa, Staphylococcus aureus
PSVALGTNKLASSFGSLT

SEQ ID NO: 1564675 - protein, 11 aa, Staphylococcus aureus
PTFNKEGANQI

SEQ ID NO: 1564676 - protein, 8 aa, Staphylococcus aureus
QADQQEQL

SEQ ID NO: 1564677 - protein, 29 aa, Staphylococcus aureus
QADQQEQLTEQTHNSVESENTIEEAGEVT

SEQ ID NO: 1564678 - protein, 11 aa, Staphylococcus aureus
QAKQTAKQQLN

SEQ ID NO: 1564679 - protein, 7 aa, Staphylococcus aureus
QDNPDHN

SEQ ID NO: 1564680 - protein, 10 aa, Staphylococcus aureus
QGAGGHDGHY

SEQ ID NO: 1564681 - protein, 8 aa, Staphylococcus aureus
QGTPQTLK

SEQ ID NO: 1564682 - protein, 7 aa, Staphylococcus aureus
QKAGIKK

SEQ ID NO: 1564683 - protein, 9 aa, Staphylococcus aureus
QRDDRNKNV

SEQ ID NO: 1564684 - protein, 21 aa, Staphylococcus aureus
QSDNYVNADTNKKNDYNNAYN

SEQ ID NO: 1564685 - protein, 7 aa, Staphylococcus aureus
QSEQPRW

SEQ ID NO: 1564686 - protein, 5 aa, Staphylococcus aureus
QTRQS

SEQ ID NO: 1564687 - protein, 11 aa, Staphylococcus aureus
QVKTKAEQLDQ

SEQ ID NO: 1564688 - protein, 7 aa, Staphylococcus aureus
QVQSSNY

SEQ ID NO: 1564689 - protein, 55 aa, Staphylococcus aureus
RGTVSSGREGSDRALEGTAVSSKSGKQLASMSAPKGSTHEKQLPKTGTDQSSSPA

SEQ ID NO: 1564690 - protein, 104 aa, Staphylococcus aureus
RKADEKTPNNTAVDKKSGKQSKKTTPSNKRNASKASTNKTSGQKKQHNKKASQGAKKQSSSSNSTTKTNQKNSKATNAKSSNASKKSNAKVEKAKSKIEKRTFN

SEQ ID NO: 1564691 - protein, 107 aa, Staphylococcus aureus
RKADEKTTNNTAVDKKSGKQSKKTTPSNKRNASKASTNKTSGQKKQHNKKSSQGAKKQSSSSKLTQKNNQTSNKNSKTTNAKSSNASKTPNAKVEKANSKIEKRTFN

SEQ ID NO: 1564692 - protein, 7 aa, Staphylococcus aureus
RRAAYKE

SEQ ID NO: 1564693 - protein, 83 aa, Staphylococcus aureus
RRAQDLNRRNQQQIPQNSAANNETSNSSPAAGNGVASTPPSAPSGDTAPNNNVTQNTAPNSNNAPVSTTPQSTSGKKDGQSFA

SEQ ID NO: 1564694 - protein, 7 aa, Staphylococcus aureus
SDFEDVT

SEQ ID NO: 1564695 - protein, 7 aa, Staphylococcus aureus
SDGGKTF

SEQ ID NO: 1564696 - protein, 14 aa, Staphylococcus aureus
SGDNFKDNKKDSLG

SEQ ID NO: 1564697 - protein, 7 aa, Staphylococcus aureus
SGFPTGT

SEQ ID NO: 1564698 - protein, 8 aa, Staphylococcus aureus
SGKKEDDI

SEQ ID NO: 1564699 - protein, 5 aa, Staphylococcus aureus
SGKVE

SEQ ID NO: 1564700 - protein, 5 aa, Staphylococcus aureus
SKKDG

SEQ ID NO: 1564701 - protein, 9 aa, Staphylococcus aureus
SKNFGSNSG

SEQ ID NO: 1564702 - protein, 149 aa, Staphylococcus aureus
SLSESTSESTSESVSSSTSESTSLSDSTSESGSTSTSLSNSTSGSASISTSTSISESTSTFKSESVSTSLSMSTSTSLSNSTSLSTSLSDSTSDSKSDSLSTSMSTSDSISTSKSDSISTSTSLSGSTSESESDSTSSSESKSDSTSMS

SEQ ID NO: 1564703 - protein, 181 aa, Staphylococcus aureus
SMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQDKSDSTSISDSESVSTSTSTSLSTSDSTSTSESLSTSMSGSQSISDSTSTSMSGSTSTSESNSMHPSDS

SEQ ID NO: 1564704 - protein, 5 aa, Staphylococcus aureus
SPTKQ

SEQ ID NO: 1564705 - protein, 4 aa, Staphylococcus aureus
SQHP

SEQ ID NO: 1564706 - protein, 15 aa, Staphylococcus aureus
SQKGQQYKTKHTDIT

SEQ ID NO: 1564707 - protein, 5 aa, Staphylococcus aureus
SRKQQ

SEQ ID NO: 1564708 - protein, 6 aa, Staphylococcus aureus
SRKQQE

SEQ ID NO: 1564709 - protein, 11 aa, Staphylococcus aureus
SRQYKDSQKQV

SEQ ID NO: 1564710 - protein, 4 aa, Staphylococcus aureus
SSFE

SEQ ID NO: 1564711 - protein, 14 aa, Staphylococcus aureus
SSSANNGSGFEGLG

SEQ ID NO: 1564712 - protein, 149 aa, Staphylococcus aureus
STSASTSKSTSVSLSDSVSASKSLSTSESNSVSSSTSTSLVNSQSVSSSMSGSVSKSTSLSDSISNSNSTEKSESLSTSTSDSLRTSTSLSDSLSMSTSGSLSKSQSLSTSISGSSSTSASLSDSTSNAISTSTSLSESASTSDSISIS

SEQ ID NO: 1564713 - protein, 8 aa, Staphylococcus aureus
STYSSDVG

SEQ ID NO: 1564714 - protein, 5 aa, Staphylococcus aureus
SYGEA

SEQ ID NO: 1564715 - protein, 10 aa, Staphylococcus aureus
TGIGTNTASK

SEQ ID NO: 1564716 - protein, 18 aa, Staphylococcus aureus
THNSVESENTIEEAGEVT

SEQ ID NO: 1564717 - protein, 9 aa, Staphylococcus aureus
TIADKHKTQ

SEQ ID NO: 1564718 - protein, 5 aa, Staphylococcus aureus
TNDSQ

SEQ ID NO: 1564719 - protein, 9 aa, Staphylococcus aureus
TNGDLGQGE

SEQ ID NO: 1564720 - protein, 8 aa, Staphylococcus aureus
TNISKERH

SEQ ID NO: 1564721 - protein, 5 aa, Staphylococcus aureus
TNPVK

SEQ ID NO: 1564722 - protein, 10 aa, Staphylococcus aureus
TNTSSNGDSL

SEQ ID NO: 1564723 - protein, 8 aa, Staphylococcus aureus
TNVGKTGW

SEQ ID NO: 1564724 - protein, 10 aa, Staphylococcus aureus
TPSESRKQDH

SEQ ID NO: 1564725 - protein, 33 aa, Staphylococcus aureus
TQIAKDTDKGVDNSLGMTSNVDTDKDSNKNEGK

SEQ ID NO: 1564726 - protein, 5 aa, Staphylococcus aureus
TRQPK

SEQ ID NO: 1564727 - protein, 7 aa, Staphylococcus aureus
TSEPGHS

SEQ ID NO: 1564728 - protein, 36 aa, Staphylococcus aureus
TSIQNDNTTKTSQNYLDASDSNKNNYNTAVNNANGV

SEQ ID NO: 1564729 - protein, 12 aa, Staphylococcus aureus
TSNSSSDKLSGR

SEQ ID NO: 1564730 - protein, 9 aa, Staphylococcus aureus
TSPSHLTAT

SEQ ID NO: 1564731 - protein, 21 aa, Staphylococcus aureus
TSVSSNITKQLPSSDIKTQTF

SEQ ID NO: 1564732 - protein, 12 aa, Staphylococcus aureus
TVKQQGTDLNTA

SEQ ID NO: 1564733 - protein, 61 aa, Staphylococcus aureus
VAQPRTASESKPRVTRSADVAEAKEASDVSEVKGTDVTSKVTVESGSIEAPQGNKVEPHAG

SEQ ID NO: 1564734 - protein, 14 aa, Staphylococcus aureus
VEESKRIEVDENKE

SEQ ID NO: 1564735 - protein, 11 aa, Staphylococcus aureus
VEQDGQKQTTL

SEQ ID NO: 1564736 - protein, 12 aa, Staphylococcus aureus
VMDPAKQPAPSK

SEQ ID NO: 1564737 - protein, 9 aa, Staphylococcus aureus
VPGAKSGLN

SEQ ID NO: 1564738 - protein, 10 aa, Staphylococcus aureus
VYTKGSKDEL

SEQ ID NO: 1564739 - protein, 20 aa, Staphylococcus aureus
WNDRAKAEGYKVDKNPEPGA

SEQ ID NO: 1564740 - protein, 7 aa, Staphylococcus aureus
YAGETDL

SEQ ID NO: 1564741 - protein, 14 aa, Staphylococcus aureus
YDEEVEYHDKKITF

SEQ ID NO: 1564742 - protein, 17 aa, Staphylococcus aureus
YDKEGYRDGEFKKGDKG

SEQ ID NO: 1564743 - protein, 8 aa, Staphylococcus aureus
YEGDKKLP

SEQ ID NO: 1564744 - protein, 14 aa, Staphylococcus aureus
YESSIADDTPEGRS

SEQ ID NO: 1564745 - protein, 13 aa, Staphylococcus aureus
YPDNSSTDNGKID

SEQ ID NO: 1564746 - protein, 4 aa, Staphylococcus aureus
YPNG

SEQ ID NO: 1564747 - protein, 4 aa, Staphylococcus aureus
YRVP

SEQ ID NO: 1564748 - protein, 10 aa, Staphylococcus aureus
YSRDTPKSEI

SEQ ID NO: 1564749 - protein, 5 aa, Staphylococcus aureus
YTTDP

SEQ ID NO: 1564750 - protein, 7 aa, Staphylococcus aureus
YTYTDTE

SEQ ID NO: 1564751 - protein, 31 aa, Staphylococcus aureus
AGVTGNLGGNSSKEANKTHKIGETVKNGDLE

SEQ ID NO: 1564752 - protein, 8 aa, Staphylococcus aureus
AKAPPLNK

SEQ ID NO: 1564753 - protein, 14 aa, Staphylococcus aureus
AKKREEYRKKWYQN

SEQ ID NO: 1564754 - protein, 9 aa, Staphylococcus aureus
AKTNATQAI

SEQ ID NO: 1564755 - protein, 60 aa, Staphylococcus aureus
DEITTKDQSDDEINTPNVAEDKSQDDLKDDLKEKQQSSNHHQSTQPKTSPSTETNRQQSF

SEQ ID NO: 1564756 - protein, 14 aa, Staphylococcus aureus
DEMDKKEKEKLSQQ

SEQ ID NO: 1564757 - protein, 5 aa, Staphylococcus aureus
DFKAP

SEQ ID NO: 1564758 - protein, 6 aa, Staphylococcus aureus
DGLKTG

SEQ ID NO: 1564759 - protein, 24 aa, Staphylococcus aureus
DGVKNQYTNVNGSIETFDKEKNKF

SEQ ID NO: 1564760 - protein, 7 aa, Staphylococcus aureus
DIASYTP

SEQ ID NO: 1564761 - protein, 8 aa, Staphylococcus aureus
DKANRQIE

SEQ ID NO: 1564762 - protein, 33 aa, Staphylococcus aureus
DKHKQNADSSETVGYQSQSTASHRSTEKRNISI

SEQ ID NO: 1564763 - protein, 12 aa, Staphylococcus aureus
DKPSSRKKKGGN

SEQ ID NO: 1564764 - protein, 9 aa, Staphylococcus aureus
DKQWEDAKK

SEQ ID NO: 1564765 - protein, 7 aa, Staphylococcus aureus
DLDNSKD

SEQ ID NO: 1564766 - protein, 7 aa, Staphylococcus aureus
DNLDNEN

SEQ ID NO: 1564767 - protein, 4 aa, Staphylococcus aureus
DVQR

SEQ ID NO: 1564768 - protein, 30 aa, Staphylococcus aureus
EEQGATKDYDKDIKKAIDDVKETKKDEFAK

SEQ ID NO: 1564769 - protein, 15 aa, Staphylococcus aureus
EESNNDEGLRTQKLF

SEQ ID NO: 1564770 - protein, 6 aa, Staphylococcus aureus
EGVANA

SEQ ID NO: 1564771 - protein, 8 aa, Staphylococcus aureus
EGVPSYEQ

SEQ ID NO: 1564772 - protein, 23 aa, Staphylococcus aureus
EKVNELNGNERVAEAKTQAKQTI

SEQ ID NO: 1564773 - protein, 5 aa, Staphylococcus aureus
ENGPT

SEQ ID NO: 1564774 - protein, 7 aa, Staphylococcus aureus
ENKNNEL

SEQ ID NO: 1564775 - protein, 5 aa, Staphylococcus aureus
ETDTT

SEQ ID NO: 1564776 - protein, 144 aa, Staphylococcus aureus
FAASDAPLTSELNTQSETVGNQNSTTIEASTSTTDSTSVTKNSSSEQTSNSDTVSSEKSENVTSTTNSTSNQQEKLTSTSESTSPKNTTSSSDTKSVTSISSTDQQTNTSTNQSTASNTTSQSTTPASANLNKTSTTSTSTAPI

SEQ ID NO: 1564777 - protein, 14 aa, Staphylococcus aureus
FNDNSKSQIERQQT

SEQ ID NO: 1564778 - protein, 4 aa, Staphylococcus aureus
FTTG

SEQ ID NO: 1564779 - protein, 23 aa, Staphylococcus aureus
GHNDINNAMTKEEIEQAKAQLAQ

SEQ ID NO: 1564780 - protein, 10 aa, Staphylococcus aureus
GNGDSSQTRI

SEQ ID NO: 1564781 - protein, 5 aa, Staphylococcus aureus
GQIRP

SEQ ID NO: 1564782 - protein, 143 aa, Staphylococcus aureus
HEAQASEKIPTTNAAAQKETLNQPGEQGNAITSHQMQSGKQLDDMHKENGKSGTVTEGKDMLQSSKHQSTQNSKIIRTQNDNQVKQDSERQGSKQSHQNNATNKTERQNDQIQNTHHAERNGSQSTTSQSNDVDKSQPSIPAQ

SEQ ID NO: 1564783 - protein, 42 aa, Staphylococcus aureus
HQAQAAENTNTSDKISENQNNNATTTQQPKDTNQTQPATQPV

SEQ ID NO: 1564784 - protein, 154 aa, Staphylococcus aureus
HQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTR

SEQ ID NO: 1564785 - protein, 13 aa, Staphylococcus aureus
IDKVKTANNRINE

SEQ ID NO: 1564786 - protein, 12 aa, Staphylococcus aureus
IEKNENVDLSKE

SEQ ID NO: 1564787 - protein, 16 aa, Staphylococcus aureus
IESIENAAQQKIDEIN

SEQ ID NO: 1564788 - protein, 9 aa, Staphylococcus aureus
IGGKENLEA

SEQ ID NO: 1564789 - protein, 7 aa, Staphylococcus aureus
IKNAKNK

SEQ ID NO: 1564790 - protein, 9 aa, Staphylococcus aureus
ISERSLADK

SEQ ID NO: 1564791 - protein, 14 aa, Staphylococcus aureus
ISKNTAKDERTSEF

SEQ ID NO: 1564792 - protein, 12 aa, Staphylococcus aureus
ISNKKVYAKLKK

SEQ ID NO: 1564793 - protein, 61 aa, Staphylococcus aureus
ISSRDGEDFKRPSSVSGSIPSINVSGSQDNNTTNRSTHGGSDTSANSSGTAQSNNNTRSQQ

SEQ ID NO: 1564794 - protein, 20 aa, Staphylococcus aureus
KAANPFAKELENRKKAAISK

SEQ ID NO: 1564795 - protein, 10 aa, Staphylococcus aureus
KDDKSNTGNR

SEQ ID NO: 1564796 - protein, 20 aa, Staphylococcus aureus
KDKDGNVETTTSIESKDEDV

SEQ ID NO: 1564797 - protein, 21 aa, Staphylococcus aureus
KDSKAVNDAIAKQKKERQQQI

SEQ ID NO: 1564798 - protein, 7 aa, Staphylococcus aureus
KFNPDAK

SEQ ID NO: 1564799 - protein, 39 aa, Staphylococcus aureus
KGKTPEEAALEHDDNNKNHYNENTRYEYDEDTNATHQRT

SEQ ID NO: 1564800 - protein, 12 aa, Staphylococcus aureus
KIWTSDDNAAYD

SEQ ID NO: 1564801 - protein, 8 aa, Staphylococcus aureus
KKKKQTFK

SEQ ID NO: 1564802 - protein, 15 aa, Staphylococcus aureus
KKTLDDIKKDDKHID

SEQ ID NO: 1564803 - protein, 13 aa, Staphylococcus aureus
KKVSKNKKRVDAQ

SEQ ID NO: 1564804 - protein, 9 aa, Staphylococcus aureus
KLSEKELEN

SEQ ID NO: 1564805 - protein, 6 aa, Staphylococcus aureus
KNGKHF

SEQ ID NO: 1564806 - protein, 30 aa, Staphylococcus aureus
KNYPAADESLKDAIKDPALENKEHDIGPRE

SEQ ID NO: 1564807 - protein, 35 aa, Staphylococcus aureus
KPANKYGESPKYPSTIKNQPVTSETPKTPEETDNQ

SEQ ID NO: 1564808 - protein, 5 aa, Staphylococcus aureus
KPNKN

SEQ ID NO: 1564809 - protein, 8 aa, Staphylococcus aureus
KQGETGRQ

SEQ ID NO: 1564810 - protein, 6 aa, Staphylococcus aureus
KSDELQ

SEQ ID NO: 1564811 - protein, 25 aa, Staphylococcus aureus
KTVQSNGQQTITSKLNGKETSGTMQ

SEQ ID NO: 1564812 - protein, 9 aa, Staphylococcus aureus
KVKKGDTMT

SEQ ID NO: 1564813 - protein, 9 aa, Staphylococcus aureus
KVQNNGSYS

SEQ ID NO: 1564814 - protein, 9 aa, Staphylococcus aureus
KVQPTNNTF

SEQ ID NO: 1564815 - protein, 21 aa, Staphylococcus aureus
LDSEPSKQVVPGMNAEVKIHK

SEQ ID NO: 1564816 - protein, 7 aa, Staphylococcus aureus
LGGGGMS

SEQ ID NO: 1564817 - protein, 25 aa, Staphylococcus aureus
LKTTVTPTKVEENEAIQEDQVQYEN

SEQ ID NO: 1564818 - protein, 4 aa, Staphylococcus aureus
LNEE

SEQ ID NO: 1564819 - protein, 7 aa, Staphylococcus aureus
LNGTSEV

SEQ ID NO: 1564820 - protein, 22 aa, Staphylococcus aureus
LQLGNPKNKTNTPLISESSDRH

SEQ ID NO: 1564821 - protein, 14 aa, Staphylococcus aureus
LSSTGNKSVSTGNA

SEQ ID NO: 1564822 - protein, 6 aa, Staphylococcus aureus
LVNSGG

SEQ ID NO: 1564823 - protein, 6 aa, Staphylococcus aureus
MYSGNE

SEQ ID NO: 1564824 - protein, 14 aa, Staphylococcus aureus
NAQQPERGKIYDRN

SEQ ID NO: 1564825 - protein, 8 aa, Staphylococcus aureus
NDNKTATV

SEQ ID NO: 1564826 - protein, 9 aa, Staphylococcus aureus
NGKIARDTF

SEQ ID NO: 1564827 - protein, 7 aa, Staphylococcus aureus
NGLPQSV

SEQ ID NO: 1564828 - protein, 5 aa, Staphylococcus aureus
NIEKN

SEQ ID NO: 1564829 - protein, 13 aa, Staphylococcus aureus
NKANGDGKYGPIV

SEQ ID NO: 1564830 - protein, 16 aa, Staphylococcus aureus
NKNSGSNLDKAAVENA

SEQ ID NO: 1564831 - protein, 15 aa, Staphylococcus aureus
NKSTGTNVPKDQVEA

SEQ ID NO: 1564832 - protein, 21 aa, Staphylococcus aureus
NNAQKADVKSKINAASNIAGV

SEQ ID NO: 1564833 - protein, 12 aa, Staphylococcus aureus
NQITTDSNHATQ

SEQ ID NO: 1564834 - protein, 12 aa, Staphylococcus aureus
NTANAADSGTLN

SEQ ID NO: 1564835 - protein, 16 aa, Staphylococcus aureus
NTVDSTQLKDVTNQMG

SEQ ID NO: 1564836 - protein, 18 aa, Staphylococcus aureus
NVNTHGVATTRKVPDIKN

SEQ ID NO: 1564837 - protein, 10 aa, Staphylococcus aureus
NYGNKNLGSY

SEQ ID NO: 1564838 - protein, 8 aa, Staphylococcus aureus
PDQYTDAN

SEQ ID NO: 1564839 - protein, 8 aa, Staphylococcus aureus
PEEKAAQI

SEQ ID NO: 1564840 - protein, 12 aa, Staphylococcus aureus
PEIKSSTEDKVM

SEQ ID NO: 1564841 - protein, 8 aa, Staphylococcus aureus
PNNQSLTS

SEQ ID NO: 1564842 - protein, 9 aa, Staphylococcus aureus
PTNEQELDR

SEQ ID NO: 1564843 - protein, 10 aa, Staphylococcus aureus
QAVNPSTPRM

SEQ ID NO: 1564844 - protein, 9 aa, Staphylococcus aureus
QAVNTSAPR

SEQ ID NO: 1564845 - protein, 5 aa, Staphylococcus aureus
QKDMA

SEQ ID NO: 1564846 - protein, 8 aa, Staphylococcus aureus
QLKDQSIQ

SEQ ID NO: 1564847 - protein, 6 aa, Staphylococcus aureus
RIGSTI

SEQ ID NO: 1564848 - protein, 5 aa, Staphylococcus aureus
RKKSI

SEQ ID NO: 1564849 - protein, 5 aa, Staphylococcus aureus
RNEGD

SEQ ID NO: 1564850 - protein, 26 aa, Staphylococcus aureus
RRKEDEEDAIVEEKDSLNNDESLDKV

SEQ ID NO: 1564851 - protein, 29 aa, Staphylococcus aureus
RRRKEDEEDVEVTNENTDEKVLQDNEHSP

SEQ ID NO: 1564852 - protein, 5 aa, Staphylococcus aureus
SHDNL

SEQ ID NO: 1564853 - protein, 32 aa, Staphylococcus aureus
SIQDQQQTESGSKFINEDKPQKDAYQAAVQNA

SEQ ID NO: 1564854 - protein, 7 aa, Staphylococcus aureus
SKAVHTK

SEQ ID NO: 1564855 - protein, 170 aa, Staphylococcus aureus
SKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVS

SEQ ID NO: 1564856 - protein, 12 aa, Staphylococcus aureus
SKNFSPTMSDYN

SEQ ID NO: 1564857 - protein, 6 aa, Staphylococcus aureus
SKVADG

SEQ ID NO: 1564858 - protein, 11 aa, Staphylococcus aureus
SNEQNSTKALQ

SEQ ID NO: 1564859 - protein, 7 aa, Staphylococcus aureus
SNGTREV

SEQ ID NO: 1564860 - protein, 4 aa, Staphylococcus aureus
SNKS

SEQ ID NO: 1564861 - protein, 7 aa, Staphylococcus aureus
SQQQQIE

SEQ ID NO: 1564862 - protein, 28 aa, Staphylococcus aureus
SQVTNAKGALNGNHNLEQAKSNANTTIN

SEQ ID NO: 1564863 - protein, 5 aa, Staphylococcus aureus
SSIAG

SEQ ID NO: 1564864 - protein, 9 aa, Staphylococcus aureus
SSSLESSYL

SEQ ID NO: 1564865 - protein, 6 aa, Staphylococcus aureus
SSSLGL

SEQ ID NO: 1564866 - protein, 7 aa, Staphylococcus aureus
SVAGQNA

SEQ ID NO: 1564867 - protein, 10 aa, Staphylococcus aureus
TAEKDSEHPL

SEQ ID NO: 1564868 - protein, 5 aa, Staphylococcus aureus
TASPI

SEQ ID NO: 1564869 - protein, 26 aa, Staphylococcus aureus
TDITQHDTEVDNVDKTAKHSHLNKPS

SEQ ID NO: 1564870 - protein, 8 aa, Staphylococcus aureus
TGYPENRY

SEQ ID NO: 1564871 - protein, 9 aa, Staphylococcus aureus
TKNDRSANI

SEQ ID NO: 1564872 - protein, 8 aa, Staphylococcus aureus
TKTHETDD

SEQ ID NO: 1564873 - protein, 7 aa, Staphylococcus aureus
TNAQKEA

SEQ ID NO: 1564874 - protein, 22 aa, Staphylococcus aureus
TPLANNIKEKESAKTVSPQLKQ

SEQ ID NO: 1564875 - protein, 4 aa, Staphylococcus aureus
TQEK

SEQ ID NO: 1564876 - protein, 13 aa, Staphylococcus aureus
TQGSNENGTQPNV

SEQ ID NO: 1564877 - protein, 7 aa, Staphylococcus aureus
TSSIDGN

SEQ ID NO: 1564878 - protein, 5 aa, Staphylococcus aureus
TTYDE

SEQ ID NO: 1564879 - protein, 63 aa, Staphylococcus aureus
VAQPRTALESKPRVTRSTDVAEAKEASDAKVETGTDVTSKVTVEDESKIEAPKGNNVQPHEGQ

SEQ ID NO: 1564880 - protein, 7 aa, Staphylococcus aureus
VDKQNKN

SEQ ID NO: 1564881 - protein, 5 aa, Staphylococcus aureus
VGTAG

SEQ ID NO: 1564882 - protein, 42 aa, Staphylococcus aureus
VKEEANPQVKETTQSQDNSGDQRQVDLTPKKATQNQVAETQV

SEQ ID NO: 1564883 - protein, 106 aa, Staphylococcus aureus
VKPAVTAPSKNENRQTTKVVSSEATKDQSQTQSARTVKTTQTAQDQNKVQTPVKDVATAKSESNNQAVSDNKSQQTNKVTKQNEVHKQGPSKDSKAKELPKTGLTS

SEQ ID NO: 1564884 - protein, 11 aa, Staphylococcus aureus
VKQTATSLDQA

SEQ ID NO: 1564885 - protein, 6 aa, Staphylococcus aureus
VSKEQY

SEQ ID NO: 1564886 - protein, 8 aa, Staphylococcus aureus
YGTQALRP

SEQ ID NO: 1564887 - protein, 18 aa, Staphylococcus aureus
AADAKGTNVNDKVTASDF

SEQ ID NO: 1564888 - protein, 7 aa, Staphylococcus aureus
AAEQYTP

SEQ ID NO: 1564889 - protein, 5 aa, Staphylococcus aureus
AGRFG

SEQ ID NO: 1564890 - protein, 21 aa, Staphylococcus aureus
AKANGTTADKIAADNKLADKN

SEQ ID NO: 1564891 - protein, 18 aa, Staphylococcus aureus
AKSALSNNSISKDNKLKA

SEQ ID NO: 1564892 - protein, 10 aa, Staphylococcus aureus
ALQDKTETLN

SEQ ID NO: 1564893 - protein, 10 aa, Staphylococcus aureus
APQPNQATTK

SEQ ID NO: 1564894 - protein, 16 aa, Staphylococcus aureus
ATDNVNNTTNDSQSKH

SEQ ID NO: 1564895 - protein, 27 aa, Staphylococcus aureus
AVAPTKKAQSKKSELPETGGEESTNKG

SEQ ID NO: 1564896 - protein, 9 aa, Staphylococcus aureus
AYAEQDQKW

SEQ ID NO: 1564897 - protein, 5 aa, Staphylococcus aureus
AYNDI

SEQ ID NO: 1564898 - protein, 11 aa, Staphylococcus aureus
AYTRETGRPFH

SEQ ID NO: 1564899 - protein, 18 aa, Staphylococcus aureus
DAQKQALKGQIDQSPEIA

SEQ ID NO: 1564900 - protein, 9 aa, Staphylococcus aureus
DASDASTIK

SEQ ID NO: 1564901 - protein, 10 aa, Staphylococcus aureus
DDNPDNDINT

SEQ ID NO: 1564902 - protein, 130 aa, Staphylococcus aureus
DFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPTPPTPEVPAEPGKPVPPAKEEPKKPSKPVEQGK

SEQ ID NO: 1564903 - protein, 8 aa, Staphylococcus aureus
DGDKKVAT

SEQ ID NO: 1564904 - protein, 7 aa, Staphylococcus aureus
DKKYKFQ

SEQ ID NO: 1564905 - protein, 6 aa, Staphylococcus aureus
DKNNKP

SEQ ID NO: 1564906 - protein, 9 aa, Staphylococcus aureus
DKVKSGDYF

SEQ ID NO: 1564907 - protein, 8 aa, Staphylococcus aureus
DRPSLGGV

SEQ ID NO: 1564908 - protein, 9 aa, Staphylococcus aureus
DSLRAQEKI

SEQ ID NO: 1564909 - protein, 10 aa, Staphylococcus aureus
DTLNKEEGKF

SEQ ID NO: 1564910 - protein, 13 aa, Staphylococcus aureus
DTMIKNGKKVKKT

SEQ ID NO: 1564911 - protein, 8 aa, Staphylococcus aureus
EDENLKQK

SEQ ID NO: 1564912 - protein, 16 aa, Staphylococcus aureus
EDNLKDNKREDNPKAK

SEQ ID NO: 1564913 - protein, 4 aa, Staphylococcus aureus
EEGY

SEQ ID NO: 1564914 - protein, 12 aa, Staphylococcus aureus
EEQGATKDFEKD

SEQ ID NO: 1564915 - protein, 4 aa, Staphylococcus aureus
EGTP

SEQ ID NO: 1564916 - protein, 8 aa, Staphylococcus aureus
EIQQQEQA

SEQ ID NO: 1564917 - protein, 60 aa, Staphylococcus aureus
EITTTDQSDDEINTPNVAEEESQDDLKDDLKEKQQPSDHHQSTQPKTSPSTETNKQQSFA

SEQ ID NO: 1564918 - protein, 8 aa, Staphylococcus aureus
EKDAKDRL

SEQ ID NO: 1564919 - protein, 11 aa, Staphylococcus aureus
EKYPITTKQSP

SEQ ID NO: 1564920 - protein, 12 aa, Staphylococcus aureus
ENANDGSGYPVG

SEQ ID NO: 1564921 - protein, 8 aa, Staphylococcus aureus
ENGSEITQ

SEQ ID NO: 1564922 - protein, 9 aa, Staphylococcus aureus
ENRANEDVY

SEQ ID NO: 1564923 - protein, 13 aa, Staphylococcus aureus
EQKLKDADTLKSS

SEQ ID NO: 1564924 - protein, 24 aa, Staphylococcus aureus
ETGAQEASKDEAKQAAAQKGNPVQ

SEQ ID NO: 1564925 - protein, 7 aa, Staphylococcus aureus
ETGVPTM

SEQ ID NO: 1564926 - protein, 10 aa, Staphylococcus aureus
ETTPITKTAT

SEQ ID NO: 1564927 - protein, 7 aa, Staphylococcus aureus
FATPTLG

SEQ ID NO: 1564928 - protein, 12 aa, Staphylococcus aureus
FTHASKKGQQKI

SEQ ID NO: 1564929 - protein, 6 aa, Staphylococcus aureus
GDASYT

SEQ ID NO: 1564930 - protein, 8 aa, Staphylococcus aureus
GDSKGAVT

SEQ ID NO: 1564931 - protein, 25 aa, Staphylococcus aureus
GDTVGKTSNNPLMPPVDTGESIGLG

SEQ ID NO: 1564932 - protein, 28 aa, Staphylococcus aureus
GEAQKLNDSQAPKADAQQNKFNKDQQSA

SEQ ID NO: 1564933 - protein, 5 aa, Staphylococcus aureus
GGRAL

SEQ ID NO: 1564934 - protein, 5 aa, Staphylococcus aureus
GHAPH

SEQ ID NO: 1564935 - protein, 8 aa, Staphylococcus aureus
GHNDINNA

SEQ ID NO: 1564936 - protein, 12 aa, Staphylococcus aureus
GINSLRNEEISH

SEQ ID NO: 1564937 - protein, 19 aa, Staphylococcus aureus
GIQSTGGAPKVNGDDNNAV

SEQ ID NO: 1564938 - protein, 6 aa, Staphylococcus aureus
GKFEKN

SEQ ID NO: 1564939 - protein, 17 aa, Staphylococcus aureus
GNQGNASVNLGGSVTSI

SEQ ID NO: 1564940 - protein, 5 aa, Staphylococcus aureus
GPEQV

SEQ ID NO: 1564941 - protein, 5 aa, Staphylococcus aureus
GQNNV

SEQ ID NO: 1564942 - protein, 9 aa, Staphylococcus aureus
GSNDPINNK

SEQ ID NO: 1564943 - protein, 17 aa, Staphylococcus aureus
GTNNNKSIGSNNPFRGK

SEQ ID NO: 1564944 - protein, 7 aa, Staphylococcus aureus
GVPSYEQ

SEQ ID NO: 1564945 - protein, 8 aa, Staphylococcus aureus
HAQQQALT

SEQ ID NO: 1564946 - protein, 12 aa, Staphylococcus aureus
HGPKTGTPETKT

SEQ ID NO: 1564947 - protein, 11 aa, Staphylococcus aureus
HNRKSNNLKKV

SEQ ID NO: 1564948 - protein, 4 aa, Staphylococcus aureus
HPDV

SEQ ID NO: 1564949 - protein, 15 aa, Staphylococcus aureus
IANRPTDGGLSWSDD

SEQ ID NO: 1564950 - protein, 5 aa, Staphylococcus aureus
IATEP

SEQ ID NO: 1564951 - protein, 82 aa, Staphylococcus aureus
IDKATTDKQQVPPTKEAAHHYGEEAATNVSASAQGTADDTNNKVTSNAPSNKPSTAVSTTVNETRDVDTQQASTQKPTRTAT

SEQ ID NO: 1564952 - protein, 11 aa, Staphylococcus aureus
IDSGDTVYPHQ

SEQ ID NO: 1564953 - protein, 19 aa, Staphylococcus aureus
IEKRHKEEQKAREKNEIQR

SEQ ID NO: 1564954 - protein, 16 aa, Staphylococcus aureus
IESIENAAQQKINEIN

SEQ ID NO: 1564955 - protein, 4 aa, Staphylococcus aureus
ILGG

SEQ ID NO: 1564956 - protein, 9 aa, Staphylococcus aureus
INGKDDMSL

SEQ ID NO: 1564957 - protein, 11 aa, Staphylococcus aureus
INGNNSDSVTV

SEQ ID NO: 1564958 - protein, 6 aa, Staphylococcus aureus
IPSGGQ

SEQ ID NO: 1564959 - protein, 10 aa, Staphylococcus aureus
IRGTNNIGKD

SEQ ID NO: 1564960 - protein, 6 aa, Staphylococcus aureus
ISTSEH

SEQ ID NO: 1564961 - protein, 9 aa, Staphylococcus aureus
ITPNNPSGH

SEQ ID NO: 1564962 - protein, 6 aa, Staphylococcus aureus
KASHEK

SEQ ID NO: 1564963 - protein, 9 aa, Staphylococcus aureus
KDSKAVNDA

SEQ ID NO: 1564964 - protein, 4 aa, Staphylococcus aureus
KEEV

SEQ ID NO: 1564965 - protein, 7 aa, Staphylococcus aureus
KHKKDIT

SEQ ID NO: 1564966 - protein, 7 aa, Staphylococcus aureus
KLAREKK

SEQ ID NO: 1564967 - protein, 8 aa, Staphylococcus aureus
KNKSNNEK

SEQ ID NO: 1564968 - protein, 23 aa, Staphylococcus aureus
KNNGGGKSTPGGNGAANARRAIK

SEQ ID NO: 1564969 - protein, 16 aa, Staphylococcus aureus
KNYKNGRISSNENVPY

SEQ ID NO: 1564970 - protein, 7 aa, Staphylococcus aureus
KPAKNNT

SEQ ID NO: 1564971 - protein, 5 aa, Staphylococcus aureus
KPDYV

SEQ ID NO: 1564972 - protein, 8 aa, Staphylococcus aureus
KQQAIEQI

SEQ ID NO: 1564973 - protein, 7 aa, Staphylococcus aureus
KQTGDGY

SEQ ID NO: 1564974 - protein, 191 aa, Staphylococcus aureus
KSHPEPIEDNDKHETIKDAENNTEHSTVSDKSKAEQSQQPKPYFATGANQANTSKDKHDDVTVKQDKDESKDHHSGKKGAAIGAGTAGVAGAAGAMGVSKAKKHSNDAQNKSNSDKSNNSTEDKASQDKSKDHHNGKKGAAIGAGTAGLAGGAASKSASAASKPHASNNASQNHDEHDNHDRDKERKKGGM

SEQ ID NO: 1564975 - protein, 8 aa, Staphylococcus aureus
KTNYGNID

SEQ ID NO: 1564976 - protein, 9 aa, Staphylococcus aureus
KTPGKSAVD

SEQ ID NO: 1564977 - protein, 4 aa, Staphylococcus aureus
KTPM

SEQ ID NO: 1564978 - protein, 14 aa, Staphylococcus aureus
KTQGANTSKQDVEA

SEQ ID NO: 1564979 - protein, 10 aa, Staphylococcus aureus
KVKTGQQVRV

SEQ ID NO: 1564980 - protein, 28 aa, Staphylococcus aureus
KVNDTNQALNGNQKLADAKQDAKTTLGT

SEQ ID NO: 1564981 - protein, 5 aa, Staphylococcus aureus
LESTN

SEQ ID NO: 1564982 - protein, 7 aa, Staphylococcus aureus
LGTQITT

SEQ ID NO: 1564983 - protein, 7 aa, Staphylococcus aureus
LNAYNQK

SEQ ID NO: 1564984 - protein, 13 aa, Staphylococcus aureus
LNNEQKIQSNRLK

SEQ ID NO: 1564985 - protein, 7 aa, Staphylococcus aureus
LNPRYNT

SEQ ID NO: 1564986 - protein, 9 aa, Staphylococcus aureus
LQAARQKLT

SEQ ID NO: 1564987 - protein, 17 aa, Staphylococcus aureus
LRSYTQSAFNKEGKETQ

SEQ ID NO: 1564988 - protein, 5 aa, Staphylococcus aureus
LSKNQ

SEQ ID NO: 1564989 - protein, 12 aa, Staphylococcus aureus
LSTGAGGTKPKI

SEQ ID NO: 1564990 - protein, 105 aa, Staphylococcus aureus
LVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDA

SEQ ID NO: 1564991 - protein, 16 aa, Staphylococcus aureus
NASSKGAPYNLPTTPW

SEQ ID NO: 1564992 - protein, 5 aa, Staphylococcus aureus
NDDVS

SEQ ID NO: 1564993 - protein, 27 aa, Staphylococcus aureus
NDIDNRSKNKRPNNLPNPSISNSDTNY

SEQ ID NO: 1564994 - protein, 11 aa, Staphylococcus aureus
NDKNKSTSLLE

SEQ ID NO: 1564995 - protein, 9 aa, Staphylococcus aureus
NDSAQNDGL

SEQ ID NO: 1564996 - protein, 8 aa, Staphylococcus aureus
NENKNKSN

SEQ ID NO: 1564997 - protein, 4 aa, Staphylococcus aureus
NGNA

SEQ ID NO: 1564998 - protein, 10 aa, Staphylococcus aureus
NGSAKLNNMT

SEQ ID NO: 1564999 - protein, 6 aa, Staphylococcus aureus
NNDKQY

SEQ ID NO: 1565000 - protein, 58 aa, Staphylococcus aureus
NNDNSTSNQSSKTQLTQKDEDKSENMPEEKSESETDKDLQSTEEVPANENTENNQHEI

SEQ ID NO: 1565001 - protein, 7 aa, Staphylococcus aureus
NNELTGQ

SEQ ID NO: 1565002 - protein, 14 aa, Staphylococcus aureus
NNWDSNARAGIPSR

SEQ ID NO: 1565003 - protein, 6 aa, Staphylococcus aureus
NPPHGA

SEQ ID NO: 1565004 - protein, 23 aa, Staphylococcus aureus
NQTTSPTMNPDDVNGATTQVNNT

SEQ ID NO: 1565005 - protein, 10 aa, Staphylococcus aureus
NRGKFSDEGA

SEQ ID NO: 1565006 - protein, 20 aa, Staphylococcus aureus
NTGDEGNQFNSSIGYKEEKI

SEQ ID NO: 1565007 - protein, 20 aa, Staphylococcus aureus
PAQKLKSPDDIKKELNKKKG

SEQ ID NO: 1565008 - protein, 7 aa, Staphylococcus aureus
PGRSTVD

SEQ ID NO: 1565009 - protein, 4 aa, Staphylococcus aureus
PLDP

SEQ ID NO: 1565010 - protein, 6 aa, Staphylococcus aureus
PLGATG

SEQ ID NO: 1565011 - protein, 4 aa, Staphylococcus aureus
PPET

SEQ ID NO: 1565012 - protein, 7 aa, Staphylococcus aureus
PSTINGR

SEQ ID NO: 1565013 - protein, 80 aa, Staphylococcus aureus
QDLNRRNQQQIPQNSAANNETSNSAPAAGNGVTSTPPSAPNGNTTPNNNVTQNTAPNSNNAPVSTTPQSTSGKKDGQSFA

SEQ ID NO: 1565014 - protein, 5 aa, Staphylococcus aureus
QKSPV

SEQ ID NO: 1565015 - protein, 5 aa, Staphylococcus aureus
QSKLN

SEQ ID NO: 1565016 - protein, 13 aa, Staphylococcus aureus
QSVQTNGQSLNNA

SEQ ID NO: 1565017 - protein, 14 aa, Staphylococcus aureus
QVNQAKGDLNGNHN

SEQ ID NO: 1565018 - protein, 9 aa, Staphylococcus aureus
RENADSGTF

SEQ ID NO: 1565019 - protein, 4 aa, Staphylococcus aureus
REND

SEQ ID NO: 1565020 - protein, 5 aa, Staphylococcus aureus
RPGEK

SEQ ID NO: 1565021 - protein, 15 aa, Staphylococcus aureus
RQSNSETVDVTEDFE

SEQ ID NO: 1565022 - protein, 14 aa, Staphylococcus aureus
SEISSGSVKYEQTY

SEQ ID NO: 1565023 - protein, 5 aa, Staphylococcus aureus
SEKDF

SEQ ID NO: 1565024 - protein, 4 aa, Staphylococcus aureus
SGKY

SEQ ID NO: 1565025 - protein, 12 aa, Staphylococcus aureus
SIARTGKGTPIK

SEQ ID NO: 1565026 - protein, 21 aa, Staphylococcus aureus
SINNAQKRDLTTKIDQATTVA

SEQ ID NO: 1565027 - protein, 10 aa, Staphylococcus aureus
SITDAQKNNL

SEQ ID NO: 1565028 - protein, 9 aa, Staphylococcus aureus
SKEKDDETF

SEQ ID NO: 1565029 - protein, 17 aa, Staphylococcus aureus
SNDTGGGDGTVKPEEKL

SEQ ID NO: 1565030 - protein, 8 aa, Staphylococcus aureus
SNENFTDK

SEQ ID NO: 1565031 - protein, 24 aa, Staphylococcus aureus
SNNAKGDGKDKPNDPIIEKSEPID

SEQ ID NO: 1565032 - protein, 16 aa, Staphylococcus aureus
SQDNQSISKKMTGYGL

SEQ ID NO: 1565033 - protein, 10 aa, Staphylococcus aureus
SRESNYTANA

SEQ ID NO: 1565034 - protein, 6 aa, Staphylococcus aureus
SSTGSL

SEQ ID NO: 1565035 - protein, 11 aa, Staphylococcus aureus
TAFDPNQSGNT

SEQ ID NO: 1565036 - protein, 8 aa, Staphylococcus aureus
TDGLDGLA

SEQ ID NO: 1565037 - protein, 9 aa, Staphylococcus aureus
TDPSRANEA

SEQ ID NO: 1565038 - protein, 12 aa, Staphylococcus aureus
TDTSGNTATTSF

SEQ ID NO: 1565039 - protein, 5 aa, Staphylococcus aureus
TEQQW

SEQ ID NO: 1565040 - protein, 30 aa, Staphylococcus aureus
TIKGVSSKEKDNKYSDKYEFGKKTEYDESK

SEQ ID NO: 1565041 - protein, 7 aa, Staphylococcus aureus
TKKTKGH

SEQ ID NO: 1565042 - protein, 10 aa, Staphylococcus aureus
TNTITANDNF

SEQ ID NO: 1565043 - protein, 12 aa, Staphylococcus aureus
TPANDNKAAKEL

SEQ ID NO: 1565044 - protein, 14 aa, Staphylococcus aureus
TSPSHLTATEIKQQ

SEQ ID NO: 1565045 - protein, 7 aa, Staphylococcus aureus
TTTVPGL

SEQ ID NO: 1565046 - protein, 12 aa, Staphylococcus aureus
TTVTKQGSQKVE

SEQ ID NO: 1565047 - protein, 4 aa, Staphylococcus aureus
VKPV

SEQ ID NO: 1565048 - protein, 7 aa, Staphylococcus aureus
VKTPSNK

SEQ ID NO: 1565049 - protein, 24 aa, Staphylococcus aureus
VNNSIDKRERHESTRVRFRRGGTI

SEQ ID NO: 1565050 - protein, 7 aa, Staphylococcus aureus
VTGETSN

SEQ ID NO: 1565051 - protein, 10 aa, Staphylococcus aureus
YASKQANKPV

SEQ ID NO: 1565052 - protein, 11 aa, Staphylococcus aureus
YDEKEKQKSIY

SEQ ID NO: 1565053 - protein, 46 aa, Staphylococcus aureus
YEKELDKSNTVYDQELERDKYDQFPKRAVESEYNHDERTEEEPSVL

SEQ ID NO: 1565054 - protein, 10 aa, Staphylococcus aureus
YGSNVTAAEI

SEQ ID NO: 1565055 - protein, 13 aa, Staphylococcus aureus
YRVGTSSTAANPV

SEQ ID NO: 1565056 - protein, 15 aa, Staphylococcus aureus
YSDNPNSKSFGGTDA

SEQ ID NO: 1565057 - protein, 101 aa, Staphylococcus aureus
YVPPQQQAPTKQRPAKEENDDKASKDESKDKDDNASQDKSDDNQKKTDDNKQPAQPKPQPQQPTPKPNNNQQNNQSNQQAKPQAPQQNSQSTTNKQNNAND

SEQ ID NO: 1565058 - protein, 5 aa, Staphylococcus aureus
YYRGD

SEQ ID NO: 1565059 - protein, 95 aa, Staphylococcus aureus
AAASEQNNTTVEESGSSATESKASETQTTTNNVNTIDETQSYSATSTEQPSKSTQVTTEEAPTTVQAPKVETEMKSQEDLPSEKVADKETTGTQV

SEQ ID NO: 1565060 - protein, 11 aa, Staphylococcus aureus
AAGSAGTAVGA

SEQ ID NO: 1565061 - protein, 11 aa, Staphylococcus aureus
AANAMNDDSGF

SEQ ID NO: 1565062 - protein, 6 aa, Staphylococcus aureus
AGSANG

SEQ ID NO: 1565063 - protein, 5 aa, Staphylococcus aureus
AIGDS

SEQ ID NO: 1565064 - protein, 6 aa, Staphylococcus aureus
AMQGES

SEQ ID NO: 1565065 - protein, 11 aa, Staphylococcus aureus
ASAATTTAVTA

SEQ ID NO: 1565066 - protein, 7 aa, Staphylococcus aureus
AVSSEQL

SEQ ID NO: 1565067 - protein, 28 aa, Staphylococcus aureus
DDVDTSELVETPKESMSLEEKEKREKIK

SEQ ID NO: 1565068 - protein, 102 aa, Staphylococcus aureus
DFEEDTLPKVSGQNEGQQTIEEDTTPPTPPTPEVPSEPETPTPPTPEVPSEPGEPTPPKPEVPSEPETPVPPTPEVPSEPGKPVPPAKEEPKKPSKPVEQGK

SEQ ID NO: 1565069 - protein, 7 aa, Staphylococcus aureus
DKDYEPV

SEQ ID NO: 1565070 - protein, 34 aa, Staphylococcus aureus
DKHKQNADSSETVGYQSQSTASHRSTEKRNISIN

SEQ ID NO: 1565071 - protein, 8 aa, Staphylococcus aureus
DLTPKGTF

SEQ ID NO: 1565072 - protein, 32 aa, Staphylococcus aureus
DQATQAVTDAKNNLHGDQKLAQDKQRATETLN

SEQ ID NO: 1565073 - protein, 35 aa, Staphylococcus aureus
DTQIAKDTDRNVDNSVGMSSNVDTDKDSNKNKDKV

SEQ ID NO: 1565074 - protein, 26 aa, Staphylococcus aureus
DTSKLSDSYYADPNDSNLKEVTGEFK

SEQ ID NO: 1565075 - protein, 22 aa, Staphylococcus aureus
DVNSAASQVNAAKTALNGDNNL

SEQ ID NO: 1565076 - protein, 16 aa, Staphylococcus aureus
EFSEDSGNGSISGQYD

SEQ ID NO: 1565077 - protein, 7 aa, Staphylococcus aureus
EKTQAEI

SEQ ID NO: 1565078 - protein, 7 aa, Staphylococcus aureus
EMSTKDT

SEQ ID NO: 1565079 - protein, 4 aa, Staphylococcus aureus
ENAN

SEQ ID NO: 1565080 - protein, 8 aa, Staphylococcus aureus
ENIDNVDK

SEQ ID NO: 1565081 - protein, 9 aa, Staphylococcus aureus
ENKSSTREI

SEQ ID NO: 1565082 - protein, 5 aa, Staphylococcus aureus
ENQAS

SEQ ID NO: 1565083 - protein, 4 aa, Staphylococcus aureus
EPIN

SEQ ID NO: 1565084 - protein, 10 aa, Staphylococcus aureus
EQAQKAGIKK

SEQ ID NO: 1565085 - protein, 5 aa, Staphylococcus aureus
ESPFT

SEQ ID NO: 1565086 - protein, 8 aa, Staphylococcus aureus
ETIPGEGF

SEQ ID NO: 1565087 - protein, 15 aa, Staphylococcus aureus
EVTQAQNNADALNTA

SEQ ID NO: 1565088 - protein, 26 aa, Staphylococcus aureus
FSKKTDFAVTNGGGIRASIAKGKVTR

SEQ ID NO: 1565089 - protein, 12 aa, Staphylococcus aureus
FTPEAPKTITEL

SEQ ID NO: 1565090 - protein, 6 aa, Staphylococcus aureus
FTTGTV

SEQ ID NO: 1565091 - protein, 6 aa, Staphylococcus aureus
GANQKK

SEQ ID NO: 1565092 - protein, 8 aa, Staphylococcus aureus
GDNELTAA

SEQ ID NO: 1565093 - protein, 41 aa, Staphylococcus aureus
GDPIPHNHNDSEKMDYKSYAADKAKANKEAHKAKQKNGKLN

SEQ ID NO: 1565094 - protein, 88 aa, Staphylococcus aureus
GEAQAAAEETGGTNTEAQPKTEAVASPTTTSEKAPETKPVANAVSVSNKEVEAPTSETKEAKEVKEVKAPKETKAVKPAAKATNNTYP

SEQ ID NO: 1565095 - protein, 10 aa, Staphylococcus aureus
GENIDKSKTN

SEQ ID NO: 1565096 - protein, 7 aa, Staphylococcus aureus
GHMQSSN

SEQ ID NO: 1565097 - protein, 6 aa, Staphylococcus aureus
GKIGEY

SEQ ID NO: 1565098 - protein, 8 aa, Staphylococcus aureus
GNAAKKGV

SEQ ID NO: 1565099 - protein, 4 aa, Staphylococcus aureus
GPSA

SEQ ID NO: 1565100 - protein, 4 aa, Staphylococcus aureus
GSEF

SEQ ID NO: 1565101 - protein, 6 aa, Staphylococcus aureus
GTHAGG

SEQ ID NO: 1565102 - protein, 4 aa, Staphylococcus aureus
HETN

SEQ ID NO: 1565103 - protein, 5 aa, Staphylococcus aureus
HGTEL

SEQ ID NO: 1565104 - protein, 66 aa, Staphylococcus aureus
IAQPSNVSEIKPRMKRSADVTAVSEKEVAEEAKATGTDVTNKVEVTESSLEGHNKDSNIVNPHNAQ

SEQ ID NO: 1565105 - protein, 6 aa, Staphylococcus aureus
IDKISQ

SEQ ID NO: 1565106 - protein, 9 aa, Staphylococcus aureus
IEKVENSMT

SEQ ID NO: 1565107 - protein, 27 aa, Staphylococcus aureus
IHGQNNGNQSFEEDTEEDKPKYEQGGN

SEQ ID NO: 1565108 - protein, 12 aa, Staphylococcus aureus
IKQTTQSLNTAM

SEQ ID NO: 1565109 - protein, 11 aa, Staphylococcus aureus
IRAKRDKFKKK

SEQ ID NO: 1565110 - protein, 9 aa, Staphylococcus aureus
ISFSPSAIG

SEQ ID NO: 1565111 - protein, 5 aa, Staphylococcus aureus
ISSSV

SEQ ID NO: 1565112 - protein, 13 aa, Staphylococcus aureus
KASLEALNRSKAK

SEQ ID NO: 1565113 - protein, 15 aa, Staphylococcus aureus
KDIIGEKANSFDTTI

SEQ ID NO: 1565114 - protein, 6 aa, Staphylococcus aureus
KGRYHG

SEQ ID NO: 1565115 - protein, 4 aa, Staphylococcus aureus
KGYN

SEQ ID NO: 1565116 - protein, 4 aa, Staphylococcus aureus
KHVK

SEQ ID NO: 1565117 - protein, 13 aa, Staphylococcus aureus
KKKKDENDQDDSQ

SEQ ID NO: 1565118 - protein, 11 aa, Staphylococcus aureus
KNDSSGNSQMV

SEQ ID NO: 1565119 - protein, 8 aa, Staphylococcus aureus
KSKEKLIN

SEQ ID NO: 1565120 - protein, 7 aa, Staphylococcus aureus
KSQISRT

SEQ ID NO: 1565121 - protein, 6 aa, Staphylococcus aureus
KTPKYN

SEQ ID NO: 1565122 - protein, 7 aa, Staphylococcus aureus
KVTSKQI

SEQ ID NO: 1565123 - protein, 32 aa, Staphylococcus aureus
LAEGRGKAQANALRQTQTEMKARRIKQDGSYE

SEQ ID NO: 1565124 - protein, 19 aa, Staphylococcus aureus
LDKNEYEAEPPLFFFSGSL

SEQ ID NO: 1565125 - protein, 14 aa, Staphylococcus aureus
LGGKENIKDVTNCT

SEQ ID NO: 1565126 - protein, 18 aa, Staphylococcus aureus
LKQKDTYKYVGKTGTGIV

SEQ ID NO: 1565127 - protein, 10 aa, Staphylococcus aureus
LNGGKKVDTH

SEQ ID NO: 1565128 - protein, 18 aa, Staphylococcus aureus
LPGTSSFSPVGNFGSNSS

SEQ ID NO: 1565129 - protein, 5 aa, Staphylococcus aureus
LRKDQ

SEQ ID NO: 1565130 - protein, 34 aa, Staphylococcus aureus
LVSTSDTTTIQKSKGNANQASHKDTCKKELDSQD

SEQ ID NO: 1565131 - protein, 6 aa, Staphylococcus aureus
NAAGEI

SEQ ID NO: 1565132 - protein, 16 aa, Staphylococcus aureus
NAQQQINTAKTEAQQV

SEQ ID NO: 1565133 - protein, 26 aa, Staphylococcus aureus
NEQTATLDNNAINQAATTVNTTKAAL

SEQ ID NO: 1565134 - protein, 9 aa, Staphylococcus aureus
NIVSTNPAM

SEQ ID NO: 1565135 - protein, 12 aa, Staphylococcus aureus
NKQSGTNEVQAQ

SEQ ID NO: 1565136 - protein, 6 aa, Staphylococcus aureus
NMSTEL

SEQ ID NO: 1565137 - protein, 14 aa, Staphylococcus aureus
NRKPIELKDFFIKN

SEQ ID NO: 1565138 - protein, 51 aa, Staphylococcus aureus
NSIANSQSASTSKSDSQSTSISLSTSDSKSMSTSESLSDSTSTSGSVSGSL

SEQ ID NO: 1565139 - protein, 47 aa, Staphylococcus aureus
NSIQDNTATKNGQNYLDATERNKTNYNNAVDSANGVINATSNPNMDA

SEQ ID NO: 1565140 - protein, 18 aa, Staphylococcus aureus
NSNVTIDAATSSGSGLDP

SEQ ID NO: 1565141 - protein, 26 aa, Staphylococcus aureus
NSSNDLNQAQKDALKQQVQNATTVAG

SEQ ID NO: 1565142 - protein, 36 aa, Staphylococcus aureus
NTDKNHTGKAAKLDGVRQNYNNTDKVTDKKTTEHLP

SEQ ID NO: 1565143 - protein, 15 aa, Staphylococcus aureus
NVPEDLKKDVDKITK

SEQ ID NO: 1565144 - protein, 21 aa, Staphylococcus aureus
PAHQTKSPDEIKKELESKKND

SEQ ID NO: 1565145 - protein, 7 aa, Staphylococcus aureus
PDSQLNK

SEQ ID NO: 1565146 - protein, 10 aa, Staphylococcus aureus
PGDKVEYKND

SEQ ID NO: 1565147 - protein, 27 aa, Staphylococcus aureus
PGDPFSDLQNGKIKQEAINAQREKLGL

SEQ ID NO: 1565148 - protein, 4 aa, Staphylococcus aureus
PKRD

SEQ ID NO: 1565149 - protein, 7 aa, Staphylococcus aureus
PKSSIKP

SEQ ID NO: 1565150 - protein, 5 aa, Staphylococcus aureus
PLASP

SEQ ID NO: 1565151 - protein, 29 aa, Staphylococcus aureus
PQIQGQNNGNQSFEEDTEKDKPKYEQGGN

SEQ ID NO: 1565152 - protein, 32 aa, Staphylococcus aureus
QAINDKAQTLADGNYLNADPDKQNAYKQAVAK

SEQ ID NO: 1565153 - protein, 9 aa, Staphylococcus aureus
QIPKNYTAA

SEQ ID NO: 1565154 - protein, 34 aa, Staphylococcus aureus
QSIADKDATRASSAYVNAEPNKKQSYDEAVQNAE

SEQ ID NO: 1565155 - protein, 8 aa, Staphylococcus aureus
QTNGNQYI

SEQ ID NO: 1565156 - protein, 18 aa, Staphylococcus aureus
RDKVEDEKNKEKNAKNIR

SEQ ID NO: 1565157 - protein, 10 aa, Staphylococcus aureus
RENKKSGQPA

SEQ ID NO: 1565158 - protein, 15 aa, Staphylococcus aureus
RQSVSKWESAKNYPS

SEQ ID NO: 1565159 - protein, 11 aa, Staphylococcus aureus
RTIESDNNGKD

SEQ ID NO: 1565160 - protein, 7 aa, Staphylococcus aureus
SGAKKNN

SEQ ID NO: 1565161 - protein, 12 aa, Staphylococcus aureus
SGHKQDSEKIAN

SEQ ID NO: 1565162 - protein, 5 aa, Staphylococcus aureus
SGRYS

SEQ ID NO: 1565163 - protein, 30 aa, Staphylococcus aureus
SIQDNAATKANSKYINEDQPEQQNYDQAVQ

SEQ ID NO: 1565164 - protein, 14 aa, Staphylococcus aureus
SLPKVQNSDEMAQQ

SEQ ID NO: 1565165 - protein, 39 aa, Staphylococcus aureus
SLSSSANASQTDNGVNRSGSEDPTVYSATSTKKLHKEPA

SEQ ID NO: 1565166 - protein, 8 aa, Staphylococcus aureus
SNAQQPSA

SEQ ID NO: 1565167 - protein, 5 aa, Staphylococcus aureus
SNPEA

SEQ ID NO: 1565168 - protein, 5 aa, Staphylococcus aureus
SRDYP

SEQ ID NO: 1565169 - protein, 10 aa, Staphylococcus aureus
SRKNPDLHKK

SEQ ID NO: 1565170 - protein, 5 aa, Staphylococcus aureus
SSPQN

SEQ ID NO: 1565171 - protein, 14 aa, Staphylococcus aureus
SSSKTYGPYPQNKD

SEQ ID NO: 1565172 - protein, 11 aa, Staphylococcus aureus
SSTSPSHLTAT

SEQ ID NO: 1565173 - protein, 9 aa, Staphylococcus aureus
TGGLTTSPV

SEQ ID NO: 1565174 - protein, 13 aa, Staphylococcus aureus
TGINSLRNEEISH

SEQ ID NO: 1565175 - protein, 17 aa, Staphylococcus aureus
TGQVTSGYKQSANNPTV

SEQ ID NO: 1565176 - protein, 7 aa, Staphylococcus aureus
TIEGGKD

SEQ ID NO: 1565177 - protein, 31 aa, Staphylococcus aureus
TTKDDGIVQPSITKDIKKTLDDIKKDDKHID

SEQ ID NO: 1565178 - protein, 18 aa, Staphylococcus aureus
TTTVNGEQTIQSPETAQA

SEQ ID NO: 1565179 - protein, 24 aa, Staphylococcus aureus
VDAKDAAMTKAIKDKNKAELESLN

SEQ ID NO: 1565180 - protein, 9 aa, Staphylococcus aureus
VEGAEGHAE

SEQ ID NO: 1565181 - protein, 25 aa, Staphylococcus aureus
VNAAKQALNGNANVQHAKDEATALI

SEQ ID NO: 1565182 - protein, 10 aa, Staphylococcus aureus
VNKNISESNF

SEQ ID NO: 1565183 - protein, 10 aa, Staphylococcus aureus
VTNNKTETNV

SEQ ID NO: 1565184 - protein, 25 aa, Staphylococcus aureus
YHNTSKPNAAAKANADPSNVAGGGA

SEQ ID NO: 1565185 - protein, 8 aa, Staphylococcus aureus
YKGAPNSM

SEQ ID NO: 1565186 - protein, 7 aa, Staphylococcus aureus
YRGYDSA

SEQ ID NO: 1565187 - protein, 15 aa, Staphylococcus aureus
AAANNGSGFEGLKDD

SEQ ID NO: 1565188 - protein, 14 aa, Staphylococcus aureus
ADAPAAGTDITNQL

SEQ ID NO: 1565189 - protein, 14 aa, Staphylococcus aureus
AEKREEHRKKWYQN

SEQ ID NO: 1565190 - protein, 23 aa, Staphylococcus aureus
AGGNYTNASPDKQGAYTDAYNAA

SEQ ID NO: 1565191 - protein, 11 aa, Staphylococcus aureus
ANDDKTVGEAL

SEQ ID NO: 1565192 - protein, 13 aa, Staphylococcus aureus
ANRQQPNNQQAGV

SEQ ID NO: 1565193 - protein, 5 aa, Staphylococcus aureus
ARGAR

SEQ ID NO: 1565194 - protein, 14 aa, Staphylococcus aureus
ASIDSGSNNQYQKN

SEQ ID NO: 1565195 - protein, 14 aa, Staphylococcus aureus
ASNVPTSKTGAAIR

SEQ ID NO: 1565196 - protein, 18 aa, Staphylococcus aureus
ASNVPTSKTGAAIRKQAP

SEQ ID NO: 1565197 - protein, 13 aa, Staphylococcus aureus
ASTAPGNFKDGTD

SEQ ID NO: 1565198 - protein, 6 aa, Staphylococcus aureus
DAISSA

SEQ ID NO: 1565199 - protein, 23 aa, Staphylococcus aureus
DDNPDNDINTPSLSKIDDDRKLD

SEQ ID NO: 1565200 - protein, 21 aa, Staphylococcus aureus
DEAVDKAKQALDKSTGQNLTA

SEQ ID NO: 1565201 - protein, 12 aa, Staphylococcus aureus
DEVEKKNNKYMT

SEQ ID NO: 1565202 - protein, 88 aa, Staphylococcus aureus
DFEEDTLPKVSGQNEGQQTIEEDTTPPTPPTPEVPSEPGTPTPPTPEVPSEPGKPTPPTPEVPAEPGKPVPPAKEEPKKPSKPVEQGK

SEQ ID NO: 1565203 - protein, 15 aa, Staphylococcus aureus
DKIEESSGKVSATDT

SEQ ID NO: 1565204 - protein, 7 aa, Staphylococcus aureus
DNSEENV

SEQ ID NO: 1565205 - protein, 10 aa, Staphylococcus aureus
DPNTNTNGIT

SEQ ID NO: 1565206 - protein, 20 aa, Staphylococcus aureus
DQEIQRGPVNHETPSHENHV

SEQ ID NO: 1565207 - protein, 6 aa, Staphylococcus aureus
DQQGHT

SEQ ID NO: 1565208 - protein, 6 aa, Staphylococcus aureus
DQVPVG

SEQ ID NO: 1565209 - protein, 8 aa, Staphylococcus aureus
DQYQEGAD

SEQ ID NO: 1565210 - protein, 17 aa, Staphylococcus aureus
DRNQVKQSDDKKHASRY

SEQ ID NO: 1565211 - protein, 16 aa, Staphylococcus aureus
DSPDTWKNTVGNTHKT

SEQ ID NO: 1565212 - protein, 16 aa, Staphylococcus aureus
DVTSQFDNKKSFSNNV

SEQ ID NO: 1565213 - protein, 8 aa, Staphylococcus aureus
DVTTSQKI

SEQ ID NO: 1565214 - protein, 5 aa, Staphylococcus aureus
EGIDK

SEQ ID NO: 1565215 - protein, 6 aa, Staphylococcus aureus
EIIPES

SEQ ID NO: 1565216 - protein, 13 aa, Staphylococcus aureus
EINSGSVKYEQTY

SEQ ID NO: 1565217 - protein, 8 aa, Staphylococcus aureus
EKDPKGVD

SEQ ID NO: 1565218 - protein, 12 aa, Staphylococcus aureus
EKVGNGAEHSKT

SEQ ID NO: 1565219 - protein, 13 aa, Staphylococcus aureus
ENGSDSGRTNSIL

SEQ ID NO: 1565220 - protein, 8 aa, Staphylococcus aureus
ENKNGAPV

SEQ ID NO: 1565221 - protein, 10 aa, Staphylococcus aureus
ESTQDHQQRL

SEQ ID NO: 1565222 - protein, 17 aa, Staphylococcus aureus
EVRGKKASKNKRPSQLS

SEQ ID NO: 1565223 - protein, 4 aa, Staphylococcus aureus
EVTQ

SEQ ID NO: 1565224 - protein, 5 aa, Staphylococcus aureus
FDSRQ

SEQ ID NO: 1565225 - protein, 16 aa, Staphylococcus aureus
FINEDQAQKDAYTQAV

SEQ ID NO: 1565226 - protein, 4 aa, Staphylococcus aureus
FKDA

SEQ ID NO: 1565227 - protein, 7 aa, Staphylococcus aureus
FKTNDNQ

SEQ ID NO: 1565228 - protein, 18 aa, Staphylococcus aureus
FTDADPEKQTAYNNAVTA

SEQ ID NO: 1565229 - protein, 29 aa, Staphylococcus aureus
FTTPEGYTPTTVTSGSDIEKDSNGLTTTG

SEQ ID NO: 1565230 - protein, 9 aa, Staphylococcus aureus
GIGSTTANK

SEQ ID NO: 1565231 - protein, 8 aa, Staphylococcus aureus
GKFPDRKN

SEQ ID NO: 1565232 - protein, 14 aa, Staphylococcus aureus
GQAPNKDNTRIGED

SEQ ID NO: 1565233 - protein, 11 aa, Staphylococcus aureus
GQKPAESPGVP

SEQ ID NO: 1565234 - protein, 9 aa, Staphylococcus aureus
GQTDKEFQT

SEQ ID NO: 1565235 - protein, 8 aa, Staphylococcus aureus
GRHFNPEP

SEQ ID NO: 1565236 - protein, 41 aa, Staphylococcus aureus
HDIETNNTKKVKQVKSITNNKTNTLNKDQVKLNENVQENNQ

SEQ ID NO: 1565237 - protein, 32 aa, Staphylococcus aureus
HDQNTVKQGVNFTDADKAKRDAYTNAVSRAET

SEQ ID NO: 1565238 - protein, 11 aa, Staphylococcus aureus
HGAGAGANKPL

SEQ ID NO: 1565239 - protein, 9 aa, Staphylococcus aureus
HGGDYAGKM

SEQ ID NO: 1565240 - protein, 12 aa, Staphylococcus aureus
HKNSKALESISK

SEQ ID NO: 1565241 - protein, 4 aa, Staphylococcus aureus
HKTF

SEQ ID NO: 1565242 - protein, 155 aa, Staphylococcus aureus
HQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTRA

SEQ ID NO: 1565243 - protein, 18 aa, Staphylococcus aureus
HQLKSPDEIKEELDKKEG

SEQ ID NO: 1565244 - protein, 5 aa, Staphylococcus aureus
HSNEL

SEQ ID NO: 1565245 - protein, 32 aa, Staphylococcus aureus
IADKERTKASGNYVNADQEKRQAYDSKVTNAE

SEQ ID NO: 1565246 - protein, 19 aa, Staphylococcus aureus
IAPGANQTVNTHAGNVTTY

SEQ ID NO: 1565247 - protein, 19 aa, Staphylococcus aureus
IDNGDATAQQISDEKHRVD

SEQ ID NO: 1565248 - protein, 8 aa, Staphylococcus aureus
IDQQNTSI

SEQ ID NO: 1565249 - protein, 5 aa, Staphylococcus aureus
IDSGK

SEQ ID NO: 1565250 - protein, 10 aa, Staphylococcus aureus
IGESKDVIEE

SEQ ID NO: 1565251 - protein, 12 aa, Staphylococcus aureus
IGNEKVRVIMKN

SEQ ID NO: 1565252 - protein, 11 aa, Staphylococcus aureus
IQTAQELNTAM

SEQ ID NO: 1565253 - protein, 6 aa, Staphylococcus aureus
ISEDAH

SEQ ID NO: 1565254 - protein, 13 aa, Staphylococcus aureus
ISVTNTPNGANVS

SEQ ID NO: 1565255 - protein, 5 aa, Staphylococcus aureus
ITPVK

SEQ ID NO: 1565256 - protein, 197 aa, Staphylococcus aureus
ITSPSVNSEMNNNETGTPHESNQTGNEGTGSNSRDANPDSNNVKPDSNNQNPSTDSKPDPNNQNPSPNPKPDPDNPKPKPDPKPDPDKPKPNLDPKPDPDNPKPKPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDF

SEQ ID NO: 1565257 - protein, 8 aa, Staphylococcus aureus
KADKRELI

SEQ ID NO: 1565258 - protein, 62 aa, Staphylococcus aureus
KAKEDAKNAIKALANAKRDQINSNPDLTLEQKAKALKEIDEAEKRALENIENAQTKDQLNQG

SEQ ID NO: 1565259 - protein, 6 aa, Staphylococcus aureus
KDALAL

SEQ ID NO: 1565260 - protein, 17 aa, Staphylococcus aureus
KDATIEKSNTGDATVDG

SEQ ID NO: 1565261 - protein, 9 aa, Staphylococcus aureus
KDDNNNNYH

SEQ ID NO: 1565262 - protein, 6 aa, Staphylococcus aureus
KDEADK

SEQ ID NO: 1565263 - protein, 14 aa, Staphylococcus aureus
KDTFDSNDNAALTS

SEQ ID NO: 1565264 - protein, 8 aa, Staphylococcus aureus
KGRLTKSF

SEQ ID NO: 1565265 - protein, 19 aa, Staphylococcus aureus
KGTKNETFRVTQEDKDKVY

SEQ ID NO: 1565266 - protein, 7 aa, Staphylococcus aureus
KISREEF

SEQ ID NO: 1565267 - protein, 12 aa, Staphylococcus aureus
KKENEIRMTKYD

SEQ ID NO: 1565268 - protein, 31 aa, Staphylococcus aureus
KKNPSTYKNKTIKSDGGNSQGGASANHQGMI

SEQ ID NO: 1565269 - protein, 19 aa, Staphylococcus aureus
KKTTEKSMDSVGNAVSEAK

SEQ ID NO: 1565270 - protein, 96 aa, Staphylococcus aureus
KLNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGV

SEQ ID NO: 1565271 - protein, 7 aa, Staphylococcus aureus
KNENYKV

SEQ ID NO: 1565272 - protein, 8 aa, Staphylococcus aureus
KNGEKAKE

SEQ ID NO: 1565273 - protein, 18 aa, Staphylococcus aureus
KNYSNGDVSINENVPSYD

SEQ ID NO: 1565274 - protein, 6 aa, Staphylococcus aureus
KQKKEH

SEQ ID NO: 1565275 - protein, 23 aa, Staphylococcus aureus
KQPEGDQRVYRTSTYDLTTDEIS

SEQ ID NO: 1565276 - protein, 7 aa, Staphylococcus aureus
KQQNKKV

SEQ ID NO: 1565277 - protein, 4 aa, Staphylococcus aureus
KRAY

SEQ ID NO: 1565278 - protein, 23 aa, Staphylococcus aureus
KSSDTAENPKEGSKEAQIKKSFS

SEQ ID NO: 1565279 - protein, 20 aa, Staphylococcus aureus
KSSDTSEKPKEDSKETQIKK

SEQ ID NO: 1565280 - protein, 8 aa, Staphylococcus aureus
KTNKDKDV

SEQ ID NO: 1565281 - protein, 28 aa, Staphylococcus aureus
KVDQVNTDKAQPNYTEASTDKKEAVDQA

SEQ ID NO: 1565282 - protein, 6 aa, Staphylococcus aureus
KYTKPK

SEQ ID NO: 1565283 - protein, 19 aa, Staphylococcus aureus
LDKNEYEADPPLFFFSGPI

SEQ ID NO: 1565284 - protein, 5 aa, Staphylococcus aureus
LGETA

SEQ ID NO: 1565285 - protein, 18 aa, Staphylococcus aureus
LNRTGTTTGKKPASITAY

SEQ ID NO: 1565286 - protein, 10 aa, Staphylococcus aureus
LQEAARTRNP

SEQ ID NO: 1565287 - protein, 51 aa, Staphylococcus aureus
LQNKEDNSQLVTSKNNLQSSVNQVPSTAGMTQQSIDNYNAKKREAETEITA

SEQ ID NO: 1565288 - protein, 6 aa, Staphylococcus aureus
LQYNED

SEQ ID NO: 1565289 - protein, 8 aa, Staphylococcus aureus
LSGNKPEL

SEQ ID NO: 1565290 - protein, 15 aa, Staphylococcus aureus
LTKEEIEQAKAQLAQ

SEQ ID NO: 1565291 - protein, 28 aa, Staphylococcus aureus
NGVANSKIKRTKEELKSIPNKTRSRLDV

SEQ ID NO: 1565292 - protein, 14 aa, Staphylococcus aureus
NIANPDKNNYIPEN

SEQ ID NO: 1565293 - protein, 10 aa, Staphylococcus aureus
NIVNGSPNVI

SEQ ID NO: 1565294 - protein, 4 aa, Staphylococcus aureus
NKSS

SEQ ID NO: 1565295 - protein, 8 aa, Staphylococcus aureus
NNKLTGNN

SEQ ID NO: 1565296 - protein, 24 aa, Staphylococcus aureus
NNVNSAKHALNGTQNLNNAKQAAI

SEQ ID NO: 1565297 - protein, 9 aa, Staphylococcus aureus
NQNATGPFN

SEQ ID NO: 1565298 - protein, 10 aa, Staphylococcus aureus
NQNTGNTTDA

SEQ ID NO: 1565299 - protein, 8 aa, Staphylococcus aureus
NSDGTNVQ

SEQ ID NO: 1565300 - protein, 33 aa, Staphylococcus aureus
NSIQDQQQTESGSKFINEDKPQKDAYQAAVQNA

SEQ ID NO: 1565301 - protein, 4 aa, Staphylococcus aureus
NSSN

SEQ ID NO: 1565302 - protein, 13 aa, Staphylococcus aureus
NVPEDLKKDVDKI

SEQ ID NO: 1565303 - protein, 10 aa, Staphylococcus aureus
NYGNENLGSY

SEQ ID NO: 1565304 - protein, 7 aa, Staphylococcus aureus
PGFQGTK

SEQ ID NO: 1565305 - protein, 17 aa, Staphylococcus aureus
PHTPTITTTAEQLRGTA

SEQ ID NO: 1565306 - protein, 4 aa, Staphylococcus aureus
PNAN

SEQ ID NO: 1565307 - protein, 39 aa, Staphylococcus aureus
PQRQQTSRRSNRIQTRSVESRAAEPRSVSDYQNANSSYY

SEQ ID NO: 1565308 - protein, 6 aa, Staphylococcus aureus
PYGPKQ

SEQ ID NO: 1565309 - protein, 13 aa, Staphylococcus aureus
QNFRDASDQLKTT

SEQ ID NO: 1565310 - protein, 18 aa, Staphylococcus aureus
QQNYINETQYQQAMSQLN

SEQ ID NO: 1565311 - protein, 8 aa, Staphylococcus aureus
QSNDHIRK

SEQ ID NO: 1565312 - protein, 10 aa, Staphylococcus aureus
RDGSSTTLDA

SEQ ID NO: 1565313 - protein, 5 aa, Staphylococcus aureus
RNRSG

SEQ ID NO: 1565314 - protein, 6 aa, Staphylococcus aureus
RQPALT

SEQ ID NO: 1565315 - protein, 12 aa, Staphylococcus aureus
SDLTSAKNSANA

SEQ ID NO: 1565316 - protein, 5 aa, Staphylococcus aureus
SEYND

SEQ ID NO: 1565317 - protein, 8 aa, Staphylococcus aureus
SFEDTDKN

SEQ ID NO: 1565318 - protein, 34 aa, Staphylococcus aureus
SIASKDATKSSEDYQDANADLQNAYNDAVTNAEG

SEQ ID NO: 1565319 - protein, 32 aa, Staphylococcus aureus
SIQDQQQTEAGSKFINEDKPQKDAYQAAVQNA

SEQ ID NO: 1565320 - protein, 15 aa, Staphylococcus aureus
SKTNAEKVVSEKDGL

SEQ ID NO: 1565321 - protein, 6 aa, Staphylococcus aureus
SLLTPS

SEQ ID NO: 1565322 - protein, 6 aa, Staphylococcus aureus
SPGKDQ

SEQ ID NO: 1565323 - protein, 7 aa, Staphylococcus aureus
SPGVGKT

SEQ ID NO: 1565324 - protein, 25 aa, Staphylococcus aureus
SQEITGNEGRTKGSTNYVNADTQVK

SEQ ID NO: 1565325 - protein, 9 aa, Staphylococcus aureus
SQQEDYESD

SEQ ID NO: 1565326 - protein, 11 aa, Staphylococcus aureus
SSITDKDNVNF

SEQ ID NO: 1565327 - protein, 8 aa, Staphylococcus aureus
SSSLESSY

SEQ ID NO: 1565328 - protein, 5 aa, Staphylococcus aureus
SSTNR

SEQ ID NO: 1565329 - protein, 10 aa, Staphylococcus aureus
SSTSNYAADT

SEQ ID NO: 1565330 - protein, 13 aa, Staphylococcus aureus
STDPVTVDNNGNV

SEQ ID NO: 1565331 - protein, 29 aa, Staphylococcus aureus
STPAGYTPTTANAGTDDAVDSDGLTTTGV

SEQ ID NO: 1565332 - protein, 10 aa, Staphylococcus aureus
TAVSNDEKQS

SEQ ID NO: 1565333 - protein, 8 aa, Staphylococcus aureus
TGTPDGVH

SEQ ID NO: 1565334 - protein, 7 aa, Staphylococcus aureus
TIPVSKN

SEQ ID NO: 1565335 - protein, 11 aa, Staphylococcus aureus
TNISRDRHEKR

SEQ ID NO: 1565336 - protein, 7 aa, Staphylococcus aureus
TNYGNID

SEQ ID NO: 1565337 - protein, 5 aa, Staphylococcus aureus
TPIPH

SEQ ID NO: 1565338 - protein, 6 aa, Staphylococcus aureus
TQGPTV

SEQ ID NO: 1565339 - protein, 9 aa, Staphylococcus aureus
TQKELPGQF

SEQ ID NO: 1565340 - protein, 12 aa, Staphylococcus aureus
TSELKKAGLTSE

SEQ ID NO: 1565341 - protein, 11 aa, Staphylococcus aureus
TSTSSNDKLSR

SEQ ID NO: 1565342 - protein, 13 aa, Staphylococcus aureus
TTRIETKTGHQAQ

SEQ ID NO: 1565343 - protein, 7 aa, Staphylococcus aureus
TVKPVKN

SEQ ID NO: 1565344 - protein, 4 aa, Staphylococcus aureus
VKHP

SEQ ID NO: 1565345 - protein, 4 aa, Staphylococcus aureus
VSRG

SEQ ID NO: 1565346 - protein, 17 aa, Staphylococcus aureus
VTASDSSDNGNVQHDRN

SEQ ID NO: 1565347 - protein, 13 aa, Staphylococcus aureus
VVNDDKKADTRTI

SEQ ID NO: 1565348 - protein, 8 aa, Staphylococcus aureus
VYTPKRNI

SEQ ID NO: 1565349 - protein, 10 aa, Staphylococcus aureus
YDKKSEKELD

SEQ ID NO: 1565350 - protein, 24 aa, Staphylococcus aureus
YKSNKSNTNHKNISNSKTTQFNTV

SEQ ID NO: 1565351 - protein, 10 aa, Staphylococcus aureus
YNDGSTEEVQ

SEQ ID NO: 1565352 - protein, 6 aa, Staphylococcus aureus
YRGYDS

SEQ ID NO: 1565353 - protein, 79 aa, Staphylococcus aureus
AAASEQKTTTVEENGNSATDNKVSETQTTTTNVNTIDETQSYSATATEQPSNATQVTTEEAPKAVQAPQTAQPANVETV

SEQ ID NO: 1565354 - protein, 22 aa, Staphylococcus aureus
AAQSITDPTNGSNANKDAVEQA

SEQ ID NO: 1565355 - protein, 11 aa, Staphylococcus aureus
AARTRGKQGTG

SEQ ID NO: 1565356 - protein, 7 aa, Staphylococcus aureus
ADKDYQP

SEQ ID NO: 1565357 - protein, 6 aa, Staphylococcus aureus
AEINDG

SEQ ID NO: 1565358 - protein, 4 aa, Staphylococcus aureus
AFDR

SEQ ID NO: 1565359 - protein, 20 aa, Staphylococcus aureus
AKANGTTADKIAADNKLADK

SEQ ID NO: 1565360 - protein, 7 aa, Staphylococcus aureus
AKPENKK

SEQ ID NO: 1565361 - protein, 10 aa, Staphylococcus aureus
AKYDTTEPQR

SEQ ID NO: 1565362 - protein, 23 aa, Staphylococcus aureus
ANDLNQAQKDALKQQVDAAQTVA

SEQ ID NO: 1565363 - protein, 11 aa, Staphylococcus aureus
APAATKKKPIP

SEQ ID NO: 1565364 - protein, 9 aa, Staphylococcus aureus
ASSSISQSP

SEQ ID NO: 1565365 - protein, 14 aa, Staphylococcus aureus
ATLSSEIKYTSPHD

SEQ ID NO: 1565366 - protein, 28 aa, Staphylococcus aureus
AVTRAKAALNGAENLRNAKTSATNTING

SEQ ID NO: 1565367 - protein, 8 aa, Staphylococcus aureus
DAQTGKVT

SEQ ID NO: 1565368 - protein, 9 aa, Staphylococcus aureus
DATDSNQKT

SEQ ID NO: 1565369 - protein, 6 aa, Staphylococcus aureus
DDAKEV

SEQ ID NO: 1565370 - protein, 8 aa, Staphylococcus aureus
DDYSSKNN

SEQ ID NO: 1565371 - protein, 5 aa, Staphylococcus aureus
DGMEG

SEQ ID NO: 1565372 - protein, 7 aa, Staphylococcus aureus
DIPKEQR

SEQ ID NO: 1565373 - protein, 7 aa, Staphylococcus aureus
DKKSELR

SEQ ID NO: 1565374 - protein, 9 aa, Staphylococcus aureus
DKSNSKSKV

SEQ ID NO: 1565375 - protein, 18 aa, Staphylococcus aureus
DLTNAQKDAAKRQIEGAT

SEQ ID NO: 1565376 - protein, 12 aa, Staphylococcus aureus
DNKKARDRAREE

SEQ ID NO: 1565377 - protein, 9 aa, Staphylococcus aureus
DSNGNNIER

SEQ ID NO: 1565378 - protein, 11 aa, Staphylococcus aureus
DYAEQNVQHRN

SEQ ID NO: 1565379 - protein, 6 aa, Staphylococcus aureus
EAGSGV

SEQ ID NO: 1565380 - protein, 4 aa, Staphylococcus aureus
EARI

SEQ ID NO: 1565381 - protein, 10 aa, Staphylococcus aureus
EKYKSKAKKL

SEQ ID NO: 1565382 - protein, 15 aa, Staphylococcus aureus
EQSKAESTKLLKDNL

SEQ ID NO: 1565383 - protein, 14 aa, Staphylococcus aureus
ESIKDQPQTEASSK

SEQ ID NO: 1565384 - protein, 15 aa, Staphylococcus aureus
FSDNSKSQIERQQTI

SEQ ID NO: 1565385 - protein, 8 aa, Staphylococcus aureus
FSGTKQAG

SEQ ID NO: 1565386 - protein, 5 aa, Staphylococcus aureus
FTKNE

SEQ ID NO: 1565387 - protein, 8 aa, Staphylococcus aureus
GASQQEVT

SEQ ID NO: 1565388 - protein, 8 aa, Staphylococcus aureus
GKSYSPEA

SEQ ID NO: 1565389 - protein, 6 aa, Staphylococcus aureus
GQNNQW

SEQ ID NO: 1565390 - protein, 9 aa, Staphylococcus aureus
GSSASVYSG

SEQ ID NO: 1565391 - protein, 36 aa, Staphylococcus aureus
HEQAQNKKAKRENQRDEPAPPLQNDNDLRRRQQDKP

SEQ ID NO: 1565392 - protein, 6 aa, Staphylococcus aureus
HGAHAP

SEQ ID NO: 1565393 - protein, 10 aa, Staphylococcus aureus
HGGDYAGKMT

SEQ ID NO: 1565394 - protein, 18 aa, Staphylococcus aureus
HLDDPVSTEGKKPGTITQ

SEQ ID NO: 1565395 - protein, 13 aa, Staphylococcus aureus
IGNKNVHVILRIN

SEQ ID NO: 1565396 - protein, 11 aa, Staphylococcus aureus
IKGRKETNFPQ

SEQ ID NO: 1565397 - protein, 16 aa, Staphylococcus aureus
INQTGNPTLDKAQVEQ

SEQ ID NO: 1565398 - protein, 47 aa, Staphylococcus aureus
INQTSNPTMEPNTITQATSQVTTKEHALNGAQNLAQAKTTAKNNLNN

SEQ ID NO: 1565399 - protein, 10 aa, Staphylococcus aureus
INTTKPIQEF

SEQ ID NO: 1565400 - protein, 9 aa, Staphylococcus aureus
IPNTKSNAL

SEQ ID NO: 1565401 - protein, 92 aa, Staphylococcus aureus
ISASESDSMSTSDSSNISGSNSTSTSLSTSDSMSGSVSVSTSTSLSDSISGSTSVSDSSSTSTSTSLSDSMSQSQSTSTSASGSLSTSISTS

SEQ ID NO: 1565402 - protein, 8 aa, Staphylococcus aureus
ISREEYEK

SEQ ID NO: 1565403 - protein, 29 aa, Staphylococcus aureus
IYSNKNNELITTQPADFEKNKKQVEKDLE

SEQ ID NO: 1565404 - protein, 13 aa, Staphylococcus aureus
KAKESAKQDIDKQ

SEQ ID NO: 1565405 - protein, 17 aa, Staphylococcus aureus
KALPETGNENSGSNNAT

SEQ ID NO: 1565406 - protein, 18 aa, Staphylococcus aureus
KALPETGSENNNSNNGTL

SEQ ID NO: 1565407 - protein, 13 aa, Staphylococcus aureus
KAPLENAKNQLQH

SEQ ID NO: 1565408 - protein, 4 aa, Staphylococcus aureus
KDFN

SEQ ID NO: 1565409 - protein, 17 aa, Staphylococcus aureus
KDIIGEKANSFDTTIED

SEQ ID NO: 1565410 - protein, 7 aa, Staphylococcus aureus
KEHTADH

SEQ ID NO: 1565411 - protein, 7 aa, Staphylococcus aureus
KISKDTR

SEQ ID NO: 1565412 - protein, 10 aa, Staphylococcus aureus
KKAKKTVVAT

SEQ ID NO: 1565413 - protein, 27 aa, Staphylococcus aureus
KKNDVSETETVNIDNKDTVKQKEAKFE

SEQ ID NO: 1565414 - protein, 28 aa, Staphylococcus aureus
KKNDVSETETVNIDNKDTVKQKEAKFEN

SEQ ID NO: 1565415 - protein, 7 aa, Staphylococcus aureus
KLKPDGL

SEQ ID NO: 1565416 - protein, 6 aa, Staphylococcus aureus
KNDDYV

SEQ ID NO: 1565417 - protein, 7 aa, Staphylococcus aureus
KNEFGIK

SEQ ID NO: 1565418 - protein, 4 aa, Staphylococcus aureus
KNPR

SEQ ID NO: 1565419 - protein, 4 aa, Staphylococcus aureus
KPLH

SEQ ID NO: 1565420 - protein, 8 aa, Staphylococcus aureus
KPYQQSLS

SEQ ID NO: 1565421 - protein, 11 aa, Staphylococcus aureus
KQNQIEDLQEE

SEQ ID NO: 1565422 - protein, 6 aa, Staphylococcus aureus
KRSETF

SEQ ID NO: 1565423 - protein, 148 aa, Staphylococcus aureus
KSKNEQAALKAQQAAIKEEASANNLSDTSQEAQEIQEAKREAQTETDKSAAVSNEESKASALKAQQAAIKEEASANNLSDTSQEAQAIQEAKKEAQAETDKSADVSNEESKASTLNVSKEESQAERLANAAKQKQAKLTPGSKESQLT

SEQ ID NO: 1565424 - protein, 5 aa, Staphylococcus aureus
KTTAF

SEQ ID NO: 1565425 - protein, 14 aa, Staphylococcus aureus
KVQQRKSKETDRGC

SEQ ID NO: 1565426 - protein, 21 aa, Staphylococcus aureus
LAKRTKSSSLNSAAKDNLSDS

SEQ ID NO: 1565427 - protein, 21 aa, Staphylococcus aureus
LQNEKGEVIGTTKTDENGKYR

SEQ ID NO: 1565428 - protein, 9 aa, Staphylococcus aureus
LSGAKKNNV

SEQ ID NO: 1565429 - protein, 4 aa, Staphylococcus aureus
LTKT

SEQ ID NO: 1565430 - protein, 6 aa, Staphylococcus aureus
NAADLS

SEQ ID NO: 1565431 - protein, 10 aa, Staphylococcus aureus
NAINDLEENP

SEQ ID NO: 1565432 - protein, 33 aa, Staphylococcus aureus
NAQKQDLTSQIEGATTVNGVNSVKTKAQDLDGA

SEQ ID NO: 1565433 - protein, 15 aa, Staphylococcus aureus
NKDHGTNKDKQAVEQ

SEQ ID NO: 1565434 - protein, 19 aa, Staphylococcus aureus
NKKAKATAQKLDADNSINH

SEQ ID NO: 1565435 - protein, 11 aa, Staphylococcus aureus
NKQSGTNEVQA

SEQ ID NO: 1565436 - protein, 11 aa, Staphylococcus aureus
NLKPNTDSNAL

SEQ ID NO: 1565437 - protein, 58 aa, Staphylococcus aureus
NNDNSTSNQSSKTQLTQKDENKNEDKPEEKSETATDEDLQSTEEVPANENTENNQHEI

SEQ ID NO: 1565438 - protein, 11 aa, Staphylococcus aureus
NNKAGIKDKAD

SEQ ID NO: 1565439 - protein, 8 aa, Staphylococcus aureus
NNKGYAYQ

SEQ ID NO: 1565440 - protein, 8 aa, Staphylococcus aureus
NNSWSTNA

SEQ ID NO: 1565441 - protein, 11 aa, Staphylococcus aureus
NQEPEMQRESK

SEQ ID NO: 1565442 - protein, 12 aa, Staphylococcus aureus
NQKSNNSDHRTA

SEQ ID NO: 1565443 - protein, 14 aa, Staphylococcus aureus
NQTTNPTLNPDDIT

SEQ ID NO: 1565444 - protein, 8 aa, Staphylococcus aureus
NREVGKEV

SEQ ID NO: 1565445 - protein, 6 aa, Staphylococcus aureus
NSEKAR

SEQ ID NO: 1565446 - protein, 34 aa, Staphylococcus aureus
NSIANKDEVKASQPYVDADTDKQNAYNTAVTSAE

SEQ ID NO: 1565447 - protein, 72 aa, Staphylococcus aureus
NSIANSQSASTSKSDSQSTSISLSTSDSKSMSTSESLSDSTSTSDSVSGSLSIATSQSVSTSSSDSMSTSEM

SEQ ID NO: 1565448 - protein, 52 aa, Staphylococcus aureus
NSIANSQSASTSKSDSQSTSISLSTSDSKSMSTSESLSDSTSTSGSVSGSLS

SEQ ID NO: 1565449 - protein, 39 aa, Staphylococcus aureus
NTIKPNSSITITPKAGTGHSVSSNPSTLTAPAAHTVNTT

SEQ ID NO: 1565450 - protein, 9 aa, Staphylococcus aureus
NYTKGQAPF

SEQ ID NO: 1565451 - protein, 6 aa, Staphylococcus aureus
PEEVEG

SEQ ID NO: 1565452 - protein, 12 aa, Staphylococcus aureus
PHQRDETNALAE

SEQ ID NO: 1565453 - protein, 11 aa, Staphylococcus aureus
PTSKGNKIIGE

SEQ ID NO: 1565454 - protein, 35 aa, Staphylococcus aureus
QGIANKDTVKASENYHDADVDKQTAYTNAVSQAEG

SEQ ID NO: 1565455 - protein, 4 aa, Staphylococcus aureus
QINY

SEQ ID NO: 1565456 - protein, 4 aa, Staphylococcus aureus
QNIR

SEQ ID NO: 1565457 - protein, 6 aa, Staphylococcus aureus
QNSGVA

SEQ ID NO: 1565458 - protein, 4 aa, Staphylococcus aureus
QRGS

SEQ ID NO: 1565459 - protein, 34 aa, Staphylococcus aureus
QSIADKDATRASSAYVNAEPNKKQAYDEAVQNAE

SEQ ID NO: 1565460 - protein, 16 aa, Staphylococcus aureus
QYMTTSGNATYDQSTG

SEQ ID NO: 1565461 - protein, 8 aa, Staphylococcus aureus
RDKTGEPM

SEQ ID NO: 1565462 - protein, 4 aa, Staphylococcus aureus
REEF

SEQ ID NO: 1565463 - protein, 9 aa, Staphylococcus aureus
RGMEEASQS

SEQ ID NO: 1565464 - protein, 8 aa, Staphylococcus aureus
RKDIPQSL

SEQ ID NO: 1565465 - protein, 9 aa, Staphylococcus aureus
RLNQTKKDI

SEQ ID NO: 1565466 - protein, 9 aa, Staphylococcus aureus
RVGDYQDAI

SEQ ID NO: 1565467 - protein, 9 aa, Staphylococcus aureus
SDMSDNTHL

SEQ ID NO: 1565468 - protein, 5 aa, Staphylococcus aureus
SEQLG

SEQ ID NO: 1565469 - protein, 16 aa, Staphylococcus aureus
SESNSTSDSESQSASA

SEQ ID NO: 1565470 - protein, 4 aa, Staphylococcus aureus
SKIK

SEQ ID NO: 1565471 - protein, 45 aa, Staphylococcus aureus
SKPANKYGESPKYPSSIKNQSVTSETPKKAGTSETPKTPEETDNQ

SEQ ID NO: 1565472 - protein, 5 aa, Staphylococcus aureus
SNDVI

SEQ ID NO: 1565473 - protein, 11 aa, Staphylococcus aureus
SNSTHNASDAV

SEQ ID NO: 1565474 - protein, 13 aa, Staphylococcus aureus
STQIDDGAETNYD

SEQ ID NO: 1565475 - protein, 8 aa, Staphylococcus aureus
STRALTPK

SEQ ID NO: 1565476 - protein, 149 aa, Staphylococcus aureus
STSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISIS

SEQ ID NO: 1565477 - protein, 5 aa, Staphylococcus aureus
TASQD

SEQ ID NO: 1565478 - protein, 10 aa, Staphylococcus aureus
TDLGRNFSGT

SEQ ID NO: 1565479 - protein, 13 aa, Staphylococcus aureus
TGEVTPLSEVPDQ

SEQ ID NO: 1565480 - protein, 9 aa, Staphylococcus aureus
TNERPELDG

SEQ ID NO: 1565481 - protein, 6 aa, Staphylococcus aureus
TRPNPM

SEQ ID NO: 1565482 - protein, 13 aa, Staphylococcus aureus
TTKDDGIVQPNIT

SEQ ID NO: 1565483 - protein, 25 aa, Staphylococcus aureus
TTMNQAKDALNGDEKLAQAKQDALA

SEQ ID NO: 1565484 - protein, 21 aa, Staphylococcus aureus
TTYTTTVGGTLASGTQASGYA

SEQ ID NO: 1565485 - protein, 12 aa, Staphylococcus aureus
VEKSAEKTVDGV

SEQ ID NO: 1565486 - protein, 20 aa, Staphylococcus aureus
VKNEDPYTVAKDYLKAKGLI

SEQ ID NO: 1565487 - protein, 15 aa, Staphylococcus aureus
VQVKDGDNSKNKGPV

SEQ ID NO: 1565488 - protein, 11 aa, Staphylococcus aureus
VRAAQTKIDQA

SEQ ID NO: 1565489 - protein, 14 aa, Staphylococcus aureus
VTAAKNKATSLNTA

SEQ ID NO: 1565490 - protein, 8 aa, Staphylococcus aureus
VTPNSNKD

SEQ ID NO: 1565491 - protein, 11 aa, Staphylococcus aureus
YDSTTNTTTYT

SEQ ID NO: 1565492 - protein, 4 aa, Staphylococcus aureus
YINN

SEQ ID NO: 1565493 - protein, 7 aa, Staphylococcus aureus
YSRKHNR

SEQ ID NO: 1565494 - protein, 32 aa, Staphylococcus aureus
AAADTTTIQKSKGNANQASHKDTCKKELDSQD

SEQ ID NO: 1565495 - protein, 32 aa, Staphylococcus aureus
AAASEQKTTTVEENGNSATDNKTSETQTTATN

SEQ ID NO: 1565496 - protein, 9 aa, Staphylococcus aureus
ADNSKTIVP

SEQ ID NO: 1565497 - protein, 12 aa, Staphylococcus aureus
AHGQNMTKAQVE

SEQ ID NO: 1565498 - protein, 8 aa, Staphylococcus aureus
AHGSDDKI

SEQ ID NO: 1565499 - protein, 14 aa, Staphylococcus aureus
AKASEVNENVEKQN

SEQ ID NO: 1565500 - protein, 11 aa, Staphylococcus aureus
AKHDLTADTHA

SEQ ID NO: 1565501 - protein, 5 aa, Staphylococcus aureus
AKRVP

SEQ ID NO: 1565502 - protein, 13 aa, Staphylococcus aureus
AQKNPDTGELKGA

SEQ ID NO: 1565503 - protein, 7 aa, Staphylococcus aureus
ASAGHPE

SEQ ID NO: 1565504 - protein, 7 aa, Staphylococcus aureus
AYHKDTE

SEQ ID NO: 1565505 - protein, 6 aa, Staphylococcus aureus
DAEYSN

SEQ ID NO: 1565506 - protein, 9 aa, Staphylococcus aureus
DAGIEASEY

SEQ ID NO: 1565507 - protein, 4 aa, Staphylococcus aureus
DDLT

SEQ ID NO: 1565508 - protein, 21 aa, Staphylococcus aureus
DEAVDKAKQALDKSSGQNLTA

SEQ ID NO: 1565509 - protein, 8 aa, Staphylococcus aureus
DENKQTIE

SEQ ID NO: 1565510 - protein, 7 aa, Staphylococcus aureus
DGDKKVA

SEQ ID NO: 1565511 - protein, 5 aa, Staphylococcus aureus
DGPIS

SEQ ID NO: 1565512 - protein, 7 aa, Staphylococcus aureus
DIDATDQ

SEQ ID NO: 1565513 - protein, 11 aa, Staphylococcus aureus
DKFKTEEDYKA

SEQ ID NO: 1565514 - protein, 8 aa, Staphylococcus aureus
DSAQNDGL

SEQ ID NO: 1565515 - protein, 21 aa, Staphylococcus aureus
DYTQADSDKQKAYKQAIADAE

SEQ ID NO: 1565516 - protein, 12 aa, Staphylococcus aureus
EIEKTPDIASAT

SEQ ID NO: 1565517 - protein, 8 aa, Staphylococcus aureus
EKGVYDRG

SEQ ID NO: 1565518 - protein, 7 aa, Staphylococcus aureus
ENPMDGY

SEQ ID NO: 1565519 - protein, 18 aa, Staphylococcus aureus
ESTNKDDVGPLKKKINGT

SEQ ID NO: 1565520 - protein, 45 aa, Staphylococcus aureus
EVQPKSSVTHNAEAPKVRKARSVDEGSFDITRDSKNVVESTPITI

SEQ ID NO: 1565521 - protein, 10 aa, Staphylococcus aureus
FDSENPNPAV

SEQ ID NO: 1565522 - protein, 9 aa, Staphylococcus aureus
FNKEGKETQ

SEQ ID NO: 1565523 - protein, 6 aa, Staphylococcus aureus
GAIHDA

SEQ ID NO: 1565524 - protein, 50 aa, Staphylococcus aureus
GEAKAAEETGVTNTEAQPKTEAVASPTTTTTEKAPEAKPVANAVSVSNKE

SEQ ID NO: 1565525 - protein, 88 aa, Staphylococcus aureus
GEAQAAAEETGGTNTEAQPKTEAVASPTTTSEKAPETKPVANAVSVSNKEVEAPTSETKEAKEVKEVKAPKETKEVKPAAKATNNTYP

SEQ ID NO: 1565526 - protein, 4 aa, Staphylococcus aureus
GEIT

SEQ ID NO: 1565527 - protein, 9 aa, Staphylococcus aureus
GGKDNLEAA

SEQ ID NO: 1565528 - protein, 27 aa, Staphylococcus aureus
GHMQSSNHQMNQSNKKVLPAAGESMTS

SEQ ID NO: 1565529 - protein, 9 aa, Staphylococcus aureus
GKSGTAELK

SEQ ID NO: 1565530 - protein, 8 aa, Staphylococcus aureus
GLAGFTAG

SEQ ID NO: 1565531 - protein, 25 aa, Staphylococcus aureus
GLDTPKKIGPKYAPVGASNDPNNMN

SEQ ID NO: 1565532 - protein, 17 aa, Staphylococcus aureus
GLDTVTQATGATGSELK

SEQ ID NO: 1565533 - protein, 35 aa, Staphylococcus aureus
GLNNPQRQALESQINNAATRDEVAQKLAEAKALDQ

SEQ ID NO: 1565534 - protein, 16 aa, Staphylococcus aureus
GSPFNDAKLNAEQKEI

SEQ ID NO: 1565535 - protein, 11 aa, Staphylococcus aureus
GTINPRKNNQL

SEQ ID NO: 1565536 - protein, 4 aa, Staphylococcus aureus
HNNE

SEQ ID NO: 1565537 - protein, 9 aa, Staphylococcus aureus
HPKYPTNIG

SEQ ID NO: 1565538 - protein, 75 aa, Staphylococcus aureus
HQAQAAENTNTSDKISENQNNNATTTQPPKDTNQTQPATQPANTAKNYPAADESLKDAIKDPALENKEHDIGPRE

SEQ ID NO: 1565539 - protein, 11 aa, Staphylococcus aureus
HRQSTASLSNI

SEQ ID NO: 1565540 - protein, 49 aa, Staphylococcus aureus
IEEVTNKDTAPQGVEAKSEVTSNKDTIEHEASVKAEDISKKEDTPKEVA

SEQ ID NO: 1565541 - protein, 7 aa, Staphylococcus aureus
IENSKKD

SEQ ID NO: 1565542 - protein, 14 aa, Staphylococcus aureus
IKKVSKNKKRVDAQ

SEQ ID NO: 1565543 - protein, 22 aa, Staphylococcus aureus
IKVGDGKDNVAAAHDGKDIEYD

SEQ ID NO: 1565544 - protein, 10 aa, Staphylococcus aureus
INKKGKHNDK

SEQ ID NO: 1565545 - protein, 10 aa, Staphylococcus aureus
IQKNPTDLGV

SEQ ID NO: 1565546 - protein, 8 aa, Staphylococcus aureus
KAATITPF

SEQ ID NO: 1565547 - protein, 11 aa, Staphylococcus aureus
KDDPSQSANLL

SEQ ID NO: 1565548 - protein, 16 aa, Staphylococcus aureus
KDDSYVKTTEVSTRMD

SEQ ID NO: 1565549 - protein, 7 aa, Staphylococcus aureus
KDLKGAK

SEQ ID NO: 1565550 - protein, 10 aa, Staphylococcus aureus
KENTISEPKQ

SEQ ID NO: 1565551 - protein, 6 aa, Staphylococcus aureus
KGKKGY

SEQ ID NO: 1565552 - protein, 8 aa, Staphylococcus aureus
KGYDVNTN

SEQ ID NO: 1565553 - protein, 73 aa, Staphylococcus aureus
KKAPNYTNNDVTTKPSTSEIQTKPTTPQESTNIENSQPQPTPSKVDNQVTDATNPKEPVNVSKEELKNNPEKL

SEQ ID NO: 1565554 - protein, 10 aa, Staphylococcus aureus
KKEEAEEEAV

SEQ ID NO: 1565555 - protein, 7 aa, Staphylococcus aureus
KKNDGAV

SEQ ID NO: 1565556 - protein, 6 aa, Staphylococcus aureus
KKNKAI

SEQ ID NO: 1565557 - protein, 9 aa, Staphylococcus aureus
KKRQLSKAQ

SEQ ID NO: 1565558 - protein, 20 aa, Staphylococcus aureus
KKTATNTKVDIAGSQVDDYG

SEQ ID NO: 1565559 - protein, 4 aa, Staphylococcus aureus
KNAK

SEQ ID NO: 1565560 - protein, 20 aa, Staphylococcus aureus
KNKVDKSIKTRSEAISSISS

SEQ ID NO: 1565561 - protein, 10 aa, Staphylococcus aureus
KPSTDGETQI

SEQ ID NO: 1565562 - protein, 12 aa, Staphylococcus aureus
KQTNYKSKHDAI

SEQ ID NO: 1565563 - protein, 15 aa, Staphylococcus aureus
KSGAINKPVSIPNTY

SEQ ID NO: 1565564 - protein, 10 aa, Staphylococcus aureus
KSTAPKSLNT

SEQ ID NO: 1565565 - protein, 65 aa, Staphylococcus aureus
KTFAEEPQEPKIDKGKNDEFNTMSSNLDKEISRISEKSTQLLSDTQESKSIADSVSGQLNQVDNN

SEQ ID NO: 1565566 - protein, 9 aa, Staphylococcus aureus
KVQARQQQE

SEQ ID NO: 1565567 - protein, 13 aa, Staphylococcus aureus
KVQQRKSEETDRG

SEQ ID NO: 1565568 - protein, 7 aa, Staphylococcus aureus
KYSVNNS

SEQ ID NO: 1565569 - protein, 13 aa, Staphylococcus aureus
KYTEKSTDSYKQR

SEQ ID NO: 1565570 - protein, 10 aa, Staphylococcus aureus
LAGTGTAKLT

SEQ ID NO: 1565571 - protein, 27 aa, Staphylococcus aureus
LAPLQTAKTQLQNDIDQPTSTTGMTSA

SEQ ID NO: 1565572 - protein, 34 aa, Staphylococcus aureus
LNNAQKAKLKEQVQSATTLDGVQTVKNSSQTLNT

SEQ ID NO: 1565573 - protein, 79 aa, Staphylococcus aureus
LNQEDNTKNDNQKEMVSSQGNETTSNGNKSIEKESVQSTTGNKVEVSTAKSDEQASPKSTNEDLNTKQTISNQEGLQPD

SEQ ID NO: 1565574 - protein, 8 aa, Staphylococcus aureus
LSAARTKI

SEQ ID NO: 1565575 - protein, 15 aa, Staphylococcus aureus
LSEISSGSVKYEQTY

SEQ ID NO: 1565576 - protein, 9 aa, Staphylococcus aureus
MKQGETGRQ

SEQ ID NO: 1565577 - protein, 17 aa, Staphylococcus aureus
MNKSRATDKKLKGGEEN

SEQ ID NO: 1565578 - protein, 33 aa, Staphylococcus aureus
NAQRNALDNEITQATNVEGVNTVKAKAQQLDGA

SEQ ID NO: 1565579 - protein, 25 aa, Staphylococcus aureus
NELDSKENKSSHTEMNGQSDIDSKL

SEQ ID NO: 1565580 - protein, 10 aa, Staphylococcus aureus
NEPAANGAGA

SEQ ID NO: 1565581 - protein, 9 aa, Staphylococcus aureus
NGEGIDSGC

SEQ ID NO: 1565582 - protein, 8 aa, Staphylococcus aureus
NGSAIPDA

SEQ ID NO: 1565583 - protein, 18 aa, Staphylococcus aureus
NKATSNQAVSQVQTAGNH

SEQ ID NO: 1565584 - protein, 10 aa, Staphylococcus aureus
NKKENQITNY

SEQ ID NO: 1565585 - protein, 29 aa, Staphylococcus aureus
NKNDRMNDNNDADAQKYTTTMKNANNAVK

SEQ ID NO: 1565586 - protein, 4 aa, Staphylococcus aureus
NKVI

SEQ ID NO: 1565587 - protein, 33 aa, Staphylococcus aureus
NLNTPQRQALENQINNAATRGEVAQKLTEAQAL

SEQ ID NO: 1565588 - protein, 13 aa, Staphylococcus aureus
NNERATPQQVSDA

SEQ ID NO: 1565589 - protein, 103 aa, Staphylococcus aureus
NQEAKAAENTSTENAKQDDATTSDNKEVVSETENNSTTENDSTNPIKKETNTDSQPEAKEESTTSSTQQQQNNVTATTETKPQNIEKENVKPSTDKTATEDTS

SEQ ID NO: 1565590 - protein, 8 aa, Staphylococcus aureus
NQNATGPF

SEQ ID NO: 1565591 - protein, 13 aa, Staphylococcus aureus
NSTNRTNNARERN

SEQ ID NO: 1565592 - protein, 11 aa, Staphylococcus aureus
NVAESGLKNGG

SEQ ID NO: 1565593 - protein, 11 aa, Staphylococcus aureus
PENVTKTGNVT

SEQ ID NO: 1565594 - protein, 11 aa, Staphylococcus aureus
PLTKDGNFYQT

SEQ ID NO: 1565595 - protein, 24 aa, Staphylococcus aureus
PTGLTQTGTNTTEDDKDADGGEVD

SEQ ID NO: 1565596 - protein, 10 aa, Staphylococcus aureus
PTYESERELP

SEQ ID NO: 1565597 - protein, 8 aa, Staphylococcus aureus
QAVPNETS

SEQ ID NO: 1565598 - protein, 5 aa, Staphylococcus aureus
QEDKI

SEQ ID NO: 1565599 - protein, 14 aa, Staphylococcus aureus
QGAINDKDATLRNQ

SEQ ID NO: 1565600 - protein, 11 aa, Staphylococcus aureus
QPNSTDSKNVN

SEQ ID NO: 1565601 - protein, 24 aa, Staphylococcus aureus
QRLQLGNPKIKTNTPLISESSDRH

SEQ ID NO: 1565602 - protein, 6 aa, Staphylococcus aureus
QSISEI

SEQ ID NO: 1565603 - protein, 5 aa, Staphylococcus aureus
QYDQN

SEQ ID NO: 1565604 - protein, 18 aa, Staphylococcus aureus
RIGTTKRVEVSQGNVQTK

SEQ ID NO: 1565605 - protein, 21 aa, Staphylococcus aureus
RKFNKNPKSVSEIKKEQNTSN

SEQ ID NO: 1565606 - protein, 25 aa, Staphylococcus aureus
RNDNNTDRSTKPVATAPTSVAPKRL

SEQ ID NO: 1565607 - protein, 6 aa, Staphylococcus aureus
RQIDSA

SEQ ID NO: 1565608 - protein, 16 aa, Staphylococcus aureus
RQRDGLAPIPGGNGSI

SEQ ID NO: 1565609 - protein, 4 aa, Staphylococcus aureus
RRDI

SEQ ID NO: 1565610 - protein, 5 aa, Staphylococcus aureus
RYQTQ

SEQ ID NO: 1565611 - protein, 11 aa, Staphylococcus aureus
SAKVKNPQTVD

SEQ ID NO: 1565612 - protein, 24 aa, Staphylococcus aureus
SDAIKSNAETLVDNNSNSNNENNA

SEQ ID NO: 1565613 - protein, 12 aa, Staphylococcus aureus
SDGNPSGKNAEL

SEQ ID NO: 1565614 - protein, 5 aa, Staphylococcus aureus
SDLLS

SEQ ID NO: 1565615 - protein, 23 aa, Staphylococcus aureus
SDLNQAQKNALTQQVNSAQNVQA

SEQ ID NO: 1565616 - protein, 7 aa, Staphylococcus aureus
SDNTPYT

SEQ ID NO: 1565617 - protein, 7 aa, Staphylococcus aureus
SGSSTGI

SEQ ID NO: 1565618 - protein, 109 aa, Staphylococcus aureus
SKPSEHDKETRIDSESSRTDSDSSMQTEKIKKDSSDGNKSSNLKSEVISDKSNTVPKLSESDDEVNNQKPLTLPEEQKLKRQQSQNEQTKTYTYGDSEQNDKSNHENDL

SEQ ID NO: 1565619 - protein, 16 aa, Staphylococcus aureus
SLQGSINDKDATLRNQ

SEQ ID NO: 1565620 - protein, 13 aa, Staphylococcus aureus
STVKQSTKNYPPT

SEQ ID NO: 1565621 - protein, 13 aa, Staphylococcus aureus
TAGKETSQNVSVD

SEQ ID NO: 1565622 - protein, 21 aa, Staphylococcus aureus
TDSYGVATTYTSSSAADNAAK

SEQ ID NO: 1565623 - protein, 10 aa, Staphylococcus aureus
TGQVKSGDYF

SEQ ID NO: 1565624 - protein, 8 aa, Staphylococcus aureus
TGTGIAPE

SEQ ID NO: 1565625 - protein, 6 aa, Staphylococcus aureus
TIPVDK

SEQ ID NO: 1565626 - protein, 15 aa, Staphylococcus aureus
TKASGQNVDKAAVEQ

SEQ ID NO: 1565627 - protein, 6 aa, Staphylococcus aureus
TNIDEN

SEQ ID NO: 1565628 - protein, 4 aa, Staphylococcus aureus
TQTH

SEQ ID NO: 1565629 - protein, 18 aa, Staphylococcus aureus
TSDRTIPTAQEVSQMNAG

SEQ ID NO: 1565630 - protein, 12 aa, Staphylococcus aureus
TSNTYSKDEEKL

SEQ ID NO: 1565631 - protein, 9 aa, Staphylococcus aureus
TTIADKHKN

SEQ ID NO: 1565632 - protein, 24 aa, Staphylococcus aureus
VNAAKQALNGNANVQHAKDEATAL

SEQ ID NO: 1565633 - protein, 11 aa, Staphylococcus aureus
VPGDKVEYKND

SEQ ID NO: 1565634 - protein, 15 aa, Staphylococcus aureus
VQPAKPTVTETAAGA

SEQ ID NO: 1565635 - protein, 8 aa, Staphylococcus aureus
VSKKGGTP

SEQ ID NO: 1565636 - protein, 10 aa, Staphylococcus aureus
YASNQANKPV

SEQ ID NO: 1565637 - protein, 7 aa, Staphylococcus aureus
YKTPKYN

SEQ ID NO: 1565638 - protein, 9 aa, Staphylococcus aureus
YTGEEDWEK

SEQ ID NO: 1565639 - protein, 12 aa, Staphylococcus aureus
YVDTINKQLKQL

SEQ ID NO: 1565640 - protein, 6 aa, Staphylococcus aureus
AAQNHA

SEQ ID NO: 1565641 - protein, 5 aa, Staphylococcus aureus
ADDLG

SEQ ID NO: 1565642 - protein, 7 aa, Staphylococcus aureus
ADNTPLN

SEQ ID NO: 1565643 - protein, 8 aa, Staphylococcus aureus
AEKRGVTK

SEQ ID NO: 1565644 - protein, 20 aa, Staphylococcus aureus
AKDNLHGDQKLADDKQHAVT

SEQ ID NO: 1565645 - protein, 26 aa, Staphylococcus aureus
ANKRTATIKNGTAMPTNLAGGSTTTI

SEQ ID NO: 1565646 - protein, 6 aa, Staphylococcus aureus
ASDLSK

SEQ ID NO: 1565647 - protein, 10 aa, Staphylococcus aureus
AVSNTGTQLN

SEQ ID NO: 1565648 - protein, 16 aa, Staphylococcus aureus
DALPNGGIKAKSSISM

SEQ ID NO: 1565649 - protein, 38 aa, Staphylococcus aureus
DANGVNHGGSEMVQNKTGHMSQQGHMNQNTHMNQQPHM

SEQ ID NO: 1565650 - protein, 23 aa, Staphylococcus aureus
DDNPDNDINTPSLSKTDDDRKLD

SEQ ID NO: 1565651 - protein, 10 aa, Staphylococcus aureus
DEKAKGQQVK

SEQ ID NO: 1565652 - protein, 9 aa, Staphylococcus aureus
DIPPTINNP

SEQ ID NO: 1565653 - protein, 10 aa, Staphylococcus aureus
DNASDLSESY

SEQ ID NO: 1565654 - protein, 33 aa, Staphylococcus aureus
DNEQPQSAPKEQNSDSIDEETVTKKERKSKVTQ

SEQ ID NO: 1565655 - protein, 4 aa, Staphylococcus aureus
DNNN

SEQ ID NO: 1565656 - protein, 7 aa, Staphylococcus aureus
DNRQTED

SEQ ID NO: 1565657 - protein, 6 aa, Staphylococcus aureus
DNVPEY

SEQ ID NO: 1565658 - protein, 33 aa, Staphylococcus aureus
DVTAATQRVNNAETGLNGDTNLATAKQQAKDAL

SEQ ID NO: 1565659 - protein, 4 aa, Staphylococcus aureus
EAPV

SEQ ID NO: 1565660 - protein, 4 aa, Staphylococcus aureus
EEIP

SEQ ID NO: 1565661 - protein, 7 aa, Staphylococcus aureus
ELNETKT

SEQ ID NO: 1565662 - protein, 4 aa, Staphylococcus aureus
ENAK

SEQ ID NO: 1565663 - protein, 9 aa, Staphylococcus aureus
ENNRQGYLD

SEQ ID NO: 1565664 - protein, 48 aa, Staphylococcus aureus
ERAKQAANTAITNASDLNTKQKEALKAQVTSAGRVSAANGVEHTATEL

SEQ ID NO: 1565665 - protein, 13 aa, Staphylococcus aureus
EYVDELKQELEFY

SEQ ID NO: 1565666 - protein, 10 aa, Staphylococcus aureus
FAESGDGGVL

SEQ ID NO: 1565667 - protein, 4 aa, Staphylococcus aureus
FANN

SEQ ID NO: 1565668 - protein, 10 aa, Staphylococcus aureus
FHQTSLGGDV

SEQ ID NO: 1565669 - protein, 50 aa, Staphylococcus aureus
FKKEESNDKNNDSASSHANDNNIDDSTDSNIENEDYRYNQEIDDQNESNV

SEQ ID NO: 1565670 - protein, 5 aa, Staphylococcus aureus
FSDNI

SEQ ID NO: 1565671 - protein, 13 aa, Staphylococcus aureus
FTPDTSKLKDVTG

SEQ ID NO: 1565672 - protein, 5 aa, Staphylococcus aureus
GASYP

SEQ ID NO: 1565673 - protein, 8 aa, Staphylococcus aureus
GGSANSEK

SEQ ID NO: 1565674 - protein, 17 aa, Staphylococcus aureus
GHNGINNAMTKEEIEHA

SEQ ID NO: 1565675 - protein, 5 aa, Staphylococcus aureus
GITNY

SEQ ID NO: 1565676 - protein, 4 aa, Staphylococcus aureus
GKPF

SEQ ID NO: 1565677 - protein, 34 aa, Staphylococcus aureus
GLNNPQRQALESQINNAATRGEVAQKLAEAKALD

SEQ ID NO: 1565678 - protein, 7 aa, Staphylococcus aureus
GNDTYSK

SEQ ID NO: 1565679 - protein, 8 aa, Staphylococcus aureus
GQNKVSKE

SEQ ID NO: 1565680 - protein, 28 aa, Staphylococcus aureus
GSMPDLKKPEDKPDSKQRSFEPHEKDDF

SEQ ID NO: 1565681 - protein, 8 aa, Staphylococcus aureus
GSPEHNYQ

SEQ ID NO: 1565682 - protein, 7 aa, Staphylococcus aureus
GTFNPAD

SEQ ID NO: 1565683 - protein, 120 aa, Staphylococcus aureus
HEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKNVSTTPKTTTIKQ

SEQ ID NO: 1565684 - protein, 24 aa, Staphylococcus aureus
HHQQFQKPEGTVYEPKPKKKSTRK

SEQ ID NO: 1565685 - protein, 4 aa, Staphylococcus aureus
HKAE

SEQ ID NO: 1565686 - protein, 15 aa, Staphylococcus aureus
HLDRDKDNRACEPDK

SEQ ID NO: 1565687 - protein, 75 aa, Staphylococcus aureus
HQAQAAENTNTSDKISENQNNNATTTQPPKDTNQTQPATQPTNTAKTYPAADESLKDAIKNPAVENKEHDIGPRE

SEQ ID NO: 1565688 - protein, 10 aa, Staphylococcus aureus
HSNKAKERML

SEQ ID NO: 1565689 - protein, 16 aa, Staphylococcus aureus
HVEGDNDQQRRSKPRR

SEQ ID NO: 1565690 - protein, 10 aa, Staphylococcus aureus
HVNKTTGNTE

SEQ ID NO: 1565691 - protein, 4 aa, Staphylococcus aureus
IALT

SEQ ID NO: 1565692 - protein, 29 aa, Staphylococcus aureus
IDDVDTSELVETPKESMSLEEKEKREKIK

SEQ ID NO: 1565693 - protein, 7 aa, Staphylococcus aureus
IEPDSQN

SEQ ID NO: 1565694 - protein, 6 aa, Staphylococcus aureus
INDAPS

SEQ ID NO: 1565695 - protein, 6 aa, Staphylococcus aureus
IPTGGQ

SEQ ID NO: 1565696 - protein, 4 aa, Staphylococcus aureus
IRGV

SEQ ID NO: 1565697 - protein, 14 aa, Staphylococcus aureus
ISQSVKVSDNNLKD

SEQ ID NO: 1565698 - protein, 29 aa, Staphylococcus aureus
ITISASGKAKGKTFTTQTKTIKASDLKYN

SEQ ID NO: 1565699 - protein, 9 aa, Staphylococcus aureus
KEKDPKYKL

SEQ ID NO: 1565700 - protein, 6 aa, Staphylococcus aureus
KGHKTF

SEQ ID NO: 1565701 - protein, 7 aa, Staphylococcus aureus
KHQNQTI

SEQ ID NO: 1565702 - protein, 8 aa, Staphylococcus aureus
KIPEDASR

SEQ ID NO: 1565703 - protein, 7 aa, Staphylococcus aureus
KKPLQSD

SEQ ID NO: 1565704 - protein, 4 aa, Staphylococcus aureus
KKSI

SEQ ID NO: 1565705 - protein, 7 aa, Staphylococcus aureus
KLEQSYG

SEQ ID NO: 1565706 - protein, 14 aa, Staphylococcus aureus
KLTETEIEASKSMD

SEQ ID NO: 1565707 - protein, 7 aa, Staphylococcus aureus
KPGAQAL

SEQ ID NO: 1565708 - protein, 191 aa, Staphylococcus aureus
KSHPEPIEDNDKHDTIKNAENNTEHSTVSDKSEAEQSQQPKPYFTTGANQSETSKNEHDNDSVKQDQDEPKEHHNGKKAAAIGAGTAGVAGAAGAMAASKAKKHSNDAQNKSNSGKANNSTEDKASQDKSKDHHNGKKGAAIGAGTAGLAGGAASKSASAASKPHASNNASQNHDEHDNHDRDKERKKGGM

SEQ ID NO: 1565709 - protein, 4 aa, Staphylococcus aureus
KSPL

SEQ ID NO: 1565710 - protein, 5 aa, Staphylococcus aureus
KSTNI

SEQ ID NO: 1565711 - protein, 12 aa, Staphylococcus aureus
KVDSSSYGNASG

SEQ ID NO: 1565712 - protein, 28 aa, Staphylococcus aureus
KVNDTNQALNGNQKLADAKQAAKTNLGT

SEQ ID NO: 1565713 - protein, 6 aa, Staphylococcus aureus
LAPRGT

SEQ ID NO: 1565714 - protein, 4 aa, Staphylococcus aureus
LEEE

SEQ ID NO: 1565715 - protein, 32 aa, Staphylococcus aureus
LETQNGKSSWSNSYSNVNGSSTANGDQKKYNL

SEQ ID NO: 1565716 - protein, 12 aa, Staphylococcus aureus
LHPFRNKGGHAE

SEQ ID NO: 1565717 - protein, 17 aa, Staphylococcus aureus
LKGDTKLNDSSKKVTIN

SEQ ID NO: 1565718 - protein, 17 aa, Staphylococcus aureus
LNADPDKQNAYKQAVAK

SEQ ID NO: 1565719 - protein, 11 aa, Staphylococcus aureus
LNSKEASPEVK

SEQ ID NO: 1565720 - protein, 16 aa, Staphylococcus aureus
LSDSPKISKSLGTRHR

SEQ ID NO: 1565721 - protein, 7 aa, Staphylococcus aureus
NADNSKF

SEQ ID NO: 1565722 - protein, 11 aa, Staphylococcus aureus
NALQDKTETLN

SEQ ID NO: 1565723 - protein, 33 aa, Staphylococcus aureus
NAQKQDLTSQIEGATTVNGVNGVKTKAQDLDGA

SEQ ID NO: 1565724 - protein, 33 aa, Staphylococcus aureus
NAQRTALDNEITQATNVEGVNTVKAKAQQLDGA

SEQ ID NO: 1565725 - protein, 33 aa, Staphylococcus aureus
NAQRTALEGQINQATTVDGVNTVKTNANTLDGA

SEQ ID NO: 1565726 - protein, 17 aa, Staphylococcus aureus
NDDTQNIAEKPFSKQAG

SEQ ID NO: 1565727 - protein, 4 aa, Staphylococcus aureus
NDDV

SEQ ID NO: 1565728 - protein, 9 aa, Staphylococcus aureus
NDKSLPQLN

SEQ ID NO: 1565729 - protein, 48 aa, Staphylococcus aureus
NEQKQEQKEKRQKENAEKERKKKQQEEKEQNELDSQANQYQQLPQQNQ

SEQ ID NO: 1565730 - protein, 6 aa, Staphylococcus aureus
NFEDVT

SEQ ID NO: 1565731 - protein, 12 aa, Staphylococcus aureus
NFKNGAKQAQLQ

SEQ ID NO: 1565732 - protein, 10 aa, Staphylococcus aureus
NGQSSSDKQY

SEQ ID NO: 1565733 - protein, 15 aa, Staphylococcus aureus
NKDHGANKDKQAVEQ

SEQ ID NO: 1565734 - protein, 4 aa, Staphylococcus aureus
NKNG

SEQ ID NO: 1565735 - protein, 10 aa, Staphylococcus aureus
NLKPNTDSNA

SEQ ID NO: 1565736 - protein, 11 aa, Staphylococcus aureus
NPENPAQHQYA

SEQ ID NO: 1565737 - protein, 10 aa, Staphylococcus aureus
NYINNEDLSR

SEQ ID NO: 1565738 - protein, 20 aa, Staphylococcus aureus
PANQLKSPDDIKKELNKKKS

SEQ ID NO: 1565739 - protein, 52 aa, Staphylococcus aureus
PDSNKDKDDAGCTVSGGNVSANGIDKFNENAKGGKLEGKGKEIQKIAEKNKV

SEQ ID NO: 1565740 - protein, 24 aa, Staphylococcus aureus
PSNGYGGQPVTNSNTRANHSNSTV

SEQ ID NO: 1565741 - protein, 9 aa, Staphylococcus aureus
QAINDKDQI

SEQ ID NO: 1565742 - protein, 7 aa, Staphylococcus aureus
QDYHGIK

SEQ ID NO: 1565743 - protein, 10 aa, Staphylococcus aureus
QGSTPVVSKP

SEQ ID NO: 1565744 - protein, 41 aa, Staphylococcus aureus
QHPVITPSDVNNALSNVTSKEHALNGEAKLNAAKQEANTAL

SEQ ID NO: 1565745 - protein, 7 aa, Staphylococcus aureus
QNYPVNE

SEQ ID NO: 1565746 - protein, 9 aa, Staphylococcus aureus
QPKKTYTKE

SEQ ID NO: 1565747 - protein, 19 aa, Staphylococcus aureus
QRERQIDEKNKKENDKNIR

SEQ ID NO: 1565748 - protein, 7 aa, Staphylococcus aureus
QSFGTDM

SEQ ID NO: 1565749 - protein, 7 aa, Staphylococcus aureus
QSGPIAA

SEQ ID NO: 1565750 - protein, 24 aa, Staphylococcus aureus
QSISGSTSVSTSESLSDSTSTSLS

SEQ ID NO: 1565751 - protein, 28 aa, Staphylococcus aureus
QVTDAKNSLNGEAKLATEKQNAKDAVSG

SEQ ID NO: 1565752 - protein, 27 aa, Staphylococcus aureus
QVTSTKDALNGDAKLAEAKAAAKQNLG

SEQ ID NO: 1565753 - protein, 6 aa, Staphylococcus aureus
QYDTYT

SEQ ID NO: 1565754 - protein, 13 aa, Staphylococcus aureus
RAGDYAYATGGKV

SEQ ID NO: 1565755 - protein, 7 aa, Staphylococcus aureus
REKDDQE

SEQ ID NO: 1565756 - protein, 4 aa, Staphylococcus aureus
RETV

SEQ ID NO: 1565757 - protein, 9 aa, Staphylococcus aureus
RGKFSDEGA

SEQ ID NO: 1565758 - protein, 10 aa, Staphylococcus aureus
RPDDVAAKAL

SEQ ID NO: 1565759 - protein, 7 aa, Staphylococcus aureus
RSTSIGA

SEQ ID NO: 1565760 - protein, 33 aa, Staphylococcus aureus
SDAQKQSITGQIDSATQVTGVQSVKDNATNLDN

SEQ ID NO: 1565761 - protein, 8 aa, Staphylococcus aureus
SGAKNQNI

SEQ ID NO: 1565762 - protein, 34 aa, Staphylococcus aureus
SINNAQKDALTRNIDGATTVAGVNQETAKATELN

SEQ ID NO: 1565763 - protein, 10 aa, Staphylococcus aureus
SISDDKDNVM

SEQ ID NO: 1565764 - protein, 12 aa, Staphylococcus aureus
SIVPHGDTQLRY

SEQ ID NO: 1565765 - protein, 169 aa, Staphylococcus aureus
SKEADASENSMTQTENTSNESKSNDPSSVNAAPKTDNTNVSDSNTTTNTNSDETNVAQNPAQQETTQSASTNATTEETPVTGEVTTTATNQANTPATTQSSNTNAEESVNQTSNETTSNDTNTVSSVNSPQNSTNAENVSTTQDISTEATPSNNESAPQSTDASNKDVV

SEQ ID NO: 1565766 - protein, 79 aa, Staphylococcus aureus
SKGESKEEITKDPINELTEYGPETIAPGHRDEFDPKLPTGEKEEVPGKPGIKNPETGDVVRPPVDSVTKYGPVKGDSIV

SEQ ID NO: 1565767 - protein, 9 aa, Staphylococcus aureus
SKKEEMQQK

SEQ ID NO: 1565768 - protein, 13 aa, Staphylococcus aureus
SKNTAKDERTSEF

SEQ ID NO: 1565769 - protein, 34 aa, Staphylococcus aureus
SLEDNSESNAVKSDVRKLEDAKANDNQKDTLSQL

SEQ ID NO: 1565770 - protein, 13 aa, Staphylococcus aureus
SNNATVSQADQTT

SEQ ID NO: 1565771 - protein, 5 aa, Staphylococcus aureus
SNPSD

SEQ ID NO: 1565772 - protein, 10 aa, Staphylococcus aureus
SYASKDMTIK

SEQ ID NO: 1565773 - protein, 13 aa, Staphylococcus aureus
TAAKNKATSLNTA

SEQ ID NO: 1565774 - protein, 20 aa, Staphylococcus aureus
TAGKSLKGSYPNVDNEQDRA

SEQ ID NO: 1565775 - protein, 25 aa, Staphylococcus aureus
TAGKSLKGSYPNVDNEQDRAYYAEH

SEQ ID NO: 1565776 - protein, 34 aa, Staphylococcus aureus
TAQRNDLTNQISQATNLAGVESVKQSANSLDGAM

SEQ ID NO: 1565777 - protein, 8 aa, Staphylococcus aureus
TGEKVNVS

SEQ ID NO: 1565778 - protein, 5 aa, Staphylococcus aureus
TGLQD

SEQ ID NO: 1565779 - protein, 8 aa, Staphylococcus aureus
TGTLTEGN

SEQ ID NO: 1565780 - protein, 6 aa, Staphylococcus aureus
THGSGF

SEQ ID NO: 1565781 - protein, 16 aa, Staphylococcus aureus
TKSPDEIKEELDKKEG

SEQ ID NO: 1565782 - protein, 4 aa, Staphylococcus aureus
TNLP

SEQ ID NO: 1565783 - protein, 17 aa, Staphylococcus aureus
TNQTTNGGSEADQIPSG

SEQ ID NO: 1565784 - protein, 10 aa, Staphylococcus aureus
TNSETSPMGS

SEQ ID NO: 1565785 - protein, 13 aa, Staphylococcus aureus
TPRLSEIKKDNRQ

SEQ ID NO: 1565786 - protein, 5 aa, Staphylococcus aureus
TRNAL

SEQ ID NO: 1565787 - protein, 13 aa, Staphylococcus aureus
TTEFDNKSPSDAI

SEQ ID NO: 1565788 - protein, 9 aa, Staphylococcus aureus
TTKDDGIVQ

SEQ ID NO: 1565789 - protein, 8 aa, Staphylococcus aureus
TYGPNKDV

SEQ ID NO: 1565790 - protein, 10 aa, Staphylococcus aureus
TYTTQDEHGQ

SEQ ID NO: 1565791 - protein, 31 aa, Staphylococcus aureus
VADNQTTLASEDYHDATAQRQNDYNKAVTAA

SEQ ID NO: 1565792 - protein, 20 aa, Staphylococcus aureus
VALDGDENLAAAKQQANNRL

SEQ ID NO: 1565793 - protein, 9 aa, Staphylococcus aureus
VASGEIPPQ

SEQ ID NO: 1565794 - protein, 19 aa, Staphylococcus aureus
VHEKNGNTNNTKVNLNTAS

SEQ ID NO: 1565795 - protein, 44 aa, Staphylococcus aureus
VKDYTTDINGTTITNKYTPGETSATVTKNWDDNNNQDGKRPTEI

SEQ ID NO: 1565796 - protein, 23 aa, Staphylococcus aureus
VKPDPPRIDANSVTYKAGLTNQE

SEQ ID NO: 1565797 - protein, 17 aa, Staphylococcus aureus
VVAPTTETKEAKEVKAV

SEQ ID NO: 1565798 - protein, 13 aa, Staphylococcus aureus
WTPSNDNKAAKEL

SEQ ID NO: 1565799 - protein, 11 aa, Staphylococcus aureus
YDSKTNTTTYT

SEQ ID NO: 1565800 - protein, 10 aa, Staphylococcus aureus
YGNQKGQQLI

SEQ ID NO: 1565801 - protein, 7 aa, Staphylococcus aureus
YQTFKDK

SEQ ID NO: 1565802 - protein, 12 aa, Staphylococcus aureus
YVDTINEQLKQL

SEQ ID NO: 1565803 - protein, 32 aa, Staphylococcus aureus
AAGQVSTSKNALNGNENLEAAKQQATQSLGSL

SEQ ID NO: 1565804 - protein, 32 aa, Staphylococcus aureus
AAGQVSTTKNALNGNENLEAAKQQATQSLGSL

SEQ ID NO: 1565805 - protein, 14 aa, Staphylococcus aureus
ADAPAAGKDITNQL

SEQ ID NO: 1565806 - protein, 8 aa, Staphylococcus aureus
AGESIPTD

SEQ ID NO: 1565807 - protein, 7 aa, Staphylococcus aureus
AHGGSVS

SEQ ID NO: 1565808 - protein, 5 aa, Staphylococcus aureus
AIGDH

SEQ ID NO: 1565809 - protein, 12 aa, Staphylococcus aureus
AIQTAQELNTAM

SEQ ID NO: 1565810 - protein, 10 aa, Staphylococcus aureus
AKENKNGAPV

SEQ ID NO: 1565811 - protein, 9 aa, Staphylococcus aureus
AKTEATQAI

SEQ ID NO: 1565812 - protein, 22 aa, Staphylococcus aureus
ANDLNQAQKDALKQQVDAAQTV

SEQ ID NO: 1565813 - protein, 42 aa, Staphylococcus aureus
ANSNPEMNPSTITQKAEQVNSSKTALNGDENLATAKQNAKTY

SEQ ID NO: 1565814 - protein, 14 aa, Staphylococcus aureus
AQAQQSDYSKIAEK

SEQ ID NO: 1565815 - protein, 9 aa, Staphylococcus aureus
AQQIGTSGS

SEQ ID NO: 1565816 - protein, 21 aa, Staphylococcus aureus
ATQDNSGNAVTNTVTGLPSGL

SEQ ID NO: 1565817 - protein, 6 aa, Staphylococcus aureus
CEIDDA

SEQ ID NO: 1565818 - protein, 13 aa, Staphylococcus aureus
DADEQKRNAYNQA

SEQ ID NO: 1565819 - protein, 8 aa, Staphylococcus aureus
DDGSSEFT

SEQ ID NO: 1565820 - protein, 15 aa, Staphylococcus aureus
DGKTYTISEDERADI

SEQ ID NO: 1565821 - protein, 21 aa, Staphylococcus aureus
DGTLQASSATNEYKKALDGVK

SEQ ID NO: 1565822 - protein, 12 aa, Staphylococcus aureus
DKTAGSNDNKVA

SEQ ID NO: 1565823 - protein, 62 aa, Staphylococcus aureus
DNQKNGNKRREQQESMNGNDVKSASVESNANNYSKQPQKASQQEHQVRETRQRKDIQRSPQV

SEQ ID NO: 1565824 - protein, 11 aa, Staphylococcus aureus
DQDNNKHDSRQ

SEQ ID NO: 1565825 - protein, 11 aa, Staphylococcus aureus
DQTTNPSLDPT

SEQ ID NO: 1565826 - protein, 15 aa, Staphylococcus aureus
DSETTRTAVKQDLTE

SEQ ID NO: 1565827 - protein, 20 aa, Staphylococcus aureus
DSINRSLSKGQPQEHQFSKE

SEQ ID NO: 1565828 - protein, 39 aa, Staphylococcus aureus
DTQIAKDTDRNVDKDADNSVGMSSNVDTDKDSNKNKDKV

SEQ ID NO: 1565829 - protein, 33 aa, Staphylococcus aureus
DVTAATQRVNNAETSLNGDTNLATAKQQAKDAL

SEQ ID NO: 1565830 - protein, 8 aa, Staphylococcus aureus
DYAEQNVQ

SEQ ID NO: 1565831 - protein, 27 aa, Staphylococcus aureus
DYTSRDFENKDTVLKQSTSENSSLSKL

SEQ ID NO: 1565832 - protein, 29 aa, Staphylococcus aureus
DYTSRNFENKDTALKQSTSENSSLSKVED

SEQ ID NO: 1565833 - protein, 5 aa, Staphylococcus aureus
EDFEE

SEQ ID NO: 1565834 - protein, 4 aa, Staphylococcus aureus
EEKY

SEQ ID NO: 1565835 - protein, 7 aa, Staphylococcus aureus
EETGDIS

SEQ ID NO: 1565836 - protein, 84 aa, Staphylococcus aureus
EETQSYNATVTEQPSNATQVTTEEAPKAVQAPQTAQPANVETVKEEEKPQVKETTQPQDNSGNQRQVDLTPKKVTQNQGTETQV

SEQ ID NO: 1565837 - protein, 7 aa, Staphylococcus aureus
EGDKKLP

SEQ ID NO: 1565838 - protein, 9 aa, Staphylococcus aureus
EKFPSNNKL

SEQ ID NO: 1565839 - protein, 8 aa, Staphylococcus aureus
EKIPQGHK

SEQ ID NO: 1565840 - protein, 7 aa, Staphylococcus aureus
ENIDNVE

SEQ ID NO: 1565841 - protein, 30 aa, Staphylococcus aureus
ESIKDQPQTEASSKFINEDQAQKDAYTQAV

SEQ ID NO: 1565842 - protein, 9 aa, Staphylococcus aureus
ETIPGEGFS

SEQ ID NO: 1565843 - protein, 6 aa, Staphylococcus aureus
FFTNEN

SEQ ID NO: 1565844 - protein, 4 aa, Staphylococcus aureus
FGPR

SEQ ID NO: 1565845 - protein, 351 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANT

SEQ ID NO: 1565846 - protein, 39 aa, Staphylococcus aureus
FTQADQDKQQAYNNAANQAQQIANGTPTPVLAPDTVTKA

SEQ ID NO: 1565847 - protein, 11 aa, Staphylococcus aureus
GDNQGTANAIG

SEQ ID NO: 1565848 - protein, 14 aa, Staphylococcus aureus
GELQTIHDYKLKLI

SEQ ID NO: 1565849 - protein, 4 aa, Staphylococcus aureus
GIGG

SEQ ID NO: 1565850 - protein, 11 aa, Staphylococcus aureus
GIQANAGTLNQ

SEQ ID NO: 1565851 - protein, 9 aa, Staphylococcus aureus
GKISKDTRF

SEQ ID NO: 1565852 - protein, 10 aa, Staphylococcus aureus
GNARGGIKGA

SEQ ID NO: 1565853 - protein, 10 aa, Staphylococcus aureus
GNKKAQPLIS

SEQ ID NO: 1565854 - protein, 28 aa, Staphylococcus aureus
GTVSSGTEGSGRTIEGATVSSKSGKQLA

SEQ ID NO: 1565855 - protein, 5 aa, Staphylococcus aureus
GVANH

SEQ ID NO: 1565856 - protein, 11 aa, Staphylococcus aureus
GVKDKGNTLNT

SEQ ID NO: 1565857 - protein, 37 aa, Staphylococcus aureus
HDKLNGQKTNTKTSANNNQKKATSKLNKGRATNNNYS

SEQ ID NO: 1565858 - protein, 27 aa, Staphylococcus aureus
HKDEATTKVVSDNTEPPIESKDHVSKK

SEQ ID NO: 1565859 - protein, 17 aa, Staphylococcus aureus
HQGTITDKYNKRQDKED

SEQ ID NO: 1565860 - protein, 13 aa, Staphylococcus aureus
HQQSAKVKQQTQI

SEQ ID NO: 1565861 - protein, 9 aa, Staphylococcus aureus
HSETAKKAF

SEQ ID NO: 1565862 - protein, 30 aa, Staphylococcus aureus
IADKADTKASGNYVNADANKRQAYDEKVTA

SEQ ID NO: 1565863 - protein, 7 aa, Staphylococcus aureus
IADKHKN

SEQ ID NO: 1565864 - protein, 9 aa, Staphylococcus aureus
IATGSTISY

SEQ ID NO: 1565865 - protein, 8 aa, Staphylococcus aureus
IDSRDSKK

SEQ ID NO: 1565866 - protein, 19 aa, Staphylococcus aureus
IDTQTSTTGMTQDSINAYN

SEQ ID NO: 1565867 - protein, 13 aa, Staphylococcus aureus
IEDAEKEVKKHKL

SEQ ID NO: 1565868 - protein, 9 aa, Staphylococcus aureus
IGQTTSPSM

SEQ ID NO: 1565869 - protein, 6 aa, Staphylococcus aureus
IKENKA

SEQ ID NO: 1565870 - protein, 8 aa, Staphylococcus aureus
IPGYGKHK

SEQ ID NO: 1565871 - protein, 19 aa, Staphylococcus aureus
IPTQTSTAIIGPSGSGKST

SEQ ID NO: 1565872 - protein, 19 aa, Staphylococcus aureus
ISNESTEYYNGQEGEQEVA

SEQ ID NO: 1565873 - protein, 9 aa, Staphylococcus aureus
ITEKEYNDA

SEQ ID NO: 1565874 - protein, 10 aa, Staphylococcus aureus
KAEQDNIPYS

SEQ ID NO: 1565875 - protein, 15 aa, Staphylococcus aureus
KAQGPNTAKDGVETA

SEQ ID NO: 1565876 - protein, 8 aa, Staphylococcus aureus
KDETNNTG

SEQ ID NO: 1565877 - protein, 6 aa, Staphylococcus aureus
KDFDNK

SEQ ID NO: 1565878 - protein, 18 aa, Staphylococcus aureus
KDGTHSDGRVSNSSSKSL

SEQ ID NO: 1565879 - protein, 47 aa, Staphylococcus aureus
KDSVADNNTIKSGQNYTDATPANKQAYDNAVNAAKGVIGETTNPTMD

SEQ ID NO: 1565880 - protein, 4 aa, Staphylococcus aureus
KGKG

SEQ ID NO: 1565881 - protein, 7 aa, Staphylococcus aureus
KHNANKK

SEQ ID NO: 1565882 - protein, 8 aa, Staphylococcus aureus
KHQVEQAQ

SEQ ID NO: 1565883 - protein, 17 aa, Staphylococcus aureus
KKDPKSSYSYEDKAAFE

SEQ ID NO: 1565884 - protein, 36 aa, Staphylococcus aureus
KKNQKDNQSKDKKSASKNTSKKVAAKKKKKKAKKNK

SEQ ID NO: 1565885 - protein, 10 aa, Staphylococcus aureus
KMTYGSNQSV

SEQ ID NO: 1565886 - protein, 19 aa, Staphylococcus aureus
KNKVDKSIKTRSEAISSIS

SEQ ID NO: 1565887 - protein, 27 aa, Staphylococcus aureus
KQDYKNKKGDSVDSKRASSGNEYEDKA

SEQ ID NO: 1565888 - protein, 21 aa, Staphylococcus aureus
KQKLTKDIAEAEAKLSELEKK

SEQ ID NO: 1565889 - protein, 8 aa, Staphylococcus aureus
KRNNSDFI

SEQ ID NO: 1565890 - protein, 5 aa, Staphylococcus aureus
KSEGV

SEQ ID NO: 1565891 - protein, 8 aa, Staphylococcus aureus
KSKAGVDY

SEQ ID NO: 1565892 - protein, 12 aa, Staphylococcus aureus
KSNTGTANSVSP

SEQ ID NO: 1565893 - protein, 8 aa, Staphylococcus aureus
KTGGLEKG

SEQ ID NO: 1565894 - protein, 8 aa, Staphylococcus aureus
KTGTLTKG

SEQ ID NO: 1565895 - protein, 11 aa, Staphylococcus aureus
KTSKESKKESY

SEQ ID NO: 1565896 - protein, 13 aa, Staphylococcus aureus
KVMDPAKKPAPGK

SEQ ID NO: 1565897 - protein, 5 aa, Staphylococcus aureus
LQSKF

SEQ ID NO: 1565898 - protein, 5 aa, Staphylococcus aureus
LRSYS

SEQ ID NO: 1565899 - protein, 16 aa, Staphylococcus aureus
LSSLENDEKDTHKVYS

SEQ ID NO: 1565900 - protein, 11 aa, Staphylococcus aureus
LSTDNGRAQAM

SEQ ID NO: 1565901 - protein, 5 aa, Staphylococcus aureus
MSKNI

SEQ ID NO: 1565902 - protein, 14 aa, Staphylococcus aureus
NALKNGSSGTAEAT

SEQ ID NO: 1565903 - protein, 7 aa, Staphylococcus aureus
NAPQTTT

SEQ ID NO: 1565904 - protein, 18 aa, Staphylococcus aureus
NAQKANLTEQIERGTTVA

SEQ ID NO: 1565905 - protein, 33 aa, Staphylococcus aureus
NAQRTDLEGQINQATTVDGVNTVKTNANTLDGA

SEQ ID NO: 1565906 - protein, 7 aa, Staphylococcus aureus
NDPDRSH

SEQ ID NO: 1565907 - protein, 18 aa, Staphylococcus aureus
NENKEDDFTAYASPEHNY

SEQ ID NO: 1565908 - protein, 11 aa, Staphylococcus aureus
NEQTATLDNNA

SEQ ID NO: 1565909 - protein, 11 aa, Staphylococcus aureus
NFREPSAKNAV

SEQ ID NO: 1565910 - protein, 19 aa, Staphylococcus aureus
NFTDADPEKQTAYNNAVTA

SEQ ID NO: 1565911 - protein, 8 aa, Staphylococcus aureus
NGKDDMSL

SEQ ID NO: 1565912 - protein, 11 aa, Staphylococcus aureus
NIVNGSPNVIT

SEQ ID NO: 1565913 - protein, 19 aa, Staphylococcus aureus
NKATSNQDVSQVQTAGNHA

SEQ ID NO: 1565914 - protein, 14 aa, Staphylococcus aureus
NPILTDKEKQALKD

SEQ ID NO: 1565915 - protein, 8 aa, Staphylococcus aureus
NQNATGSF

SEQ ID NO: 1565916 - protein, 16 aa, Staphylococcus aureus
NQSQSSYKKYKDAVDN

SEQ ID NO: 1565917 - protein, 9 aa, Staphylococcus aureus
NQTTNPTMS

SEQ ID NO: 1565918 - protein, 67 aa, Staphylococcus aureus
NQVNTTKAALNGAQNLAQAKTNATNTINNAQDLNQKQKDALKTQVNNAQRVSDANNVQHTATELNGA

SEQ ID NO: 1565919 - protein, 25 aa, Staphylococcus aureus
NSNDLNQAQKDALKQQVQNATTVAG

SEQ ID NO: 1565920 - protein, 8 aa, Staphylococcus aureus
NTKETNTI

SEQ ID NO: 1565921 - protein, 8 aa, Staphylococcus aureus
NVEDPGYY

SEQ ID NO: 1565922 - protein, 13 aa, Staphylococcus aureus
NVKQGDKLDKGDK

SEQ ID NO: 1565923 - protein, 28 aa, Staphylococcus aureus
NVTSAKNALNGDQNVTNAKNAAKNALNN

SEQ ID NO: 1565924 - protein, 20 aa, Staphylococcus aureus
PAHERKSPEKIKEELDKKEG

SEQ ID NO: 1565925 - protein, 42 aa, Staphylococcus aureus
PAVSEQPAKGQQGSKGSESGKDVQPIGDDKAMNPAKQPATGK

SEQ ID NO: 1565926 - protein, 29 aa, Staphylococcus aureus
PAVSEQPAKGQQGSKGSKSGKDTQPIGDD

SEQ ID NO: 1565927 - protein, 9 aa, Staphylococcus aureus
PDGYGNSET

SEQ ID NO: 1565928 - protein, 63 aa, Staphylococcus aureus
PEKPNKPIYPEKPKDKTPPTKPDHSNKVKPTPPDKPSKVDKDDQPKDNKTKPENPLKELPKTG

SEQ ID NO: 1565929 - protein, 6 aa, Staphylococcus aureus
PKGKYR

SEQ ID NO: 1565930 - protein, 11 aa, Staphylococcus aureus
PNIRNSEEKQI

SEQ ID NO: 1565931 - protein, 5 aa, Staphylococcus aureus
PVSTS

SEQ ID NO: 1565932 - protein, 7 aa, Staphylococcus aureus
QAIETTE

SEQ ID NO: 1565933 - protein, 26 aa, Staphylococcus aureus
QAVTTAKDNLHGDQKLARDQQQAVTT

SEQ ID NO: 1565934 - protein, 30 aa, Staphylococcus aureus
QGIADKEQTKADGNFVNADSDKQNAYNQAV

SEQ ID NO: 1565935 - protein, 10 aa, Staphylococcus aureus
QGQDGETKDM

SEQ ID NO: 1565936 - protein, 26 aa, Staphylococcus aureus
QITTTTADITYPAYKEADNNSIGSAF

SEQ ID NO: 1565937 - protein, 9 aa, Staphylococcus aureus
QKSEIQKNH

SEQ ID NO: 1565938 - protein, 36 aa, Staphylococcus aureus
QLNTPQKTALKQQVNAAQRVSGVTDLKNSATSLNNA

SEQ ID NO: 1565939 - protein, 5 aa, Staphylococcus aureus
QMEGS

SEQ ID NO: 1565940 - protein, 36 aa, Staphylococcus aureus
QNGINDKANTLASENYHDADSDKKTAYTQAVTNAEN

SEQ ID NO: 1565941 - protein, 36 aa, Staphylococcus aureus
QNGINDKTNTLASENYHDADSDKKTAYTQAVTNAEN

SEQ ID NO: 1565942 - protein, 20 aa, Staphylococcus aureus
QNLNGDQRLQDAKDKAIQSI

SEQ ID NO: 1565943 - protein, 5 aa, Staphylococcus aureus
QSEYD

SEQ ID NO: 1565944 - protein, 6 aa, Staphylococcus aureus
QSKIGR

SEQ ID NO: 1565945 - protein, 15 aa, Staphylococcus aureus
QSVTSTENALNGDAN

SEQ ID NO: 1565946 - protein, 24 aa, Staphylococcus aureus
QTSGIPSDITSEDSVTSKNNRLND

SEQ ID NO: 1565947 - protein, 5 aa, Staphylococcus aureus
QVEEK

SEQ ID NO: 1565948 - protein, 26 aa, Staphylococcus aureus
QVTSTKDALNGDAKLAEAKAAARQNL

SEQ ID NO: 1565949 - protein, 14 aa, Staphylococcus aureus
RAQKNPDTGELKGA

SEQ ID NO: 1565950 - protein, 32 aa, Staphylococcus aureus
RDSIANEATIKAGQNYTDASQNKQNDYNNAVT

SEQ ID NO: 1565951 - protein, 11 aa, Staphylococcus aureus
RKEASNAKNLR

SEQ ID NO: 1565952 - protein, 5 aa, Staphylococcus aureus
RQAQT

SEQ ID NO: 1565953 - protein, 323 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNAT

SEQ ID NO: 1565954 - protein, 10 aa, Staphylococcus aureus
SAATTTAVTA

SEQ ID NO: 1565955 - protein, 14 aa, Staphylococcus aureus
SEISSDSVKYEQTY

SEQ ID NO: 1565956 - protein, 6 aa, Staphylococcus aureus
SELDSV

SEQ ID NO: 1565957 - protein, 9 aa, Staphylococcus aureus
SENEDQDTI

SEQ ID NO: 1565958 - protein, 15 aa, Staphylococcus aureus
SEYQTANAAKTATVT

SEQ ID NO: 1565959 - protein, 5 aa, Staphylococcus aureus
SGEIT

SEQ ID NO: 1565960 - protein, 10 aa, Staphylococcus aureus
SGNTGIQTTG

SEQ ID NO: 1565961 - protein, 31 aa, Staphylococcus aureus
SGTPTPTLTPSDVTNAATQVTNAKTQLNGNH

SEQ ID NO: 1565962 - protein, 28 aa, Staphylococcus aureus
SIANKDATKASEDYVDANNDKQTAYNNA

SEQ ID NO: 1565963 - protein, 22 aa, Staphylococcus aureus
SINNAQKAALKSQIEGATTVAG

SEQ ID NO: 1565964 - protein, 29 aa, Staphylococcus aureus
SKDESTDENEKVDIESTENQFESKDKITK

SEQ ID NO: 1565965 - protein, 9 aa, Staphylococcus aureus
SKNQGRSPF

SEQ ID NO: 1565966 - protein, 9 aa, Staphylococcus aureus
SNKKNRVNK

SEQ ID NO: 1565967 - protein, 16 aa, Staphylococcus aureus
SQDNQSISKKITGYGL

SEQ ID NO: 1565968 - protein, 12 aa, Staphylococcus aureus
SQEINNSESEKG

SEQ ID NO: 1565969 - protein, 19 aa, Staphylococcus aureus
SSATRVSGVDTVKQNAQHL

SEQ ID NO: 1565970 - protein, 13 aa, Staphylococcus aureus
SSELGKDDPFNPA

SEQ ID NO: 1565971 - protein, 15 aa, Staphylococcus aureus
TDADQAKKDDYTNAV

SEQ ID NO: 1565972 - protein, 26 aa, Staphylococcus aureus
TDITQHDTEVDNVDNTAKHSHLNKPS

SEQ ID NO: 1565973 - protein, 6 aa, Staphylococcus aureus
TDKDYE

SEQ ID NO: 1565974 - protein, 21 aa, Staphylococcus aureus
TDSYGVATTYTSSSTADNAAK

SEQ ID NO: 1565975 - protein, 9 aa, Staphylococcus aureus
TEQDIENAT

SEQ ID NO: 1565976 - protein, 10 aa, Staphylococcus aureus
TIENNGHEAD

SEQ ID NO: 1565977 - protein, 16 aa, Staphylococcus aureus
TKASGQNVDKAAVEQA

SEQ ID NO: 1565978 - protein, 13 aa, Staphylococcus aureus
TKEFDNKSPSDAI

SEQ ID NO: 1565979 - protein, 5 aa, Staphylococcus aureus
TNDRL

SEQ ID NO: 1565980 - protein, 26 aa, Staphylococcus aureus
TPAGYLPTKVNGTTDGEKDSNGSSIT

SEQ ID NO: 1565981 - protein, 9 aa, Staphylococcus aureus
TVNTTKAAL

SEQ ID NO: 1565982 - protein, 10 aa, Staphylococcus aureus
VDPDNEQKIQ

SEQ ID NO: 1565983 - protein, 12 aa, Staphylococcus aureus
VKHKQRKGIDAY

SEQ ID NO: 1565984 - protein, 25 aa, Staphylococcus aureus
VNTAKTALNGDARLNEAKNTAKQQL

SEQ ID NO: 1565985 - protein, 23 aa, Staphylococcus aureus
VPKGSAHEKQLPKTGTNQSSSPE

SEQ ID NO: 1565986 - protein, 31 aa, Staphylococcus aureus
VQKAKLKEQVQSATTLDGVQTVKNSSQTLNT

SEQ ID NO: 1565987 - protein, 27 aa, Staphylococcus aureus
VQRAKNELNGNQNVANAKTTAKNALNN

SEQ ID NO: 1565988 - protein, 10 aa, Staphylococcus aureus
VQSNANTLDQ

SEQ ID NO: 1565989 - protein, 5 aa, Staphylococcus aureus
VRRNG

SEQ ID NO: 1565990 - protein, 9 aa, Staphylococcus aureus
VSERSLADK

SEQ ID NO: 1565991 - protein, 19 aa, Staphylococcus aureus
VSKTKHGYTITKNKNSSGY

SEQ ID NO: 1565992 - protein, 26 aa, Staphylococcus aureus
VVPTKKAQSKKSELPETGGEESTNNG

SEQ ID NO: 1565993 - protein, 9 aa, Staphylococcus aureus
YASSKSDDM

SEQ ID NO: 1565994 - protein, 22 aa, Staphylococcus aureus
AAESITDPTNGSNANKDAVDQA

SEQ ID NO: 1565995 - protein, 20 aa, Staphylococcus aureus
ADQTKDVELNANDKKLQKTI

SEQ ID NO: 1565996 - protein, 6 aa, Staphylococcus aureus
AGDPYY

SEQ ID NO: 1565997 - protein, 26 aa, Staphylococcus aureus
AGSPTVDQINTNTSAANQAKSDLDHA

SEQ ID NO: 1565998 - protein, 6 aa, Staphylococcus aureus
AQNTSI

SEQ ID NO: 1565999 - protein, 5 aa, Staphylococcus aureus
AQQQF

SEQ ID NO: 1566000 - protein, 5 aa, Staphylococcus aureus
ARQSI

SEQ ID NO: 1566001 - protein, 24 aa, Staphylococcus aureus
AVTAAKKALNGEEKLNNRKSEALQ

SEQ ID NO: 1566002 - protein, 4 aa, Staphylococcus aureus
AYET

SEQ ID NO: 1566003 - protein, 14 aa, Staphylococcus aureus
DAQAASEKDTEITK

SEQ ID NO: 1566004 - protein, 8 aa, Staphylococcus aureus
DEESTKGI

SEQ ID NO: 1566005 - protein, 15 aa, Staphylococcus aureus
DEMDKKEKEKLSQQQ

SEQ ID NO: 1566006 - protein, 6 aa, Staphylococcus aureus
DERADI

SEQ ID NO: 1566007 - protein, 9 aa, Staphylococcus aureus
DGAKNDAES

SEQ ID NO: 1566008 - protein, 46 aa, Staphylococcus aureus
DGTITGYKKNVDDLAKQYDKVSQEQGENSAEAQKLRQEYNKQANEL

SEQ ID NO: 1566009 - protein, 15 aa, Staphylococcus aureus
DHVDKKSNTSANDQY

SEQ ID NO: 1566010 - protein, 16 aa, Staphylococcus aureus
DIANKQRDKDELQSNI

SEQ ID NO: 1566011 - protein, 9 aa, Staphylococcus aureus
DKTGTLTKG

SEQ ID NO: 1566012 - protein, 38 aa, Staphylococcus aureus
DNLNNAQKQAVTDQINGAHTVDEANQIKQNAQNLNTAM

SEQ ID NO: 1566013 - protein, 11 aa, Staphylococcus aureus
DQTTSPTLDPT

SEQ ID NO: 1566014 - protein, 6 aa, Staphylococcus aureus
DQVEEK

SEQ ID NO: 1566015 - protein, 18 aa, Staphylococcus aureus
DSETTRTAVKQDLTEAQA

SEQ ID NO: 1566016 - protein, 197 aa, Staphylococcus aureus
DSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASA

SEQ ID NO: 1566017 - protein, 23 aa, Staphylococcus aureus
EKAKNKVDKSIETRSEAISSISS

SEQ ID NO: 1566018 - protein, 14 aa, Staphylococcus aureus
ELGQNLQLKSENAY

SEQ ID NO: 1566019 - protein, 6 aa, Staphylococcus aureus
ENFRNT

SEQ ID NO: 1566020 - protein, 7 aa, Staphylococcus aureus
EQKDSTI

SEQ ID NO: 1566021 - protein, 45 aa, Staphylococcus aureus
EVQPKSSVTHNAETPKVRKARSVDEGSFDITRDSKNVVESTPITI

SEQ ID NO: 1566022 - protein, 30 aa, Staphylococcus aureus
FTTPEGYTPTTVTSGSDIEKDSNGLTTTGV

SEQ ID NO: 1566023 - protein, 10 aa, Staphylococcus aureus
GDNQGTAEAI

SEQ ID NO: 1566024 - protein, 7 aa, Staphylococcus aureus
GETKDHS

SEQ ID NO: 1566025 - protein, 8 aa, Staphylococcus aureus
GKIARDTF

SEQ ID NO: 1566026 - protein, 7 aa, Staphylococcus aureus
GLNQQQQ

SEQ ID NO: 1566027 - protein, 12 aa, Staphylococcus aureus
GNFPEDAETVGG

SEQ ID NO: 1566028 - protein, 12 aa, Staphylococcus aureus
GQNLQLKPENAY

SEQ ID NO: 1566029 - protein, 22 aa, Staphylococcus aureus
GQSIREEGPQSHMKKTGTPTMG

SEQ ID NO: 1566030 - protein, 5 aa, Staphylococcus aureus
GSRGS

SEQ ID NO: 1566031 - protein, 14 aa, Staphylococcus aureus
GTIDQIDKTNNTYR

SEQ ID NO: 1566032 - protein, 20 aa, Staphylococcus aureus
GTLQASSATNEYKKALDGVK

SEQ ID NO: 1566033 - protein, 10 aa, Staphylococcus aureus
HDPEGDFGRV

SEQ ID NO: 1566034 - protein, 17 aa, Staphylococcus aureus
HKELQKDRENVKINTAD

SEQ ID NO: 1566035 - protein, 13 aa, Staphylococcus aureus
HMPKSQTPNINKG

SEQ ID NO: 1566036 - protein, 9 aa, Staphylococcus aureus
HSLKENNRP

SEQ ID NO: 1566037 - protein, 14 aa, Staphylococcus aureus
HTTVEDTKEYTTES

SEQ ID NO: 1566038 - protein, 4 aa, Staphylococcus aureus
IAGA

SEQ ID NO: 1566039 - protein, 49 aa, Staphylococcus aureus
IEEVTNKDTAPQGVEAKSEVTSNKDTIEHEPSVKAEDISKKEDTPKEVA

SEQ ID NO: 1566040 - protein, 4 aa, Staphylococcus aureus
IKTY

SEQ ID NO: 1566041 - protein, 72 aa, Staphylococcus aureus
ISSRDGEDFKRPSSVSGSIPSINVSGSQDNNTTNRSTHGGSDTSANSSGTAQLNNNTRSQQSRNSGGLTGIF

SEQ ID NO: 1566042 - protein, 34 aa, Staphylococcus aureus
ITEKKEVKVKKKKKNDKDKDEYETKTEEKQRKVN

SEQ ID NO: 1566043 - protein, 34 aa, Staphylococcus aureus
ITEKKEVKVKKKKKSEKDKDEYETKTEEKQRKVN

SEQ ID NO: 1566044 - protein, 6 aa, Staphylococcus aureus
KAEHGN

SEQ ID NO: 1566045 - protein, 9 aa, Staphylococcus aureus
KAEQDNITY

SEQ ID NO: 1566046 - protein, 12 aa, Staphylococcus aureus
KANGQNMTKAQV

SEQ ID NO: 1566047 - protein, 7 aa, Staphylococcus aureus
KASDSKE

SEQ ID NO: 1566048 - protein, 28 aa, Staphylococcus aureus
KAVAPTKKAQSKKSELPETGGEESTNKG

SEQ ID NO: 1566049 - protein, 6 aa, Staphylococcus aureus
KDGAVT

SEQ ID NO: 1566050 - protein, 8 aa, Staphylococcus aureus
KDQSSETK

SEQ ID NO: 1566051 - protein, 6 aa, Staphylococcus aureus
KEAAIA

SEQ ID NO: 1566052 - protein, 60 aa, Staphylococcus aureus
KEETTQTQSVAPNTGEEGMSSASTQSTKTSDIHNESIDKQMEAKAQETAQNTDLKNEARS

SEQ ID NO: 1566053 - protein, 15 aa, Staphylococcus aureus
KGDSVDNDNFSPDEG

SEQ ID NO: 1566054 - protein, 8 aa, Staphylococcus aureus
KKPQSNNT

SEQ ID NO: 1566055 - protein, 12 aa, Staphylococcus aureus
KLDDTSKFEDVT

SEQ ID NO: 1566056 - protein, 9 aa, Staphylococcus aureus
KPVAKNDLK

SEQ ID NO: 1566057 - protein, 6 aa, Staphylococcus aureus
KRSYFN

SEQ ID NO: 1566058 - protein, 7 aa, Staphylococcus aureus
KTAVSGA

SEQ ID NO: 1566059 - protein, 14 aa, Staphylococcus aureus
KVQQRKSEETDRGC

SEQ ID NO: 1566060 - protein, 5 aa, Staphylococcus aureus
KVTPI

SEQ ID NO: 1566061 - protein, 11 aa, Staphylococcus aureus
LANDDKTFGEA

SEQ ID NO: 1566062 - protein, 20 aa, Staphylococcus aureus
LGTNGGGFLGANSSTPFENP

SEQ ID NO: 1566063 - protein, 6 aa, Staphylococcus aureus
LMKNNK

SEQ ID NO: 1566064 - protein, 9 aa, Staphylococcus aureus
LNADQRNGF

SEQ ID NO: 1566065 - protein, 6 aa, Staphylococcus aureus
LNDNSV

SEQ ID NO: 1566066 - protein, 5 aa, Staphylococcus aureus
LNNYA

SEQ ID NO: 1566067 - protein, 5 aa, Staphylococcus aureus
LSNND

SEQ ID NO: 1566068 - protein, 9 aa, Staphylococcus aureus
MNKPNTAQV

SEQ ID NO: 1566069 - protein, 122 aa, Staphylococcus aureus
NDDEETNHTEAEKSSSNIKDAEKTGVATASTVGIAKNDTENTVADEPSIHEGTEKTESQHHIDNQTESNHDEDHDITSKSAESAESVKHAPQSDDLTNDSNEDETEQSLKEPATYKEDRRSS

SEQ ID NO: 1566070 - protein, 122 aa, Staphylococcus aureus
NDDEETNHTEAEKSSSNIKDAEKTGVATASTVGIAKNDTENTVADEPSIHEGTEKTESQHHIDNQTESNHDEDHDITSKSVESAESVKHAPQSDDLTNDSNEDETEQSLKEPATYKEDRRSS

SEQ ID NO: 1566071 - protein, 31 aa, Staphylococcus aureus
NEHANVEQTVDYTQADLDKQNAYKQAIADAE

SEQ ID NO: 1566072 - protein, 7 aa, Staphylococcus aureus
NEIETSR

SEQ ID NO: 1566073 - protein, 4 aa, Staphylococcus aureus
NETA

SEQ ID NO: 1566074 - protein, 12 aa, Staphylococcus aureus
NFYANNSEISEI

SEQ ID NO: 1566075 - protein, 43 aa, Staphylococcus aureus
NGYTKGSEKDQEAFTNNKDEEAVAAKNPESEEYKVNEKIKKEH

SEQ ID NO: 1566076 - protein, 17 aa, Staphylococcus aureus
NHSELRGKKVSLNDGDP

SEQ ID NO: 1566077 - protein, 19 aa, Staphylococcus aureus
NKATSNQAVSQVQTAGNHA

SEQ ID NO: 1566078 - protein, 7 aa, Staphylococcus aureus
NKKEEQK

SEQ ID NO: 1566079 - protein, 33 aa, Staphylococcus aureus
NLNTPQRQALENQINNAATRGEVAQKLTEAEAL

SEQ ID NO: 1566080 - protein, 9 aa, Staphylococcus aureus
NNADTVSDV

SEQ ID NO: 1566081 - protein, 7 aa, Staphylococcus aureus
NTSTKNL

SEQ ID NO: 1566082 - protein, 23 aa, Staphylococcus aureus
NVQPTNEENKKVDAKTESTTLNV

SEQ ID NO: 1566083 - protein, 203 aa, Staphylococcus aureus
NVTSPSVNSEMNNNETGTPHESNQAGNEGTGSNSRDANPDSNNVKPDSNNQNPSPDSKPDPNNPNPGPNPKPDPDKPKPNPEPKPDPKPDPDKPKPNPDPKPNPDPKPDPDKPKPNPDPKPDPDKPKPNPDPKPDPNPNPKPDPNKPNPNPSPNPNQPGDSNQSGGSKNGGTWNPNASDGSNQGQWQPNGNQGNSQNPTGNDF

SEQ ID NO: 1566084 - protein, 41 aa, Staphylococcus aureus
PAVSEQPAKGQQGSKGSESGKDVQPIGDDKAMNPAKQPATG

SEQ ID NO: 1566085 - protein, 5 aa, Staphylococcus aureus
PEEVE

SEQ ID NO: 1566086 - protein, 8 aa, Staphylococcus aureus
PKDSPKLL

SEQ ID NO: 1566087 - protein, 18 aa, Staphylococcus aureus
QDGKATGKTATLNESNNW

SEQ ID NO: 1566088 - protein, 24 aa, Staphylococcus aureus
QLSASSKEHYKAQLNEAKTASQID

SEQ ID NO: 1566089 - protein, 31 aa, Staphylococcus aureus
QNGINNESQVKSSEKYRDADTNKQQEYDNAI

SEQ ID NO: 1566090 - protein, 5 aa, Staphylococcus aureus
QNQGK

SEQ ID NO: 1566091 - protein, 4 aa, Staphylococcus aureus
QNSF

SEQ ID NO: 1566092 - protein, 34 aa, Staphylococcus aureus
QSIADNATTKQNQNYTDASPNKKDAYNNAVTTAQ

SEQ ID NO: 1566093 - protein, 27 aa, Staphylococcus aureus
QSVTSTENALNGDANLQRAKTEATQAI

SEQ ID NO: 1566094 - protein, 12 aa, Staphylococcus aureus
QTVEMSKGNYTQ

SEQ ID NO: 1566095 - protein, 11 aa, Staphylococcus aureus
RAGDYAYATGG

SEQ ID NO: 1566096 - protein, 27 aa, Staphylococcus aureus
RDQATRVSEGDYSYKPSVTTKDEIGQL

SEQ ID NO: 1566097 - protein, 4 aa, Staphylococcus aureus
REFD

SEQ ID NO: 1566098 - protein, 10 aa, Staphylococcus aureus
RESNYQSNAV

SEQ ID NO: 1566099 - protein, 11 aa, Staphylococcus aureus
RGEEKAKTHQK

SEQ ID NO: 1566100 - protein, 82 aa, Staphylococcus aureus
RRAQDLNRRNQQQIPQNSAANNETSNSAPAAGNGVASTPPSAPSGDTAPNNNVTQNTAPNSNNAPVSTTPQSTSGKKDGQSF

SEQ ID NO: 1566101 - protein, 6 aa, Staphylococcus aureus
RSRQSI

SEQ ID NO: 1566102 - protein, 7 aa, Staphylococcus aureus
RTNVNGG

SEQ ID NO: 1566103 - protein, 4 aa, Staphylococcus aureus
SDEK

SEQ ID NO: 1566104 - protein, 11 aa, Staphylococcus aureus
SDLKGNNHQDQ

SEQ ID NO: 1566105 - protein, 21 aa, Staphylococcus aureus
SDYKKPDEKISDTERKLNSKE

SEQ ID NO: 1566106 - protein, 21 aa, Staphylococcus aureus
SDYKKPEEKTSDTERKLNSKE

SEQ ID NO: 1566107 - protein, 147 aa, Staphylococcus aureus
SESTSASTSESLSGSTSDSTSLSDSNSESGSTSTSLSNSTSSSTSISTSISGSASTSAYKSDSVSTSLSTSTSTSLSDSTSLSTSLSDSASGSKSNSLSASMSTSDSISTRKSESLSTSTSLSVSTSESESGSTSSSESKSDSTSMS

SEQ ID NO: 1566108 - protein, 14 aa, Staphylococcus aureus
SGHGGGSSLGKGLA

SEQ ID NO: 1566109 - protein, 16 aa, Staphylococcus aureus
SINPEPSFKVDGKKYE

SEQ ID NO: 1566110 - protein, 79 aa, Staphylococcus aureus
SKGESKEEITKDPINELTEYGPETITPGHRDEFDPKLPTGEKEEVPGKPGIKNPETGDVVRPPVDSVTKYGPVKGDSIV

SEQ ID NO: 1566111 - protein, 5 aa, Staphylococcus aureus
SLKKI

SEQ ID NO: 1566112 - protein, 5 aa, Staphylococcus aureus
SNAVN

SEQ ID NO: 1566113 - protein, 8 aa, Staphylococcus aureus
SPTTAGTM

SEQ ID NO: 1566114 - protein, 43 aa, Staphylococcus aureus
SSSKTYGPYPQNKDITISASGKAKDKTFTTQTKTIKASDLKYN

SEQ ID NO: 1566115 - protein, 6 aa, Staphylococcus aureus
STDQNT

SEQ ID NO: 1566116 - protein, 17 aa, Staphylococcus aureus
TAQKTNLTNQINSGTTV

SEQ ID NO: 1566117 - protein, 4 aa, Staphylococcus aureus
TDEL

SEQ ID NO: 1566118 - protein, 52 aa, Staphylococcus aureus
TELKTEVAQKSSTEKNDNCNHDIEGNVEDIAEGRLDEVQNTDSMLNQKNKRI

SEQ ID NO: 1566119 - protein, 9 aa, Staphylococcus aureus
TGTITNGRP

SEQ ID NO: 1566120 - protein, 7 aa, Staphylococcus aureus
TNPDKLA

SEQ ID NO: 1566121 - protein, 5 aa, Staphylococcus aureus
TQLNQ

SEQ ID NO: 1566122 - protein, 13 aa, Staphylococcus aureus
TTVGYGDLSPSTI

SEQ ID NO: 1566123 - protein, 15 aa, Staphylococcus aureus
TVDKDGKPSRMNQPY

SEQ ID NO: 1566124 - protein, 4 aa, Staphylococcus aureus
VDEN

SEQ ID NO: 1566125 - protein, 10 aa, Staphylococcus aureus
VDNESTQFDQ

SEQ ID NO: 1566126 - protein, 9 aa, Staphylococcus aureus
VGDGMSDAL

SEQ ID NO: 1566127 - protein, 4 aa, Staphylococcus aureus
VKPG

SEQ ID NO: 1566128 - protein, 8 aa, Staphylococcus aureus
VNADNSKF

SEQ ID NO: 1566129 - protein, 33 aa, Staphylococcus aureus
VNQKAASVKSTKDALDGQQNLQRAKTEATNAIT

SEQ ID NO: 1566130 - protein, 22 aa, Staphylococcus aureus
VQPTNEENKKVDAKTESTTLNV

SEQ ID NO: 1566131 - protein, 5 aa, Staphylococcus aureus
VSETY

SEQ ID NO: 1566132 - protein, 29 aa, Staphylococcus aureus
VSPEKLANQTIQRVKDDTKAHKEEKTPFY

SEQ ID NO: 1566133 - protein, 19 aa, Staphylococcus aureus
VTAANAAKTALDQARNGLT

SEQ ID NO: 1566134 - protein, 78 aa, Staphylococcus aureus
VVKDEDSEFNDGKFGKSYEEIRKEQLEDGQRDESEDRKEEKDIAEDKKEADKSDEKDEPAHQQAPNIEKPYDPNHPDN

SEQ ID NO: 1566135 - protein, 43 aa, Staphylococcus aureus
VVKEEAKPQVKETTQSQDNSGDQRQVDLTPKKATQNQVAETQV

SEQ ID NO: 1566136 - protein, 13 aa, Staphylococcus aureus
YKRNNSDGNVKKL

SEQ ID NO: 1566137 - protein, 5 aa, Staphylococcus aureus
YPGIS

SEQ ID NO: 1566138 - protein, 19 aa, Staphylococcus aureus
AASQSVSTSTSDSMSTSEI

SEQ ID NO: 1566139 - protein, 7 aa, Staphylococcus aureus
ADLKKQS

SEQ ID NO: 1566140 - protein, 4 aa, Staphylococcus aureus
ADNW

SEQ ID NO: 1566141 - protein, 6 aa, Staphylococcus aureus
AGGSDY

SEQ ID NO: 1566142 - protein, 12 aa, Staphylococcus aureus
AGIKGEKAGTAL

SEQ ID NO: 1566143 - protein, 42 aa, Staphylococcus aureus
AINGASDLNQHQKDALKAQANGAQRVSNAQDVQRNATELNTA

SEQ ID NO: 1566144 - protein, 42 aa, Staphylococcus aureus
AINGASDLNQKQKDALKAQANGAQRVSNANDVQRNATELNTA

SEQ ID NO: 1566145 - protein, 9 aa, Staphylococcus aureus
AKQQANNRL

SEQ ID NO: 1566146 - protein, 9 aa, Staphylococcus aureus
AKYDTTEPQ

SEQ ID NO: 1566147 - protein, 10 aa, Staphylococcus aureus
ANDDKTFGEA

SEQ ID NO: 1566148 - protein, 20 aa, Staphylococcus aureus
ANSSMQAVKEDTKAPKEEKI

SEQ ID NO: 1566149 - protein, 7 aa, Staphylococcus aureus
AQQQTLT

SEQ ID NO: 1566150 - protein, 11 aa, Staphylococcus aureus
ASGQQLPQSNK

SEQ ID NO: 1566151 - protein, 248 aa, Staphylococcus aureus
ASMNQSGVDSNSASQSASTSTSTSTSESDSQSTSSYTSQSTSQSESTSTSTSLSDSTSMSRSTSQSGSTSTSASLSASESESDSQSISTSASDSTSESTSTSLSDSTSTSNSTSESTSKAISTSASASESDSSSTSLSDSTSASMQSSESDSQSTSASGSTSESTSESDSTSISDSESVSTSTSMSLSTSDSTSTSESLSTSMSGSQSISDSTSTSMSNSTSMSNSTSTSMSGSTSTSESNSMHPSDS

SEQ ID NO: 1566152 - protein, 12 aa, Staphylococcus aureus
ASVEELEKAGAF

SEQ ID NO: 1566153 - protein, 5 aa, Staphylococcus aureus
CEIDD

SEQ ID NO: 1566154 - protein, 111 aa, Staphylococcus aureus
DAKKTSKAKKDKQDTEVAVASSNSDNVSYEASATTPATTSSADTDSEDSEKSSKDEDKQNASKSDKSSVEKSESNEETAPVEPMPHSKPTTSEAPPSQNIHNEDSMYDAST

SEQ ID NO: 1566155 - protein, 16 aa, Staphylococcus aureus
DAQKQALKGQIDQSPE

SEQ ID NO: 1566156 - protein, 6 aa, Staphylococcus aureus
DELNNE

SEQ ID NO: 1566157 - protein, 4 aa, Staphylococcus aureus
DFPH

SEQ ID NO: 1566158 - protein, 11 aa, Staphylococcus aureus
DGSGFNRGVTG

SEQ ID NO: 1566159 - protein, 21 aa, Staphylococcus aureus
DIKDPNNGETIATAKHDTANN

SEQ ID NO: 1566160 - protein, 16 aa, Staphylococcus aureus
DKEGYRDGEFEKGDKG

SEQ ID NO: 1566161 - protein, 10 aa, Staphylococcus aureus
DKIKESSKQM

SEQ ID NO: 1566162 - protein, 9 aa, Staphylococcus aureus
DKLPDRKNY

SEQ ID NO: 1566163 - protein, 32 aa, Staphylococcus aureus
DQATQAVTDAKNNLHGDQKLDQDKQRATETLN

SEQ ID NO: 1566164 - protein, 9 aa, Staphylococcus aureus
DSETTRTAV

SEQ ID NO: 1566165 - protein, 8 aa, Staphylococcus aureus
DYQSNGSK

SEQ ID NO: 1566166 - protein, 12 aa, Staphylococcus aureus
DYTSRDFENKDT

SEQ ID NO: 1566167 - protein, 9 aa, Staphylococcus aureus
EDKKLKQKI

SEQ ID NO: 1566168 - protein, 4 aa, Staphylococcus aureus
EEDQ

SEQ ID NO: 1566169 - protein, 6 aa, Staphylococcus aureus
EELEPN

SEQ ID NO: 1566170 - protein, 7 aa, Staphylococcus aureus
EGTVDNK

SEQ ID NO: 1566171 - protein, 9 aa, Staphylococcus aureus
EKNSIGSAF

SEQ ID NO: 1566172 - protein, 11 aa, Staphylococcus aureus
ELGESKEVIEE

SEQ ID NO: 1566173 - protein, 7 aa, Staphylococcus aureus
ESKNNEL

SEQ ID NO: 1566174 - protein, 9 aa, Staphylococcus aureus
ESNSNHPLA

SEQ ID NO: 1566175 - protein, 18 aa, Staphylococcus aureus
EVRGKKASKNKRPSQLSD

SEQ ID NO: 1566176 - protein, 5 aa, Staphylococcus aureus
FGPSG

SEQ ID NO: 1566177 - protein, 8 aa, Staphylococcus aureus
FSGSSTGI

SEQ ID NO: 1566178 - protein, 18 aa, Staphylococcus aureus
FSQNKLPDVEKDLKKANK

SEQ ID NO: 1566179 - protein, 33 aa, Staphylococcus aureus
FTQADQDKQQAYNNAANQAQQIANGTPTPVLTP

SEQ ID NO: 1566180 - protein, 11 aa, Staphylococcus aureus
GANSSTPFENP

SEQ ID NO: 1566181 - protein, 10 aa, Staphylococcus aureus
GDNKEVAQTV

SEQ ID NO: 1566182 - protein, 6 aa, Staphylococcus aureus
GIGISE

SEQ ID NO: 1566183 - protein, 12 aa, Staphylococcus aureus
GISGNTGFSTGP

SEQ ID NO: 1566184 - protein, 17 aa, Staphylococcus aureus
GKNISYATPQEVNNIPG

SEQ ID NO: 1566185 - protein, 7 aa, Staphylococcus aureus
GNDTYSE

SEQ ID NO: 1566186 - protein, 12 aa, Staphylococcus aureus
GNTTTKTTANIQ

SEQ ID NO: 1566187 - protein, 9 aa, Staphylococcus aureus
GQAIPNGTF

SEQ ID NO: 1566188 - protein, 4 aa, Staphylococcus aureus
GSAA

SEQ ID NO: 1566189 - protein, 36 aa, Staphylococcus aureus
HKSKDASKDTSEDPAVSTTDNNHEVAKTPNNDGSGH

SEQ ID NO: 1566190 - protein, 10 aa, Staphylococcus aureus
HSSYPNNIGQ

SEQ ID NO: 1566191 - protein, 5 aa, Staphylococcus aureus
HVTIN

SEQ ID NO: 1566192 - protein, 9 aa, Staphylococcus aureus
IEPTAKASL

SEQ ID NO: 1566193 - protein, 8 aa, Staphylococcus aureus
IKAVKDKG

SEQ ID NO: 1566194 - protein, 8 aa, Staphylococcus aureus
ITDSNGKM

SEQ ID NO: 1566195 - protein, 17 aa, Staphylococcus aureus
ITKSKQLTEESYANRPL

SEQ ID NO: 1566196 - protein, 9 aa, Staphylococcus aureus
ITRKKQGKA

SEQ ID NO: 1566197 - protein, 8 aa, Staphylococcus aureus
KANATQAI

SEQ ID NO: 1566198 - protein, 9 aa, Staphylococcus aureus
KEISEQDQK

SEQ ID NO: 1566199 - protein, 32 aa, Staphylococcus aureus
KELKDSYDKLSKETGENSAKTQAAAAKYNEAY

SEQ ID NO: 1566200 - protein, 11 aa, Staphylococcus aureus
KGLDDHESVGI

SEQ ID NO: 1566201 - protein, 11 aa, Staphylococcus aureus
KIENKSSFVSA

SEQ ID NO: 1566202 - protein, 7 aa, Staphylococcus aureus
KKAEVEL

SEQ ID NO: 1566203 - protein, 20 aa, Staphylococcus aureus
KKAREMGATTKFSASDSAEA

SEQ ID NO: 1566204 - protein, 7 aa, Staphylococcus aureus
KKGIEFD

SEQ ID NO: 1566205 - protein, 88 aa, Staphylococcus aureus
KLNDAQAPKEEDNNKPGKEDNNKPGKEDGNKPGKEDNKKPGKEDGNKPGKEDNKKPGKEDGNKPGKEDGNKPGKEDGNKPGKEDGNGV

SEQ ID NO: 1566206 - protein, 8 aa, Staphylococcus aureus
KLPGVNTS

SEQ ID NO: 1566207 - protein, 6 aa, Staphylococcus aureus
KNQNLK

SEQ ID NO: 1566208 - protein, 17 aa, Staphylococcus aureus
KNYSNGDVSINENVPSY

SEQ ID NO: 1566209 - protein, 37 aa, Staphylococcus aureus
KQGIANKDTVKASENYHDADADKQTAYTNAVSQAEGI

SEQ ID NO: 1566210 - protein, 13 aa, Staphylococcus aureus
KQHGPNTAQNAVE

SEQ ID NO: 1566211 - protein, 7 aa, Staphylococcus aureus
KQTATSL

SEQ ID NO: 1566212 - protein, 4 aa, Staphylococcus aureus
KRPL

SEQ ID NO: 1566213 - protein, 20 aa, Staphylococcus aureus
KSLDAFSNKNVKAKLDASIQ

SEQ ID NO: 1566214 - protein, 20 aa, Staphylococcus aureus
KSSDTAEKSKEDSKETQIKK

SEQ ID NO: 1566215 - protein, 9 aa, Staphylococcus aureus
KSTAPKRLN

SEQ ID NO: 1566216 - protein, 19 aa, Staphylococcus aureus
KVAEANQAKDQLNTARQGL

SEQ ID NO: 1566217 - protein, 14 aa, Staphylococcus aureus
KVKATSGATGEEFE

SEQ ID NO: 1566218 - protein, 22 aa, Staphylococcus aureus
KVNETRDVDTQQASTQKPTHTA

SEQ ID NO: 1566219 - protein, 23 aa, Staphylococcus aureus
KVTQAKNDLNGNTNLATTKQNVQ

SEQ ID NO: 1566220 - protein, 5 aa, Staphylococcus aureus
KYVPD

SEQ ID NO: 1566221 - protein, 50 aa, Staphylococcus aureus
LKTEVAQKSSTEKNDNCNHDIEGNVEDIAEGRLDEVQNTDSMLNQKNKRI

SEQ ID NO: 1566222 - protein, 14 aa, Staphylococcus aureus
LNKSTGPNTAQNAV

SEQ ID NO: 1566223 - protein, 6 aa, Staphylococcus aureus
LPGKVK

SEQ ID NO: 1566224 - protein, 11 aa, Staphylococcus aureus
LPSGQGTRNVE

SEQ ID NO: 1566225 - protein, 6 aa, Staphylococcus aureus
LTEAQA

SEQ ID NO: 1566226 - protein, 8 aa, Staphylococcus aureus
MPEDKESI

SEQ ID NO: 1566227 - protein, 25 aa, Staphylococcus aureus
MQSSNHQMNQSNKKVLPAAGESMTS

SEQ ID NO: 1566228 - protein, 14 aa, Staphylococcus aureus
MSTEQLEISHIQHN

SEQ ID NO: 1566229 - protein, 20 aa, Staphylococcus aureus
NAKAPSRDVKGQNLTNGTDA

SEQ ID NO: 1566230 - protein, 34 aa, Staphylococcus aureus
NAKNTNVTIKSGGVADNGDYYTGDGSTIIDSNTE

SEQ ID NO: 1566231 - protein, 8 aa, Staphylococcus aureus
NDDNTTVF

SEQ ID NO: 1566232 - protein, 7 aa, Staphylococcus aureus
NEAVQGD

SEQ ID NO: 1566233 - protein, 15 aa, Staphylococcus aureus
NEGDVTISNYNQNSA

SEQ ID NO: 1566234 - protein, 26 aa, Staphylococcus aureus
NEHANVEQTVDYTQADSDKQNAYKQA

SEQ ID NO: 1566235 - protein, 5 aa, Staphylococcus aureus
NEKQL

SEQ ID NO: 1566236 - protein, 25 aa, Staphylococcus aureus
NELDSKDNKSSHTEMNGQSDIDSKL

SEQ ID NO: 1566237 - protein, 5 aa, Staphylococcus aureus
NGDHN

SEQ ID NO: 1566238 - protein, 9 aa, Staphylococcus aureus
NLKGSSVGY

SEQ ID NO: 1566239 - protein, 27 aa, Staphylococcus aureus
NNPTINKGNVTSATQAVTSSKNALDGV

SEQ ID NO: 1566240 - protein, 10 aa, Staphylococcus aureus
NPNQQLPQSN

SEQ ID NO: 1566241 - protein, 10 aa, Staphylococcus aureus
NPSENSLTNA

SEQ ID NO: 1566242 - protein, 32 aa, Staphylococcus aureus
NQAKDQVTAKQQALNGQENLRTAQTNAKQHLN

SEQ ID NO: 1566243 - protein, 13 aa, Staphylococcus aureus
NQVNTTKAALNGV

SEQ ID NO: 1566244 - protein, 37 aa, Staphylococcus aureus
NSPKSYRESKYEGEPAQHSQLHENENVANELIDFLWK

SEQ ID NO: 1566245 - protein, 18 aa, Staphylococcus aureus
NVNTHGVSTARKVPEIKN

SEQ ID NO: 1566246 - protein, 10 aa, Staphylococcus aureus
NYRESNRAPS

SEQ ID NO: 1566247 - protein, 9 aa, Staphylococcus aureus
PGKSTKNTL

SEQ ID NO: 1566248 - protein, 13 aa, Staphylococcus aureus
PKYDEGKKIEYTV

SEQ ID NO: 1566249 - protein, 16 aa, Staphylococcus aureus
PNLNQTQKTALKDQVS

SEQ ID NO: 1566250 - protein, 8 aa, Staphylococcus aureus
PQESFTSA

SEQ ID NO: 1566251 - protein, 11 aa, Staphylococcus aureus
PTYESERELPK

SEQ ID NO: 1566252 - protein, 10 aa, Staphylococcus aureus
QAAITGESVP

SEQ ID NO: 1566253 - protein, 9 aa, Staphylococcus aureus
QAATTLNDA

SEQ ID NO: 1566254 - protein, 11 aa, Staphylococcus aureus
QEIGNSMKNVG

SEQ ID NO: 1566255 - protein, 32 aa, Staphylococcus aureus
QGIADKEQTKADGNFVNADPDKQNAYKQAVAK

SEQ ID NO: 1566256 - protein, 30 aa, Staphylococcus aureus
QGIADKEQTKADGNFVNADPDKQNAYNQAV

SEQ ID NO: 1566257 - protein, 7 aa, Staphylococcus aureus
QNPKLGI

SEQ ID NO: 1566258 - protein, 12 aa, Staphylococcus aureus
QNQELDEKQPEL

SEQ ID NO: 1566259 - protein, 12 aa, Staphylococcus aureus
QVNSAKNNLDGT

SEQ ID NO: 1566260 - protein, 27 aa, Staphylococcus aureus
QVTDAKNGLNGEAKLATEKQNAKDAVN

SEQ ID NO: 1566261 - protein, 14 aa, Staphylococcus aureus
QVTQAKGDLNGNHN

SEQ ID NO: 1566262 - protein, 26 aa, Staphylococcus aureus
QYERELNQATQELKDMQREQKALNTA

SEQ ID NO: 1566263 - protein, 11 aa, Staphylococcus aureus
RANAKRGYTNF

SEQ ID NO: 1566264 - protein, 34 aa, Staphylococcus aureus
RGINDEAATKAAQKYTEADRDKQTAYNDAVTAAK

SEQ ID NO: 1566265 - protein, 4 aa, Staphylococcus aureus
RHRD

SEQ ID NO: 1566266 - protein, 17 aa, Staphylococcus aureus
RMTTTNKYNYSSYAGYT

SEQ ID NO: 1566267 - protein, 34 aa, Staphylococcus aureus
RQALTPDKAPLQTAKTQLEQSINQPTDTTGMTTA

SEQ ID NO: 1566268 - protein, 11 aa, Staphylococcus aureus
RQSNSETVDVT

SEQ ID NO: 1566269 - protein, 16 aa, Staphylococcus aureus
SAAANNGSGFEGLKDD

SEQ ID NO: 1566270 - protein, 12 aa, Staphylococcus aureus
SKKEHYIETQEK

SEQ ID NO: 1566271 - protein, 7 aa, Staphylococcus aureus
SKNKKMS

SEQ ID NO: 1566272 - protein, 9 aa, Staphylococcus aureus
SNEQNSTEA

SEQ ID NO: 1566273 - protein, 9 aa, Staphylococcus aureus
SNFDYNKEQ

SEQ ID NO: 1566274 - protein, 9 aa, Staphylococcus aureus
SNSSNLKQY

SEQ ID NO: 1566275 - protein, 11 aa, Staphylococcus aureus
SNTIAESLNTQ

SEQ ID NO: 1566276 - protein, 10 aa, Staphylococcus aureus
SSLSEEEVAS

SEQ ID NO: 1566277 - protein, 10 aa, Staphylococcus aureus
SSPTRAMGNE

SEQ ID NO: 1566278 - protein, 4 aa, Staphylococcus aureus
SSTV

SEQ ID NO: 1566279 - protein, 10 aa, Staphylococcus aureus
SVKNSERRGM

SEQ ID NO: 1566280 - protein, 11 aa, Staphylococcus aureus
SVQELEKAGAF

SEQ ID NO: 1566281 - protein, 6 aa, Staphylococcus aureus
TATEVG

SEQ ID NO: 1566282 - protein, 14 aa, Staphylococcus aureus
TDADQAKKDAYTNA

SEQ ID NO: 1566283 - protein, 15 aa, Staphylococcus aureus
TDADQAKKDAYTNAV

SEQ ID NO: 1566284 - protein, 4 aa, Staphylococcus aureus
TDGL

SEQ ID NO: 1566285 - protein, 10 aa, Staphylococcus aureus
TDKVKSGDYF

SEQ ID NO: 1566286 - protein, 9 aa, Staphylococcus aureus
TDPARRNDA

SEQ ID NO: 1566287 - protein, 4 aa, Staphylococcus aureus
TDVG

SEQ ID NO: 1566288 - protein, 52 aa, Staphylococcus aureus
TELKTEVAQKSSAEKNDNCNHDIEGNVEDIAEGRLDEVQNTDSMLNQKNKRI

SEQ ID NO: 1566289 - protein, 9 aa, Staphylococcus aureus
TINQKAQAL

SEQ ID NO: 1566290 - protein, 5 aa, Staphylococcus aureus
TKNKV

SEQ ID NO: 1566291 - protein, 33 aa, Staphylococcus aureus
TNNQKSAISSQIDRAGHVSEVTAAKNAATELNA

SEQ ID NO: 1566292 - protein, 26 aa, Staphylococcus aureus
TPAGYLPTKENGTTDGEKDSNGSSVT

SEQ ID NO: 1566293 - protein, 5 aa, Staphylococcus aureus
TPSYD

SEQ ID NO: 1566294 - protein, 16 aa, Staphylococcus aureus
TQGSGETISDEQRSDD

SEQ ID NO: 1566295 - protein, 5 aa, Staphylococcus aureus
TSLKG

SEQ ID NO: 1566296 - protein, 10 aa, Staphylococcus aureus
TTIADKHKNQ

SEQ ID NO: 1566297 - protein, 7 aa, Staphylococcus aureus
TTKHEVE

SEQ ID NO: 1566298 - protein, 25 aa, Staphylococcus aureus
TTMNQAKDALNGDEKLAQAKQDAIA

SEQ ID NO: 1566299 - protein, 23 aa, Staphylococcus aureus
TTMPGATPQSTQDEISSKIDNQV

SEQ ID NO: 1566300 - protein, 33 aa, Staphylococcus aureus
TVPNTSQITGTVDNNHQHVSATAPNVTSATSKT

SEQ ID NO: 1566301 - protein, 7 aa, Staphylococcus aureus
TYGDNNS

SEQ ID NO: 1566302 - protein, 32 aa, Staphylococcus aureus
VADNQATLASEDYHDATAQRQNDYNQAVTATN

SEQ ID NO: 1566303 - protein, 4 aa, Staphylococcus aureus
VAKT

SEQ ID NO: 1566304 - protein, 10 aa, Staphylococcus aureus
VGNKENPGYY

SEQ ID NO: 1566305 - protein, 7 aa, Staphylococcus aureus
VKDESNI

SEQ ID NO: 1566306 - protein, 15 aa, Staphylococcus aureus
VLKQSTSENSSLSKL

SEQ ID NO: 1566307 - protein, 24 aa, Staphylococcus aureus
VLTPNTDTTAYLPKGSKVYNGAQT

SEQ ID NO: 1566308 - protein, 12 aa, Staphylococcus aureus
VNDDKKADTRTI

SEQ ID NO: 1566309 - protein, 11 aa, Staphylococcus aureus
VQPSSTEAKNV

SEQ ID NO: 1566310 - protein, 9 aa, Staphylococcus aureus
YDDTPEGKS

SEQ ID NO: 1566311 - protein, 9 aa, Staphylococcus aureus
YEDVTNSVT

SEQ ID NO: 1566312 - protein, 30 aa, Staphylococcus aureus
YRGNTSSQSESDKNVTKSSQEENQAKEELQ

SEQ ID NO: 1566313 - protein, 73 aa, Staphylococcus aureus
AAASEQNNTTVEESGSSATESKASETQTTTNNVNTIDETQSYSATSTEQPSQSTQVTTEEAPTTVQAPKVETE

SEQ ID NO: 1566314 - protein, 20 aa, Staphylococcus aureus
AAESITDPTNGSNANKDAVD

SEQ ID NO: 1566315 - protein, 9 aa, Staphylococcus aureus
AASGEELGA

SEQ ID NO: 1566316 - protein, 10 aa, Staphylococcus aureus
ADKNNKIVPA

SEQ ID NO: 1566317 - protein, 8 aa, Staphylococcus aureus
AKDYSKSK

SEQ ID NO: 1566318 - protein, 8 aa, Staphylococcus aureus
AKISENEF

SEQ ID NO: 1566319 - protein, 12 aa, Staphylococcus aureus
AKSNKPGELSNE

SEQ ID NO: 1566320 - protein, 10 aa, Staphylococcus aureus
AKTNGKHDIE

SEQ ID NO: 1566321 - protein, 14 aa, Staphylococcus aureus
AQAKTNATNTINNA

SEQ ID NO: 1566322 - protein, 14 aa, Staphylococcus aureus
AQTSSKANTDVRGL

SEQ ID NO: 1566323 - protein, 5 aa, Staphylococcus aureus
ARGSR

SEQ ID NO: 1566324 - protein, 11 aa, Staphylococcus aureus
ARQSPEFGNPD

SEQ ID NO: 1566325 - protein, 30 aa, Staphylococcus aureus
ASALGDSGSPASDSTLGPTAGLNVDGQHDH

SEQ ID NO: 1566326 - protein, 5 aa, Staphylococcus aureus
ASDLS

SEQ ID NO: 1566327 - protein, 8 aa, Staphylococcus aureus
ASGLPTDG

SEQ ID NO: 1566328 - protein, 25 aa, Staphylococcus aureus
ASNKNEAKESKEPLPDTGSEDEANT

SEQ ID NO: 1566329 - protein, 8 aa, Staphylococcus aureus
ATGLPTDG

SEQ ID NO: 1566330 - protein, 7 aa, Staphylococcus aureus
ATQNIAD

SEQ ID NO: 1566331 - protein, 27 aa, Staphylococcus aureus
AVAPTKKPQSKKSELPETGGEESTNKG

SEQ ID NO: 1566332 - protein, 19 aa, Staphylococcus aureus
DADEQKRNAYNQAVSAAET

SEQ ID NO: 1566333 - protein, 9 aa, Staphylococcus aureus
DAKTPSKIS

SEQ ID NO: 1566334 - protein, 19 aa, Staphylococcus aureus
DASIKDNNKDQTSRKAEAL

SEQ ID NO: 1566335 - protein, 10 aa, Staphylococcus aureus
DEDSTKGIVT

SEQ ID NO: 1566336 - protein, 60 aa, Staphylococcus aureus
DEITTKDQSDDDINTPNVAEDKSQDDLKDDLKEKQQSSNHHQSTQPKTSPSTETNTQQSF

SEQ ID NO: 1566337 - protein, 7 aa, Staphylococcus aureus
DKDDAVD

SEQ ID NO: 1566338 - protein, 17 aa, Staphylococcus aureus
DKIDKKALQSTAQTLEN

SEQ ID NO: 1566339 - protein, 4 aa, Staphylococcus aureus
DKVD

SEQ ID NO: 1566340 - protein, 7 aa, Staphylococcus aureus
DLDNSND

SEQ ID NO: 1566341 - protein, 4 aa, Staphylococcus aureus
DLSI

SEQ ID NO: 1566342 - protein, 8 aa, Staphylococcus aureus
DNNQREEV

SEQ ID NO: 1566343 - protein, 9 aa, Staphylococcus aureus
DQTTASKSF

SEQ ID NO: 1566344 - protein, 33 aa, Staphylococcus aureus
DRHSGIKNTTITTLPSGWTSNLTKSDNKNGSLA

SEQ ID NO: 1566345 - protein, 23 aa, Staphylococcus aureus
DTETKKSLKTAKHKYFNQNYKPS

SEQ ID NO: 1566346 - protein, 10 aa, Staphylococcus aureus
DTLNKADGKF

SEQ ID NO: 1566347 - protein, 43 aa, Staphylococcus aureus
EDLPSEKVADKKTTGTQVDTAQPSNVSEIKPRMKRSADVAEVA

SEQ ID NO: 1566348 - protein, 31 aa, Staphylococcus aureus
EEQKQHHKELKESHKELKDKQDKVVDENLEQ

SEQ ID NO: 1566349 - protein, 8 aa, Staphylococcus aureus
EGIKDDGV

SEQ ID NO: 1566350 - protein, 7 aa, Staphylococcus aureus
EGLGPSI

SEQ ID NO: 1566351 - protein, 16 aa, Staphylococcus aureus
EHERDRLSLNSKEEIE

SEQ ID NO: 1566352 - protein, 9 aa, Staphylococcus aureus
EIKNSTEDK

SEQ ID NO: 1566353 - protein, 27 aa, Staphylococcus aureus
EIPNAEQTVNYQNADDNAKTNFDDAKR

SEQ ID NO: 1566354 - protein, 26 aa, Staphylococcus aureus
EIPNAEQTVNYQNAEDNAKTNFDDAK

SEQ ID NO: 1566355 - protein, 9 aa, Staphylococcus aureus
ELANTGTAY

SEQ ID NO: 1566356 - protein, 9 aa, Staphylococcus aureus
ELSNTKLYP

SEQ ID NO: 1566357 - protein, 10 aa, Staphylococcus aureus
ENNEYRGGPA

SEQ ID NO: 1566358 - protein, 6 aa, Staphylococcus aureus
ENSSVA

SEQ ID NO: 1566359 - protein, 11 aa, Staphylococcus aureus
ESQIREEEAKL

SEQ ID NO: 1566360 - protein, 18 aa, Staphylococcus aureus
EVRGRKASKNKRPSQLSN

SEQ ID NO: 1566361 - protein, 8 aa, Staphylococcus aureus
EYATTRCQ

SEQ ID NO: 1566362 - protein, 5 aa, Staphylococcus aureus
FASDS

SEQ ID NO: 1566363 - protein, 16 aa, Staphylococcus aureus
FLSGAKDEISTKKPGM

SEQ ID NO: 1566364 - protein, 6 aa, Staphylococcus aureus
FSGQEA

SEQ ID NO: 1566365 - protein, 7 aa, Staphylococcus aureus
GDKTIEK

SEQ ID NO: 1566366 - protein, 7 aa, Staphylococcus aureus
GETSIDE

SEQ ID NO: 1566367 - protein, 4 aa, Staphylococcus aureus
GGTF

SEQ ID NO: 1566368 - protein, 11 aa, Staphylococcus aureus
GIQANAGTLDQ

SEQ ID NO: 1566369 - protein, 7 aa, Staphylococcus aureus
GNAGNAL

SEQ ID NO: 1566370 - protein, 12 aa, Staphylococcus aureus
GQSSTGKSTAAA

SEQ ID NO: 1566371 - protein, 8 aa, Staphylococcus aureus
GSDELAES

SEQ ID NO: 1566372 - protein, 7 aa, Staphylococcus aureus
GTNNGIT

SEQ ID NO: 1566373 - protein, 4 aa, Staphylococcus aureus
GYHD

SEQ ID NO: 1566374 - protein, 9 aa, Staphylococcus aureus
HHKPGEEFE

SEQ ID NO: 1566375 - protein, 17 aa, Staphylococcus aureus
HHSHQEHENHTSHGNHE

SEQ ID NO: 1566376 - protein, 5 aa, Staphylococcus aureus
HIDTA

SEQ ID NO: 1566377 - protein, 17 aa, Staphylococcus aureus
HKDAQDKYGFKTEISGQ

SEQ ID NO: 1566378 - protein, 10 aa, Staphylococcus aureus
HQDGTTSTVT

SEQ ID NO: 1566379 - protein, 7 aa, Staphylococcus aureus
HTIPSDI

SEQ ID NO: 1566380 - protein, 5 aa, Staphylococcus aureus
IADAE

SEQ ID NO: 1566381 - protein, 58 aa, Staphylococcus aureus
IDKATTDKQQVPPTKEAAHHSGKEAATNVSASAQGTADDTNSKVTSNAPSNKPSTVVS

SEQ ID NO: 1566382 - protein, 8 aa, Staphylococcus aureus
IDPDSQNA

SEQ ID NO: 1566383 - protein, 16 aa, Staphylococcus aureus
IEEDTNKDKPSYQFGG

SEQ ID NO: 1566384 - protein, 27 aa, Staphylococcus aureus
IHGQNNGNQSFEEDTEKDKPKYEQGGN

SEQ ID NO: 1566385 - protein, 8 aa, Staphylococcus aureus
IKDHPRQE

SEQ ID NO: 1566386 - protein, 12 aa, Staphylococcus aureus
INPEPSFKVDGK

SEQ ID NO: 1566387 - protein, 6 aa, Staphylococcus aureus
IPPSAS

SEQ ID NO: 1566388 - protein, 10 aa, Staphylococcus aureus
IQKKPTDLGV

SEQ ID NO: 1566389 - protein, 9 aa, Staphylococcus aureus
ISTSTQSEI

SEQ ID NO: 1566390 - protein, 14 aa, Staphylococcus aureus
ITGRGIQGNIDGTT

SEQ ID NO: 1566391 - protein, 197 aa, Staphylococcus aureus
ITSPSVNSEMNNNETGTPHESNQTGNEGTGSNSRDANPDSNNVKPDSNNQNPSTDSKPDPNNQNPSPNPKPDPDNPKPKPDPKPDPDKPKPNPDPKPDPDNPKPNPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDF

SEQ ID NO: 1566392 - protein, 6 aa, Staphylococcus aureus
KAEREP

SEQ ID NO: 1566393 - protein, 7 aa, Staphylococcus aureus
KDGETYT

SEQ ID NO: 1566394 - protein, 6 aa, Staphylococcus aureus
KDGIGN

SEQ ID NO: 1566395 - protein, 6 aa, Staphylococcus aureus
KDHKGI

SEQ ID NO: 1566396 - protein, 26 aa, Staphylococcus aureus
KDISTDKIDRIRNSTIGTAEERQAAM

SEQ ID NO: 1566397 - protein, 5 aa, Staphylococcus aureus
KEEVN

SEQ ID NO: 1566398 - protein, 7 aa, Staphylococcus aureus
KEQLNTP

SEQ ID NO: 1566399 - protein, 8 aa, Staphylococcus aureus
KEVNEQFK

SEQ ID NO: 1566400 - protein, 8 aa, Staphylococcus aureus
KGIKNTPN

SEQ ID NO: 1566401 - protein, 4 aa, Staphylococcus aureus
KGLS

SEQ ID NO: 1566402 - protein, 6 aa, Staphylococcus aureus
KGNNEV

SEQ ID NO: 1566403 - protein, 11 aa, Staphylococcus aureus
KGSNQNGNQPK

SEQ ID NO: 1566404 - protein, 12 aa, Staphylococcus aureus
KGYTTHVDNNDM

SEQ ID NO: 1566405 - protein, 9 aa, Staphylococcus aureus
KKEVPNETN

SEQ ID NO: 1566406 - protein, 5 aa, Staphylococcus aureus
KLKQG

SEQ ID NO: 1566407 - protein, 4 aa, Staphylococcus aureus
KLPT

SEQ ID NO: 1566408 - protein, 28 aa, Staphylococcus aureus
KNTHKITGEYDTTTNDKKNATDSTYKSY

SEQ ID NO: 1566409 - protein, 18 aa, Staphylococcus aureus
KNYNNGDVSINENVPSYD

SEQ ID NO: 1566410 - protein, 5 aa, Staphylococcus aureus
KPLHN

SEQ ID NO: 1566411 - protein, 11 aa, Staphylococcus aureus
KQKLTKDIAEA

SEQ ID NO: 1566412 - protein, 13 aa, Staphylococcus aureus
KQNQIEDLQEEQR

SEQ ID NO: 1566413 - protein, 11 aa, Staphylococcus aureus
KSHSENEKKRI

SEQ ID NO: 1566414 - protein, 9 aa, Staphylococcus aureus
KSREKDSAI

SEQ ID NO: 1566415 - protein, 9 aa, Staphylococcus aureus
KVALDGDEN

SEQ ID NO: 1566416 - protein, 11 aa, Staphylococcus aureus
KVDDKVKSGDY

SEQ ID NO: 1566417 - protein, 12 aa, Staphylococcus aureus
KYKSSKDYKNLD

SEQ ID NO: 1566418 - protein, 13 aa, Staphylococcus aureus
KYTEKSTDSYQQR

SEQ ID NO: 1566419 - protein, 11 aa, Staphylococcus aureus
KYTPGAEDDLA

SEQ ID NO: 1566420 - protein, 5 aa, Staphylococcus aureus
LAGVQ

SEQ ID NO: 1566421 - protein, 6 aa, Staphylococcus aureus
LAPKAF

SEQ ID NO: 1566422 - protein, 6 aa, Staphylococcus aureus
LDQSKN

SEQ ID NO: 1566423 - protein, 51 aa, Staphylococcus aureus
LNQAKNDLNGDNKVAQAKETAKRALASYSNLNNAQSTAATSQIDNATTVAD

SEQ ID NO: 1566424 - protein, 11 aa, Staphylococcus aureus
LPNGQGTRNVE

SEQ ID NO: 1566425 - protein, 6 aa, Staphylococcus aureus
LQNQGK

SEQ ID NO: 1566426 - protein, 10 aa, Staphylococcus aureus
LTAARNKVQQ

SEQ ID NO: 1566427 - protein, 28 aa, Staphylococcus aureus
LVTGESKKVHKTHNDDVIGGSINGSGTV

SEQ ID NO: 1566428 - protein, 19 aa, Staphylococcus aureus
NAKAPSRDVKGQNLTHGTN

SEQ ID NO: 1566429 - protein, 10 aa, Staphylococcus aureus
NAVKAGDTMT

SEQ ID NO: 1566430 - protein, 57 aa, Staphylococcus aureus
NDNSTNNQSSKTQLTQKDENKNEDKPEEKSETATDEDLQSTEEVPANENTENNQHEI

SEQ ID NO: 1566431 - protein, 7 aa, Staphylococcus aureus
NEHANVE

SEQ ID NO: 1566432 - protein, 6 aa, Staphylococcus aureus
NGEKAK

SEQ ID NO: 1566433 - protein, 30 aa, Staphylococcus aureus
NGINNESQVKSSEKYRDADTNKQQEYDNAI

SEQ ID NO: 1566434 - protein, 13 aa, Staphylococcus aureus
NKANGNGKNGPII

SEQ ID NO: 1566435 - protein, 4 aa, Staphylococcus aureus
NKII

SEQ ID NO: 1566436 - protein, 7 aa, Staphylococcus aureus
NKNYGTN

SEQ ID NO: 1566437 - protein, 11 aa, Staphylococcus aureus
NLKGSSVGDRK

SEQ ID NO: 1566438 - protein, 37 aa, Staphylococcus aureus
NNITGNEKAQAEAGGRPNYRTTGYSQSNATTDGQRQF

SEQ ID NO: 1566439 - protein, 10 aa, Staphylococcus aureus
NQPKNTYTKQ

SEQ ID NO: 1566440 - protein, 23 aa, Staphylococcus aureus
NQTTSPTMNPDEVNRATTQVNNT

SEQ ID NO: 1566441 - protein, 6 aa, Staphylococcus aureus
NTTPGI

SEQ ID NO: 1566442 - protein, 37 aa, Staphylococcus aureus
NVDDLAKQYDKVSQEQGENSAEAQKLRQEYNKQANEL

SEQ ID NO: 1566443 - protein, 15 aa, Staphylococcus aureus
NVQRQNLQSQINGAH

SEQ ID NO: 1566444 - protein, 4 aa, Staphylococcus aureus
PEDD

SEQ ID NO: 1566445 - protein, 5 aa, Staphylococcus aureus
PLGAT

SEQ ID NO: 1566446 - protein, 11 aa, Staphylococcus aureus
PNNGKTTSVTV

SEQ ID NO: 1566447 - protein, 28 aa, Staphylococcus aureus
PNNQSLSSVTVTGQVTSGYKQNANKPTV

SEQ ID NO: 1566448 - protein, 19 aa, Staphylococcus aureus
PQGATNVSKHQDAHGQDDA

SEQ ID NO: 1566449 - protein, 15 aa, Staphylococcus aureus
PTNANTNAFRPGGVQ

SEQ ID NO: 1566450 - protein, 8 aa, Staphylococcus aureus
PTTLQHKS

SEQ ID NO: 1566451 - protein, 14 aa, Staphylococcus aureus
QAAITGESVPVSKA

SEQ ID NO: 1566452 - protein, 5 aa, Staphylococcus aureus
QAQHS

SEQ ID NO: 1566453 - protein, 12 aa, Staphylococcus aureus
QAQNDKSKAELL

SEQ ID NO: 1566454 - protein, 5 aa, Staphylococcus aureus
QKFST

SEQ ID NO: 1566455 - protein, 5 aa, Staphylococcus aureus
QNGHE

SEQ ID NO: 1566456 - protein, 12 aa, Staphylococcus aureus
QNKPYNTKGVIV

SEQ ID NO: 1566457 - protein, 5 aa, Staphylococcus aureus
QQGHT

SEQ ID NO: 1566458 - protein, 4 aa, Staphylococcus aureus
QSEY

SEQ ID NO: 1566459 - protein, 4 aa, Staphylococcus aureus
QSFN

SEQ ID NO: 1566460 - protein, 8 aa, Staphylococcus aureus
QTANPTMS

SEQ ID NO: 1566461 - protein, 13 aa, Staphylococcus aureus
QVNSAKNNLDGTR

SEQ ID NO: 1566462 - protein, 13 aa, Staphylococcus aureus
RAGDYAYASGGKV

SEQ ID NO: 1566463 - protein, 10 aa, Staphylococcus aureus
RDTTGTNDAN

SEQ ID NO: 1566464 - protein, 8 aa, Staphylococcus aureus
RGMEEASQ

SEQ ID NO: 1566465 - protein, 4 aa, Staphylococcus aureus
RGVE

SEQ ID NO: 1566466 - protein, 5 aa, Staphylococcus aureus
RHRDP

SEQ ID NO: 1566467 - protein, 107 aa, Staphylococcus aureus
RKADEKTTNNTAVDKKSGKQSKKTTPSNKRNASKASTNKTSGQKKQHNKKSSQGAKKQSSSSKSTQKNNQTSNKNSKTTNAKSSNASKTPNAKVEKAKSKIEKRTFN

SEQ ID NO: 1566468 - protein, 24 aa, Staphylococcus aureus
RNDIDAQERKAKEAQFQKQQNEEI

SEQ ID NO: 1566469 - protein, 26 aa, Staphylococcus aureus
RNDSNTDRSTKPVATAPTSVAPKRVN

SEQ ID NO: 1566470 - protein, 70 aa, Staphylococcus aureus
RQAKYKQKSTEELGIEDDGYYAEPEVDPKELKAQQKREKAEIKAKKKEKRKAYNQRMKERRKNQPSAVSQ

SEQ ID NO: 1566471 - protein, 34 aa, Staphylococcus aureus
RQALTPDKAPLQNAKTQLEQSINQPTDTTGMTTA

SEQ ID NO: 1566472 - protein, 7 aa, Staphylococcus aureus
RQNGHEA

SEQ ID NO: 1566473 - protein, 7 aa, Staphylococcus aureus
RTASTSF

SEQ ID NO: 1566474 - protein, 4 aa, Staphylococcus aureus
SDEQ

SEQ ID NO: 1566475 - protein, 4 aa, Staphylococcus aureus
SELE

SEQ ID NO: 1566476 - protein, 27 aa, Staphylococcus aureus
SETALTAANKTKFKTEADKGDKKAKGI

SEQ ID NO: 1566477 - protein, 7 aa, Staphylococcus aureus
SGRNLGS

SEQ ID NO: 1566478 - protein, 6 aa, Staphylococcus aureus
SGSSTH

SEQ ID NO: 1566479 - protein, 30 aa, Staphylococcus aureus
SIQDNAATKANSKYINEDQSEQQNYDQAVQ

SEQ ID NO: 1566480 - protein, 11 aa, Staphylococcus aureus
SKDQQASSAAT

SEQ ID NO: 1566481 - protein, 11 aa, Staphylococcus aureus
SKKEHYIETQE

SEQ ID NO: 1566482 - protein, 5 aa, Staphylococcus aureus
SKPIP

SEQ ID NO: 1566483 - protein, 7 aa, Staphylococcus aureus
SKRENSH

SEQ ID NO: 1566484 - protein, 4 aa, Staphylococcus aureus
SLAY

SEQ ID NO: 1566485 - protein, 5 aa, Staphylococcus aureus
SLTKT

SEQ ID NO: 1566486 - protein, 181 aa, Staphylococcus aureus
SMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESNSSSVSMSQDKSDSTSISDSESVSTSTSTSLSTSDSTSTSESLSTSMSGSQSISDSTSTSMSGSTSTSESNSMHPSDS

SEQ ID NO: 1566487 - protein, 24 aa, Staphylococcus aureus
SNNAQGDGKDKPNDPIIDKSEPIE

SEQ ID NO: 1566488 - protein, 61 aa, Staphylococcus aureus
SQAHAAETNQPASVVKQKQQSNNEQTENRESQVQNSQNSQNSQSLSATHENEQPNNSQANL

SEQ ID NO: 1566489 - protein, 25 aa, Staphylococcus aureus
SQEITDNEGRTKGSTNYVNADTQVK

SEQ ID NO: 1566490 - protein, 11 aa, Staphylococcus aureus
SQTPALQKETE

SEQ ID NO: 1566491 - protein, 12 aa, Staphylococcus aureus
STIGSSKHHTEV

SEQ ID NO: 1566492 - protein, 12 aa, Staphylococcus aureus
TADKETSKNVKV

SEQ ID NO: 1566493 - protein, 8 aa, Staphylococcus aureus
TATGENGY

SEQ ID NO: 1566494 - protein, 10 aa, Staphylococcus aureus
TDEDQKEIVE

SEQ ID NO: 1566495 - protein, 9 aa, Staphylococcus aureus
TDPARKNDA

SEQ ID NO: 1566496 - protein, 66 aa, Staphylococcus aureus
TDPTSKGVSDSSIAQTYQAPRDSNKEEQQVTWKSSQDSSLTPELSTKAPKEYDTSQPFTDASNDVG

SEQ ID NO: 1566497 - protein, 6 aa, Staphylococcus aureus
TGSEGV

SEQ ID NO: 1566498 - protein, 8 aa, Staphylococcus aureus
TKNDRSAN

SEQ ID NO: 1566499 - protein, 8 aa, Staphylococcus aureus
TKQYPDEY

SEQ ID NO: 1566500 - protein, 4 aa, Staphylococcus aureus
TLEE

SEQ ID NO: 1566501 - protein, 5 aa, Staphylococcus aureus
TNDDY

SEQ ID NO: 1566502 - protein, 13 aa, Staphylococcus aureus
TNHQPNRKSNDEN

SEQ ID NO: 1566503 - protein, 9 aa, Staphylococcus aureus
TNLAQQGNS

SEQ ID NO: 1566504 - protein, 5 aa, Staphylococcus aureus
TRESM

SEQ ID NO: 1566505 - protein, 6 aa, Staphylococcus aureus
TRNALE

SEQ ID NO: 1566506 - protein, 26 aa, Staphylococcus aureus
TRNESVDSNDSASVTVTPQLQATTEG

SEQ ID NO: 1566507 - protein, 12 aa, Staphylococcus aureus
TSEIELKSDARG

SEQ ID NO: 1566508 - protein, 34 aa, Staphylococcus aureus
TSNAPNRNYATASANEITSKTVSNVSRTGNNANV

SEQ ID NO: 1566509 - protein, 25 aa, Staphylococcus aureus
TTQVSTANENTQNITDKDVKSMEAA

SEQ ID NO: 1566510 - protein, 13 aa, Staphylococcus aureus
TTVTKQGKQKVEV

SEQ ID NO: 1566511 - protein, 34 aa, Staphylococcus aureus
VADKDQVKRTEDYADADTAKQNAYNSAVSSAETI

SEQ ID NO: 1566512 - protein, 30 aa, Staphylococcus aureus
VADNQTTLASEDYHDATAQRQNDYNQAVTA

SEQ ID NO: 1566513 - protein, 4 aa, Staphylococcus aureus
VANH

SEQ ID NO: 1566514 - protein, 61 aa, Staphylococcus aureus
VAQSSTTNDEQPASQNVNTKKDSATAATTQPDKEESKHKQNESQSANKNGNDNRAAHVENH

SEQ ID NO: 1566515 - protein, 10 aa, Staphylococcus aureus
VEEEYDSSTL

SEQ ID NO: 1566516 - protein, 18 aa, Staphylococcus aureus
VEGAEGHAEGIVETEEDS

SEQ ID NO: 1566517 - protein, 13 aa, Staphylococcus aureus
VGISGNTGFSTGP

SEQ ID NO: 1566518 - protein, 7 aa, Staphylococcus aureus
VNGFDDP

SEQ ID NO: 1566519 - protein, 14 aa, Staphylococcus aureus
VSPEKYQQLKTQNN

SEQ ID NO: 1566520 - protein, 10 aa, Staphylococcus aureus
YINNEDLSRN

SEQ ID NO: 1566521 - protein, 8 aa, Staphylococcus aureus
YLNGTDEV

SEQ ID NO: 1566522 - protein, 13 aa, Staphylococcus aureus
YNIPKNASTKVEL

SEQ ID NO: 1566523 - protein, 9 aa, Staphylococcus aureus
YNIPTDKSP

SEQ ID NO: 1566524 - protein, 13 aa, Staphylococcus aureus
YPDNTSTDNGKID

SEQ ID NO: 1566525 - protein, 4 aa, Staphylococcus aureus
YPLQ

SEQ ID NO: 1566526 - protein, 8 aa, Staphylococcus aureus
YQTFKDKS

SEQ ID NO: 1566527 - protein, 9 aa, Staphylococcus aureus
YSSSKSDDM

SEQ ID NO: 1566528 - protein, 33 aa, Staphylococcus aureus
AAASEQKTTTVEENGNSATDNKTSETQTTATNV

SEQ ID NO: 1566529 - protein, 92 aa, Staphylococcus aureus
AAASEQNNTTVEESGSSATESKASETQTTTNNVNTIDETQSYSATSTEQPSQSTQVTTEEAPKTVQAPKVETSRVDLPSEKVADKETTGTQV

SEQ ID NO: 1566530 - protein, 8 aa, Staphylococcus aureus
AANIKENN

SEQ ID NO: 1566531 - protein, 17 aa, Staphylococcus aureus
AANNDAQIHKQKSLSPG

SEQ ID NO: 1566532 - protein, 6 aa, Staphylococcus aureus
AATDLG

SEQ ID NO: 1566533 - protein, 9 aa, Staphylococcus aureus
ADKNNKIVP

SEQ ID NO: 1566534 - protein, 31 aa, Staphylococcus aureus
ADSQQVNAATEATNATNNQSTQVSQATSQPI

SEQ ID NO: 1566535 - protein, 13 aa, Staphylococcus aureus
AEIEKTPDIASAT

SEQ ID NO: 1566536 - protein, 6 aa, Staphylococcus aureus
AERDAH

SEQ ID NO: 1566537 - protein, 5 aa, Staphylococcus aureus
AFDRE

SEQ ID NO: 1566538 - protein, 10 aa, Staphylococcus aureus
AGSSPTASLS

SEQ ID NO: 1566539 - protein, 8 aa, Staphylococcus aureus
AIREDARR

SEQ ID NO: 1566540 - protein, 5 aa, Staphylococcus aureus
AISQA

SEQ ID NO: 1566541 - protein, 7 aa, Staphylococcus aureus
AKDSGHF

SEQ ID NO: 1566542 - protein, 12 aa, Staphylococcus aureus
AKSNKPGELDDE

SEQ ID NO: 1566543 - protein, 25 aa, Staphylococcus aureus
ANELDSKDNKGSQIEMNGQSDIDSK

SEQ ID NO: 1566544 - protein, 6 aa, Staphylococcus aureus
ANGELF

SEQ ID NO: 1566545 - protein, 5 aa, Staphylococcus aureus
ANKSH

SEQ ID NO: 1566546 - protein, 12 aa, Staphylococcus aureus
APAKELGPVEES

SEQ ID NO: 1566547 - protein, 83 aa, Staphylococcus aureus
AQQAAIKEEASANNLSDISQEAQEVQEAKKEAQAEKDSDTLTKDASAAKVEVSKPESQAERLANAAKQKQAKLTPGSKESQLT

SEQ ID NO: 1566548 - protein, 173 aa, Staphylococcus aureus
ASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDLSSTSLSDSTSASMQSSESDSQSTSASLSDSLSTSTSNRMST

SEQ ID NO: 1566549 - protein, 6 aa, Staphylococcus aureus
ATRNAL

SEQ ID NO: 1566550 - protein, 27 aa, Staphylococcus aureus
AVAPTKQKQAKKSELPETGGEESTNKG

SEQ ID NO: 1566551 - protein, 15 aa, Staphylococcus aureus
AVEIGKADTTSNKFG

SEQ ID NO: 1566552 - protein, 27 aa, Staphylococcus aureus
AVTRAKAALNGADNLRNAKTSATNTIN

SEQ ID NO: 1566553 - protein, 18 aa, Staphylococcus aureus
DAQKANLTSQIERGTTVA

SEQ ID NO: 1566554 - protein, 32 aa, Staphylococcus aureus
DAQKQSITGQIDSATQVTGVQSVKDNATNLDN

SEQ ID NO: 1566555 - protein, 24 aa, Staphylococcus aureus
DDNPDNDINTPSLSKIDDDRKLDE

SEQ ID NO: 1566556 - protein, 9 aa, Staphylococcus aureus
DDYSSKNNL

SEQ ID NO: 1566557 - protein, 21 aa, Staphylococcus aureus
DETVDKAKQALDKSTGQNLTA

SEQ ID NO: 1566558 - protein, 106 aa, Staphylococcus aureus
DFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGK

SEQ ID NO: 1566559 - protein, 127 aa, Staphylococcus aureus
DFEEDTLPKVSGQNEGQQTIEEDTTPPTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGK

SEQ ID NO: 1566560 - protein, 26 aa, Staphylococcus aureus
DGDTVGKTSNNPLMPPVDTGESIGLG

SEQ ID NO: 1566561 - protein, 5 aa, Staphylococcus aureus
DHDDV

SEQ ID NO: 1566562 - protein, 4 aa, Staphylococcus aureus
DIIP

SEQ ID NO: 1566563 - protein, 24 aa, Staphylococcus aureus
DISTDKIDRIRNSTIGTAEERQAA

SEQ ID NO: 1566564 - protein, 8 aa, Staphylococcus aureus
DKFPDRKK

SEQ ID NO: 1566565 - protein, 15 aa, Staphylococcus aureus
DKTAGTNDNKAAVEQ

SEQ ID NO: 1566566 - protein, 8 aa, Staphylococcus aureus
DMSDNTHL

SEQ ID NO: 1566567 - protein, 28 aa, Staphylococcus aureus
DNLKHQVEQAQNVAGVNGVKDKGNTLNT

SEQ ID NO: 1566568 - protein, 12 aa, Staphylococcus aureus
DPENVKKTGNVT

SEQ ID NO: 1566569 - protein, 10 aa, Staphylococcus aureus
DQTTSPTLDP

SEQ ID NO: 1566570 - protein, 5 aa, Staphylococcus aureus
DRLGY

SEQ ID NO: 1566571 - protein, 18 aa, Staphylococcus aureus
DRNQVKQSDDKKHASRYQ

SEQ ID NO: 1566572 - protein, 177 aa, Staphylococcus aureus
DSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASEST

SEQ ID NO: 1566573 - protein, 7 aa, Staphylococcus aureus
DTNGGYS

SEQ ID NO: 1566574 - protein, 8 aa, Staphylococcus aureus
EDPKLKKR

SEQ ID NO: 1566575 - protein, 10 aa, Staphylococcus aureus
EEVPNNSEKA

SEQ ID NO: 1566576 - protein, 22 aa, Staphylococcus aureus
EGQGRQRSNVHGEVKTPKNWGT

SEQ ID NO: 1566577 - protein, 54 aa, Staphylococcus aureus
EKESVQSTTGNKVEVSTAKSDEQASPKSTNEDLNTKQTISNQEALQPDLQENKS

SEQ ID NO: 1566578 - protein, 6 aa, Staphylococcus aureus
EKQNEW

SEQ ID NO: 1566579 - protein, 9 aa, Staphylococcus aureus
ELKGWSQEE

SEQ ID NO: 1566580 - protein, 19 aa, Staphylococcus aureus
ESTNKDDVGPLKKKINGTV

SEQ ID NO: 1566581 - protein, 4 aa, Staphylococcus aureus
ETEF

SEQ ID NO: 1566582 - protein, 28 aa, Staphylococcus aureus
ETPSGYTPTSVTTGNDTEKDSNGLTTTG

SEQ ID NO: 1566583 - protein, 25 aa, Staphylococcus aureus
EVRGRKASKNKRPSQLSSVNGFDDP

SEQ ID NO: 1566584 - protein, 11 aa, Staphylococcus aureus
EVTGKSYAENY

SEQ ID NO: 1566585 - protein, 12 aa, Staphylococcus aureus
EVYNSKDPKYKK

SEQ ID NO: 1566586 - protein, 16 aa, Staphylococcus aureus
EYKEDTIKETLTGQYD

SEQ ID NO: 1566587 - protein, 14 aa, Staphylococcus aureus
EYKRNNSDGNVKKL

SEQ ID NO: 1566588 - protein, 10 aa, Staphylococcus aureus
FDSENPNKTV

SEQ ID NO: 1566589 - protein, 6 aa, Staphylococcus aureus
FNPNAK

SEQ ID NO: 1566590 - protein, 7 aa, Staphylococcus aureus
FSSNPEA

SEQ ID NO: 1566591 - protein, 12 aa, Staphylococcus aureus
GASNRAKGVKWS

SEQ ID NO: 1566592 - protein, 54 aa, Staphylococcus aureus
GEAKAAEETGVTNTEAQPKTEAVASPTTTTTEKAPEAKPVAKPVANAVSVSNKE

SEQ ID NO: 1566593 - protein, 8 aa, Staphylococcus aureus
GGKDNLEA

SEQ ID NO: 1566594 - protein, 5 aa, Staphylococcus aureus
GGRRT

SEQ ID NO: 1566595 - protein, 8 aa, Staphylococcus aureus
GHSNDKQI

SEQ ID NO: 1566596 - protein, 11 aa, Staphylococcus aureus
GIQANAGTLNE

SEQ ID NO: 1566597 - protein, 35 aa, Staphylococcus aureus
GLNNPQRQALESQINNAATRGEVAQKLAEAKALDQ

SEQ ID NO: 1566598 - protein, 8 aa, Staphylococcus aureus
GSDDLAES

SEQ ID NO: 1566599 - protein, 6 aa, Staphylococcus aureus
GSIETF

SEQ ID NO: 1566600 - protein, 7 aa, Staphylococcus aureus
GSLNPSR

SEQ ID NO: 1566601 - protein, 5 aa, Staphylococcus aureus
GYHDD

SEQ ID NO: 1566602 - protein, 35 aa, Staphylococcus aureus
HDLNQKQKDALKTQVNNAQRVSDANNVQHTATELN

SEQ ID NO: 1566603 - protein, 11 aa, Staphylococcus aureus
HPFRNKGGHAE

SEQ ID NO: 1566604 - protein, 10 aa, Staphylococcus aureus
HSMKENNRPI

SEQ ID NO: 1566605 - protein, 24 aa, Staphylococcus aureus
IANKDQTKASENYIDADPTNKTAF

SEQ ID NO: 1566606 - protein, 23 aa, Staphylococcus aureus
IAQPSNVSEIKPRMKRSTDVTAV

SEQ ID NO: 1566607 - protein, 8 aa, Staphylococcus aureus
IDGGGGYV

SEQ ID NO: 1566608 - protein, 11 aa, Staphylococcus aureus
IDGNNSPLKRA

SEQ ID NO: 1566609 - protein, 11 aa, Staphylococcus aureus
IGESKDVIEEQ

SEQ ID NO: 1566610 - protein, 10 aa, Staphylococcus aureus
IGRGENELVD

SEQ ID NO: 1566611 - protein, 29 aa, Staphylococcus aureus
IKGVSSKEKDNKYNDKYEFGKKTEYDESK

SEQ ID NO: 1566612 - protein, 30 aa, Staphylococcus aureus
IKNNTINKAYEHKDPTNNSEQRDGKVFALI

SEQ ID NO: 1566613 - protein, 4 aa, Staphylococcus aureus
INDP

SEQ ID NO: 1566614 - protein, 47 aa, Staphylococcus aureus
INQTSNPTMEPNTITQATSQVTTKEQALNGAQNLAQAKTTAKNNLNN

SEQ ID NO: 1566615 - protein, 7 aa, Staphylococcus aureus
IQGSVNA

SEQ ID NO: 1566616 - protein, 6 aa, Staphylococcus aureus
ITGRGI

SEQ ID NO: 1566617 - protein, 43 aa, Staphylococcus aureus
KALDKVKDNKTTVKFERDGKTKSVELTPKKTEKKLTKVSSETK

SEQ ID NO: 1566618 - protein, 9 aa, Staphylococcus aureus
KAVEAGKAI

SEQ ID NO: 1566619 - protein, 9 aa, Staphylococcus aureus
KDDKLKQKI

SEQ ID NO: 1566620 - protein, 9 aa, Staphylococcus aureus
KENTVTEPE

SEQ ID NO: 1566621 - protein, 9 aa, Staphylococcus aureus
KGETPSDIP

SEQ ID NO: 1566622 - protein, 5 aa, Staphylococcus aureus
KGKDV

SEQ ID NO: 1566623 - protein, 9 aa, Staphylococcus aureus
KGVSEDMKM

SEQ ID NO: 1566624 - protein, 6 aa, Staphylococcus aureus
KGYAYQ

SEQ ID NO: 1566625 - protein, 73 aa, Staphylococcus aureus
KKAPNNTNNDVTTKPSTSEIQTTPTTPQESTNIENSQPQPTPSKVDNQVTDATNPKEPVNVSKEELKNNPEKL

SEQ ID NO: 1566626 - protein, 8 aa, Staphylococcus aureus
KKIPGVQD

SEQ ID NO: 1566627 - protein, 7 aa, Staphylococcus aureus
KKPLQND

SEQ ID NO: 1566628 - protein, 15 aa, Staphylococcus aureus
KKQEDNKKSASTAYS

SEQ ID NO: 1566629 - protein, 28 aa, Staphylococcus aureus
KNTHKITGEYDTTTNDRKNATDSTYKSY

SEQ ID NO: 1566630 - protein, 4 aa, Staphylococcus aureus
KPNT

SEQ ID NO: 1566631 - protein, 9 aa, Staphylococcus aureus
KRGIDPKKY

SEQ ID NO: 1566632 - protein, 61 aa, Staphylococcus aureus
KSKNEQAALKAQQAAIKEEASANNLSDTSQEAQEIQEAKREAQAEADKSVAVSNKESKAVA

SEQ ID NO: 1566633 - protein, 6 aa, Staphylococcus aureus
KSPSAK

SEQ ID NO: 1566634 - protein, 23 aa, Staphylococcus aureus
KSSDTSEKPKEDSKEAQIKKSFE

SEQ ID NO: 1566635 - protein, 13 aa, Staphylococcus aureus
KSVGPSLAPTNAK

SEQ ID NO: 1566636 - protein, 25 aa, Staphylococcus aureus
KTVQTNGNQTITSTLNEEQTSKELD

SEQ ID NO: 1566637 - protein, 66 aa, Staphylococcus aureus
KYTPEKPNKPIYPEKPKDKTPPTKPDHSNKVKPTPPDKPSKVDKDDQPKDNKTKPENPLKELPKTG

SEQ ID NO: 1566638 - protein, 11 aa, Staphylococcus aureus
LDDTSKFEDVT

SEQ ID NO: 1566639 - protein, 18 aa, Staphylococcus aureus
LDKKSTPLQLKSDEKGGF

SEQ ID NO: 1566640 - protein, 42 aa, Staphylococcus aureus
LGDPIPHNHNDSEKMDYKSYAADKAKANKEAHKAKQKNGKLN

SEQ ID NO: 1566641 - protein, 4 aa, Staphylococcus aureus
LGEG

SEQ ID NO: 1566642 - protein, 6 aa, Staphylococcus aureus
LGETTV

SEQ ID NO: 1566643 - protein, 26 aa, Staphylococcus aureus
LKHQVEQAQNVAGVNGVKDKGNTLNT

SEQ ID NO: 1566644 - protein, 10 aa, Staphylococcus aureus
LKVQPTNNTF

SEQ ID NO: 1566645 - protein, 50 aa, Staphylococcus aureus
LNKGKDDAGCTVSGGNVSANGIDKFNENAKGGKLEGKGKEIQKIAEKNKV

SEQ ID NO: 1566646 - protein, 31 aa, Staphylococcus aureus
LNQEDNTKNDNQKEMVSSQGNETTSNGNKLI

SEQ ID NO: 1566647 - protein, 11 aa, Staphylococcus aureus
LNYGNKNLGSY

SEQ ID NO: 1566648 - protein, 8 aa, Staphylococcus aureus
LQNNGSYS

SEQ ID NO: 1566649 - protein, 32 aa, Staphylococcus aureus
LTPAQQQALENQINNATTRGEVAQKLTEAQAL

SEQ ID NO: 1566650 - protein, 105 aa, Staphylococcus aureus
LVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDA

SEQ ID NO: 1566651 - protein, 9 aa, Staphylococcus aureus
MSKGYGYQD

SEQ ID NO: 1566652 - protein, 7 aa, Staphylococcus aureus
MSNKDEI

SEQ ID NO: 1566653 - protein, 16 aa, Staphylococcus aureus
NADTDKQTAYTTAVNE

SEQ ID NO: 1566654 - protein, 16 aa, Staphylococcus aureus
NAQANFSKVKSDVAKA

SEQ ID NO: 1566655 - protein, 20 aa, Staphylococcus aureus
NATQVTGVQSVKDNATNLDN

SEQ ID NO: 1566656 - protein, 57 aa, Staphylococcus aureus
NDNSTSNQSSKTQLTQKDENKNEDKPEEKSETATDEDLQSTEEVPANENTENNQHEI

SEQ ID NO: 1566657 - protein, 8 aa, Staphylococcus aureus
NDRSSNGK

SEQ ID NO: 1566658 - protein, 8 aa, Staphylococcus aureus
NESKNNEL

SEQ ID NO: 1566659 - protein, 4 aa, Staphylococcus aureus
NGDH

SEQ ID NO: 1566660 - protein, 8 aa, Staphylococcus aureus
NGEGIDSG

SEQ ID NO: 1566661 - protein, 11 aa, Staphylococcus aureus
NINKKGKHNDK

SEQ ID NO: 1566662 - protein, 4 aa, Staphylococcus aureus
NKEL

SEQ ID NO: 1566663 - protein, 28 aa, Staphylococcus aureus
NKNDRMNDNNDADAQKYTTTMKNANNAV

SEQ ID NO: 1566664 - protein, 15 aa, Staphylococcus aureus
NKSTGTNVSKDQVEA

SEQ ID NO: 1566665 - protein, 8 aa, Staphylococcus aureus
NLSAHDSG

SEQ ID NO: 1566666 - protein, 33 aa, Staphylococcus aureus
NNAQKQDLNTQVTNAPNISTVSQVKTKAEQLDQ

SEQ ID NO: 1566667 - protein, 7 aa, Staphylococcus aureus
NNEDIAK

SEQ ID NO: 1566668 - protein, 103 aa, Staphylococcus aureus
NQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTS

SEQ ID NO: 1566669 - protein, 7 aa, Staphylococcus aureus
NQNYSYE

SEQ ID NO: 1566670 - protein, 13 aa, Staphylococcus aureus
NQVSTTASELNTA

SEQ ID NO: 1566671 - protein, 34 aa, Staphylococcus aureus
NSIANKDEVKASQPYVDADRDKQNAYNTAVTSAE

SEQ ID NO: 1566672 - protein, 12 aa, Staphylococcus aureus
NTKDGGKYTLES

SEQ ID NO: 1566673 - protein, 7 aa, Staphylococcus aureus
NTTLRNT

SEQ ID NO: 1566674 - protein, 9 aa, Staphylococcus aureus
NVGDGMKNA

SEQ ID NO: 1566675 - protein, 182 aa, Staphylococcus aureus
NVTSPSVNSEMNNNETGTPHESNQAGNEGTGSNSRDANPDSNNVKPDSNNQNPSPDSKPDPNNPNPGPNPKPDPDKPKPNPEPKPDPDKPKPNPDPKPDPDKPKPNPDPKPDPNPNPNPKPDPNKPNPNPSPNPNQPGDSNQSGGSKNGGTWNPNASDGSNQGQWQPNGNQGNSQNPTGNDF

SEQ ID NO: 1566676 - protein, 5 aa, Staphylococcus aureus
PGTVD

SEQ ID NO: 1566677 - protein, 4 aa, Staphylococcus aureus
PNTK

SEQ ID NO: 1566678 - protein, 4 aa, Staphylococcus aureus
QAGS

SEQ ID NO: 1566679 - protein, 9 aa, Staphylococcus aureus
QEKKDLTAE

SEQ ID NO: 1566680 - protein, 7 aa, Staphylococcus aureus
QGLGPKV

SEQ ID NO: 1566681 - protein, 5 aa, Staphylococcus aureus
QHQSI

SEQ ID NO: 1566682 - protein, 35 aa, Staphylococcus aureus
QNGINDEAATKAAQKYTDADSDKQTAYNDAVTAAK

SEQ ID NO: 1566683 - protein, 9 aa, Staphylococcus aureus
QQSHSLTKT

SEQ ID NO: 1566684 - protein, 11 aa, Staphylococcus aureus
QSDIEQREGFE

SEQ ID NO: 1566685 - protein, 7 aa, Staphylococcus aureus
QSIDEIS

SEQ ID NO: 1566686 - protein, 7 aa, Staphylococcus aureus
QSISEIT

SEQ ID NO: 1566687 - protein, 4 aa, Staphylococcus aureus
QSLN

SEQ ID NO: 1566688 - protein, 9 aa, Staphylococcus aureus
QSLTDYSEK

SEQ ID NO: 1566689 - protein, 7 aa, Staphylococcus aureus
QTNGNQY

SEQ ID NO: 1566690 - protein, 4 aa, Staphylococcus aureus
QTSQ

SEQ ID NO: 1566691 - protein, 4 aa, Staphylococcus aureus
QTVE

SEQ ID NO: 1566692 - protein, 6 aa, Staphylococcus aureus
RKDAVN

SEQ ID NO: 1566693 - protein, 16 aa, Staphylococcus aureus
RKKDELYKKSGKNPII

SEQ ID NO: 1566694 - protein, 17 aa, Staphylococcus aureus
RKYNNGDVSINENVPSY

SEQ ID NO: 1566695 - protein, 12 aa, Staphylococcus aureus
RNKGKGEPSKLK

SEQ ID NO: 1566696 - protein, 4 aa, Staphylococcus aureus
RRGS

SEQ ID NO: 1566697 - protein, 6 aa, Staphylococcus aureus
SANLGG

SEQ ID NO: 1566698 - protein, 24 aa, Staphylococcus aureus
SDAIKSNDETLVDNNSNSNNENNA

SEQ ID NO: 1566699 - protein, 9 aa, Staphylococcus aureus
SDAQKQSIT

SEQ ID NO: 1566700 - protein, 13 aa, Staphylococcus aureus
SESTTYGDARNKL

SEQ ID NO: 1566701 - protein, 6 aa, Staphylococcus aureus
SFKTKK

SEQ ID NO: 1566702 - protein, 7 aa, Staphylococcus aureus
SFKTKKT

SEQ ID NO: 1566703 - protein, 6 aa, Staphylococcus aureus
SGGSGF

SEQ ID NO: 1566704 - protein, 14 aa, Staphylococcus aureus
SGHGGGSGLGKGLA

SEQ ID NO: 1566705 - protein, 14 aa, Staphylococcus aureus
SHQRAYDAQRDGRF

SEQ ID NO: 1566706 - protein, 34 aa, Staphylococcus aureus
SINNAQKDALTRSIDGATTVAGVNQETAKATELN

SEQ ID NO: 1566707 - protein, 204 aa, Staphylococcus aureus
SISDSQSMSESVNDSESVSESNSESDSKSMSGSTSVSDSGSLSVSTSLRKSESVSESSSLSCSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFD

SEQ ID NO: 1566708 - protein, 6 aa, Staphylococcus aureus
SKGASL

SEQ ID NO: 1566709 - protein, 36 aa, Staphylococcus aureus
SKPANKYGESPKYPSTIKNQPVTSETPKTPEETDNQ

SEQ ID NO: 1566710 - protein, 8 aa, Staphylococcus aureus
SKQNTSYI

SEQ ID NO: 1566711 - protein, 8 aa, Staphylococcus aureus
SKRENSKL

SEQ ID NO: 1566712 - protein, 14 aa, Staphylococcus aureus
SLARDSSGKLKTRG

SEQ ID NO: 1566713 - protein, 9 aa, Staphylococcus aureus
SLPEKKNEI

SEQ ID NO: 1566714 - protein, 15 aa, Staphylococcus aureus
SNNAQGDGKDKLKEP

SEQ ID NO: 1566715 - protein, 15 aa, Staphylococcus aureus
SQDNQSISKKITGYG

SEQ ID NO: 1566716 - protein, 10 aa, Staphylococcus aureus
SRKTPDLHKK

SEQ ID NO: 1566717 - protein, 149 aa, Staphylococcus aureus
STSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISIS

SEQ ID NO: 1566718 - protein, 7 aa, Staphylococcus aureus
SVAEKMG

SEQ ID NO: 1566719 - protein, 5 aa, Staphylococcus aureus
TADAI

SEQ ID NO: 1566720 - protein, 20 aa, Staphylococcus aureus
TAQRNDLTNQISQATNLAGV

SEQ ID NO: 1566721 - protein, 8 aa, Staphylococcus aureus
TDPDADRL

SEQ ID NO: 1566722 - protein, 16 aa, Staphylococcus aureus
TDRPDLAQQFKQTIPN

SEQ ID NO: 1566723 - protein, 9 aa, Staphylococcus aureus
TGQVKSGDY

SEQ ID NO: 1566724 - protein, 9 aa, Staphylococcus aureus
TKTNSIEPI

SEQ ID NO: 1566725 - protein, 8 aa, Staphylococcus aureus
TNAQKEAL

SEQ ID NO: 1566726 - protein, 18 aa, Staphylococcus aureus
TSDRAKQSSSTGNESNSH

SEQ ID NO: 1566727 - protein, 4 aa, Staphylococcus aureus
TSEI

SEQ ID NO: 1566728 - protein, 36 aa, Staphylococcus aureus
TSIQNDNTTKTSQNYLDASDINKNNYNTAVNNANGV

SEQ ID NO: 1566729 - protein, 6 aa, Staphylococcus aureus
TSLKNH

SEQ ID NO: 1566730 - protein, 16 aa, Staphylococcus aureus
TTKDDGIVQPSITKDI

SEQ ID NO: 1566731 - protein, 12 aa, Staphylococcus aureus
TTVTQKGNQNVE

SEQ ID NO: 1566732 - protein, 8 aa, Staphylococcus aureus
TYKTTPEL

SEQ ID NO: 1566733 - protein, 33 aa, Staphylococcus aureus
VADKDQVKRTEDYADADTAKQNAYNSAVSSAET

SEQ ID NO: 1566734 - protein, 40 aa, Staphylococcus aureus
VAQPRTASESKPRVTRSADVAEAKEASNAKVETGTDVTSK

SEQ ID NO: 1566735 - protein, 9 aa, Staphylococcus aureus
VDKANRQIE

SEQ ID NO: 1566736 - protein, 18 aa, Staphylococcus aureus
VEGAEGHAEGTIETEEDS

SEQ ID NO: 1566737 - protein, 15 aa, Staphylococcus aureus
VENPTTMEDDKDETV

SEQ ID NO: 1566738 - protein, 6 aa, Staphylococcus aureus
VGSKKV

SEQ ID NO: 1566739 - protein, 12 aa, Staphylococcus aureus
VNTAKDALNGDA

SEQ ID NO: 1566740 - protein, 25 aa, Staphylococcus aureus
VNTAKTALNGDARLNQAKNTAKQQL

SEQ ID NO: 1566741 - protein, 16 aa, Staphylococcus aureus
VVAPTTETKEAKEVKA

SEQ ID NO: 1566742 - protein, 4 aa, Staphylococcus aureus
WSQE

SEQ ID NO: 1566743 - protein, 20 aa, Staphylococcus aureus
YANTTDTSKFKEVTSNMSGN

SEQ ID NO: 1566744 - protein, 7 aa, Staphylococcus aureus
YASGKTI

SEQ ID NO: 1566745 - protein, 17 aa, Staphylococcus aureus
YDKEGSRDGEFKKGDKG

SEQ ID NO: 1566746 - protein, 19 aa, Staphylococcus aureus
YDKEGYRDGEFKKGDKGTW

SEQ ID NO: 1566747 - protein, 9 aa, Staphylococcus aureus
YNISTEKSP

SEQ ID NO: 1566748 - protein, 12 aa, Staphylococcus aureus
YNKNTKETMPFN

SEQ ID NO: 1566749 - protein, 6 aa, Staphylococcus aureus
YPGISA

SEQ ID NO: 1566750 - protein, 10 aa, Staphylococcus aureus
YQDGTTSTVT

SEQ ID NO: 1566751 - protein, 7 aa, Staphylococcus aureus
YSYNSTG

SEQ ID NO: 1566752 - protein, 14 aa, Staphylococcus aureus
AADAPAAGTDITNQ

SEQ ID NO: 1566753 - protein, 8 aa, Staphylococcus aureus
AATKQNSW

SEQ ID NO: 1566754 - protein, 7 aa, Staphylococcus aureus
ADDVLSG

SEQ ID NO: 1566755 - protein, 14 aa, Staphylococcus aureus
ADGNVSLPKAGETI

SEQ ID NO: 1566756 - protein, 15 aa, Staphylococcus aureus
AGKRALDQYQSTMDG

SEQ ID NO: 1566757 - protein, 8 aa, Staphylococcus aureus
AGTDVAIE

SEQ ID NO: 1566758 - protein, 7 aa, Staphylococcus aureus
AIGASGV

SEQ ID NO: 1566759 - protein, 4 aa, Staphylococcus aureus
AKAG

SEQ ID NO: 1566760 - protein, 6 aa, Staphylococcus aureus
ALTTNQ

SEQ ID NO: 1566761 - protein, 79 aa, Staphylococcus aureus
ANETTVKASQNYTDASPNNQSTYNSAVSNAKGIINQTNNPTMDTSAITQATTQVNNAKNGLNGAENLRNAQNTAKQNLN

SEQ ID NO: 1566762 - protein, 8 aa, Staphylococcus aureus
ANLKKQSK

SEQ ID NO: 1566763 - protein, 4 aa, Staphylococcus aureus
APDR

SEQ ID NO: 1566764 - protein, 50 aa, Staphylococcus aureus
AQQAAIKEEASANNLSDTSQEAQEIQEAKKEAQAETDKSAAVSNEEPKAV

SEQ ID NO: 1566765 - protein, 7 aa, Staphylococcus aureus
AQQQALT

SEQ ID NO: 1566766 - protein, 4 aa, Staphylococcus aureus
AQRS

SEQ ID NO: 1566767 - protein, 19 aa, Staphylococcus aureus
ASAATTTAVTANTITVNKD

SEQ ID NO: 1566768 - protein, 34 aa, Staphylococcus aureus
ASDEDYQKLTKSIDSSTGASKRMADTMESGLGGK

SEQ ID NO: 1566769 - protein, 11 aa, Staphylococcus aureus
ASQKKVVGEPL

SEQ ID NO: 1566770 - protein, 4 aa, Staphylococcus aureus
ASSL

SEQ ID NO: 1566771 - protein, 16 aa, Staphylococcus aureus
ATPSTDTAIANAPLEK

SEQ ID NO: 1566772 - protein, 24 aa, Staphylococcus aureus
AVTAAKQALNGEERLNNRKSEALQ

SEQ ID NO: 1566773 - protein, 19 aa, Staphylococcus aureus
CGKGNETKEDSKEEQIKKS

SEQ ID NO: 1566774 - protein, 19 aa, Staphylococcus aureus
DADEQKRNAYNQAVSNAET

SEQ ID NO: 1566775 - protein, 11 aa, Staphylococcus aureus
DALSSVAYGPE

SEQ ID NO: 1566776 - protein, 8 aa, Staphylococcus aureus
DEDKQTIE

SEQ ID NO: 1566777 - protein, 11 aa, Staphylococcus aureus
DFSKKGQDEID

SEQ ID NO: 1566778 - protein, 16 aa, Staphylococcus aureus
DIIGEKANSFDTTIED

SEQ ID NO: 1566779 - protein, 6 aa, Staphylococcus aureus
DKNGVI

SEQ ID NO: 1566780 - protein, 15 aa, Staphylococcus aureus
DKTAGSNDNKAAVEQ

SEQ ID NO: 1566781 - protein, 8 aa, Staphylococcus aureus
DKTTTLAS

SEQ ID NO: 1566782 - protein, 20 aa, Staphylococcus aureus
DKVTEANQAKDQLNTARQGL

SEQ ID NO: 1566783 - protein, 14 aa, Staphylococcus aureus
DKYPAQQAGIQKGD

SEQ ID NO: 1566784 - protein, 39 aa, Staphylococcus aureus
DLKINSEEVRNVEEKRDNTDNANSSELIKPKSTAPKRLN

SEQ ID NO: 1566785 - protein, 18 aa, Staphylococcus aureus
DLTDAQKDAVKRQIEGAT

SEQ ID NO: 1566786 - protein, 38 aa, Staphylococcus aureus
DNLNNAQKQAVTNQINGAHTVDEANQIKQNAQNLNTAM

SEQ ID NO: 1566787 - protein, 4 aa, Staphylococcus aureus
DSGK

SEQ ID NO: 1566788 - protein, 21 aa, Staphylococcus aureus
DSINRSLSKGQPQEHQFSKEE

SEQ ID NO: 1566789 - protein, 248 aa, Staphylococcus aureus
DSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDS

SEQ ID NO: 1566790 - protein, 10 aa, Staphylococcus aureus
DTNKNGVQDL

SEQ ID NO: 1566791 - protein, 7 aa, Staphylococcus aureus
DTRGMTK

SEQ ID NO: 1566792 - protein, 5 aa, Staphylococcus aureus
DTTGM

SEQ ID NO: 1566793 - protein, 18 aa, Staphylococcus aureus
EASAATVAGIAGTNNGIT

SEQ ID NO: 1566794 - protein, 11 aa, Staphylococcus aureus
EAVSNTGTQLN

SEQ ID NO: 1566795 - protein, 8 aa, Staphylococcus aureus
EDQKLKER

SEQ ID NO: 1566796 - protein, 8 aa, Staphylococcus aureus
EKDPKYKL

SEQ ID NO: 1566797 - protein, 6 aa, Staphylococcus aureus
EKNRAY

SEQ ID NO: 1566798 - protein, 24 aa, Staphylococcus aureus
EKVNELNGNERVAEAKTQAKQTID

SEQ ID NO: 1566799 - protein, 14 aa, Staphylococcus aureus
ELNKKADFHKNSEK

SEQ ID NO: 1566800 - protein, 5 aa, Staphylococcus aureus
ENFRK

SEQ ID NO: 1566801 - protein, 23 aa, Staphylococcus aureus
ENVTPNKALAEQINQADQTFRAQ

SEQ ID NO: 1566802 - protein, 8 aa, Staphylococcus aureus
ENYNNGDV

SEQ ID NO: 1566803 - protein, 36 aa, Staphylococcus aureus
ERAKQAANTAITNASDLNTKQKEALKAQVTSAGRVS

SEQ ID NO: 1566804 - protein, 9 aa, Staphylococcus aureus
ETKLSDNAK

SEQ ID NO: 1566805 - protein, 25 aa, Staphylococcus aureus
EVRGKNASKNKRPSQLSSVNGFDDP

SEQ ID NO: 1566806 - protein, 26 aa, Staphylococcus aureus
EVVEETKATGTDVTNKVEVEEGSEIV

SEQ ID NO: 1566807 - protein, 10 aa, Staphylococcus aureus
EYLGKSKKFG

SEQ ID NO: 1566808 - protein, 8 aa, Staphylococcus aureus
EYRGYDSA

SEQ ID NO: 1566809 - protein, 10 aa, Staphylococcus aureus
EYTTSESPTL

SEQ ID NO: 1566810 - protein, 42 aa, Staphylococcus aureus
FETPSGYTPTQVGSGTDEGIDSNGTSTTGVIKDKDNDTIDSG

SEQ ID NO: 1566811 - protein, 5 aa, Staphylococcus aureus
FHGSG

SEQ ID NO: 1566812 - protein, 12 aa, Staphylococcus aureus
FHTGKQSEGASD

SEQ ID NO: 1566813 - protein, 9 aa, Staphylococcus aureus
FRKGEPGLL

SEQ ID NO: 1566814 - protein, 20 aa, Staphylococcus aureus
FTDADEAKRNAYTNAVTQAE

SEQ ID NO: 1566815 - protein, 9 aa, Staphylococcus aureus
FTEVPQERD

SEQ ID NO: 1566816 - protein, 7 aa, Staphylococcus aureus
FTPDTSK

SEQ ID NO: 1566817 - protein, 13 aa, Staphylococcus aureus
FTPDTSKLKDVTD

SEQ ID NO: 1566818 - protein, 9 aa, Staphylococcus aureus
GAATTFSDT

SEQ ID NO: 1566819 - protein, 5 aa, Staphylococcus aureus
GDIIP

SEQ ID NO: 1566820 - protein, 14 aa, Staphylococcus aureus
GEVIGTTKTDENGK

SEQ ID NO: 1566821 - protein, 16 aa, Staphylococcus aureus
GHKQDTNVVNPHNAER

SEQ ID NO: 1566822 - protein, 23 aa, Staphylococcus aureus
GHNDINNALTKEEIEQAKAQLAQ

SEQ ID NO: 1566823 - protein, 6 aa, Staphylococcus aureus
GLQGKI

SEQ ID NO: 1566824 - protein, 12 aa, Staphylococcus aureus
GNDTTKTTANIQ

SEQ ID NO: 1566825 - protein, 7 aa, Staphylococcus aureus
GPTTADR

SEQ ID NO: 1566826 - protein, 13 aa, Staphylococcus aureus
GTPETKSEITNTH

SEQ ID NO: 1566827 - protein, 9 aa, Staphylococcus aureus
GVEHTATEL

SEQ ID NO: 1566828 - protein, 9 aa, Staphylococcus aureus
GVSKKGGTP

SEQ ID NO: 1566829 - protein, 123 aa, Staphylococcus aureus
HEAKAAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTL

SEQ ID NO: 1566830 - protein, 34 aa, Staphylococcus aureus
HEQAQNKKAKRENQRDEPAPPLQNDNDLRRRQQY

SEQ ID NO: 1566831 - protein, 35 aa, Staphylococcus aureus
HHNDSEKMDYKSYAADKAKANKEAHKAKQKNGKLN

SEQ ID NO: 1566832 - protein, 155 aa, Staphylococcus aureus
HQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRA

SEQ ID NO: 1566833 - protein, 10 aa, Staphylococcus aureus
HVNQTTGKTE

SEQ ID NO: 1566834 - protein, 34 aa, Staphylococcus aureus
IADKADTKASGNYVNADANKRQAYDEKVTAAENI

SEQ ID NO: 1566835 - protein, 34 aa, Staphylococcus aureus
IADKAETKASGNYVNADANKRQAYDEKVTAAENI

SEQ ID NO: 1566836 - protein, 33 aa, Staphylococcus aureus
IADKERTKASGNYVNADQEKRQAYDSKVTNAEN

SEQ ID NO: 1566837 - protein, 27 aa, Staphylococcus aureus
IANNDATKASEDYVDANNDKQTAYNNA

SEQ ID NO: 1566838 - protein, 8 aa, Staphylococcus aureus
IDADASKV

SEQ ID NO: 1566839 - protein, 46 aa, Staphylococcus aureus
IGQTTSPSMNAQEINQAKDQVTAKQQALNGQENLRTAQTNAKQHLN

SEQ ID NO: 1566840 - protein, 4 aa, Staphylococcus aureus
IPKI

SEQ ID NO: 1566841 - protein, 17 aa, Staphylococcus aureus
IQTNKQGLEKDKKENLL

SEQ ID NO: 1566842 - protein, 8 aa, Staphylococcus aureus
ISFSPSAI

SEQ ID NO: 1566843 - protein, 5 aa, Staphylococcus aureus
ISTSE

SEQ ID NO: 1566844 - protein, 8 aa, Staphylococcus aureus
ITDPSGEV

SEQ ID NO: 1566845 - protein, 9 aa, Staphylococcus aureus
ITEDAQRGM

SEQ ID NO: 1566846 - protein, 5 aa, Staphylococcus aureus
ITKKQ

SEQ ID NO: 1566847 - protein, 10 aa, Staphylococcus aureus
ITYGANDSVN

SEQ ID NO: 1566848 - protein, 6 aa, Staphylococcus aureus
KANNRF

SEQ ID NO: 1566849 - protein, 15 aa, Staphylococcus aureus
KAQGPNTSKDGVETA

SEQ ID NO: 1566850 - protein, 25 aa, Staphylococcus aureus
KDISTDKIDRIRNSTIGTAEERQAA

SEQ ID NO: 1566851 - protein, 13 aa, Staphylococcus aureus
KDYPDNVGQINKD

SEQ ID NO: 1566852 - protein, 7 aa, Staphylococcus aureus
KEINEQF

SEQ ID NO: 1566853 - protein, 9 aa, Staphylococcus aureus
KGQTSSNKQ

SEQ ID NO: 1566854 - protein, 18 aa, Staphylococcus aureus
KGTKNETFRVTQEDKDKV

SEQ ID NO: 1566855 - protein, 12 aa, Staphylococcus aureus
KGYSRNDRVGKS

SEQ ID NO: 1566856 - protein, 9 aa, Staphylococcus aureus
KIKNAGAVG

SEQ ID NO: 1566857 - protein, 6 aa, Staphylococcus aureus
KINDQE

SEQ ID NO: 1566858 - protein, 7 aa, Staphylococcus aureus
KKDIDTP

SEQ ID NO: 1566859 - protein, 20 aa, Staphylococcus aureus
KKSATNTKVDIAGSQVDDYG

SEQ ID NO: 1566860 - protein, 6 aa, Staphylococcus aureus
KLDDVN

SEQ ID NO: 1566861 - protein, 96 aa, Staphylococcus aureus
KLNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGV

SEQ ID NO: 1566862 - protein, 4 aa, Staphylococcus aureus
KMNN

SEQ ID NO: 1566863 - protein, 7 aa, Staphylococcus aureus
KNEPVTK

SEQ ID NO: 1566864 - protein, 44 aa, Staphylococcus aureus
KPANKYGESPKYPSSIKNQSVTSETPKKAGTSETPKTPEETDNQ

SEQ ID NO: 1566865 - protein, 44 aa, Staphylococcus aureus
KPANKYGESPKYPSTIKNQPVTSETPEKACTSETPKTPEETDNQ

SEQ ID NO: 1566866 - protein, 36 aa, Staphylococcus aureus
KQGIANKDTVKASENYHDADADKQTAYTNAVSQAEG

SEQ ID NO: 1566867 - protein, 9 aa, Staphylococcus aureus
KQIDSAVKS

SEQ ID NO: 1566868 - protein, 6 aa, Staphylococcus aureus
KSKERL

SEQ ID NO: 1566869 - protein, 21 aa, Staphylococcus aureus
KSLDAFSNKKVKAKLDASIQD

SEQ ID NO: 1566870 - protein, 6 aa, Staphylococcus aureus
KSQSLG

SEQ ID NO: 1566871 - protein, 7 aa, Staphylococcus aureus
KTEEEVE

SEQ ID NO: 1566872 - protein, 14 aa, Staphylococcus aureus
KTQGANTPKQDVEA

SEQ ID NO: 1566873 - protein, 8 aa, Staphylococcus aureus
KTVPNETS

SEQ ID NO: 1566874 - protein, 7 aa, Staphylococcus aureus
KVHADYP

SEQ ID NO: 1566875 - protein, 16 aa, Staphylococcus aureus
LDGVEGQVQGITRETT

SEQ ID NO: 1566876 - protein, 5 aa, Staphylococcus aureus
LDNGR

SEQ ID NO: 1566877 - protein, 14 aa, Staphylococcus aureus
LDRDKDNRACEPDK

SEQ ID NO: 1566878 - protein, 64 aa, Staphylococcus aureus
LEKNNNSQPSENGKLQTSDVKKTDDNNATSDDQVTTTVNSQQLNTDNTTANATMSSAPINVSKD

SEQ ID NO: 1566879 - protein, 10 aa, Staphylococcus aureus
LGESKEVIEE

SEQ ID NO: 1566880 - protein, 7 aa, Staphylococcus aureus
LGNGTYS

SEQ ID NO: 1566881 - protein, 9 aa, Staphylococcus aureus
LGQNKVSKE

SEQ ID NO: 1566882 - protein, 11 aa, Staphylococcus aureus
LGTDSGGRDNF

SEQ ID NO: 1566883 - protein, 35 aa, Staphylococcus aureus
LNTPQKTALKQQVNAAQRVSGVTDLKNSATSLNNA

SEQ ID NO: 1566884 - protein, 6 aa, Staphylococcus aureus
LRGQLD

SEQ ID NO: 1566885 - protein, 7 aa, Staphylococcus aureus
LRPEQTQ

SEQ ID NO: 1566886 - protein, 6 aa, Staphylococcus aureus
LSQSGL

SEQ ID NO: 1566887 - protein, 22 aa, Staphylococcus aureus
LSRASDYFSEAGATPATKAFGR

SEQ ID NO: 1566888 - protein, 5 aa, Staphylococcus aureus
LSSQA

SEQ ID NO: 1566889 - protein, 15 aa, Staphylococcus aureus
LTSDGNRSVSTGNAL

SEQ ID NO: 1566890 - protein, 12 aa, Staphylococcus aureus
NEVEKKDNKYMT

SEQ ID NO: 1566891 - protein, 9 aa, Staphylococcus aureus
NGKDNLSAD

SEQ ID NO: 1566892 - protein, 4 aa, Staphylococcus aureus
NGMS

SEQ ID NO: 1566893 - protein, 11 aa, Staphylococcus aureus
NKEQDLNTAMQ

SEQ ID NO: 1566894 - protein, 15 aa, Staphylococcus aureus
NKTSGGNTPKADVER

SEQ ID NO: 1566895 - protein, 34 aa, Staphylococcus aureus
NNAQKQQLQSQITQSSDIAAVNGHKQTAESLNTA

SEQ ID NO: 1566896 - protein, 10 aa, Staphylococcus aureus
NNKAGIKDKA

SEQ ID NO: 1566897 - protein, 7 aa, Staphylococcus aureus
NNRSSNG

SEQ ID NO: 1566898 - protein, 8 aa, Staphylococcus aureus
NNVKTDLT

SEQ ID NO: 1566899 - protein, 7 aa, Staphylococcus aureus
NPEDIKN

SEQ ID NO: 1566900 - protein, 9 aa, Staphylococcus aureus
NQSSPSYPI

SEQ ID NO: 1566901 - protein, 12 aa, Staphylococcus aureus
NQTTNPMLNPDD

SEQ ID NO: 1566902 - protein, 13 aa, Staphylococcus aureus
NQTTNPTLNPDEI

SEQ ID NO: 1566903 - protein, 6 aa, Staphylococcus aureus
NSDEAK

SEQ ID NO: 1566904 - protein, 10 aa, Staphylococcus aureus
NSDQQLPQSN

SEQ ID NO: 1566905 - protein, 47 aa, Staphylococcus aureus
NSIQDNAATKNGQNYLDATESNKTNYNNAVDSANGVINATSNPNMDA

SEQ ID NO: 1566906 - protein, 9 aa, Staphylococcus aureus
NSKEVTPEI

SEQ ID NO: 1566907 - protein, 5 aa, Staphylococcus aureus
NSNVT

SEQ ID NO: 1566908 - protein, 6 aa, Staphylococcus aureus
NSPEFQ

SEQ ID NO: 1566909 - protein, 34 aa, Staphylococcus aureus
NTPQKTALKQQVNAAQRVSGVTDLKNSATSLNNA

SEQ ID NO: 1566910 - protein, 28 aa, Staphylococcus aureus
NVQRAKNDLNGNQNVANAKTTAKNALNN

SEQ ID NO: 1566911 - protein, 28 aa, Staphylococcus aureus
NVQRAKNELNGNQNVANAKTTAKNALNN

SEQ ID NO: 1566912 - protein, 12 aa, Staphylococcus aureus
NVTPTNDQLTDL

SEQ ID NO: 1566913 - protein, 11 aa, Staphylococcus aureus
PEIKSTDGQVM

SEQ ID NO: 1566914 - protein, 16 aa, Staphylococcus aureus
PMKGSPAERAGIRPKD

SEQ ID NO: 1566915 - protein, 27 aa, Staphylococcus aureus
PNNQSLSSVTVTGQVTKGNKPGVNNPT

SEQ ID NO: 1566916 - protein, 23 aa, Staphylococcus aureus
PQGYEVTPSKQGNNEELDSNGVS

SEQ ID NO: 1566917 - protein, 10 aa, Staphylococcus aureus
QAVNTSAPRM

SEQ ID NO: 1566918 - protein, 13 aa, Staphylococcus aureus
QDFPAGNGSSAAD

SEQ ID NO: 1566919 - protein, 24 aa, Staphylococcus aureus
QEITGNEGRTKGSTNYVNADTQVK

SEQ ID NO: 1566920 - protein, 7 aa, Staphylococcus aureus
QGGAQYG

SEQ ID NO: 1566921 - protein, 17 aa, Staphylococcus aureus
QIATAKQNIDQATKLQP

SEQ ID NO: 1566922 - protein, 5 aa, Staphylococcus aureus
QLNQA

SEQ ID NO: 1566923 - protein, 29 aa, Staphylococcus aureus
QNVSSAKNALNGDQNVTNAKNAAKNALNN

SEQ ID NO: 1566924 - protein, 9 aa, Staphylococcus aureus
QPKNTYTKE

SEQ ID NO: 1566925 - protein, 26 aa, Staphylococcus aureus
QSVTSAKNALNGDQNVTNAKNAAKHA

SEQ ID NO: 1566926 - protein, 8 aa, Staphylococcus aureus
QTDKEFQT

SEQ ID NO: 1566927 - protein, 12 aa, Staphylococcus aureus
QVSATASELNTA

SEQ ID NO: 1566928 - protein, 32 aa, Staphylococcus aureus
RDSIANEATIKAEQNYTDASPNNRSEYDSAVT

SEQ ID NO: 1566929 - protein, 32 aa, Staphylococcus aureus
RDSIANEATIKAGQNYTDASQNKQTDYNSAVT

SEQ ID NO: 1566930 - protein, 12 aa, Staphylococcus aureus
RDTTGTNDANWS

SEQ ID NO: 1566931 - protein, 11 aa, Staphylococcus aureus
RIKTEEDVESQ

SEQ ID NO: 1566932 - protein, 11 aa, Staphylococcus aureus
RKNATTDKTAY

SEQ ID NO: 1566933 - protein, 26 aa, Staphylococcus aureus
RNDSNTDHSTKPVATAPTSVAPKRVN

SEQ ID NO: 1566934 - protein, 8 aa, Staphylococcus aureus
RPSGTEPK

SEQ ID NO: 1566935 - protein, 4 aa, Staphylococcus aureus
RSDI

SEQ ID NO: 1566936 - protein, 16 aa, Staphylococcus aureus
RYSQNTINGKSNKSRN

SEQ ID NO: 1566937 - protein, 9 aa, Staphylococcus aureus
SAGNSGMYA

SEQ ID NO: 1566938 - protein, 9 aa, Staphylococcus aureus
SEAYANQHN

SEQ ID NO: 1566939 - protein, 14 aa, Staphylococcus aureus
SEINSGSVKYEQTY

SEQ ID NO: 1566940 - protein, 4 aa, Staphylococcus aureus
SELT

SEQ ID NO: 1566941 - protein, 16 aa, Staphylococcus aureus
SEVTQAQNNADALNTA

SEQ ID NO: 1566942 - protein, 34 aa, Staphylococcus aureus
SINNAQKDALTRSIDGATTVAGVNQETVKATELN

SEQ ID NO: 1566943 - protein, 23 aa, Staphylococcus aureus
SINNAQKRDLTTKIDQATTVSGV

SEQ ID NO: 1566944 - protein, 15 aa, Staphylococcus aureus
SKANGGNATQAEVEQ

SEQ ID NO: 1566945 - protein, 169 aa, Staphylococcus aureus
SKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVV

SEQ ID NO: 1566946 - protein, 7 aa, Staphylococcus aureus
SKEPDTF

SEQ ID NO: 1566947 - protein, 30 aa, Staphylococcus aureus
SKGESKEEITKDPVNELTEFGGEKIPQGHK

SEQ ID NO: 1566948 - protein, 7 aa, Staphylococcus aureus
SKSEQLG

SEQ ID NO: 1566949 - protein, 14 aa, Staphylococcus aureus
SKTNAEKVVSEKDG

SEQ ID NO: 1566950 - protein, 22 aa, Staphylococcus aureus
SNVRKAQRLAKTSVPNEIETDV

SEQ ID NO: 1566951 - protein, 67 aa, Staphylococcus aureus
SQEAKAAEVTNKEMKEDATSVNNDQVSKKVDTGQLNNDGNTSKVDTEQLKDENINKVANQKEVTRVE

SEQ ID NO: 1566952 - protein, 11 aa, Staphylococcus aureus
SQTPALQKEAE

SEQ ID NO: 1566953 - protein, 21 aa, Staphylococcus aureus
SRASDYFSEAGATPATKAFGR

SEQ ID NO: 1566954 - protein, 8 aa, Staphylococcus aureus
SSASVYSG

SEQ ID NO: 1566955 - protein, 19 aa, Staphylococcus aureus
SSATRVSSVDTVKQNAQHL

SEQ ID NO: 1566956 - protein, 10 aa, Staphylococcus aureus
SSITDKDNVN

SEQ ID NO: 1566957 - protein, 9 aa, Staphylococcus aureus
SSTTLRDTT

SEQ ID NO: 1566958 - protein, 29 aa, Staphylococcus aureus
STPAGYTPTTANVGTDDAVDSDGLTTTGV

SEQ ID NO: 1566959 - protein, 16 aa, Staphylococcus aureus
SYAKNPKETKDSYISG

SEQ ID NO: 1566960 - protein, 5 aa, Staphylococcus aureus
TAAEG

SEQ ID NO: 1566961 - protein, 11 aa, Staphylococcus aureus
TAGKETSQNVT

SEQ ID NO: 1566962 - protein, 26 aa, Staphylococcus aureus
TAGKSLKGSYPNVDNEQDRAYYAEHP

SEQ ID NO: 1566963 - protein, 5 aa, Staphylococcus aureus
TDKIE

SEQ ID NO: 1566964 - protein, 9 aa, Staphylococcus aureus
TDNTQDGAV

SEQ ID NO: 1566965 - protein, 23 aa, Staphylococcus aureus
TIKVGDGKDNVAAAHDGKDIEYD

SEQ ID NO: 1566966 - protein, 33 aa, Staphylococcus aureus
TLDTDKTKYSWSNSYSNVNGSSTANGDQKKYNL

SEQ ID NO: 1566967 - protein, 9 aa, Staphylococcus aureus
TNNNGKKDI

SEQ ID NO: 1566968 - protein, 36 aa, Staphylococcus aureus
TNNQKSAISSQIDRAGHVSEVTAAKNAATELNTQMG

SEQ ID NO: 1566969 - protein, 6 aa, Staphylococcus aureus
TNVRGS

SEQ ID NO: 1566970 - protein, 16 aa, Staphylococcus aureus
TQGSGETVSDEQRSDD

SEQ ID NO: 1566971 - protein, 17 aa, Staphylococcus aureus
TTAPTVTPIGDQSSEVF

SEQ ID NO: 1566972 - protein, 25 aa, Staphylococcus aureus
TTMNQAKDALNGDEKLAQAKQEALA

SEQ ID NO: 1566973 - protein, 4 aa, Staphylococcus aureus
TVEG

SEQ ID NO: 1566974 - protein, 33 aa, Staphylococcus aureus
TVPNTSQITGTVDNNHQHVSATAPNVTSATNKT

SEQ ID NO: 1566975 - protein, 11 aa, Staphylococcus aureus
TYSNDNKTATV

SEQ ID NO: 1566976 - protein, 12 aa, Staphylococcus aureus
VKTAKNALNGDA

SEQ ID NO: 1566977 - protein, 12 aa, Staphylococcus aureus
VMNPAKQPAPSK

SEQ ID NO: 1566978 - protein, 16 aa, Staphylococcus aureus
VNADSTKQNVYTTKVT

SEQ ID NO: 1566979 - protein, 11 aa, Staphylococcus aureus
VNPSEKSLTNA

SEQ ID NO: 1566980 - protein, 31 aa, Staphylococcus aureus
VNRATSAVTTNKSALNGDEKLVQSKTDAARA

SEQ ID NO: 1566981 - protein, 15 aa, Staphylococcus aureus
VQGPNTAKDNVESAL

SEQ ID NO: 1566982 - protein, 21 aa, Staphylococcus aureus
VQQSHKNLSSTIGEPNANAYA

SEQ ID NO: 1566983 - protein, 32 aa, Staphylococcus aureus
VSGTPTPTLTPADVTNAATQVTNAKTQLNGNH

SEQ ID NO: 1566984 - protein, 32 aa, Staphylococcus aureus
VSGTPTPTLTPSDVTNAATQVTNAKTQLNGNH

SEQ ID NO: 1566985 - protein, 12 aa, Staphylococcus aureus
VSRDNNSIGSAF

SEQ ID NO: 1566986 - protein, 33 aa, Staphylococcus aureus
VSTSDTTTIQKSKGNANQASHKDTCKKELDSQD

SEQ ID NO: 1566987 - protein, 35 aa, Staphylococcus aureus
WKTSQDTSLTPELSTKAPKEYDTSQPFTDTSNEIG

SEQ ID NO: 1566988 - protein, 9 aa, Staphylococcus aureus
YASNQANKP

SEQ ID NO: 1566989 - protein, 6 aa, Staphylococcus aureus
YDVNTN

SEQ ID NO: 1566990 - protein, 6 aa, Staphylococcus aureus
YGGTAG

SEQ ID NO: 1566991 - protein, 9 aa, Staphylococcus aureus
YINNEDLSR

SEQ ID NO: 1566992 - protein, 5 aa, Staphylococcus aureus
YTKPK

SEQ ID NO: 1566993 - protein, 6 aa, Staphylococcus aureus
YTSPHD

SEQ ID NO: 1566994 - protein, 8 aa, Staphylococcus aureus
YTYTDTEE

SEQ ID NO: 1566995 - protein, 9 aa, Staphylococcus aureus
YYDSNASNL

SEQ ID NO: 1566996 - protein, 197 aa, Staphylococcus aureus
YYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNAT

SEQ ID NO: 1566997 - protein, 245 aa, Staphylococcus aureus
YYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNAT

SEQ ID NO: 1566998 - protein, 15 aa, Staphylococcus aureus
AADAPAAGKDITNQL

SEQ ID NO: 1566999 - protein, 15 aa, Staphylococcus aureus
AADAPAAGTDITNQL

SEQ ID NO: 1567000 - protein, 22 aa, Staphylococcus aureus
AAESITDPTNGSNANKDAVEQA

SEQ ID NO: 1567001 - protein, 9 aa, Staphylococcus aureus
AAGKASTLG

SEQ ID NO: 1567002 - protein, 32 aa, Staphylococcus aureus
AAGQVSTTKNALNGNENLEAAKQQASQSLGSL

SEQ ID NO: 1567003 - protein, 5 aa, Staphylococcus aureus
AATSL

SEQ ID NO: 1567004 - protein, 5 aa, Staphylococcus aureus
ADNIR

SEQ ID NO: 1567005 - protein, 7 aa, Staphylococcus aureus
AEAKTQL

SEQ ID NO: 1567006 - protein, 4 aa, Staphylococcus aureus
AEAN

SEQ ID NO: 1567007 - protein, 8 aa, Staphylococcus aureus
AEETQSEG

SEQ ID NO: 1567008 - protein, 5 aa, Staphylococcus aureus
AIANQ

SEQ ID NO: 1567009 - protein, 34 aa, Staphylococcus aureus
AITQATTQVNNAKNGLNGAENLRNAQNTAKQNLN

SEQ ID NO: 1567010 - protein, 12 aa, Staphylococcus aureus
AKSNKSDELDDE

SEQ ID NO: 1567011 - protein, 25 aa, Staphylococcus aureus
ANELDSKDNKGSQIEMNGRSDIDSK

SEQ ID NO: 1567012 - protein, 26 aa, Staphylococcus aureus
ANELDSKDNKSSHTEMNGQSDIDSKL

SEQ ID NO: 1567013 - protein, 7 aa, Staphylococcus aureus
ANEQQLE

SEQ ID NO: 1567014 - protein, 8 aa, Staphylococcus aureus
ANEQQLEQ

SEQ ID NO: 1567015 - protein, 7 aa, Staphylococcus aureus
ANGRIDT

SEQ ID NO: 1567016 - protein, 23 aa, Staphylococcus aureus
ANHPFNSSTIGHKKKIDEDDDID

SEQ ID NO: 1567017 - protein, 27 aa, Staphylococcus aureus
ANKRTATIKNGTAMPTNLAGGSTTTIP

SEQ ID NO: 1567018 - protein, 15 aa, Staphylococcus aureus
ANNNKAKADSHSKQL

SEQ ID NO: 1567019 - protein, 13 aa, Staphylococcus aureus
APTVTVGNQTIEV

SEQ ID NO: 1567020 - protein, 13 aa, Staphylococcus aureus
AQASLGHKSLKKQ

SEQ ID NO: 1567021 - protein, 7 aa, Staphylococcus aureus
AQSIDEI

SEQ ID NO: 1567022 - protein, 7 aa, Staphylococcus aureus
AQTNSPT

SEQ ID NO: 1567023 - protein, 23 aa, Staphylococcus aureus
ASGNYTNASPDKQGAYTDAYNAA

SEQ ID NO: 1567024 - protein, 14 aa, Staphylococcus aureus
ASLSSEIKYTAPHD

SEQ ID NO: 1567025 - protein, 5 aa, Staphylococcus aureus
ATSLS

SEQ ID NO: 1567026 - protein, 10 aa, Staphylococcus aureus
AVSNTSTQLN

SEQ ID NO: 1567027 - protein, 18 aa, Staphylococcus aureus
CGGGNKITGDSKETQIKK

SEQ ID NO: 1567028 - protein, 20 aa, Staphylococcus aureus
CKPDPNFSSVQSANPEDHRA

SEQ ID NO: 1567029 - protein, 10 aa, Staphylococcus aureus
DANVKRTSYR

SEQ ID NO: 1567030 - protein, 5 aa, Staphylococcus aureus
DDMPG

SEQ ID NO: 1567031 - protein, 8 aa, Staphylococcus aureus
DEDTAGGI

SEQ ID NO: 1567032 - protein, 92 aa, Staphylococcus aureus
DFEEDTLPQVSGHNEGQQTIEEDTTPPIVPPTPPTPEVPSEPETPTPPTPEVPSEPETPTPPTPEVPTEPGKPIPPAKEEPKKPSKPVEQGK

SEQ ID NO: 1567033 - protein, 5 aa, Staphylococcus aureus
DHDNT

SEQ ID NO: 1567034 - protein, 10 aa, Staphylococcus aureus
DIPPTINNPV

SEQ ID NO: 1567035 - protein, 7 aa, Staphylococcus aureus
DKDKSIV

SEQ ID NO: 1567036 - protein, 9 aa, Staphylococcus aureus
DKIGKGTKW

SEQ ID NO: 1567037 - protein, 8 aa, Staphylococcus aureus
DNKKEEQK

SEQ ID NO: 1567038 - protein, 37 aa, Staphylococcus aureus
DNLNNAQKQAVTNQINGAHTVDEANQIKQNAQNLNTA

SEQ ID NO: 1567039 - protein, 7 aa, Staphylococcus aureus
DNTPLTI

SEQ ID NO: 1567040 - protein, 48 aa, Staphylococcus aureus
DRAKQAANTAITNASDLNTKQKEALKAQVTSAGRVSAANGVEHTATEL

SEQ ID NO: 1567041 - protein, 20 aa, Staphylococcus aureus
DSYGVATTYTSSSAADNAAK

SEQ ID NO: 1567042 - protein, 4 aa, Staphylococcus aureus
DTGR

SEQ ID NO: 1567043 - protein, 25 aa, Staphylococcus aureus
DTSKLSDSYYADPNDSNLKEVTNEF

SEQ ID NO: 1567044 - protein, 22 aa, Staphylococcus aureus
DVNSATSQVNAAKTALNGDNNL

SEQ ID NO: 1567045 - protein, 5 aa, Staphylococcus aureus
EAIQS

SEQ ID NO: 1567046 - protein, 7 aa, Staphylococcus aureus
EHGREAD

SEQ ID NO: 1567047 - protein, 22 aa, Staphylococcus aureus
EKAKNKVDKSIETRSEAISSIS

SEQ ID NO: 1567048 - protein, 8 aa, Staphylococcus aureus
EKDSKGVD

SEQ ID NO: 1567049 - protein, 11 aa, Staphylococcus aureus
EKQLTLTETTT

SEQ ID NO: 1567050 - protein, 8 aa, Staphylococcus aureus
EKSQISRT

SEQ ID NO: 1567051 - protein, 7 aa, Staphylococcus aureus
EKYSLKE

SEQ ID NO: 1567052 - protein, 7 aa, Staphylococcus aureus
ELSSTLT

SEQ ID NO: 1567053 - protein, 7 aa, Staphylococcus aureus
EMESTTA

SEQ ID NO: 1567054 - protein, 12 aa, Staphylococcus aureus
ENATGKDYSGTA

SEQ ID NO: 1567055 - protein, 62 aa, Staphylococcus aureus
ENQKNGNKRREQQESMNGNDVKSASVESNANNYSKQPQKASQQEHQVRETRQRKDIQRSPQV

SEQ ID NO: 1567056 - protein, 8 aa, Staphylococcus aureus
EQEQRNNV

SEQ ID NO: 1567057 - protein, 9 aa, Staphylococcus aureus
ERDGYSQEY

SEQ ID NO: 1567058 - protein, 4 aa, Staphylococcus aureus
ESFA

SEQ ID NO: 1567059 - protein, 13 aa, Staphylococcus aureus
ETIDTSNEYSKYG

SEQ ID NO: 1567060 - protein, 14 aa, Staphylococcus aureus
ETIPPKKDGDSEKV

SEQ ID NO: 1567061 - protein, 33 aa, Staphylococcus aureus
ETVPNRSYARASANEITSKTVSNVSRTGNNANV

SEQ ID NO: 1567062 - protein, 10 aa, Staphylococcus aureus
EYTNAGPKVH

SEQ ID NO: 1567063 - protein, 9 aa, Staphylococcus aureus
FAESGDGGV

SEQ ID NO: 1567064 - protein, 188 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1567065 - protein, 451 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANT

SEQ ID NO: 1567066 - protein, 4 aa, Staphylococcus aureus
FSDG

SEQ ID NO: 1567067 - protein, 6 aa, Staphylococcus aureus
GADNMT

SEQ ID NO: 1567068 - protein, 8 aa, Staphylococcus aureus
GGTGSGKS

SEQ ID NO: 1567069 - protein, 23 aa, Staphylococcus aureus
GHKATKDNEVLADETLKNKGFKI

SEQ ID NO: 1567070 - protein, 9 aa, Staphylococcus aureus
GHNDINNAM

SEQ ID NO: 1567071 - protein, 4 aa, Staphylococcus aureus
GIGQ

SEQ ID NO: 1567072 - protein, 10 aa, Staphylococcus aureus
GIGSTTANKT

SEQ ID NO: 1567073 - protein, 56 aa, Staphylococcus aureus
GKAGSTKQKTMTTKQNQTNKANHTRQNERTTPKKETALSNVKKQQGGIGQRLGEKT

SEQ ID NO: 1567074 - protein, 10 aa, Staphylococcus aureus
GKLPDEKNYK

SEQ ID NO: 1567075 - protein, 9 aa, Staphylococcus aureus
GKVKSGDYF

SEQ ID NO: 1567076 - protein, 24 aa, Staphylococcus aureus
GLDTPKKIGPKYAPVGASNDPNNM

SEQ ID NO: 1567077 - protein, 7 aa, Staphylococcus aureus
GNAAKKG

SEQ ID NO: 1567078 - protein, 7 aa, Staphylococcus aureus
GNDAYSE

SEQ ID NO: 1567079 - protein, 6 aa, Staphylococcus aureus
GPRPAL

SEQ ID NO: 1567080 - protein, 5 aa, Staphylococcus aureus
GQSFN

SEQ ID NO: 1567081 - protein, 10 aa, Staphylococcus aureus
GRGYVDTGKS

SEQ ID NO: 1567082 - protein, 15 aa, Staphylococcus aureus
GSDGAQLSTDASELA

SEQ ID NO: 1567083 - protein, 4 aa, Staphylococcus aureus
GSVR

SEQ ID NO: 1567084 - protein, 7 aa, Staphylococcus aureus
GSVTQSI

SEQ ID NO: 1567085 - protein, 4 aa, Staphylococcus aureus
GSYT

SEQ ID NO: 1567086 - protein, 9 aa, Staphylococcus aureus
GVDKNDIEI

SEQ ID NO: 1567087 - protein, 20 aa, Staphylococcus aureus
GYTLNKGYDVNTKELTDVTN

SEQ ID NO: 1567088 - protein, 25 aa, Staphylococcus aureus
GYTPTTVNAGTDDAVDSDGLTTTGV

SEQ ID NO: 1567089 - protein, 13 aa, Staphylococcus aureus
HAWESDNETSTNV

SEQ ID NO: 1567090 - protein, 37 aa, Staphylococcus aureus
HDLNQKQKDALKTQVNNAQRVSDANNVQHTATELNSA

SEQ ID NO: 1567091 - protein, 9 aa, Staphylococcus aureus
HDQNTVKQS

SEQ ID NO: 1567092 - protein, 4 aa, Staphylococcus aureus
HEQD

SEQ ID NO: 1567093 - protein, 10 aa, Staphylococcus aureus
HVNSTTGKTE

SEQ ID NO: 1567094 - protein, 34 aa, Staphylococcus aureus
IADKERTKASGNYVNADQEKRQAYDSKVTNAENI

SEQ ID NO: 1567095 - protein, 6 aa, Staphylococcus aureus
IDEQTE

SEQ ID NO: 1567096 - protein, 5 aa, Staphylococcus aureus
IDKTT

SEQ ID NO: 1567097 - protein, 86 aa, Staphylococcus aureus
IEETQSYNATVTEQPSNATQVTTEEAPKAVQAPQTAQPANVETVKEEEKPQVKETTQPQDNSGNQRQVDLTPKKVTQNQGTETQVE

SEQ ID NO: 1567098 - protein, 14 aa, Staphylococcus aureus
IKTDVTTAKVTTAE

SEQ ID NO: 1567099 - protein, 92 aa, Staphylococcus aureus
ISASESDSMSTSDSSSISGSNSTSTSLSTSDSMSGSVSVSTSTSLSDSISGSTSVSDSSSTSTSTSLSDSMSQSQSTSTSASGSLSTSISTS

SEQ ID NO: 1567100 - protein, 10 aa, Staphylococcus aureus
ISGTPNATLT

SEQ ID NO: 1567101 - protein, 16 aa, Staphylococcus aureus
ISLSDSTSTSTSASEV

SEQ ID NO: 1567102 - protein, 13 aa, Staphylococcus aureus
ISNTLRHSNGTKV

SEQ ID NO: 1567103 - protein, 9 aa, Staphylococcus aureus
ISSRDSEKF

SEQ ID NO: 1567104 - protein, 7 aa, Staphylococcus aureus
ITKGPEL

SEQ ID NO: 1567105 - protein, 9 aa, Staphylococcus aureus
ITPNGFSSS

SEQ ID NO: 1567106 - protein, 195 aa, Staphylococcus aureus
ITSPSVNSEMNNNETGTPHESNQTGNEGTGSNSRDANPDSNNVKPDSNNQNPSTDSKPDPNNQNPSPNPKPDPDNPKPKPDPKPDPDKPKPNPDPKPDPDNPKPNPDPKPDPNKPNPDPKPDPDKPKPNPNPKPDPNKPNPNPSPDPDQPGDSNHSGGSKNGGTWNPNASDGSNQGQWQPNGNQGNSQNPTGNDF

SEQ ID NO: 1567107 - protein, 13 aa, Staphylococcus aureus
IVDPKAERGEWKE

SEQ ID NO: 1567108 - protein, 5 aa, Staphylococcus aureus
IVPSK

SEQ ID NO: 1567109 - protein, 13 aa, Staphylococcus aureus
KAKEDAKNDIDKR

SEQ ID NO: 1567110 - protein, 16 aa, Staphylococcus aureus
KALSTVRNKKKELKDL

SEQ ID NO: 1567111 - protein, 4 aa, Staphylococcus aureus
KAND

SEQ ID NO: 1567112 - protein, 8 aa, Staphylococcus aureus
KASDSKEI

SEQ ID NO: 1567113 - protein, 14 aa, Staphylococcus aureus
KASLEALNRSKAKA

SEQ ID NO: 1567114 - protein, 10 aa, Staphylococcus aureus
KDAAKSCELN

SEQ ID NO: 1567115 - protein, 13 aa, Staphylococcus aureus
KDKFSDRKNYKVE

SEQ ID NO: 1567116 - protein, 13 aa, Staphylococcus aureus
KEDENNQKRLREL

SEQ ID NO: 1567117 - protein, 7 aa, Staphylococcus aureus
KERRSRN

SEQ ID NO: 1567118 - protein, 42 aa, Staphylococcus aureus
KEVVGEAKATGTDVTSKVKVTESSLEGHNKDSNIVNPHNAQR

SEQ ID NO: 1567119 - protein, 20 aa, Staphylococcus aureus
KFTDADKAKRDAYTNAVSRA

SEQ ID NO: 1567120 - protein, 6 aa, Staphylococcus aureus
KGPEQV

SEQ ID NO: 1567121 - protein, 11 aa, Staphylococcus aureus
KKGPNAESTND

SEQ ID NO: 1567122 - protein, 7 aa, Staphylococcus aureus
KKLNEVN

SEQ ID NO: 1567123 - protein, 7 aa, Staphylococcus aureus
KLPGKVK

SEQ ID NO: 1567124 - protein, 6 aa, Staphylococcus aureus
KNLDEL

SEQ ID NO: 1567125 - protein, 4 aa, Staphylococcus aureus
KNPA

SEQ ID NO: 1567126 - protein, 14 aa, Staphylococcus aureus
KNREYQKEIAEKNR

SEQ ID NO: 1567127 - protein, 4 aa, Staphylococcus aureus
KNTM

SEQ ID NO: 1567128 - protein, 6 aa, Staphylococcus aureus
KPTKNR

SEQ ID NO: 1567129 - protein, 6 aa, Staphylococcus aureus
KQLDKP

SEQ ID NO: 1567130 - protein, 6 aa, Staphylococcus aureus
KRETTK

SEQ ID NO: 1567131 - protein, 6 aa, Staphylococcus aureus
KRYEDK

SEQ ID NO: 1567132 - protein, 9 aa, Staphylococcus aureus
KSGASSAFN

SEQ ID NO: 1567133 - protein, 24 aa, Staphylococcus aureus
KSSDTAENPKEGSKEAQIKKSFSK

SEQ ID NO: 1567134 - protein, 6 aa, Staphylococcus aureus
KSTQEI

SEQ ID NO: 1567135 - protein, 8 aa, Staphylococcus aureus
KSYSPEAF

SEQ ID NO: 1567136 - protein, 21 aa, Staphylococcus aureus
KVALDGDENLAAAKQQANNRL

SEQ ID NO: 1567137 - protein, 7 aa, Staphylococcus aureus
LAKGLGQ

SEQ ID NO: 1567138 - protein, 13 aa, Staphylococcus aureus
LASQGIKGSVTNA

SEQ ID NO: 1567139 - protein, 10 aa, Staphylococcus aureus
LDQTTASKSF

SEQ ID NO: 1567140 - protein, 10 aa, Staphylococcus aureus
LEQAKNGGAV

SEQ ID NO: 1567141 - protein, 8 aa, Staphylococcus aureus
LGGGKSFS

SEQ ID NO: 1567142 - protein, 10 aa, Staphylococcus aureus
LIPNTKSNAL

SEQ ID NO: 1567143 - protein, 4 aa, Staphylococcus aureus
LKDS

SEQ ID NO: 1567144 - protein, 10 aa, Staphylococcus aureus
LPSKKTKQRI

SEQ ID NO: 1567145 - protein, 9 aa, Staphylococcus aureus
LSDRRQLSD

SEQ ID NO: 1567146 - protein, 6 aa, Staphylococcus aureus
LSSQAN

SEQ ID NO: 1567147 - protein, 7 aa, Staphylococcus aureus
LSSRTVK

SEQ ID NO: 1567148 - protein, 9 aa, Staphylococcus aureus
LTKKPGAFV

SEQ ID NO: 1567149 - protein, 12 aa, Staphylococcus aureus
MANDDKTVGEAL

SEQ ID NO: 1567150 - protein, 44 aa, Staphylococcus aureus
NATSQPTLDPSAVTQAANQVSTNKTALNGAQNLANKKQETTANI

SEQ ID NO: 1567151 - protein, 4 aa, Staphylococcus aureus
NATY

SEQ ID NO: 1567152 - protein, 7 aa, Staphylococcus aureus
NDKNEEF

SEQ ID NO: 1567153 - protein, 8 aa, Staphylococcus aureus
NDPNLKER

SEQ ID NO: 1567154 - protein, 7 aa, Staphylococcus aureus
NDRSSNG

SEQ ID NO: 1567155 - protein, 8 aa, Staphylococcus aureus
NDSSRTHT

SEQ ID NO: 1567156 - protein, 15 aa, Staphylococcus aureus
NEDVSEKEYAAVSQQ

SEQ ID NO: 1567157 - protein, 4 aa, Staphylococcus aureus
NEGM

SEQ ID NO: 1567158 - protein, 9 aa, Staphylococcus aureus
NEHANVEQT

SEQ ID NO: 1567159 - protein, 24 aa, Staphylococcus aureus
NELDSKDNKGSQIEMNGQSDIDSK

SEQ ID NO: 1567160 - protein, 9 aa, Staphylococcus aureus
NENEKNKVD

SEQ ID NO: 1567161 - protein, 13 aa, Staphylococcus aureus
NFKNGAKQAQLQS

SEQ ID NO: 1567162 - protein, 6 aa, Staphylococcus aureus
NGKKSL

SEQ ID NO: 1567163 - protein, 9 aa, Staphylococcus aureus
NGQTNSNKQ

SEQ ID NO: 1567164 - protein, 12 aa, Staphylococcus aureus
NGYTTHVDNNDM

SEQ ID NO: 1567165 - protein, 10 aa, Staphylococcus aureus
NHENSYSKNY

SEQ ID NO: 1567166 - protein, 9 aa, Staphylococcus aureus
NIDPATGKD

SEQ ID NO: 1567167 - protein, 12 aa, Staphylococcus aureus
NIPRNASTKVEL

SEQ ID NO: 1567168 - protein, 8 aa, Staphylococcus aureus
NKDTIDRT

SEQ ID NO: 1567169 - protein, 32 aa, Staphylococcus aureus
NKEDLQKLQAQSKVDNKVISNDEVDKVSEGQK

SEQ ID NO: 1567170 - protein, 16 aa, Staphylococcus aureus
NKNSGSNLDKTAVENA

SEQ ID NO: 1567171 - protein, 10 aa, Staphylococcus aureus
NKNYADDQTY

SEQ ID NO: 1567172 - protein, 21 aa, Staphylococcus aureus
NLEKTSESDKSPYIQNKQEKK

SEQ ID NO: 1567173 - protein, 16 aa, Staphylococcus aureus
NNAQRQNLQSQINGAH

SEQ ID NO: 1567174 - protein, 24 aa, Staphylococcus aureus
NNVNNAKHALNGTQNLNNAKQAAI

SEQ ID NO: 1567175 - protein, 7 aa, Staphylococcus aureus
NQHAQSI

SEQ ID NO: 1567176 - protein, 5 aa, Staphylococcus aureus
NRDGK

SEQ ID NO: 1567177 - protein, 4 aa, Staphylococcus aureus
NRPR

SEQ ID NO: 1567178 - protein, 73 aa, Staphylococcus aureus
NSALRTAKTKLDEEINKSVTTDGMTQSSIQAYENAKRAGQTETTNAQNVINNGDATDQQIAAEKTKVEEKYNS

SEQ ID NO: 1567179 - protein, 8 aa, Staphylococcus aureus
NSFPEDEV

SEQ ID NO: 1567180 - protein, 34 aa, Staphylococcus aureus
NSIANKDDVKASQPYVDADRDKQNAYNTAVTNAE

SEQ ID NO: 1567181 - protein, 8 aa, Staphylococcus aureus
NSKTERCE

SEQ ID NO: 1567182 - protein, 27 aa, Staphylococcus aureus
NSVANSKIKRTKEELKSIPNKTRSRLD

SEQ ID NO: 1567183 - protein, 9 aa, Staphylococcus aureus
NSYGPSKDV

SEQ ID NO: 1567184 - protein, 11 aa, Staphylococcus aureus
NTTYGSGNTAV

SEQ ID NO: 1567185 - protein, 11 aa, Staphylococcus aureus
NTVSDLSPKGI

SEQ ID NO: 1567186 - protein, 6 aa, Staphylococcus aureus
PASERT

SEQ ID NO: 1567187 - protein, 29 aa, Staphylococcus aureus
PAVSEQPAKGQQGSKGSESGKDTQPIGKD

SEQ ID NO: 1567188 - protein, 10 aa, Staphylococcus aureus
PDSNSSFEEY

SEQ ID NO: 1567189 - protein, 4 aa, Staphylococcus aureus
PGHG

SEQ ID NO: 1567190 - protein, 7 aa, Staphylococcus aureus
PKDSESL

SEQ ID NO: 1567191 - protein, 12 aa, Staphylococcus aureus
PNTDSQGKDSVD

SEQ ID NO: 1567192 - protein, 13 aa, Staphylococcus aureus
PQSGGMSNYAQYT

SEQ ID NO: 1567193 - protein, 6 aa, Staphylococcus aureus
QATGNL

SEQ ID NO: 1567194 - protein, 10 aa, Staphylococcus aureus
QDAKQFETKL

SEQ ID NO: 1567195 - protein, 5 aa, Staphylococcus aureus
QDQTW

SEQ ID NO: 1567196 - protein, 6 aa, Staphylococcus aureus
QEDTTT

SEQ ID NO: 1567197 - protein, 9 aa, Staphylococcus aureus
QEEEFNQRR

SEQ ID NO: 1567198 - protein, 24 aa, Staphylococcus aureus
QEKENELNGNERVAEAKTQAKQTI

SEQ ID NO: 1567199 - protein, 8 aa, Staphylococcus aureus
QGSKQHTI

SEQ ID NO: 1567200 - protein, 27 aa, Staphylococcus aureus
QIHGQNKGNQSFEEDTEKDKPKYEHGG

SEQ ID NO: 1567201 - protein, 6 aa, Staphylococcus aureus
QIRPLP

SEQ ID NO: 1567202 - protein, 5 aa, Staphylococcus aureus
QNDKV

SEQ ID NO: 1567203 - protein, 35 aa, Staphylococcus aureus
QNGINDEAATKAAQKYTDADREKQTAYNDAVTAAK

SEQ ID NO: 1567204 - protein, 20 aa, Staphylococcus aureus
QNYNNTDKVTDKKTTEHLPS

SEQ ID NO: 1567205 - protein, 5 aa, Staphylococcus aureus
QRINN

SEQ ID NO: 1567206 - protein, 34 aa, Staphylococcus aureus
QSIADNATTKQNQNYTDASQNKKDAYNNAVTTAQ

SEQ ID NO: 1567207 - protein, 34 aa, Staphylococcus aureus
QSIADNATTKQNQNYTDSSPNKKDAYNNAVTTAQ

SEQ ID NO: 1567208 - protein, 28 aa, Staphylococcus aureus
QSMADTKAQRKQQRMNQQEQKRKNIAQK

SEQ ID NO: 1567209 - protein, 14 aa, Staphylococcus aureus
QSNSETVDVTEDFE

SEQ ID NO: 1567210 - protein, 9 aa, Staphylococcus aureus
QTSQAIGEN

SEQ ID NO: 1567211 - protein, 11 aa, Staphylococcus aureus
QTVQTNGQALN

SEQ ID NO: 1567212 - protein, 28 aa, Staphylococcus aureus
QVTDAKNGLNGEAKLATEKQNAKDAVSG

SEQ ID NO: 1567213 - protein, 49 aa, Staphylococcus aureus
RDSIANETTVKASQNYTDASPNNQSTYNSAVSNAKGIINQTNNPTMDAS

SEQ ID NO: 1567214 - protein, 83 aa, Staphylococcus aureus
RDSIANETTVKASQNYTDASPNNQSTYNSAVSNAKGIINQTNNPTMDTSAITQATTQVNNAKNGLNGAENLRNAQNTAKQNLN

SEQ ID NO: 1567215 - protein, 83 aa, Staphylococcus aureus
RDSIANETTVKTSQNYTDASPNNQSTYNSAVSNAKGIINQTNNPTMDTSAITQATTQVNNAKNGLNGAENLRNAQNTAKQNLN

SEQ ID NO: 1567216 - protein, 8 aa, Staphylococcus aureus
REKKLSQI

SEQ ID NO: 1567217 - protein, 18 aa, Staphylococcus aureus
RERQESTKVKFRKGGIAI

SEQ ID NO: 1567218 - protein, 5 aa, Staphylococcus aureus
RESTT

SEQ ID NO: 1567219 - protein, 4 aa, Staphylococcus aureus
RGAR

SEQ ID NO: 1567220 - protein, 10 aa, Staphylococcus aureus
RKEDTPISNS

SEQ ID NO: 1567221 - protein, 6 aa, Staphylococcus aureus
RPDAKY

SEQ ID NO: 1567222 - protein, 83 aa, Staphylococcus aureus
RRAQDLNRRNQQQIPQNSAANNETSNSAPAAGNGVASTPPSAPSGDTAPNNNVTQNTAPNSNNAPVSTTPQSTSGKKDGQSFA

SEQ ID NO: 1567223 - protein, 4 aa, Staphylococcus aureus
RRFQ

SEQ ID NO: 1567224 - protein, 17 aa, Staphylococcus aureus
RSETMKQHPNYKTGENY

SEQ ID NO: 1567225 - protein, 9 aa, Staphylococcus aureus
RSVTQSKQR

SEQ ID NO: 1567226 - protein, 16 aa, Staphylococcus aureus
RTEQTEKHIYDDSTQF

SEQ ID NO: 1567227 - protein, 10 aa, Staphylococcus aureus
SAKGKETPRN

SEQ ID NO: 1567228 - protein, 5 aa, Staphylococcus aureus
SAYTS

SEQ ID NO: 1567229 - protein, 6 aa, Staphylococcus aureus
SDDRTK

SEQ ID NO: 1567230 - protein, 5 aa, Staphylococcus aureus
SDPIT

SEQ ID NO: 1567231 - protein, 44 aa, Staphylococcus aureus
SGTPTVVTTPSEVTAAANQVNSAKQELNGDERLREAKQNANTAI

SEQ ID NO: 1567232 - protein, 6 aa, Staphylococcus aureus
SHKDND

SEQ ID NO: 1567233 - protein, 34 aa, Staphylococcus aureus
SIASKDATKASEDYHDANTDLQNAYNDAVTNAEG

SEQ ID NO: 1567234 - protein, 4 aa, Staphylococcus aureus
SIID

SEQ ID NO: 1567235 - protein, 21 aa, Staphylococcus aureus
SINNAQKEALKSQIEGATTVA

SEQ ID NO: 1567236 - protein, 10 aa, Staphylococcus aureus
SKDVSTASLN

SEQ ID NO: 1567237 - protein, 7 aa, Staphylococcus aureus
SKEDRDI

SEQ ID NO: 1567238 - protein, 10 aa, Staphylococcus aureus
SKEVDYSEAI

SEQ ID NO: 1567239 - protein, 13 aa, Staphylococcus aureus
SKIWTSDDNAAYD

SEQ ID NO: 1567240 - protein, 5 aa, Staphylococcus aureus
SKLSD

SEQ ID NO: 1567241 - protein, 45 aa, Staphylococcus aureus
SKPANKYGESPKYPSTIKNQPVTSETPEKACTSETPKTPEETDNQ

SEQ ID NO: 1567242 - protein, 8 aa, Staphylococcus aureus
SKRKVRRD

SEQ ID NO: 1567243 - protein, 9 aa, Staphylococcus aureus
SLRDQVAEQ

SEQ ID NO: 1567244 - protein, 149 aa, Staphylococcus aureus
SLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMS

SEQ ID NO: 1567245 - protein, 8 aa, Staphylococcus aureus
SNASDLLS

SEQ ID NO: 1567246 - protein, 7 aa, Staphylococcus aureus
SNKEQDV

SEQ ID NO: 1567247 - protein, 13 aa, Staphylococcus aureus
SNNATVSQADQTA

SEQ ID NO: 1567248 - protein, 8 aa, Staphylococcus aureus
SNPPQEIQ

SEQ ID NO: 1567249 - protein, 4 aa, Staphylococcus aureus
SNVA

SEQ ID NO: 1567250 - protein, 17 aa, Staphylococcus aureus
SNVTIDAATSSGSGLDP

SEQ ID NO: 1567251 - protein, 41 aa, Staphylococcus aureus
SQNTKRENHQRPLKKEQKQKTPPKQFNQRKLNKRTDKRGQQ

SEQ ID NO: 1567252 - protein, 28 aa, Staphylococcus aureus
SRYDNSLEKSKIKVEGLSKKQKVQAQIT

SEQ ID NO: 1567253 - protein, 16 aa, Staphylococcus aureus
SSTSPSHLTATEIKQQ

SEQ ID NO: 1567254 - protein, 12 aa, Staphylococcus aureus
STDVEALGEERV

SEQ ID NO: 1567255 - protein, 14 aa, Staphylococcus aureus
STSPDTNNGEDREN

SEQ ID NO: 1567256 - protein, 18 aa, Staphylococcus aureus
STTDSGGGDGTVKPEEKL

SEQ ID NO: 1567257 - protein, 6 aa, Staphylococcus aureus
SYPEHQ

SEQ ID NO: 1567258 - protein, 31 aa, Staphylococcus aureus
TDPTSKGVADSSIAQTYQAPRDSSKEEQQVT

SEQ ID NO: 1567259 - protein, 31 aa, Staphylococcus aureus
TDPTSKGVSDSSIAQTYQAPRDSSKEEQQVT

SEQ ID NO: 1567260 - protein, 19 aa, Staphylococcus aureus
TESSIRATQEQSKKEITGR

SEQ ID NO: 1567261 - protein, 7 aa, Staphylococcus aureus
TGTITYG

SEQ ID NO: 1567262 - protein, 5 aa, Staphylococcus aureus
TGVPF

SEQ ID NO: 1567263 - protein, 15 aa, Staphylococcus aureus
TKEEIEQAKAQLGQA

SEQ ID NO: 1567264 - protein, 4 aa, Staphylococcus aureus
TKGA

SEQ ID NO: 1567265 - protein, 8 aa, Staphylococcus aureus
TKNTAVKV

SEQ ID NO: 1567266 - protein, 19 aa, Staphylococcus aureus
TKVNGTTDGEKDSNGSSVT

SEQ ID NO: 1567267 - protein, 33 aa, Staphylococcus aureus
TLDTDKTKYSWSNSYSSVNGSSTANGDQKKYNL

SEQ ID NO: 1567268 - protein, 5 aa, Staphylococcus aureus
TNLPK

SEQ ID NO: 1567269 - protein, 5 aa, Staphylococcus aureus
TPFSN

SEQ ID NO: 1567270 - protein, 48 aa, Staphylococcus aureus
TPLPGNVKEKESAKTVSSKLKQELKNTVTPTKVEENEAIQEDQVQYEN

SEQ ID NO: 1567271 - protein, 12 aa, Staphylococcus aureus
TQDAKQFETKLS

SEQ ID NO: 1567272 - protein, 6 aa, Staphylococcus aureus
TQLNQA

SEQ ID NO: 1567273 - protein, 5 aa, Staphylococcus aureus
TQMSP

SEQ ID NO: 1567274 - protein, 10 aa, Staphylococcus aureus
TRRNNTSPWV

SEQ ID NO: 1567275 - protein, 9 aa, Staphylococcus aureus
TSENDNKGL

SEQ ID NO: 1567276 - protein, 6 aa, Staphylococcus aureus
TSQETA

SEQ ID NO: 1567277 - protein, 30 aa, Staphylococcus aureus
TSQVTTKEQALNGARNLAQAKTTAKNNLNN

SEQ ID NO: 1567278 - protein, 5 aa, Staphylococcus aureus
TSYHA

SEQ ID NO: 1567279 - protein, 15 aa, Staphylococcus aureus
TTNETESRNYPLEKA

SEQ ID NO: 1567280 - protein, 21 aa, Staphylococcus aureus
VADQTKDVELNANDKKLQKTI

SEQ ID NO: 1567281 - protein, 93 aa, Staphylococcus aureus
VDFEEDTLPQVSGHNEGQQTIEEDTTPPIVPPTPPTPEVPSEPETPTPPTPEVPSEPETPTPPTPEVPTEPGKPIPPAKEEPKKPSKPVEQGK

SEQ ID NO: 1567282 - protein, 6 aa, Staphylococcus aureus
VGTAGS

SEQ ID NO: 1567283 - protein, 8 aa, Staphylococcus aureus
VKNPQTVD

SEQ ID NO: 1567284 - protein, 23 aa, Staphylococcus aureus
VKPDPPRIDGNSVTYKAGLTNQQ

SEQ ID NO: 1567285 - protein, 102 aa, Staphylococcus aureus
VKPTVTTTSKVEDNHSTKVVSTDTTKDQTKTQTAHTVKTAQTAQEQNKVQTPVKDVATAKSESNNQAVSDNKSQQTNKVTKHNETPKQASKAKELPKTGLTS

SEQ ID NO: 1567286 - protein, 34 aa, Staphylococcus aureus
VNQKAASVKSTKDALDGQQNLQRAKTEATNAITH

SEQ ID NO: 1567287 - protein, 26 aa, Staphylococcus aureus
VNTAKTALNGDERLNEAKNTAKQQVA

SEQ ID NO: 1567288 - protein, 7 aa, Staphylococcus aureus
VNYSPKD

SEQ ID NO: 1567289 - protein, 12 aa, Staphylococcus aureus
VQPSSTDSKNVN

SEQ ID NO: 1567290 - protein, 16 aa, Staphylococcus aureus
VRRGKDKENKKNSKDF

SEQ ID NO: 1567291 - protein, 5 aa, Staphylococcus aureus
VSDQA

SEQ ID NO: 1567292 - protein, 33 aa, Staphylococcus aureus
VSTADTTTIQKSKGNANQASHKDTCKKELDSQD

SEQ ID NO: 1567293 - protein, 19 aa, Staphylococcus aureus
VTAANAAKSALDQARNGLT

SEQ ID NO: 1567294 - protein, 10 aa, Staphylococcus aureus
YDEKEKQKAL

SEQ ID NO: 1567295 - protein, 17 aa, Staphylococcus aureus
YDKEGYRDGEFEKGDKG

SEQ ID NO: 1567296 - protein, 6 aa, Staphylococcus aureus
YPEAYR

SEQ ID NO: 1567297 - protein, 4 aa, Staphylococcus aureus
YTTN

SEQ ID NO: 1567298 - protein, 220 aa, Staphylococcus aureus
YYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTL

SEQ ID NO: 1567299 - protein, 232 aa, Staphylococcus aureus
YYEEETSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDNDSDSDSDSDSDSDSDSDSDSDSDSDSDSDSDSDSDSDSDSDSDSDSDSDSDSDSDSDSDSDSDSDSDSDSDSDSDSDSDAGKHTPTKPMSTVKDQHKTAKALPETGSENNNSNNGTL

SEQ ID NO: 1567300 - protein, 17 aa, Staphylococcus aureus
AADAKGTNVNDKVTASD

SEQ ID NO: 1567301 - protein, 13 aa, Staphylococcus aureus
ADAPAAGTDITNQ

SEQ ID NO: 1567302 - protein, 20 aa, Staphylococcus aureus
ADQTKDVELNADDKKLQKTI

SEQ ID NO: 1567303 - protein, 16 aa, Staphylococcus aureus
AFPGSKITVDNTKNTI

SEQ ID NO: 1567304 - protein, 5 aa, Staphylococcus aureus
AGPSA

SEQ ID NO: 1567305 - protein, 26 aa, Staphylococcus aureus
AGSPTVEQINTNTSTANQAKSDLDHA

SEQ ID NO: 1567306 - protein, 4 aa, Staphylococcus aureus
AIQS

SEQ ID NO: 1567307 - protein, 14 aa, Staphylococcus aureus
AKEIEKTKDVSAQK

SEQ ID NO: 1567308 - protein, 8 aa, Staphylococcus aureus
AKRYKNEY

SEQ ID NO: 1567309 - protein, 10 aa, Staphylococcus aureus
AKSNRPGVLD

SEQ ID NO: 1567310 - protein, 11 aa, Staphylococcus aureus
AKTPNNDGSGH

SEQ ID NO: 1567311 - protein, 42 aa, Staphylococcus aureus
ALDKVKDNKTTVKFERDGKTKSVELTPKKTEKKLTKVSSETK

SEQ ID NO: 1567312 - protein, 6 aa, Staphylococcus aureus
ALPSGD

SEQ ID NO: 1567313 - protein, 7 aa, Staphylococcus aureus
AMNKPNV

SEQ ID NO: 1567314 - protein, 9 aa, Staphylococcus aureus
ANASKVHGK

SEQ ID NO: 1567315 - protein, 10 aa, Staphylococcus aureus
ANEQQLEQEI

SEQ ID NO: 1567316 - protein, 4 aa, Staphylococcus aureus
ANKG

SEQ ID NO: 1567317 - protein, 9 aa, Staphylococcus aureus
ANQQSDDME

SEQ ID NO: 1567318 - protein, 6 aa, Staphylococcus aureus
ANSEHR

SEQ ID NO: 1567319 - protein, 42 aa, Staphylococcus aureus
ANSNPEMNPSTITQKAEQVNSSKTALNGDENLAAAKQNAKTY

SEQ ID NO: 1567320 - protein, 41 aa, Staphylococcus aureus
ANSNPEMNPSTITQKAEQVNSSKTALNGDENLATAKLNAKT

SEQ ID NO: 1567321 - protein, 9 aa, Staphylococcus aureus
APAPYTFDK

SEQ ID NO: 1567322 - protein, 22 aa, Staphylococcus aureus
APIYQSETNYYSKDLDKSKSGI

SEQ ID NO: 1567323 - protein, 4 aa, Staphylococcus aureus
APSI

SEQ ID NO: 1567324 - protein, 5 aa, Staphylococcus aureus
AQDGR

SEQ ID NO: 1567325 - protein, 10 aa, Staphylococcus aureus
AQSIDEISEQ

SEQ ID NO: 1567326 - protein, 13 aa, Staphylococcus aureus
AQSSNTNSKNIEQ

SEQ ID NO: 1567327 - protein, 12 aa, Staphylococcus aureus
ARPKKPENVENK

SEQ ID NO: 1567328 - protein, 11 aa, Staphylococcus aureus
ARTDDKKYATQ

SEQ ID NO: 1567329 - protein, 4 aa, Staphylococcus aureus
ARTT

SEQ ID NO: 1567330 - protein, 5 aa, Staphylococcus aureus
ASADI

SEQ ID NO: 1567331 - protein, 8 aa, Staphylococcus aureus
ASKATIRN

SEQ ID NO: 1567332 - protein, 173 aa, Staphylococcus aureus
ASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSTSNSGSASTSTSLSNSASASESDSSSTSLSDSTSASMQSSESDSQSTSASLSDSLSTSTSNRMST

SEQ ID NO: 1567333 - protein, 7 aa, Staphylococcus aureus
ATDRRGR

SEQ ID NO: 1567334 - protein, 13 aa, Staphylococcus aureus
ATEKDKANRYKTI

SEQ ID NO: 1567335 - protein, 8 aa, Staphylococcus aureus
AVDNFKAS

SEQ ID NO: 1567336 - protein, 9 aa, Staphylococcus aureus
AVKSPAIAF

SEQ ID NO: 1567337 - protein, 5 aa, Staphylococcus aureus
AVQAT

SEQ ID NO: 1567338 - protein, 4 aa, Staphylococcus aureus
AYND

SEQ ID NO: 1567339 - protein, 12 aa, Staphylococcus aureus
AYVDPDSEQKIQ

SEQ ID NO: 1567340 - protein, 12 aa, Staphylococcus aureus
DALKGKAYTSAK

SEQ ID NO: 1567341 - protein, 38 aa, Staphylococcus aureus
DANGINHGGSEMVQNKTGHMSQQGHMNQNTHMNQQPHM

SEQ ID NO: 1567342 - protein, 15 aa, Staphylococcus aureus
DAQAASEKDTEISTE

SEQ ID NO: 1567343 - protein, 18 aa, Staphylococcus aureus
DAQKANLTSQIESGTTVA

SEQ ID NO: 1567344 - protein, 19 aa, Staphylococcus aureus
DAQKANLTSQIESGTTVAG

SEQ ID NO: 1567345 - protein, 6 aa, Staphylococcus aureus
DASTIK

SEQ ID NO: 1567346 - protein, 8 aa, Staphylococcus aureus
DAYGNSET

SEQ ID NO: 1567347 - protein, 4 aa, Staphylococcus aureus
DDLL

SEQ ID NO: 1567348 - protein, 9 aa, Staphylococcus aureus
DDNPDNDIN

SEQ ID NO: 1567349 - protein, 24 aa, Staphylococcus aureus
DDNPDNDINTPSLSKTDDDRKLDE

SEQ ID NO: 1567350 - protein, 58 aa, Staphylococcus aureus
DDVSKKQNSLDSVDQDTEKSKYYEQNSEATLSTKSTDKVESTDMRKLSSDKNKVGHEE

SEQ ID NO: 1567351 - protein, 14 aa, Staphylococcus aureus
DELESNLDQTKESM

SEQ ID NO: 1567352 - protein, 5 aa, Staphylococcus aureus
DFDNK

SEQ ID NO: 1567353 - protein, 5 aa, Staphylococcus aureus
DFTES

SEQ ID NO: 1567354 - protein, 6 aa, Staphylococcus aureus
DGGDSF

SEQ ID NO: 1567355 - protein, 5 aa, Staphylococcus aureus
DIDPT

SEQ ID NO: 1567356 - protein, 8 aa, Staphylococcus aureus
DIPKEQRR

SEQ ID NO: 1567357 - protein, 5 aa, Staphylococcus aureus
DKEYE

SEQ ID NO: 1567358 - protein, 7 aa, Staphylococcus aureus
DKKEVVA

SEQ ID NO: 1567359 - protein, 8 aa, Staphylococcus aureus
DKLTGGKN

SEQ ID NO: 1567360 - protein, 12 aa, Staphylococcus aureus
DKQNYDKSKLKY

SEQ ID NO: 1567361 - protein, 8 aa, Staphylococcus aureus
DLAETPFQ

SEQ ID NO: 1567362 - protein, 4 aa, Staphylococcus aureus
DNDI

SEQ ID NO: 1567363 - protein, 19 aa, Staphylococcus aureus
DNKTNKEVGRTITDDKGGY

SEQ ID NO: 1567364 - protein, 62 aa, Staphylococcus aureus
DNQKNGNKRREQQESMNGNDVKSASVESNANDYSKQPQKASQQEHQVRETRQRKDIQRSPQV

SEQ ID NO: 1567365 - protein, 13 aa, Staphylococcus aureus
DNYGGGKAITVQK

SEQ ID NO: 1567366 - protein, 35 aa, Staphylococcus aureus
DRHSGIKNTTITTLPNGWTSNLTKADKNNGSLSIT

SEQ ID NO: 1567367 - protein, 7 aa, Staphylococcus aureus
DRSKKKR

SEQ ID NO: 1567368 - protein, 8 aa, Staphylococcus aureus
DSDLPQPE

SEQ ID NO: 1567369 - protein, 177 aa, Staphylococcus aureus
DSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESTSTSDSISEAISASEST

SEQ ID NO: 1567370 - protein, 11 aa, Staphylococcus aureus
DSTSDDFSTPK

SEQ ID NO: 1567371 - protein, 7 aa, Staphylococcus aureus
DTDNQGY

SEQ ID NO: 1567372 - protein, 4 aa, Staphylococcus aureus
DTTF

SEQ ID NO: 1567373 - protein, 4 aa, Staphylococcus aureus
DTYT

SEQ ID NO: 1567374 - protein, 33 aa, Staphylococcus aureus
DVNSATSAVTTNKNALNGDEKLAQSKTDAASAI

SEQ ID NO: 1567375 - protein, 12 aa, Staphylococcus aureus
DVNSATSQVNAA

SEQ ID NO: 1567376 - protein, 6 aa, Staphylococcus aureus
EDIEDY

SEQ ID NO: 1567377 - protein, 17 aa, Staphylococcus aureus
EDVTSQFDNKKSFSNNV

SEQ ID NO: 1567378 - protein, 5 aa, Staphylococcus aureus
EETGK

SEQ ID NO: 1567379 - protein, 7 aa, Staphylococcus aureus
EETTKEK

SEQ ID NO: 1567380 - protein, 9 aa, Staphylococcus aureus
EGGEMLSGG

SEQ ID NO: 1567381 - protein, 16 aa, Staphylococcus aureus
EGHNNTNKVEPHAGQR

SEQ ID NO: 1567382 - protein, 8 aa, Staphylococcus aureus
EGKEFKTN

SEQ ID NO: 1567383 - protein, 10 aa, Staphylococcus aureus
EGTKAITQKF

SEQ ID NO: 1567384 - protein, 7 aa, Staphylococcus aureus
EINETKT

SEQ ID NO: 1567385 - protein, 6 aa, Staphylococcus aureus
EKEVSI

SEQ ID NO: 1567386 - protein, 6 aa, Staphylococcus aureus
EKLSDV

SEQ ID NO: 1567387 - protein, 6 aa, Staphylococcus aureus
EKNSGE

SEQ ID NO: 1567388 - protein, 5 aa, Staphylococcus aureus
EKRYV

SEQ ID NO: 1567389 - protein, 22 aa, Staphylococcus aureus
EKTDAVSNSAYLDKAKDLDQEQ

SEQ ID NO: 1567390 - protein, 31 aa, Staphylococcus aureus
ELGYEGGQNIGNQSFEEDTEEDKPKYEQGGN

SEQ ID NO: 1567391 - protein, 4 aa, Staphylococcus aureus
EMTA

SEQ ID NO: 1567392 - protein, 4 aa, Staphylococcus aureus
ENQA

SEQ ID NO: 1567393 - protein, 8 aa, Staphylococcus aureus
ENQNYSYE

SEQ ID NO: 1567394 - protein, 5 aa, Staphylococcus aureus
ENSRW

SEQ ID NO: 1567395 - protein, 6 aa, Staphylococcus aureus
ENTKGI

SEQ ID NO: 1567396 - protein, 19 aa, Staphylococcus aureus
ENYELYGKTGTGIVNGKYN

SEQ ID NO: 1567397 - protein, 11 aa, Staphylococcus aureus
EPTSSLDNTTE

SEQ ID NO: 1567398 - protein, 11 aa, Staphylococcus aureus
ERKEASNAKNL

SEQ ID NO: 1567399 - protein, 5 aa, Staphylococcus aureus
ERLNI

SEQ ID NO: 1567400 - protein, 14 aa, Staphylococcus aureus
ESVKQNANSLDGAM

SEQ ID NO: 1567401 - protein, 7 aa, Staphylococcus aureus
ETDRPEL

SEQ ID NO: 1567402 - protein, 15 aa, Staphylococcus aureus
ETVSHAGNAEDPGYY

SEQ ID NO: 1567403 - protein, 8 aa, Staphylococcus aureus
EVNGTSDI

SEQ ID NO: 1567404 - protein, 15 aa, Staphylococcus aureus
EYKANLERAKAQVER

SEQ ID NO: 1567405 - protein, 5 aa, Staphylococcus aureus
EYNGP

SEQ ID NO: 1567406 - protein, 144 aa, Staphylococcus aureus
FAASDAPLTSELNTQSETVGNQNSTTIEASTSTADSTSVTKNSSSEQTSNSDTVSSEKSENVTSTTNSTSNQQEKLTSTSESTSSKNTTSSSDTKSVASTSSTEQQTNISTNQSTASNTTSQSTAPASTHLKQTSTTSTSTAPV

SEQ ID NO: 1567407 - protein, 5 aa, Staphylococcus aureus
FEDVT

SEQ ID NO: 1567408 - protein, 224 aa, Staphylococcus aureus
FEEDTSDSDSDSDSDSDSESDSDSDSESDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1567409 - protein, 10 aa, Staphylococcus aureus
FGVPKGGHSL

SEQ ID NO: 1567410 - protein, 22 aa, Staphylococcus aureus
FKKKTEKRINKNRNSFLKTEKL

SEQ ID NO: 1567411 - protein, 14 aa, Staphylococcus aureus
FKNPTTKNLEGLNE

SEQ ID NO: 1567412 - protein, 13 aa, Staphylococcus aureus
FNDNSKSQIERQR

SEQ ID NO: 1567413 - protein, 7 aa, Staphylococcus aureus
FNGKKSL

SEQ ID NO: 1567414 - protein, 379 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1567415 - protein, 10 aa, Staphylococcus aureus
FPEGLQGQNI

SEQ ID NO: 1567416 - protein, 4 aa, Staphylococcus aureus
FPGY

SEQ ID NO: 1567417 - protein, 8 aa, Staphylococcus aureus
FPKSVTDD

SEQ ID NO: 1567418 - protein, 31 aa, Staphylococcus aureus
FTQADQDKQQAYNNAANQAQQIANGIPTPVL

SEQ ID NO: 1567419 - protein, 7 aa, Staphylococcus aureus
GDETRYG

SEQ ID NO: 1567420 - protein, 6 aa, Staphylococcus aureus
GDRVKA

SEQ ID NO: 1567421 - protein, 28 aa, Staphylococcus aureus
GEAKKLNDSQAPKADAQQNNFNKDQQSA

SEQ ID NO: 1567422 - protein, 87 aa, Staphylococcus aureus
GEAQAAAEETGGTNTEAQPKTEAVASPTTTSEKAPETKPVANAVSVSNKEVEAPTSETKEAKEVKEVKAPKETKAVKPAAKATNNTY

SEQ ID NO: 1567423 - protein, 13 aa, Staphylococcus aureus
GEGIQTEKNVTDI

SEQ ID NO: 1567424 - protein, 10 aa, Staphylococcus aureus
GGAATTFSDT

SEQ ID NO: 1567425 - protein, 10 aa, Staphylococcus aureus
GGEKIPQGHK

SEQ ID NO: 1567426 - protein, 5 aa, Staphylococcus aureus
GGGLI

SEQ ID NO: 1567427 - protein, 6 aa, Staphylococcus aureus
GGKANI

SEQ ID NO: 1567428 - protein, 22 aa, Staphylococcus aureus
GGNYTNASPDKQGAYTDAYNAA

SEQ ID NO: 1567429 - protein, 24 aa, Staphylococcus aureus
GHNDINNALTKEEIEQAKAQLAQA

SEQ ID NO: 1567430 - protein, 24 aa, Staphylococcus aureus
GHNDINNAMTKEEIEQAKAQLAQA

SEQ ID NO: 1567431 - protein, 24 aa, Staphylococcus aureus
GHNDINNAMTKEEIEQAKAQLGQA

SEQ ID NO: 1567432 - protein, 4 aa, Staphylococcus aureus
GIAE

SEQ ID NO: 1567433 - protein, 6 aa, Staphylococcus aureus
GITNYK

SEQ ID NO: 1567434 - protein, 8 aa, Staphylococcus aureus
GKQKQRGV

SEQ ID NO: 1567435 - protein, 9 aa, Staphylococcus aureus
GKSGAGKST

SEQ ID NO: 1567436 - protein, 12 aa, Staphylococcus aureus
GKTDPMEKRTRV

SEQ ID NO: 1567437 - protein, 6 aa, Staphylococcus aureus
GLTGSD

SEQ ID NO: 1567438 - protein, 6 aa, Staphylococcus aureus
GNYKGD

SEQ ID NO: 1567439 - protein, 8 aa, Staphylococcus aureus
GNYRENNR

SEQ ID NO: 1567440 - protein, 8 aa, Staphylococcus aureus
GQSDIDSK

SEQ ID NO: 1567441 - protein, 8 aa, Staphylococcus aureus
GTFNPADT

SEQ ID NO: 1567442 - protein, 6 aa, Staphylococcus aureus
GTNNQN

SEQ ID NO: 1567443 - protein, 4 aa, Staphylococcus aureus
GTRI

SEQ ID NO: 1567444 - protein, 13 aa, Staphylococcus aureus
GVKRRNKQHQEGL

SEQ ID NO: 1567445 - protein, 114 aa, Staphylococcus aureus
HEAKAAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTL

SEQ ID NO: 1567446 - protein, 5 aa, Staphylococcus aureus
HEIKE

SEQ ID NO: 1567447 - protein, 21 aa, Staphylococcus aureus
HGGATNKTQCSYGGVTLSDNN

SEQ ID NO: 1567448 - protein, 9 aa, Staphylococcus aureus
HPTKSHSDI

SEQ ID NO: 1567449 - protein, 75 aa, Staphylococcus aureus
HQAQAAENTNTSDKISENQNNNATTTQPPKDTNQTQPATQPANTAKTYPAADESLKDAIKDPALENKEHDIGPRE

SEQ ID NO: 1567450 - protein, 154 aa, Staphylococcus aureus
HQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSEPSVRTR

SEQ ID NO: 1567451 - protein, 9 aa, Staphylococcus aureus
HSETTKKAF

SEQ ID NO: 1567452 - protein, 54 aa, Staphylococcus aureus
HSTSTSISTSEATTSTSESQSTLSATSEATKHNGTRAQSEERLPDTGDSIKQNG

SEQ ID NO: 1567453 - protein, 12 aa, Staphylococcus aureus
HTAQSNANTLDQ

SEQ ID NO: 1567454 - protein, 43 aa, Staphylococcus aureus
IDKATTDKQQVPPTKEAAHQSGEEAATNVSASAQGTADEINNK

SEQ ID NO: 1567455 - protein, 5 aa, Staphylococcus aureus
IDKTG

SEQ ID NO: 1567456 - protein, 4 aa, Staphylococcus aureus
IDRR

SEQ ID NO: 1567457 - protein, 44 aa, Staphylococcus aureus
IEETQSYNATVTEQPSNATQVTTEEAPKAVQAPQTAQPANIETV

SEQ ID NO: 1567458 - protein, 27 aa, Staphylococcus aureus
IEKVENSMTLKQKDTYKYVGKTGTGIV

SEQ ID NO: 1567459 - protein, 6 aa, Staphylococcus aureus
IENETL

SEQ ID NO: 1567460 - protein, 11 aa, Staphylococcus aureus
IGKSGNTGSMT

SEQ ID NO: 1567461 - protein, 8 aa, Staphylococcus aureus
IGNKLPDP

SEQ ID NO: 1567462 - protein, 40 aa, Staphylococcus aureus
IGQTSSPTMNAQEINQAKDQVTAKQQALNGQENLTNAQIN

SEQ ID NO: 1567463 - protein, 28 aa, Staphylococcus aureus
IHKDEATTKVDSDNTQPPIESKDHVSKK

SEQ ID NO: 1567464 - protein, 7 aa, Staphylococcus aureus
IKKGDKV

SEQ ID NO: 1567465 - protein, 11 aa, Staphylococcus aureus
IKNKGKEALTI

SEQ ID NO: 1567466 - protein, 8 aa, Staphylococcus aureus
IKPEAVDP

SEQ ID NO: 1567467 - protein, 12 aa, Staphylococcus aureus
IKPTDGSDKKHQ

SEQ ID NO: 1567468 - protein, 11 aa, Staphylococcus aureus
IKTDKTIEDSI

SEQ ID NO: 1567469 - protein, 17 aa, Staphylococcus aureus
IKVEGLSKKQKVQAQIT

SEQ ID NO: 1567470 - protein, 14 aa, Staphylococcus aureus
INQTSNPTMEPNTI

SEQ ID NO: 1567471 - protein, 5 aa, Staphylococcus aureus
IPKDR

SEQ ID NO: 1567472 - protein, 8 aa, Staphylococcus aureus
IQPAQGVK

SEQ ID NO: 1567473 - protein, 6 aa, Staphylococcus aureus
IQSNHQ

SEQ ID NO: 1567474 - protein, 9 aa, Staphylococcus aureus
IRDKKDKRL

SEQ ID NO: 1567475 - protein, 5 aa, Staphylococcus aureus
IRSDI

SEQ ID NO: 1567476 - protein, 9 aa, Staphylococcus aureus
ISRGTLPNT

SEQ ID NO: 1567477 - protein, 4 aa, Staphylococcus aureus
ISTS

SEQ ID NO: 1567478 - protein, 5 aa, Staphylococcus aureus
ITETF

SEQ ID NO: 1567479 - protein, 29 aa, Staphylococcus aureus
ITISASGKAKDKTFTTQTKTIKASDLKYN

SEQ ID NO: 1567480 - protein, 9 aa, Staphylococcus aureus
ITPDGATIT

SEQ ID NO: 1567481 - protein, 11 aa, Staphylococcus aureus
KAAGQGVTNKI

SEQ ID NO: 1567482 - protein, 7 aa, Staphylococcus aureus
KAMGASP

SEQ ID NO: 1567483 - protein, 5 aa, Staphylococcus aureus
KANYK

SEQ ID NO: 1567484 - protein, 7 aa, Staphylococcus aureus
KASNDAK

SEQ ID NO: 1567485 - protein, 7 aa, Staphylococcus aureus
KASWNKI

SEQ ID NO: 1567486 - protein, 19 aa, Staphylococcus aureus
KATNKNKEIETVDNTNIME

SEQ ID NO: 1567487 - protein, 17 aa, Staphylococcus aureus
KDFNVTKTMDTAKPVEK

SEQ ID NO: 1567488 - protein, 8 aa, Staphylococcus aureus
KDSKAVND

SEQ ID NO: 1567489 - protein, 4 aa, Staphylococcus aureus
KDSL

SEQ ID NO: 1567490 - protein, 47 aa, Staphylococcus aureus
KDSVADNNSIKSGQNYTDATTANKQAYDNAVNAAKGVIGETTNPTMD

SEQ ID NO: 1567491 - protein, 47 aa, Staphylococcus aureus
KDSVADNNTIKSDQNYTDATPANKQAYDNAVNAAKGVIGETTNPTMD

SEQ ID NO: 1567492 - protein, 13 aa, Staphylococcus aureus
KDTTSQINSSKSN

SEQ ID NO: 1567493 - protein, 12 aa, Staphylococcus aureus
KEAIEQAKERLA

SEQ ID NO: 1567494 - protein, 5 aa, Staphylococcus aureus
KEDLA

SEQ ID NO: 1567495 - protein, 5 aa, Staphylococcus aureus
KEKVV

SEQ ID NO: 1567496 - protein, 9 aa, Staphylococcus aureus
KELSSTLTD

SEQ ID NO: 1567497 - protein, 8 aa, Staphylococcus aureus
KENKNNEL

SEQ ID NO: 1567498 - protein, 9 aa, Staphylococcus aureus
KENTVTEPK

SEQ ID NO: 1567499 - protein, 7 aa, Staphylococcus aureus
KETDKFE

SEQ ID NO: 1567500 - protein, 9 aa, Staphylococcus aureus
KEVNEQFKE

SEQ ID NO: 1567501 - protein, 7 aa, Staphylococcus aureus
KFEDVTD

SEQ ID NO: 1567502 - protein, 6 aa, Staphylococcus aureus
KGAPNS

SEQ ID NO: 1567503 - protein, 6 aa, Staphylococcus aureus
KGEQVG

SEQ ID NO: 1567504 - protein, 9 aa, Staphylococcus aureus
KGFSKSTKL

SEQ ID NO: 1567505 - protein, 13 aa, Staphylococcus aureus
KGFSQKLKENRLK

SEQ ID NO: 1567506 - protein, 9 aa, Staphylococcus aureus
KGKNGEKAK

SEQ ID NO: 1567507 - protein, 6 aa, Staphylococcus aureus
KGLMND

SEQ ID NO: 1567508 - protein, 16 aa, Staphylococcus aureus
KGNEIKEDAKEEQIKK

SEQ ID NO: 1567509 - protein, 21 aa, Staphylococcus aureus
KGQKQIAGKPITKDTAEKVEK

SEQ ID NO: 1567510 - protein, 5 aa, Staphylococcus aureus
KGRMK

SEQ ID NO: 1567511 - protein, 21 aa, Staphylococcus aureus
KGYTLNKGYDVNTKELTDVTN

SEQ ID NO: 1567512 - protein, 4 aa, Staphylococcus aureus
KIST

SEQ ID NO: 1567513 - protein, 12 aa, Staphylococcus aureus
KITNEQQKEFVN

SEQ ID NO: 1567514 - protein, 7 aa, Staphylococcus aureus
KKDNNLL

SEQ ID NO: 1567515 - protein, 7 aa, Staphylococcus aureus
KKDPAVL

SEQ ID NO: 1567516 - protein, 7 aa, Staphylococcus aureus
KKINGTV

SEQ ID NO: 1567517 - protein, 9 aa, Staphylococcus aureus
KKKPGKPLD

SEQ ID NO: 1567518 - protein, 10 aa, Staphylococcus aureus
KKLEDGTTKV

SEQ ID NO: 1567519 - protein, 20 aa, Staphylococcus aureus
KKMERNHARQDGTADTEKGY

SEQ ID NO: 1567520 - protein, 6 aa, Staphylococcus aureus
KKPASI

SEQ ID NO: 1567521 - protein, 7 aa, Staphylococcus aureus
KKPDINV

SEQ ID NO: 1567522 - protein, 11 aa, Staphylococcus aureus
KKTIKENIGDK

SEQ ID NO: 1567523 - protein, 10 aa, Staphylococcus aureus
KLSYEPSSQE

SEQ ID NO: 1567524 - protein, 10 aa, Staphylococcus aureus
KLTAARNKIQ

SEQ ID NO: 1567525 - protein, 6 aa, Staphylococcus aureus
KNADLA

SEQ ID NO: 1567526 - protein, 16 aa, Staphylococcus aureus
KNAPELDENGKNLTIK

SEQ ID NO: 1567527 - protein, 21 aa, Staphylococcus aureus
KNDSSGNSQMVGENIDKSKTN

SEQ ID NO: 1567528 - protein, 5 aa, Staphylococcus aureus
KNGHI

SEQ ID NO: 1567529 - protein, 7 aa, Staphylococcus aureus
KNNHSNK

SEQ ID NO: 1567530 - protein, 6 aa, Staphylococcus aureus
KNQLQK

SEQ ID NO: 1567531 - protein, 15 aa, Staphylococcus aureus
KNSKFDTRKTRSSLS

SEQ ID NO: 1567532 - protein, 30 aa, Staphylococcus aureus
KNSLNDKDTTLGSQNFADADPEKKNAYNEA

SEQ ID NO: 1567533 - protein, 7 aa, Staphylococcus aureus
KNTEAAP

SEQ ID NO: 1567534 - protein, 5 aa, Staphylococcus aureus
KNTMK

SEQ ID NO: 1567535 - protein, 6 aa, Staphylococcus aureus
KNYLRS

SEQ ID NO: 1567536 - protein, 4 aa, Staphylococcus aureus
KPAG

SEQ ID NO: 1567537 - protein, 7 aa, Staphylococcus aureus
KPPTPEL

SEQ ID NO: 1567538 - protein, 11 aa, Staphylococcus aureus
KQDKDTKAPIA

SEQ ID NO: 1567539 - protein, 6 aa, Staphylococcus aureus
KQQAIE

SEQ ID NO: 1567540 - protein, 5 aa, Staphylococcus aureus
KQRHA

SEQ ID NO: 1567541 - protein, 5 aa, Staphylococcus aureus
KQTYT

SEQ ID NO: 1567542 - protein, 8 aa, Staphylococcus aureus
KRDSSLPF

SEQ ID NO: 1567543 - protein, 7 aa, Staphylococcus aureus
KRKVRRD

SEQ ID NO: 1567544 - protein, 8 aa, Staphylococcus aureus
KRNNSDLI

SEQ ID NO: 1567545 - protein, 12 aa, Staphylococcus aureus
KSKFDSKRLSNA

SEQ ID NO: 1567546 - protein, 11 aa, Staphylococcus aureus
KSKSKQPPNKY

SEQ ID NO: 1567547 - protein, 11 aa, Staphylococcus aureus
KSQLDELSSKD

SEQ ID NO: 1567548 - protein, 8 aa, Staphylococcus aureus
KSYNHGDV

SEQ ID NO: 1567549 - protein, 7 aa, Staphylococcus aureus
KSYSPEA

SEQ ID NO: 1567550 - protein, 27 aa, Staphylococcus aureus
KTFTSELGSTLTDGFNDSLTPSVDGHM

SEQ ID NO: 1567551 - protein, 7 aa, Staphylococcus aureus
KTSGNPA

SEQ ID NO: 1567552 - protein, 10 aa, Staphylococcus aureus
KTTEVSTRMD

SEQ ID NO: 1567553 - protein, 10 aa, Staphylococcus aureus
KTVLNGDNNL

SEQ ID NO: 1567554 - protein, 20 aa, Staphylococcus aureus
KVAEANQAKDQLNTARQGLT

SEQ ID NO: 1567555 - protein, 62 aa, Staphylococcus aureus
KVAQSSTTNDEQPASQNVNTKKDSATAATTQPDKEQSKHKQNESQSANKNGNDNRAAHVENH

SEQ ID NO: 1567556 - protein, 5 aa, Staphylococcus aureus
KVGVA

SEQ ID NO: 1567557 - protein, 6 aa, Staphylococcus aureus
KVPTPN

SEQ ID NO: 1567558 - protein, 6 aa, Staphylococcus aureus
KYHAKN

SEQ ID NO: 1567559 - protein, 29 aa, Staphylococcus aureus
KYTPETTSISGEKVWDDKDNQDGKRPEKV

SEQ ID NO: 1567560 - protein, 11 aa, Staphylococcus aureus
LAQSKTDAARA

SEQ ID NO: 1567561 - protein, 9 aa, Staphylococcus aureus
LAVSSEQLK

SEQ ID NO: 1567562 - protein, 8 aa, Staphylococcus aureus
LDDINNKA

SEQ ID NO: 1567563 - protein, 9 aa, Staphylococcus aureus
LEEKENNFD

SEQ ID NO: 1567564 - protein, 8 aa, Staphylococcus aureus
LEELEPNN

SEQ ID NO: 1567565 - protein, 10 aa, Staphylococcus aureus
LESQAGDGSV

SEQ ID NO: 1567566 - protein, 6 aa, Staphylococcus aureus
LGGEDN

SEQ ID NO: 1567567 - protein, 6 aa, Staphylococcus aureus
LGGKDN

SEQ ID NO: 1567568 - protein, 4 aa, Staphylococcus aureus
LGGQ

SEQ ID NO: 1567569 - protein, 5 aa, Staphylococcus aureus
LKKDD

SEQ ID NO: 1567570 - protein, 5 aa, Staphylococcus aureus
LKPEE

SEQ ID NO: 1567571 - protein, 5 aa, Staphylococcus aureus
LLDAN

SEQ ID NO: 1567572 - protein, 9 aa, Staphylococcus aureus
LNAASDTSK

SEQ ID NO: 1567573 - protein, 10 aa, Staphylococcus aureus
LNADPKNADY

SEQ ID NO: 1567574 - protein, 13 aa, Staphylococcus aureus
LNKKADFHKNSEK

SEQ ID NO: 1567575 - protein, 51 aa, Staphylococcus aureus
LNQAKNDLNGDNKVAQAKETAKRALASYSNLNNAQSTAATSQIDNATTVAG

SEQ ID NO: 1567576 - protein, 4 aa, Staphylococcus aureus
LNQL

SEQ ID NO: 1567577 - protein, 4 aa, Staphylococcus aureus
LPQF

SEQ ID NO: 1567578 - protein, 4 aa, Staphylococcus aureus
LPVS

SEQ ID NO: 1567579 - protein, 7 aa, Staphylococcus aureus
LQQQGKK

SEQ ID NO: 1567580 - protein, 12 aa, Staphylococcus aureus
LQSQKSEIQKNH

SEQ ID NO: 1567581 - protein, 7 aa, Staphylococcus aureus
LRKDAVN

SEQ ID NO: 1567582 - protein, 9 aa, Staphylococcus aureus
LSAARTKIQ

SEQ ID NO: 1567583 - protein, 6 aa, Staphylococcus aureus
LSKNQA

SEQ ID NO: 1567584 - protein, 16 aa, Staphylococcus aureus
LSSSLSEKTTAQLEEE

SEQ ID NO: 1567585 - protein, 8 aa, Staphylococcus aureus
LTAARNKI

SEQ ID NO: 1567586 - protein, 4 aa, Staphylococcus aureus
LTGS

SEQ ID NO: 1567587 - protein, 5 aa, Staphylococcus aureus
LTRAN

SEQ ID NO: 1567588 - protein, 106 aa, Staphylococcus aureus
LVKSDTNDAVVTNDQSSSVASNQTNTNTSNQNTSTINNANNQPQATTNMSQPAQPKSSTNADQASSQPAHETNSNGNTNDKTNESSNQSDVNQQYPPADESLQDAI

SEQ ID NO: 1567589 - protein, 14 aa, Staphylococcus aureus
MGGNEPTNNPTLQY

SEQ ID NO: 1567590 - protein, 5 aa, Staphylococcus aureus
MKPTN

SEQ ID NO: 1567591 - protein, 6 aa, Staphylococcus aureus
MLPEDT

SEQ ID NO: 1567592 - protein, 10 aa, Staphylococcus aureus
MNTGEGGLSE

SEQ ID NO: 1567593 - protein, 16 aa, Staphylococcus aureus
MSMSTSESNSMHPSDS

SEQ ID NO: 1567594 - protein, 26 aa, Staphylococcus aureus
MSQSTSGSTSVSTSESLSDSTSTSLS

SEQ ID NO: 1567595 - protein, 9 aa, Staphylococcus aureus
MTKEEIEHA

SEQ ID NO: 1567596 - protein, 22 aa, Staphylococcus aureus
NAETLNKASRAINRATKLDNAM

SEQ ID NO: 1567597 - protein, 8 aa, Staphylococcus aureus
NAPQTTTH

SEQ ID NO: 1567598 - protein, 8 aa, Staphylococcus aureus
NATKATVE

SEQ ID NO: 1567599 - protein, 9 aa, Staphylococcus aureus
NAYHKDSED

SEQ ID NO: 1567600 - protein, 49 aa, Staphylococcus aureus
NDAAKKQINNYTSQQVSNKKNDAWRDASATEIKSAMDSGTFIDNEKQKY

SEQ ID NO: 1567601 - protein, 14 aa, Staphylococcus aureus
NDENITVNESVPRG

SEQ ID NO: 1567602 - protein, 23 aa, Staphylococcus aureus
NDKTGGKNSPGGSGSENARRAIR

SEQ ID NO: 1567603 - protein, 7 aa, Staphylococcus aureus
NDPHRSH

SEQ ID NO: 1567604 - protein, 4 aa, Staphylococcus aureus
NDTY

SEQ ID NO: 1567605 - protein, 8 aa, Staphylococcus aureus
NEAVQGDT

SEQ ID NO: 1567606 - protein, 24 aa, Staphylococcus aureus
NELDSKENKSSHTEMNGQSDIDSK

SEQ ID NO: 1567607 - protein, 6 aa, Staphylococcus aureus
NEVEGA

SEQ ID NO: 1567608 - protein, 20 aa, Staphylococcus aureus
NEVSSKVDRGQQSGEDDLNA

SEQ ID NO: 1567609 - protein, 6 aa, Staphylococcus aureus
NGKVDG

SEQ ID NO: 1567610 - protein, 4 aa, Staphylococcus aureus
NGNY

SEQ ID NO: 1567611 - protein, 56 aa, Staphylococcus aureus
NGPTDVAGANAPGKDDKNSASGSDKGSDGATTGQSESNSSNKDKVENPQTNAGTPA

SEQ ID NO: 1567612 - protein, 10 aa, Staphylococcus aureus
NGQPIPSGTF

SEQ ID NO: 1567613 - protein, 13 aa, Staphylococcus aureus
NHFSKNEKKQLSS

SEQ ID NO: 1567614 - protein, 7 aa, Staphylococcus aureus
NINSTEL

SEQ ID NO: 1567615 - protein, 13 aa, Staphylococcus aureus
NITNPARNNPSYL

SEQ ID NO: 1567616 - protein, 18 aa, Staphylococcus aureus
NKATSNQDVSQVQTAGNH

SEQ ID NO: 1567617 - protein, 6 aa, Staphylococcus aureus
NKEKSQ

SEQ ID NO: 1567618 - protein, 7 aa, Staphylococcus aureus
NKLGHKS

SEQ ID NO: 1567619 - protein, 6 aa, Staphylococcus aureus
NKNPKY

SEQ ID NO: 1567620 - protein, 5 aa, Staphylococcus aureus
NKTIE

SEQ ID NO: 1567621 - protein, 12 aa, Staphylococcus aureus
NLPENDKNGKTI

SEQ ID NO: 1567622 - protein, 5 aa, Staphylococcus aureus
NNEVI

SEQ ID NO: 1567623 - protein, 14 aa, Staphylococcus aureus
NNQNENKELKEKAN

SEQ ID NO: 1567624 - protein, 6 aa, Staphylococcus aureus
NNSSGD

SEQ ID NO: 1567625 - protein, 15 aa, Staphylococcus aureus
NNWDSNARAGTPSRG

SEQ ID NO: 1567626 - protein, 4 aa, Staphylococcus aureus
NPEK

SEQ ID NO: 1567627 - protein, 11 aa, Staphylococcus aureus
NPNQQLPQSNR

SEQ ID NO: 1567628 - protein, 103 aa, Staphylococcus aureus
NQEAKAAENTSTENAKQDDATTSDNKEVVSETENNSTTENNSTNPIKKETNTDSQPEAKKESTSSSTQKQQNNVTATTETKPQNIEKENVKPSTDKTATEDTS

SEQ ID NO: 1567629 - protein, 13 aa, Staphylococcus aureus
NQGGESNRYSTDP

SEQ ID NO: 1567630 - protein, 14 aa, Staphylococcus aureus
NQSQSSYKKYQDAV

SEQ ID NO: 1567631 - protein, 8 aa, Staphylococcus aureus
NSNVPSYD

SEQ ID NO: 1567632 - protein, 4 aa, Staphylococcus aureus
NSNY

SEQ ID NO: 1567633 - protein, 13 aa, Staphylococcus aureus
NSTNRPNNARERN

SEQ ID NO: 1567634 - protein, 37 aa, Staphylococcus aureus
NTDKNHTGKAAKLDGVRQNYNNTDKVTDKKTTEHLPS

SEQ ID NO: 1567635 - protein, 31 aa, Staphylococcus aureus
NTEKPIETTSISGEKVWDDKDNQDGKRPEKV

SEQ ID NO: 1567636 - protein, 7 aa, Staphylococcus aureus
NTKSKEQ

SEQ ID NO: 1567637 - protein, 11 aa, Staphylococcus aureus
NVGESKTVGRY

SEQ ID NO: 1567638 - protein, 4 aa, Staphylococcus aureus
NYAS

SEQ ID NO: 1567639 - protein, 16 aa, Staphylococcus aureus
NYINADDNLKANYDNA

SEQ ID NO: 1567640 - protein, 5 aa, Staphylococcus aureus
NYLRS

SEQ ID NO: 1567641 - protein, 5 aa, Staphylococcus aureus
NYPVN

SEQ ID NO: 1567642 - protein, 24 aa, Staphylococcus aureus
PAGLKQTGTNTTEDDKDADGGEVD

SEQ ID NO: 1567643 - protein, 20 aa, Staphylococcus aureus
PANQLKSPEKIKEELDKKEG

SEQ ID NO: 1567644 - protein, 17 aa, Staphylococcus aureus
PDDGVKPADSTQKKAYD

SEQ ID NO: 1567645 - protein, 10 aa, Staphylococcus aureus
PDVNSGGTIG

SEQ ID NO: 1567646 - protein, 23 aa, Staphylococcus aureus
PEGYDTNVGSVGDKLSGGEKQRV

SEQ ID NO: 1567647 - protein, 13 aa, Staphylococcus aureus
PENVTKTGNVTLT

SEQ ID NO: 1567648 - protein, 15 aa, Staphylococcus aureus
PEYQTVNAAKTATVT

SEQ ID NO: 1567649 - protein, 9 aa, Staphylococcus aureus
PIDKKSSFR

SEQ ID NO: 1567650 - protein, 21 aa, Staphylococcus aureus
PLTGEKVGEGQPTEEITKQPI

SEQ ID NO: 1567651 - protein, 5 aa, Staphylococcus aureus
PNANQ

SEQ ID NO: 1567652 - protein, 20 aa, Staphylococcus aureus
PQGATNVSKHQDAHGQDDAH

SEQ ID NO: 1567653 - protein, 12 aa, Staphylococcus aureus
PRKGRKNLNASN

SEQ ID NO: 1567654 - protein, 11 aa, Staphylococcus aureus
PSISDDKDNVM

SEQ ID NO: 1567655 - protein, 4 aa, Staphylococcus aureus
PSSK

SEQ ID NO: 1567656 - protein, 10 aa, Staphylococcus aureus
PYKSDDTDVE

SEQ ID NO: 1567657 - protein, 20 aa, Staphylococcus aureus
QAVTTAKDNLHGDQKLARDQ

SEQ ID NO: 1567658 - protein, 14 aa, Staphylococcus aureus
QDDNQNTTPVDKAE

SEQ ID NO: 1567659 - protein, 14 aa, Staphylococcus aureus
QDFPAGNGSSASDY

SEQ ID NO: 1567660 - protein, 36 aa, Staphylococcus aureus
QDKEAAASEQKTTTVEENGNSATDNKTSETQTTATN

SEQ ID NO: 1567661 - protein, 83 aa, Staphylococcus aureus
QDKEAAASEQKTTTVEENGNSATDNKVSETQTTTTNVNTIDETQSYSATATEQPSNATQVTTEEAPKAVQAPQTAQPANVETV

SEQ ID NO: 1567662 - protein, 8 aa, Staphylococcus aureus
QDNSDHNH

SEQ ID NO: 1567663 - protein, 11 aa, Staphylococcus aureus
QEEEFNQRRDE

SEQ ID NO: 1567664 - protein, 11 aa, Staphylococcus aureus
QGGYDLTPQQK

SEQ ID NO: 1567665 - protein, 24 aa, Staphylococcus aureus
QGITGNEGRTKGSTNYVNADTQVK

SEQ ID NO: 1567666 - protein, 9 aa, Staphylococcus aureus
QGKENVTHN

SEQ ID NO: 1567667 - protein, 5 aa, Staphylococcus aureus
QGTHN

SEQ ID NO: 1567668 - protein, 22 aa, Staphylococcus aureus
QHKETHQGTITDKYNKRQDKED

SEQ ID NO: 1567669 - protein, 14 aa, Staphylococcus aureus
QKQKKEGKNPVFKP

SEQ ID NO: 1567670 - protein, 10 aa, Staphylococcus aureus
QLENKNTNDR

SEQ ID NO: 1567671 - protein, 8 aa, Staphylococcus aureus
QLQATTEG

SEQ ID NO: 1567672 - protein, 11 aa, Staphylococcus aureus
QQFKNQPKNEI

SEQ ID NO: 1567673 - protein, 4 aa, Staphylococcus aureus
QQRL

SEQ ID NO: 1567674 - protein, 4 aa, Staphylococcus aureus
QRCD

SEQ ID NO: 1567675 - protein, 10 aa, Staphylococcus aureus
QRELTRAKSM

SEQ ID NO: 1567676 - protein, 6 aa, Staphylococcus aureus
QRTSQI

SEQ ID NO: 1567677 - protein, 35 aa, Staphylococcus aureus
QSIADNATTKQNQNYTDASPNKKDAYNNAVTTAQG

SEQ ID NO: 1567678 - protein, 35 aa, Staphylococcus aureus
QSIASKDATKSSEDYQDANADLQNAYNDAVTNAEG

SEQ ID NO: 1567679 - protein, 24 aa, Staphylococcus aureus
QSVTSTENALNGDANLQRAKTEAI

SEQ ID NO: 1567680 - protein, 12 aa, Staphylococcus aureus
QTVQSNANTLDQ

SEQ ID NO: 1567681 - protein, 12 aa, Staphylococcus aureus
QTVRDNAQTLNT

SEQ ID NO: 1567682 - protein, 27 aa, Staphylococcus aureus
QVANAKGALNGNHNLEQAKSNANTTIN

SEQ ID NO: 1567683 - protein, 26 aa, Staphylococcus aureus
QVNATKAALNGTQNLEKAKQHANTAI

SEQ ID NO: 1567684 - protein, 4 aa, Staphylococcus aureus
QYTP

SEQ ID NO: 1567685 - protein, 7 aa, Staphylococcus aureus
RAGAVSG

SEQ ID NO: 1567686 - protein, 6 aa, Staphylococcus aureus
RCNDDR

SEQ ID NO: 1567687 - protein, 5 aa, Staphylococcus aureus
RDFSQ

SEQ ID NO: 1567688 - protein, 9 aa, Staphylococcus aureus
RDYTNTEMS

SEQ ID NO: 1567689 - protein, 4 aa, Staphylococcus aureus
RGNQ

SEQ ID NO: 1567690 - protein, 9 aa, Staphylococcus aureus
RGTNNIGKD

SEQ ID NO: 1567691 - protein, 5 aa, Staphylococcus aureus
RINTI

SEQ ID NO: 1567692 - protein, 5 aa, Staphylococcus aureus
RKDIV

SEQ ID NO: 1567693 - protein, 34 aa, Staphylococcus aureus
RKFNPDLAPGTEKVTREGQKGEKTITTPTLKNPL

SEQ ID NO: 1567694 - protein, 5 aa, Staphylococcus aureus
RKNDT

SEQ ID NO: 1567695 - protein, 27 aa, Staphylococcus aureus
RNLTQTNTSDDKVATITSGNKSTNVTV

SEQ ID NO: 1567696 - protein, 5 aa, Staphylococcus aureus
RNNCD

SEQ ID NO: 1567697 - protein, 5 aa, Staphylococcus aureus
RNTKR

SEQ ID NO: 1567698 - protein, 5 aa, Staphylococcus aureus
RPGVT

SEQ ID NO: 1567699 - protein, 7 aa, Staphylococcus aureus
RPHTRYA

SEQ ID NO: 1567700 - protein, 6 aa, Staphylococcus aureus
RQIPGD

SEQ ID NO: 1567701 - protein, 5 aa, Staphylococcus aureus
RQPAF

SEQ ID NO: 1567702 - protein, 16 aa, Staphylococcus aureus
RQSNSETVDVTEDFEE

SEQ ID NO: 1567703 - protein, 9 aa, Staphylococcus aureus
RRNNTSPWV

SEQ ID NO: 1567704 - protein, 26 aa, Staphylococcus aureus
RRRKEDEEDVTVEEKDSLNNGESLDK

SEQ ID NO: 1567705 - protein, 5 aa, Staphylococcus aureus
RSAYE

SEQ ID NO: 1567706 - protein, 15 aa, Staphylococcus aureus
RSHINEVESNNEVNF

SEQ ID NO: 1567707 - protein, 5 aa, Staphylococcus aureus
RTASA

SEQ ID NO: 1567708 - protein, 8 aa, Staphylococcus aureus
RTGSRTFD

SEQ ID NO: 1567709 - protein, 13 aa, Staphylococcus aureus
RVNTAKDALNGDA

SEQ ID NO: 1567710 - protein, 373 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSESDSDSESDSDSDSDSDSDSDSRVTPPNNEQKAPSNPKGEVNHSNKASKQHQTDALPETGDKSENTNAT

SEQ ID NO: 1567711 - protein, 5 aa, Staphylococcus aureus
SASAG

SEQ ID NO: 1567712 - protein, 7 aa, Staphylococcus aureus
SATFRDT

SEQ ID NO: 1567713 - protein, 11 aa, Staphylococcus aureus
SDEKASGENAK

SEQ ID NO: 1567714 - protein, 5 aa, Staphylococcus aureus
SDEKI

SEQ ID NO: 1567715 - protein, 31 aa, Staphylococcus aureus
SDIHNESINKQMEAKAHETAQNADLKTEARS

SEQ ID NO: 1567716 - protein, 23 aa, Staphylococcus aureus
SDLNQTQKNALTQQVNNAQNVQA

SEQ ID NO: 1567717 - protein, 17 aa, Staphylococcus aureus
SDRAKQSSSTGNESNSH

SEQ ID NO: 1567718 - protein, 12 aa, Staphylococcus aureus
SEMEKTSWPTKE

SEQ ID NO: 1567719 - protein, 15 aa, Staphylococcus aureus
SENGSNFSGGQKQQI

SEQ ID NO: 1567720 - protein, 8 aa, Staphylococcus aureus
SESITNPS

SEQ ID NO: 1567721 - protein, 4 aa, Staphylococcus aureus
SGAS

SEQ ID NO: 1567722 - protein, 25 aa, Staphylococcus aureus
SGDKTFEADNTGSMSANQNDNGSIE

SEQ ID NO: 1567723 - protein, 8 aa, Staphylococcus aureus
SGKKLGTI

SEQ ID NO: 1567724 - protein, 15 aa, Staphylococcus aureus
SGSQTDKNGTTEELK

SEQ ID NO: 1567725 - protein, 8 aa, Staphylococcus aureus
SHNPKDYN

SEQ ID NO: 1567726 - protein, 22 aa, Staphylococcus aureus
SINNAQNEALKSQIDSATTVAG

SEQ ID NO: 1567727 - protein, 9 aa, Staphylococcus aureus
SITDAQKNN

SEQ ID NO: 1567728 - protein, 5 aa, Staphylococcus aureus
SKDRT

SEQ ID NO: 1567729 - protein, 8 aa, Staphylococcus aureus
SKEENSEL

SEQ ID NO: 1567730 - protein, 20 aa, Staphylococcus aureus
SKGESKEEITKDPVNELTEF

SEQ ID NO: 1567731 - protein, 8 aa, Staphylococcus aureus
SKNQESIA

SEQ ID NO: 1567732 - protein, 17 aa, Staphylococcus aureus
SLSRKISNKELTIDEAK

SEQ ID NO: 1567733 - protein, 185 aa, Staphylococcus aureus
SMSASTSSSQSTSVSTSLSTSDSISDSTSISISGSQSTVESESTSDSTSISDSESLSTSDSDSTSTSTSDSTSGSTSTSISESLSTSGSGSTSVSDSTSMSESDSTSVSMSQSMSGSTYNSTSVSDSESVSTSTSTSLSTSDSTSTSESLSTSMSGSQSISDSTSTSMSGSTSTSESNSMHPSDS

SEQ ID NO: 1567734 - protein, 10 aa, Staphylococcus aureus
SNAETASLSP

SEQ ID NO: 1567735 - protein, 9 aa, Staphylococcus aureus
SNEKKRVNK

SEQ ID NO: 1567736 - protein, 8 aa, Staphylococcus aureus
SNGSDIAD

SEQ ID NO: 1567737 - protein, 22 aa, Staphylococcus aureus
SNVRKAQRLAKTAVPNEIETDV

SEQ ID NO: 1567738 - protein, 10 aa, Staphylococcus aureus
SPRERQQTLQ

SEQ ID NO: 1567739 - protein, 58 aa, Staphylococcus aureus
SQAHAAETNQPASVVKQKQQSNNEQTENRESQVQNSQNSQNGQSLSATHENEQPNISQ

SEQ ID NO: 1567740 - protein, 11 aa, Staphylococcus aureus
SQLSAGSNMQD

SEQ ID NO: 1567741 - protein, 7 aa, Staphylococcus aureus
SQNKQTV

SEQ ID NO: 1567742 - protein, 8 aa, Staphylococcus aureus
SQQQQIED

SEQ ID NO: 1567743 - protein, 11 aa, Staphylococcus aureus
SRYDNSLEKSK

SEQ ID NO: 1567744 - protein, 10 aa, Staphylococcus aureus
SSESSSNGRI

SEQ ID NO: 1567745 - protein, 8 aa, Staphylococcus aureus
SSGLPTGT

SEQ ID NO: 1567746 - protein, 5 aa, Staphylococcus aureus
SSNAK

SEQ ID NO: 1567747 - protein, 16 aa, Staphylococcus aureus
SSPIAGIDKPNGANIS

SEQ ID NO: 1567748 - protein, 10 aa, Staphylococcus aureus
STGAGGTKPK

SEQ ID NO: 1567749 - protein, 7 aa, Staphylococcus aureus
STNKIGH

SEQ ID NO: 1567750 - protein, 6 aa, Staphylococcus aureus
SVPENV

SEQ ID NO: 1567751 - protein, 12 aa, Staphylococcus aureus
TAGQFGVPSVST

SEQ ID NO: 1567752 - protein, 10 aa, Staphylococcus aureus
TAHAEQDQTW

SEQ ID NO: 1567753 - protein, 30 aa, Staphylococcus aureus
TAPTKQPIVKPKEKTKYEFKSGGKKKTVIA

SEQ ID NO: 1567754 - protein, 18 aa, Staphylococcus aureus
TAQKTHLTNQINSGTTVA

SEQ ID NO: 1567755 - protein, 19 aa, Staphylococcus aureus
TAQKTNLTNQINSGTTVAG

SEQ ID NO: 1567756 - protein, 26 aa, Staphylococcus aureus
TDITQHDTEVDNVDNTSKHSHLNKPS

SEQ ID NO: 1567757 - protein, 7 aa, Staphylococcus aureus
TDRFDGK

SEQ ID NO: 1567758 - protein, 21 aa, Staphylococcus aureus
TDSTGVATTYTSSSTADNAAK

SEQ ID NO: 1567759 - protein, 7 aa, Staphylococcus aureus
TFSTGEK

SEQ ID NO: 1567760 - protein, 14 aa, Staphylococcus aureus
TGINSLRNEEISHG

SEQ ID NO: 1567761 - protein, 4 aa, Staphylococcus aureus
TGLD

SEQ ID NO: 1567762 - protein, 16 aa, Staphylococcus aureus
THSHSHNHHAHHHAHA

SEQ ID NO: 1567763 - protein, 30 aa, Staphylococcus aureus
TIKGVSSKEKDNKYNDKYEFGKKTEYDESK

SEQ ID NO: 1567764 - protein, 15 aa, Staphylococcus aureus
TKELNKAYKKKDYKY

SEQ ID NO: 1567765 - protein, 13 aa, Staphylococcus aureus
TKEQTKSFNEGVS

SEQ ID NO: 1567766 - protein, 14 aa, Staphylococcus aureus
TKPENPLKELPKTG

SEQ ID NO: 1567767 - protein, 5 aa, Staphylococcus aureus
TNGDF

SEQ ID NO: 1567768 - protein, 5 aa, Staphylococcus aureus
TNNKK

SEQ ID NO: 1567769 - protein, 57 aa, Staphylococcus aureus
TNRGTVSSGREGSDRALEGTAVSSKSGKQLASMSAPKGSTHEKQLPKTGNNQSSSPA

SEQ ID NO: 1567770 - protein, 26 aa, Staphylococcus aureus
TPAGYTPTVKNTTADDKDSNGLTTTG

SEQ ID NO: 1567771 - protein, 8 aa, Staphylococcus aureus
TPDTVTQA

SEQ ID NO: 1567772 - protein, 4 aa, Staphylococcus aureus
TPIP

SEQ ID NO: 1567773 - protein, 19 aa, Staphylococcus aureus
TRDGETIEYDHTSHKAMSD

SEQ ID NO: 1567774 - protein, 17 aa, Staphylococcus aureus
TRNESVDSNDSATVTVT

SEQ ID NO: 1567775 - protein, 5 aa, Staphylococcus aureus
TRRQR

SEQ ID NO: 1567776 - protein, 4 aa, Staphylococcus aureus
TSKN

SEQ ID NO: 1567777 - protein, 14 aa, Staphylococcus aureus
TSTANRNETTSSGM

SEQ ID NO: 1567778 - protein, 15 aa, Staphylococcus aureus
TTKDDGIVQPNITED

SEQ ID NO: 1567779 - protein, 6 aa, Staphylococcus aureus
TTKKSP

SEQ ID NO: 1567780 - protein, 9 aa, Staphylococcus aureus
TTYKGNEVV

SEQ ID NO: 1567781 - protein, 11 aa, Staphylococcus aureus
TYPDEDKQYFS

SEQ ID NO: 1567782 - protein, 33 aa, Staphylococcus aureus
VADKEQVKRTEDYADADTAKQNAYNSAVSSAET

SEQ ID NO: 1567783 - protein, 18 aa, Staphylococcus aureus
VAQPRTASESKPRVTRSA

SEQ ID NO: 1567784 - protein, 37 aa, Staphylococcus aureus
VDKTVKTKEKAGTPSKENKLSQSKMLPKTGETTSSQS

SEQ ID NO: 1567785 - protein, 18 aa, Staphylococcus aureus
VEIDGDASGLKRNVATSK

SEQ ID NO: 1567786 - protein, 7 aa, Staphylococcus aureus
VGESTEN

SEQ ID NO: 1567787 - protein, 9 aa, Staphylococcus aureus
VGKKAEPVK

SEQ ID NO: 1567788 - protein, 5 aa, Staphylococcus aureus
VGSAI

SEQ ID NO: 1567789 - protein, 5 aa, Staphylococcus aureus
VLDQP

SEQ ID NO: 1567790 - protein, 12 aa, Staphylococcus aureus
VMNPAKQPATGK

SEQ ID NO: 1567791 - protein, 50 aa, Staphylococcus aureus
VNEAKQALNGNDNVQRAKDAAKQVITNANDLNQAQKDALKQQVDAAQTVA

SEQ ID NO: 1567792 - protein, 17 aa, Staphylococcus aureus
VNKRKQAKQQIQATPTH

SEQ ID NO: 1567793 - protein, 34 aa, Staphylococcus aureus
VNQKAETVKSTKGALDGQQNLQRAKTEATNAITH

SEQ ID NO: 1567794 - protein, 6 aa, Staphylococcus aureus
VRGKDD

SEQ ID NO: 1567795 - protein, 4 aa, Staphylococcus aureus
VSDE

SEQ ID NO: 1567796 - protein, 10 aa, Staphylococcus aureus
VSREDQDAYA

SEQ ID NO: 1567797 - protein, 38 aa, Staphylococcus aureus
VTYNAPSNKPSTAVSTTVNETRDVDTQQASTQKLTHTT

SEQ ID NO: 1567798 - protein, 17 aa, Staphylococcus aureus
YDKEGYRDSEFKKGDKG

SEQ ID NO: 1567799 - protein, 13 aa, Staphylococcus aureus
YFPKKNKSFGNAP

SEQ ID NO: 1567800 - protein, 25 aa, Staphylococcus aureus
YHNTSKPNSAAKANADPSSVAGGGA

SEQ ID NO: 1567801 - protein, 111 aa, Staphylococcus aureus
YNDPSLVKSDTNDAVATNDQSSSDASNQTNTNTSNQNTSTTNNTNDQPQATNNMSQPAQPKASANSDQASSQPAHETNSNDNTNDVTNASSNQSNGNQQYPPADESLQDAI

SEQ ID NO: 1567802 - protein, 5 aa, Staphylococcus aureus
YNGDT

SEQ ID NO: 1567803 - protein, 5 aa, Staphylococcus aureus
YPKDE

SEQ ID NO: 1567804 - protein, 8 aa, Staphylococcus aureus
YPKSKRKS

SEQ ID NO: 1567805 - protein, 14 aa, Staphylococcus aureus
YSAPPKPPNPNYPF

SEQ ID NO: 1567806 - protein, 6 aa, Staphylococcus aureus
YTGLKK

SEQ ID NO: 1567807 - protein, 79 aa, Staphylococcus aureus
AAASEQKTTTVEENGNSATENKVNETQTTTTNVNTIDETQSYSATATEQPSNATQVTTEEAPKAVQAPQTAQPANLETV

SEQ ID NO: 1567808 - protein, 162 aa, Staphylococcus aureus
AAASEQNNTTVEESGSSATERKASETQTTTNNVNTIDETQSYSATSTEQPSQSTQVTTEEAPTTVQAPKVETSRVDLPSEKVADKETTGTQVDTAQPSNVSEIKPRMKRSTDVTAVTEKEVVEEAKATGTDVTSKVEVEEGSEIVGHNNKETNVVNPHNAER

SEQ ID NO: 1567809 - protein, 17 aa, Staphylococcus aureus
AADAKGTNVNDKVTAKD

SEQ ID NO: 1567810 - protein, 15 aa, Staphylococcus aureus
AADGSFYGSDAGAGF

SEQ ID NO: 1567811 - protein, 7 aa, Staphylococcus aureus
AAGQLGK

SEQ ID NO: 1567812 - protein, 5 aa, Staphylococcus aureus
AAQNH

SEQ ID NO: 1567813 - protein, 9 aa, Staphylococcus aureus
AASGPASDW

SEQ ID NO: 1567814 - protein, 14 aa, Staphylococcus aureus
AAVKQTAKSDIGRL

SEQ ID NO: 1567815 - protein, 18 aa, Staphylococcus aureus
ADDEATKEEEAEAEAQQV

SEQ ID NO: 1567816 - protein, 11 aa, Staphylococcus aureus
ADETLKNKGFK

SEQ ID NO: 1567817 - protein, 7 aa, Staphylococcus aureus
ADKPGFA

SEQ ID NO: 1567818 - protein, 16 aa, Staphylococcus aureus
ADKYPAQQAGLQKGDK

SEQ ID NO: 1567819 - protein, 11 aa, Staphylococcus aureus
ADNTPKTNKLA

SEQ ID NO: 1567820 - protein, 7 aa, Staphylococcus aureus
ADSNTVY

SEQ ID NO: 1567821 - protein, 5 aa, Staphylococcus aureus
AEGLS

SEQ ID NO: 1567822 - protein, 16 aa, Staphylococcus aureus
AEKAASVAKGALNAAK

SEQ ID NO: 1567823 - protein, 10 aa, Staphylococcus aureus
AEKKNLDNKE

SEQ ID NO: 1567824 - protein, 20 aa, Staphylococcus aureus
AENNIENPTTLKDNVQSKEV

SEQ ID NO: 1567825 - protein, 7 aa, Staphylococcus aureus
AGEHADK

SEQ ID NO: 1567826 - protein, 13 aa, Staphylococcus aureus
AGETKDPVKTIPK

SEQ ID NO: 1567827 - protein, 4 aa, Staphylococcus aureus
AGLT

SEQ ID NO: 1567828 - protein, 26 aa, Staphylococcus aureus
AGSPTVEQINTNTSAANQAKSDLDHA

SEQ ID NO: 1567829 - protein, 9 aa, Staphylococcus aureus
AGTDVAVDS

SEQ ID NO: 1567830 - protein, 7 aa, Staphylococcus aureus
AIGPTAT

SEQ ID NO: 1567831 - protein, 42 aa, Staphylococcus aureus
AINGASDLNQKQKDALKAQANGAQRVSNAQDVQHNATELNTA

SEQ ID NO: 1567832 - protein, 7 aa, Staphylococcus aureus
AIPQLNE

SEQ ID NO: 1567833 - protein, 17 aa, Staphylococcus aureus
AIQDESSYQVDGSTFRN

SEQ ID NO: 1567834 - protein, 9 aa, Staphylococcus aureus
AKATNTMNN

SEQ ID NO: 1567835 - protein, 8 aa, Staphylococcus aureus
AKKESKAL

SEQ ID NO: 1567836 - protein, 9 aa, Staphylococcus aureus
AKLNAEQKE

SEQ ID NO: 1567837 - protein, 4 aa, Staphylococcus aureus
AKPQ

SEQ ID NO: 1567838 - protein, 18 aa, Staphylococcus aureus
AKQDDTVRQSEQKPQVGD

SEQ ID NO: 1567839 - protein, 5 aa, Staphylococcus aureus
AKRPL

SEQ ID NO: 1567840 - protein, 17 aa, Staphylococcus aureus
AKSALSNNSISKDNKLK

SEQ ID NO: 1567841 - protein, 10 aa, Staphylococcus aureus
AKSKKLNKNT

SEQ ID NO: 1567842 - protein, 11 aa, Staphylococcus aureus
AKSNKPGEIDD

SEQ ID NO: 1567843 - protein, 8 aa, Staphylococcus aureus
AKTNATQA

SEQ ID NO: 1567844 - protein, 9 aa, Staphylococcus aureus
AKTNGKHDI

SEQ ID NO: 1567845 - protein, 5 aa, Staphylococcus aureus
ALGGP

SEQ ID NO: 1567846 - protein, 5 aa, Staphylococcus aureus
ALNRA

SEQ ID NO: 1567847 - protein, 5 aa, Staphylococcus aureus
ALPNG

SEQ ID NO: 1567848 - protein, 26 aa, Staphylococcus aureus
ANELDSKENKSSHTEMNGQSDIDSKL

SEQ ID NO: 1567849 - protein, 9 aa, Staphylococcus aureus
ANEQQLEQA

SEQ ID NO: 1567850 - protein, 15 aa, Staphylococcus aureus
ANRQDEPNDKKTTSV

SEQ ID NO: 1567851 - protein, 6 aa, Staphylococcus aureus
AQQGNS

SEQ ID NO: 1567852 - protein, 18 aa, Staphylococcus aureus
AQVEAQRMAESGWGKTSK

SEQ ID NO: 1567853 - protein, 11 aa, Staphylococcus aureus
ARKLNKNNGKV

SEQ ID NO: 1567854 - protein, 5 aa, Staphylococcus aureus
ASAIE

SEQ ID NO: 1567855 - protein, 8 aa, Staphylococcus aureus
ASKKQKNE

SEQ ID NO: 1567856 - protein, 7 aa, Staphylococcus aureus
ATRNALE

SEQ ID NO: 1567857 - protein, 6 aa, Staphylococcus aureus
ATSLSS

SEQ ID NO: 1567858 - protein, 7 aa, Staphylococcus aureus
AVGEDGY

SEQ ID NO: 1567859 - protein, 6 aa, Staphylococcus aureus
AVPAGS

SEQ ID NO: 1567860 - protein, 29 aa, Staphylococcus aureus
AVTRAKAALNGADNLRNAKTSATNTIDGL

SEQ ID NO: 1567861 - protein, 7 aa, Staphylococcus aureus
AYALGGP

SEQ ID NO: 1567862 - protein, 9 aa, Staphylococcus aureus
AYKENESIA

SEQ ID NO: 1567863 - protein, 17 aa, Staphylococcus aureus
CGKGNETKEDSKEEQIK

SEQ ID NO: 1567864 - protein, 10 aa, Staphylococcus aureus
DAEEAAKTKL

SEQ ID NO: 1567865 - protein, 10 aa, Staphylococcus aureus
DAEKHGDKIT

SEQ ID NO: 1567866 - protein, 111 aa, Staphylococcus aureus
DAKKTSKAKKDKQDTEVAAASSNSDNVSYEASATTPATTSSANNDSEENEQSSKDEDKQNASKSDKSSVEKSESNEETATVESAPQSKPVTSEAPPNQNNHNEDSMYDAST

SEQ ID NO: 1567867 - protein, 7 aa, Staphylococcus aureus
DANPAKM

SEQ ID NO: 1567868 - protein, 19 aa, Staphylococcus aureus
DAQKQALKGQIDQSPEIAT

SEQ ID NO: 1567869 - protein, 10 aa, Staphylococcus aureus
DDDEHKRNIT

SEQ ID NO: 1567870 - protein, 6 aa, Staphylococcus aureus
DDGEKN

SEQ ID NO: 1567871 - protein, 15 aa, Staphylococcus aureus
DDHEETSSHITDKEA

SEQ ID NO: 1567872 - protein, 18 aa, Staphylococcus aureus
DDHSNAAMTHTSDAISSS

SEQ ID NO: 1567873 - protein, 4 aa, Staphylococcus aureus
DDIP

SEQ ID NO: 1567874 - protein, 9 aa, Staphylococcus aureus
DDITDDQKV

SEQ ID NO: 1567875 - protein, 11 aa, Staphylococcus aureus
DDLDGKKLDKE

SEQ ID NO: 1567876 - protein, 58 aa, Staphylococcus aureus
DDVSKKQNSLDSVDQDTVKSKYYEQNSEATLSTKSTDKVESTEMRKLSSDKNKVGHEE

SEQ ID NO: 1567877 - protein, 9 aa, Staphylococcus aureus
DEDQKEIVE

SEQ ID NO: 1567878 - protein, 5 aa, Staphylococcus aureus
DEEDD

SEQ ID NO: 1567879 - protein, 11 aa, Staphylococcus aureus
DEFNEKEHQKK

SEQ ID NO: 1567880 - protein, 60 aa, Staphylococcus aureus
DEITTKDQSDDEINTPNVAEDKSQDDLKDDLKEKQQSSNHHQSTQPKTSPSTETNTQQSF

SEQ ID NO: 1567881 - protein, 8 aa, Staphylococcus aureus
DEPTTALD

SEQ ID NO: 1567882 - protein, 20 aa, Staphylococcus aureus
DERAEIATSNQDQQTNSSKR

SEQ ID NO: 1567883 - protein, 13 aa, Staphylococcus aureus
DESKLVDRAGKNY

SEQ ID NO: 1567884 - protein, 25 aa, Staphylococcus aureus
DETGAQEASKDEAKQAAAQKGNPVQ

SEQ ID NO: 1567885 - protein, 16 aa, Staphylococcus aureus
DFDEMEEKYDYHEDNK

SEQ ID NO: 1567886 - protein, 102 aa, Staphylococcus aureus
DFEEDTLPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGK

SEQ ID NO: 1567887 - protein, 5 aa, Staphylococcus aureus
DFTNN

SEQ ID NO: 1567888 - protein, 11 aa, Staphylococcus aureus
DGGEGGTGATF

SEQ ID NO: 1567889 - protein, 7 aa, Staphylococcus aureus
DGIKPGD

SEQ ID NO: 1567890 - protein, 46 aa, Staphylococcus aureus
DGTITGYKKNVDDLAKQYDKVSQEQGENSAGAQKLRQEYNKQANEL

SEQ ID NO: 1567891 - protein, 16 aa, Staphylococcus aureus
DHVDKKSDTSAKDQYH

SEQ ID NO: 1567892 - protein, 13 aa, Staphylococcus aureus
DIKQTTQSLNTAM

SEQ ID NO: 1567893 - protein, 12 aa, Staphylococcus aureus
DISKNQNEKKYR

SEQ ID NO: 1567894 - protein, 9 aa, Staphylococcus aureus
DITDPSGEV

SEQ ID NO: 1567895 - protein, 32 aa, Staphylococcus aureus
DKAKEKRRKENPSSPVQNNQQHVRKRQQTVTP

SEQ ID NO: 1567896 - protein, 13 aa, Staphylococcus aureus
DKANGQNMTKAQV

SEQ ID NO: 1567897 - protein, 16 aa, Staphylococcus aureus
DKEGYRDGEFKKGDKG

SEQ ID NO: 1567898 - protein, 16 aa, Staphylococcus aureus
DKEGYRDSEFKKGDKG

SEQ ID NO: 1567899 - protein, 72 aa, Staphylococcus aureus
DKHKQNADSSETVGYQSQSSASHRITEKRNNAINDHDKLNGQKPNAKTSANNNQKKATSKLNKGRATNNNYS

SEQ ID NO: 1567900 - protein, 8 aa, Staphylococcus aureus
DKKVFSSG

SEQ ID NO: 1567901 - protein, 10 aa, Staphylococcus aureus
DKLLDSDSNK

SEQ ID NO: 1567902 - protein, 14 aa, Staphylococcus aureus
DKLTQNHKGQGHSK

SEQ ID NO: 1567903 - protein, 22 aa, Staphylococcus aureus
DKTDAVSNSAYLDKAKNLDQEQ

SEQ ID NO: 1567904 - protein, 5 aa, Staphylococcus aureus
DKWGR

SEQ ID NO: 1567905 - protein, 7 aa, Staphylococcus aureus
DKYGPRP

SEQ ID NO: 1567906 - protein, 14 aa, Staphylococcus aureus
DLPNANPKSNVIPK

SEQ ID NO: 1567907 - protein, 19 aa, Staphylococcus aureus
DLTNAQKDAAKRQIEGATH

SEQ ID NO: 1567908 - protein, 7 aa, Staphylococcus aureus
DLYQTRN

SEQ ID NO: 1567909 - protein, 5 aa, Staphylococcus aureus
DNDET

SEQ ID NO: 1567910 - protein, 33 aa, Staphylococcus aureus
DNEQPQSAPKEQNGDSNDEETVTKKERKSKVTQ

SEQ ID NO: 1567911 - protein, 6 aa, Staphylococcus aureus
DNEYNS

SEQ ID NO: 1567912 - protein, 8 aa, Staphylococcus aureus
DNGQREEV

SEQ ID NO: 1567913 - protein, 8 aa, Staphylococcus aureus
DNKNDNDK

SEQ ID NO: 1567914 - protein, 15 aa, Staphylococcus aureus
DNLKDNKREDNPKAK

SEQ ID NO: 1567915 - protein, 38 aa, Staphylococcus aureus
DNLNNAQKQTVTDQINGAHTVDEANQIKQNAQNLNTAM

SEQ ID NO: 1567916 - protein, 6 aa, Staphylococcus aureus
DNMPEY

SEQ ID NO: 1567917 - protein, 4 aa, Staphylococcus aureus
DNSY

SEQ ID NO: 1567918 - protein, 5 aa, Staphylococcus aureus
DQDAY

SEQ ID NO: 1567919 - protein, 8 aa, Staphylococcus aureus
DQIQGGQQ

SEQ ID NO: 1567920 - protein, 7 aa, Staphylococcus aureus
DRPSIDG

SEQ ID NO: 1567921 - protein, 7 aa, Staphylococcus aureus
DSEVGHV

SEQ ID NO: 1567922 - protein, 177 aa, Staphylococcus aureus
DSISTSGSLSASDSKSMSVSSSMSTSQSGSTSESLSDSQSTSDSDSKSLSQSTSQSGSTSTSTSTSASVRTSESQSTSGSMSASQSDSMSISTSFSDSTSDSKSASTASSESISQSAFTSTSGSVSTSTSLSTSNSERTSTSMSDSTSLSTSESDSISESTSTSDSISEAISASEST

SEQ ID NO: 1567923 - protein, 9 aa, Staphylococcus aureus
DSKEVTPEV

SEQ ID NO: 1567924 - protein, 5 aa, Staphylococcus aureus
DSKRI

SEQ ID NO: 1567925 - protein, 4 aa, Staphylococcus aureus
DSLK

SEQ ID NO: 1567926 - protein, 9 aa, Staphylococcus aureus
DTENSYDSR

SEQ ID NO: 1567927 - protein, 9 aa, Staphylococcus aureus
DTKENVTAN

SEQ ID NO: 1567928 - protein, 35 aa, Staphylococcus aureus
DTQIAKDTDKGVDNSVGMSSNVDTDKDSNKNKDKV

SEQ ID NO: 1567929 - protein, 39 aa, Staphylococcus aureus
DTQIAKDTDRNVDKGADNSVGMSSNVDTDKDSNKNKDKV

SEQ ID NO: 1567930 - protein, 34 aa, Staphylococcus aureus
DTQIAKDTDRNVDNSVGMSSNVDTDKDSNKNKDK

SEQ ID NO: 1567931 - protein, 25 aa, Staphylococcus aureus
DTSKLSDSYYADPNDSNLKEVTDQF

SEQ ID NO: 1567932 - protein, 7 aa, Staphylococcus aureus
DTTKLEQ

SEQ ID NO: 1567933 - protein, 4 aa, Staphylococcus aureus
DTYI

SEQ ID NO: 1567934 - protein, 17 aa, Staphylococcus aureus
DVDYNSKKTYGKYYNPT

SEQ ID NO: 1567935 - protein, 7 aa, Staphylococcus aureus
DVRTVGD

SEQ ID NO: 1567936 - protein, 33 aa, Staphylococcus aureus
DVTAATQRVNNAETSLNGDSNLATAKQQAKDAL

SEQ ID NO: 1567937 - protein, 9 aa, Staphylococcus aureus
DYKKKGKVG

SEQ ID NO: 1567938 - protein, 5 aa, Staphylococcus aureus
DYNSI

SEQ ID NO: 1567939 - protein, 8 aa, Staphylococcus aureus
DYQSDGNK

SEQ ID NO: 1567940 - protein, 29 aa, Staphylococcus aureus
DYTSRNFENKDNALKQSTSENSSLSKVED

SEQ ID NO: 1567941 - protein, 27 aa, Staphylococcus aureus
DYTSRNFENKDTALKQSTSENSSLSKL

SEQ ID NO: 1567942 - protein, 4 aa, Staphylococcus aureus
EAAI

SEQ ID NO: 1567943 - protein, 19 aa, Staphylococcus aureus
EAIRAVPNSVREASYGLGA

SEQ ID NO: 1567944 - protein, 12 aa, Staphylococcus aureus
EANQDTNGSNEP

SEQ ID NO: 1567945 - protein, 9 aa, Staphylococcus aureus
EDEKLKQKI

SEQ ID NO: 1567946 - protein, 6 aa, Staphylococcus aureus
EDERQR

SEQ ID NO: 1567947 - protein, 9 aa, Staphylococcus aureus
EDSKLKNKI

SEQ ID NO: 1567948 - protein, 5 aa, Staphylococcus aureus
EDVTD

SEQ ID NO: 1567949 - protein, 5 aa, Staphylococcus aureus
EEGYP

SEQ ID NO: 1567950 - protein, 9 aa, Staphylococcus aureus
EEKKVKENI

SEQ ID NO: 1567951 - protein, 9 aa, Staphylococcus aureus
EELDKTNPV

SEQ ID NO: 1567952 - protein, 4 aa, Staphylococcus aureus
EESI

SEQ ID NO: 1567953 - protein, 10 aa, Staphylococcus aureus
EESNNDEGLR

SEQ ID NO: 1567954 - protein, 43 aa, Staphylococcus aureus
EETQSYNATVTEQPSNATQVTTEEAPKAVQAPQTAQPANIETV

SEQ ID NO: 1567955 - protein, 85 aa, Staphylococcus aureus
EETQSYNATVTEQPSNATQVTTEEAPKAVQAPQTAQPANVETVKEEEKPQVKETTQPQDNSGNQRQVDLTPKKVTQNQGTETQVE

SEQ ID NO: 1567956 - protein, 12 aa, Staphylococcus aureus
EEYSKTGDNDYS

SEQ ID NO: 1567957 - protein, 10 aa, Staphylococcus aureus
EFSEEQLNEV

SEQ ID NO: 1567958 - protein, 15 aa, Staphylococcus aureus
EGHNNTNKVEPHAGQ

SEQ ID NO: 1567959 - protein, 11 aa, Staphylococcus aureus
EGVARQPEARG

SEQ ID NO: 1567960 - protein, 7 aa, Staphylococcus aureus
EGVEGHA

SEQ ID NO: 1567961 - protein, 7 aa, Staphylococcus aureus
EIADNAD

SEQ ID NO: 1567962 - protein, 12 aa, Staphylococcus aureus
EIERTPDIASAT

SEQ ID NO: 1567963 - protein, 27 aa, Staphylococcus aureus
EIESPEAGDNHHYDESGEEIKASNKSF

SEQ ID NO: 1567964 - protein, 9 aa, Staphylococcus aureus
EITKDDKKL

SEQ ID NO: 1567965 - protein, 15 aa, Staphylococcus aureus
EITQNMNDTQRSEIN

SEQ ID NO: 1567966 - protein, 60 aa, Staphylococcus aureus
EITTTDQSDDEINTPNVAEEESQDDLKDDLNEKQQPSDHHQSTQPKTSPSTETNKQQSFA

SEQ ID NO: 1567967 - protein, 12 aa, Staphylococcus aureus
EKDDENSKELER

SEQ ID NO: 1567968 - protein, 30 aa, Staphylococcus aureus
EKKKYNKDVEKREKDYKDYLDNKSKEINKA

SEQ ID NO: 1567969 - protein, 6 aa, Staphylococcus aureus
EKLTKI

SEQ ID NO: 1567970 - protein, 7 aa, Staphylococcus aureus
EKQNEWR

SEQ ID NO: 1567971 - protein, 24 aa, Staphylococcus aureus
EKVNELNGDERVAEAKTQAKQNID

SEQ ID NO: 1567972 - protein, 7 aa, Staphylococcus aureus
EMGSTTA

SEQ ID NO: 1567973 - protein, 8 aa, Staphylococcus aureus
ENEFTDDP

SEQ ID NO: 1567974 - protein, 7 aa, Staphylococcus aureus
ENPEEAV

SEQ ID NO: 1567975 - protein, 9 aa, Staphylococcus aureus
EPTSEHGKK

SEQ ID NO: 1567976 - protein, 11 aa, Staphylococcus aureus
EQKHQAVETIN

SEQ ID NO: 1567977 - protein, 7 aa, Staphylococcus aureus
ERKNEIE

SEQ ID NO: 1567978 - protein, 8 aa, Staphylococcus aureus
ESDTIEDT

SEQ ID NO: 1567979 - protein, 7 aa, Staphylococcus aureus
ESGTGYH

SEQ ID NO: 1567980 - protein, 4 aa, Staphylococcus aureus
ESIH

SEQ ID NO: 1567981 - protein, 13 aa, Staphylococcus aureus
ESKDGNEKNQDYK

SEQ ID NO: 1567982 - protein, 7 aa, Staphylococcus aureus
ESQSNHP

SEQ ID NO: 1567983 - protein, 94 aa, Staphylococcus aureus
ESSRTDSDSSMQTEKIKKDSSDGNKSSNLKSEVISDKSNTVPKLSESDDEVNNQKPLTLPEEQKLKRQQSQNEQTKTYTYGDSEQNDKSNYEND

SEQ ID NO: 1567984 - protein, 14 aa, Staphylococcus aureus
ESVKQSANSLDGAM

SEQ ID NO: 1567985 - protein, 19 aa, Staphylococcus aureus
ETPKESMSLEEKEKREKIK

SEQ ID NO: 1567986 - protein, 8 aa, Staphylococcus aureus
ETPTGYLP

SEQ ID NO: 1567987 - protein, 6 aa, Staphylococcus aureus
EYSNKN

SEQ ID NO: 1567988 - protein, 14 aa, Staphylococcus aureus
FARPKKPENVENKS

SEQ ID NO: 1567989 - protein, 10 aa, Staphylococcus aureus
FDEESTKGIL

SEQ ID NO: 1567990 - protein, 184 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1567991 - protein, 200 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1567992 - protein, 202 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1567993 - protein, 208 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1567994 - protein, 51 aa, Staphylococcus aureus
FKKEQSNDENNDSASSRANNNNIDDSTDSNIENEDYRYNQEIDDQNESNGI

SEQ ID NO: 1567995 - protein, 10 aa, Staphylococcus aureus
FKPKSSEYNA

SEQ ID NO: 1567996 - protein, 13 aa, Staphylococcus aureus
FKQTNYKSKHDAI

SEQ ID NO: 1567997 - protein, 16 aa, Staphylococcus aureus
FLSGGKDEIATKKPGM

SEQ ID NO: 1567998 - protein, 435 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANT

SEQ ID NO: 1567999 - protein, 4 aa, Staphylococcus aureus
FQRQ

SEQ ID NO: 1568000 - protein, 24 aa, Staphylococcus aureus
FSNEKINSIRNSEIGTADEKQAAM

SEQ ID NO: 1568001 - protein, 25 aa, Staphylococcus aureus
FSNEKMNSIRNSEIGTADEKQAAMN

SEQ ID NO: 1568002 - protein, 6 aa, Staphylococcus aureus
FSSKGI

SEQ ID NO: 1568003 - protein, 15 aa, Staphylococcus aureus
FSSRKQYDDLSFNFI

SEQ ID NO: 1568004 - protein, 6 aa, Staphylococcus aureus
FSTNEA

SEQ ID NO: 1568005 - protein, 6 aa, Staphylococcus aureus
FTAETR

SEQ ID NO: 1568006 - protein, 7 aa, Staphylococcus aureus
FTTGTVN

SEQ ID NO: 1568007 - protein, 10 aa, Staphylococcus aureus
GAGSDHHIPT

SEQ ID NO: 1568008 - protein, 5 aa, Staphylococcus aureus
GAITE

SEQ ID NO: 1568009 - protein, 11 aa, Staphylococcus aureus
GAKAGPDLADA

SEQ ID NO: 1568010 - protein, 13 aa, Staphylococcus aureus
GDGDLKGSSIGSK

SEQ ID NO: 1568011 - protein, 25 aa, Staphylococcus aureus
GDKVGKPSNNPLMPPVDTGESIGLG

SEQ ID NO: 1568012 - protein, 5 aa, Staphylococcus aureus
GDLGR

SEQ ID NO: 1568013 - protein, 9 aa, Staphylococcus aureus
GDNELTAAT

SEQ ID NO: 1568014 - protein, 7 aa, Staphylococcus aureus
GDNNEVA

SEQ ID NO: 1568015 - protein, 11 aa, Staphylococcus aureus
GDQIKESSKQM

SEQ ID NO: 1568016 - protein, 11 aa, Staphylococcus aureus
GEGPILGGNLG

SEQ ID NO: 1568017 - protein, 8 aa, Staphylococcus aureus
GENKISKE

SEQ ID NO: 1568018 - protein, 10 aa, Staphylococcus aureus
GESGSGKSIT

SEQ ID NO: 1568019 - protein, 10 aa, Staphylococcus aureus
GESGSGKSTI

SEQ ID NO: 1568020 - protein, 4 aa, Staphylococcus aureus
GGGA

SEQ ID NO: 1568021 - protein, 10 aa, Staphylococcus aureus
GGGGTFPIQT

SEQ ID NO: 1568022 - protein, 9 aa, Staphylococcus aureus
GGGNGAEAL

SEQ ID NO: 1568023 - protein, 15 aa, Staphylococcus aureus
GGKVIDDTKQPSYSI

SEQ ID NO: 1568024 - protein, 11 aa, Staphylococcus aureus
GGPYNQIRGTT

SEQ ID NO: 1568025 - protein, 46 aa, Staphylococcus aureus
GGQGQSQSQSDNKQNSAMSDVNQASPQQNSKASAPNNISGMPTAKL

SEQ ID NO: 1568026 - protein, 5 aa, Staphylococcus aureus
GGQSA

SEQ ID NO: 1568027 - protein, 14 aa, Staphylococcus aureus
GGYTESSEESNPID

SEQ ID NO: 1568028 - protein, 9 aa, Staphylococcus aureus
GHAMGSTAY

SEQ ID NO: 1568029 - protein, 9 aa, Staphylococcus aureus
GIGNTTANK

SEQ ID NO: 1568030 - protein, 7 aa, Staphylococcus aureus
GIHSPSR

SEQ ID NO: 1568031 - protein, 5 aa, Staphylococcus aureus
GINSL

SEQ ID NO: 1568032 - protein, 6 aa, Staphylococcus aureus
GITKTN

SEQ ID NO: 1568033 - protein, 8 aa, Staphylococcus aureus
GKAYTSAK

SEQ ID NO: 1568034 - protein, 9 aa, Staphylococcus aureus
GKELENATE

SEQ ID NO: 1568035 - protein, 5 aa, Staphylococcus aureus
GKFEK

SEQ ID NO: 1568036 - protein, 20 aa, Staphylococcus aureus
GKSDKTKEDSKEAQIKKSFE

SEQ ID NO: 1568037 - protein, 9 aa, Staphylococcus aureus
GKSKAGVDY

SEQ ID NO: 1568038 - protein, 59 aa, Staphylococcus aureus
GKSKDDTSNAEYSKVPDVEGQDKQKAIDNMSAKSLEPVTIGSGTQIKAQSIKAGNKVLP

SEQ ID NO: 1568039 - protein, 8 aa, Staphylococcus aureus
GKYNENDK

SEQ ID NO: 1568040 - protein, 9 aa, Staphylococcus aureus
GLEGKKKIE

SEQ ID NO: 1568041 - protein, 7 aa, Staphylococcus aureus
GLVNSGG

SEQ ID NO: 1568042 - protein, 7 aa, Staphylococcus aureus
GNAGDAL

SEQ ID NO: 1568043 - protein, 11 aa, Staphylococcus aureus
GNGDSSQTRIQ

SEQ ID NO: 1568044 - protein, 23 aa, Staphylococcus aureus
GNIEVNSQVGKGSTFKVILKDYK

SEQ ID NO: 1568045 - protein, 15 aa, Staphylococcus aureus
GQDFPAGNGSSASDY

SEQ ID NO: 1568046 - protein, 9 aa, Staphylococcus aureus
GQKPPGDEY

SEQ ID NO: 1568047 - protein, 12 aa, Staphylococcus aureus
GRAKSKKDVGTA

SEQ ID NO: 1568048 - protein, 17 aa, Staphylococcus aureus
GRGKAQADSLRQAQSNL

SEQ ID NO: 1568049 - protein, 8 aa, Staphylococcus aureus
GRRPDSRY

SEQ ID NO: 1568050 - protein, 8 aa, Staphylococcus aureus
GRVDYGAA

SEQ ID NO: 1568051 - protein, 8 aa, Staphylococcus aureus
GRYSGRID

SEQ ID NO: 1568052 - protein, 4 aa, Staphylococcus aureus
GSLI

SEQ ID NO: 1568053 - protein, 6 aa, Staphylococcus aureus
GSPFND

SEQ ID NO: 1568054 - protein, 12 aa, Staphylococcus aureus
GSRAFDPSTTVG

SEQ ID NO: 1568055 - protein, 6 aa, Staphylococcus aureus
GSTADY

SEQ ID NO: 1568056 - protein, 7 aa, Staphylococcus aureus
GTDVAIE

SEQ ID NO: 1568057 - protein, 5 aa, Staphylococcus aureus
GTKQY

SEQ ID NO: 1568058 - protein, 5 aa, Staphylococcus aureus
GTLAV

SEQ ID NO: 1568059 - protein, 11 aa, Staphylococcus aureus
GTPETKSKSIS

SEQ ID NO: 1568060 - protein, 5 aa, Staphylococcus aureus
GTQAI

SEQ ID NO: 1568061 - protein, 6 aa, Staphylococcus aureus
GVSGEP

SEQ ID NO: 1568062 - protein, 18 aa, Staphylococcus aureus
GVTPAANAAQHDEAQQNA

SEQ ID NO: 1568063 - protein, 9 aa, Staphylococcus aureus
HAQQQTLTD

SEQ ID NO: 1568064 - protein, 37 aa, Staphylococcus aureus
HDLNQKQKDALKTQVNNAQRVSDANNVQHTATELNGA

SEQ ID NO: 1568065 - protein, 12 aa, Staphylococcus aureus
HEGALNEIETSR

SEQ ID NO: 1568066 - protein, 10 aa, Staphylococcus aureus
HKDAQDKYGF

SEQ ID NO: 1568067 - protein, 12 aa, Staphylococcus aureus
HKENSTSIISND

SEQ ID NO: 1568068 - protein, 18 aa, Staphylococcus aureus
HLDDPVSTDGKKPGTITQ

SEQ ID NO: 1568069 - protein, 16 aa, Staphylococcus aureus
HLGTYTPLKNNSELEE

SEQ ID NO: 1568070 - protein, 6 aa, Staphylococcus aureus
HNGTLT

SEQ ID NO: 1568071 - protein, 18 aa, Staphylococcus aureus
HQLKSPDDIKKELNKKKS

SEQ ID NO: 1568072 - protein, 14 aa, Staphylococcus aureus
HQRAYEAQRDGRFN

SEQ ID NO: 1568073 - protein, 15 aa, Staphylococcus aureus
HSKQLKADGAVEYGV

SEQ ID NO: 1568074 - protein, 6 aa, Staphylococcus aureus
HTEQQW

SEQ ID NO: 1568075 - protein, 4 aa, Staphylococcus aureus
HVSR

SEQ ID NO: 1568076 - protein, 9 aa, Staphylococcus aureus
IAKGLGQNI

SEQ ID NO: 1568077 - protein, 7 aa, Staphylococcus aureus
IANDGYR

SEQ ID NO: 1568078 - protein, 10 aa, Staphylococcus aureus
IDGTKDPNVI

SEQ ID NO: 1568079 - protein, 81 aa, Staphylococcus aureus
IDKATTDRQQVPPTKEAAHHYGEEAATNVSASAQGTADDTNNKVTSNAPTNKPTTAVSTTGNKRHDVDAQQASTQKPTHTA

SEQ ID NO: 1568080 - protein, 9 aa, Staphylococcus aureus
IEEGGPVTV

SEQ ID NO: 1568081 - protein, 9 aa, Staphylococcus aureus
IESGAKNQN

SEQ ID NO: 1568082 - protein, 15 aa, Staphylococcus aureus
IESIENAAQQKINDI

SEQ ID NO: 1568083 - protein, 5 aa, Staphylococcus aureus
IGPTV

SEQ ID NO: 1568084 - protein, 37 aa, Staphylococcus aureus
IHKSKDALKYASKDPAVSTTDSNHEVAKTPNNDGSGH

SEQ ID NO: 1568085 - protein, 5 aa, Staphylococcus aureus
IHQQN

SEQ ID NO: 1568086 - protein, 13 aa, Staphylococcus aureus
IKDKNKAELESLN

SEQ ID NO: 1568087 - protein, 5 aa, Staphylococcus aureus
IKNSK

SEQ ID NO: 1568088 - protein, 8 aa, Staphylococcus aureus
IKTDVTTA

SEQ ID NO: 1568089 - protein, 5 aa, Staphylococcus aureus
INELE

SEQ ID NO: 1568090 - protein, 23 aa, Staphylococcus aureus
INSEELKQKEYKGYKDDAVIGKK

SEQ ID NO: 1568091 - protein, 28 aa, Staphylococcus aureus
INSEELKQKEYKGYKDDAVIGKKGLEKL

SEQ ID NO: 1568092 - protein, 72 aa, Staphylococcus aureus
INTKDDDTSQNNTSEPLNVQTGQEGKVADTDVAENSSTATNPKDASDKADVIEPDSDVVKDADNNIDKDVQH

SEQ ID NO: 1568093 - protein, 10 aa, Staphylococcus aureus
INTTKPVQEF

SEQ ID NO: 1568094 - protein, 14 aa, Staphylococcus aureus
IPEGANWIKQAVSS

SEQ ID NO: 1568095 - protein, 9 aa, Staphylococcus aureus
IQNKSKANL

SEQ ID NO: 1568096 - protein, 93 aa, Staphylococcus aureus
ISASESDSMSTSDSSNISGSNSTSTSLSTSDSMSGSVSVSTSTSLSDSISGSTSVSDSSSTSTSTSLSDSMSQSQSTSTSASGSLSTSISTSM

SEQ ID NO: 1568097 - protein, 7 aa, Staphylococcus aureus
ISHERES

SEQ ID NO: 1568098 - protein, 5 aa, Staphylococcus aureus
ISTKE

SEQ ID NO: 1568099 - protein, 12 aa, Staphylococcus aureus
ITASISKEQYKR

SEQ ID NO: 1568100 - protein, 6 aa, Staphylococcus aureus
ITDQYG

SEQ ID NO: 1568101 - protein, 7 aa, Staphylococcus aureus
ITECSGN

SEQ ID NO: 1568102 - protein, 5 aa, Staphylococcus aureus
ITGRG

SEQ ID NO: 1568103 - protein, 193 aa, Staphylococcus aureus
ITSPSVNSEMNNNETGTPHESNQTGNEGTGSNSRDANPDSNNVKPDSNNQNPSTDSKPDPNNQNPSPNPKPDPDNPKPKPDPDKPKPNLDPKPDPDNPKPKPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDF

SEQ ID NO: 1568104 - protein, 17 aa, Staphylococcus aureus
KADASTQNSSSVQDKQF

SEQ ID NO: 1568105 - protein, 62 aa, Staphylococcus aureus
KAKEDAKNAIKALANAKRDQINSNPDLTPEQKAKALKEIDEAEKRALENIENAQTKDQLNQG

SEQ ID NO: 1568106 - protein, 12 aa, Staphylococcus aureus
KAKNDVEETKDI

SEQ ID NO: 1568107 - protein, 52 aa, Staphylococcus aureus
KALANAKRDQINSNPDLTLEQKAKALKEIDEAEKRALENIENAQTKDQLNQG

SEQ ID NO: 1568108 - protein, 8 aa, Staphylococcus aureus
KASTSPIT

SEQ ID NO: 1568109 - protein, 7 aa, Staphylococcus aureus
KATGIKQ

SEQ ID NO: 1568110 - protein, 10 aa, Staphylococcus aureus
KATSSDSSVK

SEQ ID NO: 1568111 - protein, 7 aa, Staphylococcus aureus
KAVGASS

SEQ ID NO: 1568112 - protein, 15 aa, Staphylococcus aureus
KDGVQGTDSKEKPMA

SEQ ID NO: 1568113 - protein, 9 aa, Staphylococcus aureus
KDIDGTYKT

SEQ ID NO: 1568114 - protein, 18 aa, Staphylococcus aureus
KDIKKTLDDIKKDDKHID

SEQ ID NO: 1568115 - protein, 7 aa, Staphylococcus aureus
KDILEEK

SEQ ID NO: 1568116 - protein, 6 aa, Staphylococcus aureus
KDIPKD

SEQ ID NO: 1568117 - protein, 6 aa, Staphylococcus aureus
KDLRRA

SEQ ID NO: 1568118 - protein, 7 aa, Staphylococcus aureus
KDMSKNI

SEQ ID NO: 1568119 - protein, 6 aa, Staphylococcus aureus
KDNTVG

SEQ ID NO: 1568120 - protein, 8 aa, Staphylococcus aureus
KEARILKD

SEQ ID NO: 1568121 - protein, 60 aa, Staphylococcus aureus
KEETIQTQSVAPNTGEEGMSSAITQSTKTSDIHNESIDKQMEAKAHETAQNADLKNEARS

SEQ ID NO: 1568122 - protein, 7 aa, Staphylococcus aureus
KENGEQQ

SEQ ID NO: 1568123 - protein, 9 aa, Staphylococcus aureus
KENKNKAPV

SEQ ID NO: 1568124 - protein, 9 aa, Staphylococcus aureus
KENNTNKAH

SEQ ID NO: 1568125 - protein, 11 aa, Staphylococcus aureus
KENQEQYNEQI

SEQ ID NO: 1568126 - protein, 9 aa, Staphylococcus aureus
KENTITEPK

SEQ ID NO: 1568127 - protein, 8 aa, Staphylococcus aureus
KESTQKYK

SEQ ID NO: 1568128 - protein, 8 aa, Staphylococcus aureus
KETGKFES

SEQ ID NO: 1568129 - protein, 41 aa, Staphylococcus aureus
KEVVGEAKATGTDVTSKVKVTESSLEGHNKDSNIVNPHNAQ

SEQ ID NO: 1568130 - protein, 5 aa, Staphylococcus aureus
KEYPF

SEQ ID NO: 1568131 - protein, 7 aa, Staphylococcus aureus
KGAPNSM

SEQ ID NO: 1568132 - protein, 8 aa, Staphylococcus aureus
KGEQRING

SEQ ID NO: 1568133 - protein, 4 aa, Staphylococcus aureus
KGFR

SEQ ID NO: 1568134 - protein, 14 aa, Staphylococcus aureus
KGLTYGNASHAFGT

SEQ ID NO: 1568135 - protein, 8 aa, Staphylococcus aureus
KGRARTKS

SEQ ID NO: 1568136 - protein, 18 aa, Staphylococcus aureus
KGSEFTFTPEAPKTITEL

SEQ ID NO: 1568137 - protein, 7 aa, Staphylococcus aureus
KGTPFET

SEQ ID NO: 1568138 - protein, 6 aa, Staphylococcus aureus
KGYSSN

SEQ ID NO: 1568139 - protein, 15 aa, Staphylococcus aureus
KHGSHGSAKFAEDSE

SEQ ID NO: 1568140 - protein, 8 aa, Staphylococcus aureus
KIEDLQQK

SEQ ID NO: 1568141 - protein, 10 aa, Staphylococcus aureus
KIEQGGKSGV

SEQ ID NO: 1568142 - protein, 8 aa, Staphylococcus aureus
KKAKAMMT

SEQ ID NO: 1568143 - protein, 73 aa, Staphylococcus aureus
KKAPNNTNNDVTTKPSTSEIQTKPTTPQESTNIENSQPQPTPSKVDNQVTDATNPKEPVNVSKEELKNNPEKL

SEQ ID NO: 1568144 - protein, 78 aa, Staphylococcus aureus
KKAPNNTNNDVTTKPSTSEPSTSEIQTKPTTPQESTNIENSQPQPTPSKVDNQVTDATNPKEPVNVSKEELKNNPEKL

SEQ ID NO: 1568145 - protein, 7 aa, Staphylococcus aureus
KKATGYY

SEQ ID NO: 1568146 - protein, 19 aa, Staphylococcus aureus
KKDKRARQGQNNDESSIPG

SEQ ID NO: 1568147 - protein, 6 aa, Staphylococcus aureus
KKEAPY

SEQ ID NO: 1568148 - protein, 7 aa, Staphylococcus aureus
KKGLEND

SEQ ID NO: 1568149 - protein, 7 aa, Staphylococcus aureus
KKIPGVQ

SEQ ID NO: 1568150 - protein, 6 aa, Staphylococcus aureus
KKKIND

SEQ ID NO: 1568151 - protein, 6 aa, Staphylococcus aureus
KKNDGV

SEQ ID NO: 1568152 - protein, 26 aa, Staphylococcus aureus
KKNDVSETVNTDNKDTVKQKEAKFEN

SEQ ID NO: 1568153 - protein, 8 aa, Staphylococcus aureus
KKPTGGTI

SEQ ID NO: 1568154 - protein, 18 aa, Staphylococcus aureus
KKQSEPVPHEVKGTGSDL

SEQ ID NO: 1568155 - protein, 11 aa, Staphylococcus aureus
KKQVKSKSKVK

SEQ ID NO: 1568156 - protein, 7 aa, Staphylococcus aureus
KLANPSM

SEQ ID NO: 1568157 - protein, 15 aa, Staphylococcus aureus
KLAREKNIVLNLKTI

SEQ ID NO: 1568158 - protein, 7 aa, Staphylococcus aureus
KLEKGDL

SEQ ID NO: 1568159 - protein, 80 aa, Staphylococcus aureus
KLNDAQAPKEEDNNKPGKEDGNKPGKEDGNKPGKEDNNKPGKEDGNKPGKEDNKKPGKEDGNKPGKEDNNKPGKEDGNGV

SEQ ID NO: 1568160 - protein, 111 aa, Staphylococcus aureus
KLNDAQAPKEEDNNKPGKEDNKPGKEDGNKPGKEDGNKPGKEDNNKPGKEDGNKPGKEDNKKPGKEDGNKPGKEDNNKPGKEDGNKPGKEDGNKPGKEDNKKPGKEDGNGV

SEQ ID NO: 1568161 - protein, 104 aa, Staphylococcus aureus
KLNDAQAPKEEDNNKPGKEDNNKPGKEDGNKPGKEDNKKPGKEDGNKPGKEDNKKPGKEDGNKPGKEDGNKPGKEDGNKPGKEDGNKPGKEDGNKPGKEDGNGV

SEQ ID NO: 1568162 - protein, 4 aa, Staphylococcus aureus
KLNV

SEQ ID NO: 1568163 - protein, 21 aa, Staphylococcus aureus
KLSDSYYADPNDSNLKEVTDQ

SEQ ID NO: 1568164 - protein, 8 aa, Staphylococcus aureus
KMKENDIT

SEQ ID NO: 1568165 - protein, 35 aa, Staphylococcus aureus
KMSERNQEKQLKREEKARLKEEQKARQNEQPQIKD

SEQ ID NO: 1568166 - protein, 23 aa, Staphylococcus aureus
KNAENLKSPEKIKEEINKKKNTK

SEQ ID NO: 1568167 - protein, 17 aa, Staphylococcus aureus
KNAQANFSKVKSDVAKA

SEQ ID NO: 1568168 - protein, 4 aa, Staphylococcus aureus
KNEE

SEQ ID NO: 1568169 - protein, 16 aa, Staphylococcus aureus
KNIADEYDVDSRKSAS

SEQ ID NO: 1568170 - protein, 10 aa, Staphylococcus aureus
KNNSQLEKQL

SEQ ID NO: 1568171 - protein, 9 aa, Staphylococcus aureus
KNTRPSNKQ

SEQ ID NO: 1568172 - protein, 7 aa, Staphylococcus aureus
KNVGKEI

SEQ ID NO: 1568173 - protein, 19 aa, Staphylococcus aureus
KNYQDGSITTNENVPSYEA

SEQ ID NO: 1568174 - protein, 15 aa, Staphylococcus aureus
KPEMNAHGSSMTNTV

SEQ ID NO: 1568175 - protein, 4 aa, Staphylococcus aureus
KPVA

SEQ ID NO: 1568176 - protein, 6 aa, Staphylococcus aureus
KPVQEF

SEQ ID NO: 1568177 - protein, 7 aa, Staphylococcus aureus
KQAQQSI

SEQ ID NO: 1568178 - protein, 27 aa, Staphylococcus aureus
KQDYKNKKGEDTDSKRASTGNEYEDKA

SEQ ID NO: 1568179 - protein, 7 aa, Staphylococcus aureus
KQGQRLV

SEQ ID NO: 1568180 - protein, 13 aa, Staphylococcus aureus
KQHPAGPEQITSS

SEQ ID NO: 1568181 - protein, 11 aa, Staphylococcus aureus
KQNKQTDWSED

SEQ ID NO: 1568182 - protein, 21 aa, Staphylococcus aureus
KQQELDSKIAQADKQEQRSKV

SEQ ID NO: 1568183 - protein, 5 aa, Staphylococcus aureus
KQRYT

SEQ ID NO: 1568184 - protein, 15 aa, Staphylococcus aureus
KQTSQKEKAQTIAKQ

SEQ ID NO: 1568185 - protein, 5 aa, Staphylococcus aureus
KRPSA

SEQ ID NO: 1568186 - protein, 4 aa, Staphylococcus aureus
KRVP

SEQ ID NO: 1568187 - protein, 6 aa, Staphylococcus aureus
KSHGTV

SEQ ID NO: 1568188 - protein, 191 aa, Staphylococcus aureus
KSHPEPIEDNDKHETIKDAENNTEHSTVSDKSIAEQSQQPKPYFATGANQANTSKDKHDDVTVKQDKDESKDHHSGKKGAAIGAGTAGVAGAAGAMGVSKAKKHSNDAQNKSNSDKSNNSTEDKASQDKSKDHHNGKKGAAIGAGTAGLAGGAASKSASAASKPHASNNASQNHDEHDNHDRDKERKKGGM

SEQ ID NO: 1568189 - protein, 191 aa, Staphylococcus aureus
KSHPEPIEDNDKHETIKEAENNTEHSTVSDKSEAEQSQQPKPYFATGANQANTSKDKHDDVTVKQDKDESKDHHSGKKGAAIGAGTAGVAGAAGAMGVSKAKKHSNDAQNKSNSDKSNNSTEDKVSQDKSKDHHNGKKGAAIGAGTAGLAGGAASKSASAASKPHASNNASQNHDEHDNHDRDKERKKGGM

SEQ ID NO: 1568190 - protein, 4 aa, Staphylococcus aureus
KSIY

SEQ ID NO: 1568191 - protein, 11 aa, Staphylococcus aureus
KSKKKKPFSAG

SEQ ID NO: 1568192 - protein, 17 aa, Staphylococcus aureus
KSLDAFSNKKVKAKLDA

SEQ ID NO: 1568193 - protein, 15 aa, Staphylococcus aureus
KSNIDKNKDNNTVYG

SEQ ID NO: 1568194 - protein, 12 aa, Staphylococcus aureus
KSNSGTANSVSP

SEQ ID NO: 1568195 - protein, 5 aa, Staphylococcus aureus
KSSYI

SEQ ID NO: 1568196 - protein, 4 aa, Staphylococcus aureus
KSYD

SEQ ID NO: 1568197 - protein, 14 aa, Staphylococcus aureus
KTDIPDEIKTEVTA

SEQ ID NO: 1568198 - protein, 4 aa, Staphylococcus aureus
KTLE

SEQ ID NO: 1568199 - protein, 7 aa, Staphylococcus aureus
KTNNGNV

SEQ ID NO: 1568200 - protein, 8 aa, Staphylococcus aureus
KTPASPGS

SEQ ID NO: 1568201 - protein, 21 aa, Staphylococcus aureus
KTPGREDKVAAQQVEATERAQ

SEQ ID NO: 1568202 - protein, 23 aa, Staphylococcus aureus
KTVQSNGEQKITSKLNGEETEKT

SEQ ID NO: 1568203 - protein, 12 aa, Staphylococcus aureus
KVQAAQTKINEA

SEQ ID NO: 1568204 - protein, 7 aa, Staphylococcus aureus
KVTQAQP

SEQ ID NO: 1568205 - protein, 7 aa, Staphylococcus aureus
KVTVPTK

SEQ ID NO: 1568206 - protein, 10 aa, Staphylococcus aureus
KYEGDDYQAI

SEQ ID NO: 1568207 - protein, 6 aa, Staphylococcus aureus
KYPTQL

SEQ ID NO: 1568208 - protein, 8 aa, Staphylococcus aureus
KYSVNNSD

SEQ ID NO: 1568209 - protein, 12 aa, Staphylococcus aureus
LAAGSASIGISA

SEQ ID NO: 1568210 - protein, 22 aa, Staphylococcus aureus
LAEGRGKAQANALRQTQTEMKA

SEQ ID NO: 1568211 - protein, 48 aa, Staphylococcus aureus
LAEKDNTKRSVNYTDADQPKQQAYDTAVTQAEAITNANGSNANETQVQ

SEQ ID NO: 1568212 - protein, 11 aa, Staphylococcus aureus
LAKTNGKHDID

SEQ ID NO: 1568213 - protein, 8 aa, Staphylococcus aureus
LDDHESVG

SEQ ID NO: 1568214 - protein, 18 aa, Staphylococcus aureus
LDEEEGRKESNSDLKEKV

SEQ ID NO: 1568215 - protein, 10 aa, Staphylococcus aureus
LDSEPSKQVV

SEQ ID NO: 1568216 - protein, 31 aa, Staphylococcus aureus
LDTSRKPFVARDGQRKGNSNDSQEKLSPGKA

SEQ ID NO: 1568217 - protein, 4 aa, Staphylococcus aureus
LEEV

SEQ ID NO: 1568218 - protein, 7 aa, Staphylococcus aureus
LEPSGTQ

SEQ ID NO: 1568219 - protein, 6 aa, Staphylococcus aureus
LESESG

SEQ ID NO: 1568220 - protein, 15 aa, Staphylococcus aureus
LEVTGEFNKETNNKF

SEQ ID NO: 1568221 - protein, 16 aa, Staphylococcus aureus
LGAPTTQKDGKTVLTA

SEQ ID NO: 1568222 - protein, 6 aa, Staphylococcus aureus
LGESIK

SEQ ID NO: 1568223 - protein, 5 aa, Staphylococcus aureus
LGGPT

SEQ ID NO: 1568224 - protein, 8 aa, Staphylococcus aureus
LGKRKLNR

SEQ ID NO: 1568225 - protein, 15 aa, Staphylococcus aureus
LGNPEASDDAVEKAA

SEQ ID NO: 1568226 - protein, 8 aa, Staphylococcus aureus
LGTSGHTL

SEQ ID NO: 1568227 - protein, 7 aa, Staphylococcus aureus
LKEQSIQ

SEQ ID NO: 1568228 - protein, 50 aa, Staphylococcus aureus
LNDAAKKQINNYTSQQVSNKKNDAWRDASATEIKSAMDSGTFIDNEKQKY

SEQ ID NO: 1568229 - protein, 15 aa, Staphylococcus aureus
LNDPQKTALKDQVTA

SEQ ID NO: 1568230 - protein, 15 aa, Staphylococcus aureus
LNENEGQAIQTMDQS

SEQ ID NO: 1568231 - protein, 16 aa, Staphylococcus aureus
LNNAQRQNLQSQINGA

SEQ ID NO: 1568232 - protein, 51 aa, Staphylococcus aureus
LNQAKNDLNGDNKVAQAKESAKRALASYSNLNNAQSTAATSQIDNATTVAG

SEQ ID NO: 1568233 - protein, 50 aa, Staphylococcus aureus
LNQAKNDLNGDNKVAQAKETAKRALASYSNLNNAQSTAATSQIDNATTVA

SEQ ID NO: 1568234 - protein, 65 aa, Staphylococcus aureus
LNQAKNDLNGDNKVAQAKETAKRALASYSNLNNAQSTAATSQIDNATTVAGVTAAQNTANELNTA

SEQ ID NO: 1568235 - protein, 19 aa, Staphylococcus aureus
LNTPQKAKLKEQVGQANRL

SEQ ID NO: 1568236 - protein, 14 aa, Staphylococcus aureus
LPKYDEGKKIEYTV

SEQ ID NO: 1568237 - protein, 8 aa, Staphylococcus aureus
LPPGNSHI

SEQ ID NO: 1568238 - protein, 4 aa, Staphylococcus aureus
LPSL

SEQ ID NO: 1568239 - protein, 12 aa, Staphylococcus aureus
LQGKEYQLEKTT

SEQ ID NO: 1568240 - protein, 5 aa, Staphylococcus aureus
LQKEG

SEQ ID NO: 1568241 - protein, 20 aa, Staphylococcus aureus
LQNEKGEVIGTTKTDENGKY

SEQ ID NO: 1568242 - protein, 12 aa, Staphylococcus aureus
LQQTSDKTLRQQ

SEQ ID NO: 1568243 - protein, 15 aa, Staphylococcus aureus
LSNRGNNNKIYADED

SEQ ID NO: 1568244 - protein, 10 aa, Staphylococcus aureus
LSNTSNKQKI

SEQ ID NO: 1568245 - protein, 22 aa, Staphylococcus aureus
LSRASDYFSEAGATAATKAFGR

SEQ ID NO: 1568246 - protein, 4 aa, Staphylococcus aureus
LSSA

SEQ ID NO: 1568247 - protein, 10 aa, Staphylococcus aureus
LSSENPPASV

SEQ ID NO: 1568248 - protein, 38 aa, Staphylococcus aureus
LSSSANASQTDNGVNRSGSEHPTVYSATSTKKLHKEPA

SEQ ID NO: 1568249 - protein, 5 aa, Staphylococcus aureus
LSSSD

SEQ ID NO: 1568250 - protein, 7 aa, Staphylococcus aureus
LSSSDPM

SEQ ID NO: 1568251 - protein, 4 aa, Staphylococcus aureus
LSTR

SEQ ID NO: 1568252 - protein, 4 aa, Staphylococcus aureus
LTEP

SEQ ID NO: 1568253 - protein, 10 aa, Staphylococcus aureus
LTEQDIENAT

SEQ ID NO: 1568254 - protein, 36 aa, Staphylococcus aureus
LTIRDAEDKVKLSGSDIKQGSAKQEFKQETNQPTVT

SEQ ID NO: 1568255 - protein, 4 aa, Staphylococcus aureus
LTKD

SEQ ID NO: 1568256 - protein, 6 aa, Staphylococcus aureus
LTNQNF

SEQ ID NO: 1568257 - protein, 20 aa, Staphylococcus aureus
LTPAQQQALENQINNATTCD

SEQ ID NO: 1568258 - protein, 6 aa, Staphylococcus aureus
LTPYRG

SEQ ID NO: 1568259 - protein, 6 aa, Staphylococcus aureus
LTSPKM

SEQ ID NO: 1568260 - protein, 5 aa, Staphylococcus aureus
LTTNQ

SEQ ID NO: 1568261 - protein, 105 aa, Staphylococcus aureus
LVKSDTNDAVATNDQSSSDASNQTNTNTSNQNTSTTNNTNDQPQATNNMSQPAQPKASANSDQASSQPAHETNSNDNTNDATNASSNQSNGNQQYPPADESLQDA

SEQ ID NO: 1568262 - protein, 105 aa, Staphylococcus aureus
LVKSDTNDAVATNDQSSSDASNQTNTNTSNQNTSTTNNTNDQPQATNNMSQPAQPKASANSDQASSQPAHETNSNDNTNDVTNASSNQSNGNQQYPPADESLQDA

SEQ ID NO: 1568263 - protein, 28 aa, Staphylococcus aureus
LVTGESKKVQKNQNDNVIGGSINGSGTI

SEQ ID NO: 1568264 - protein, 10 aa, Staphylococcus aureus
MEEKNNDKEL

SEQ ID NO: 1568265 - protein, 39 aa, Staphylococcus aureus
MKKSQKYEEKAGLTPNKLDEKTEKKGDKLAEKNRKEIAK

SEQ ID NO: 1568266 - protein, 4 aa, Staphylococcus aureus
MPKI

SEQ ID NO: 1568267 - protein, 8 aa, Staphylococcus aureus
MPQKGTIA

SEQ ID NO: 1568268 - protein, 5 aa, Staphylococcus aureus
MRTAQ

SEQ ID NO: 1568269 - protein, 6 aa, Staphylococcus aureus
MRTAQR

SEQ ID NO: 1568270 - protein, 4 aa, Staphylococcus aureus
MSGK

SEQ ID NO: 1568271 - protein, 30 aa, Staphylococcus aureus
MSLSTSESLSASMSGSQSISDSTSTSMSNS

SEQ ID NO: 1568272 - protein, 7 aa, Staphylococcus aureus
NAAPNHA

SEQ ID NO: 1568273 - protein, 10 aa, Staphylococcus aureus
NAATGTNDAN

SEQ ID NO: 1568274 - protein, 5 aa, Staphylococcus aureus
NAETF

SEQ ID NO: 1568275 - protein, 10 aa, Staphylococcus aureus
NAGIEGTVKG

SEQ ID NO: 1568276 - protein, 9 aa, Staphylococcus aureus
NAHTPQQVE

SEQ ID NO: 1568277 - protein, 8 aa, Staphylococcus aureus
NAKGQVKE

SEQ ID NO: 1568278 - protein, 6 aa, Staphylococcus aureus
NAPDVH

SEQ ID NO: 1568279 - protein, 5 aa, Staphylococcus aureus
NASNS

SEQ ID NO: 1568280 - protein, 18 aa, Staphylococcus aureus
NDDTQNIAEKPFSKQAGH

SEQ ID NO: 1568281 - protein, 8 aa, Staphylococcus aureus
NDEPATRR

SEQ ID NO: 1568282 - protein, 6 aa, Staphylococcus aureus
NDLSND

SEQ ID NO: 1568283 - protein, 8 aa, Staphylococcus aureus
NDSLLEKN

SEQ ID NO: 1568284 - protein, 9 aa, Staphylococcus aureus
NDSWTQNAQ

SEQ ID NO: 1568285 - protein, 9 aa, Staphylococcus aureus
NEDKGDIIR

SEQ ID NO: 1568286 - protein, 8 aa, Staphylococcus aureus
NEKEKDKI

SEQ ID NO: 1568287 - protein, 12 aa, Staphylococcus aureus
NELDSKDNKGFQ

SEQ ID NO: 1568288 - protein, 6 aa, Staphylococcus aureus
NENYKE

SEQ ID NO: 1568289 - protein, 6 aa, Staphylococcus aureus
NEPNQK

SEQ ID NO: 1568290 - protein, 26 aa, Staphylococcus aureus
NEQTATLDNNAINQAAATVNTTKAAL

SEQ ID NO: 1568291 - protein, 9 aa, Staphylococcus aureus
NETSTSPIT

SEQ ID NO: 1568292 - protein, 16 aa, Staphylococcus aureus
NEVTQAQNNADALNTA

SEQ ID NO: 1568293 - protein, 12 aa, Staphylococcus aureus
NFTKNDNTKRKK

SEQ ID NO: 1568294 - protein, 8 aa, Staphylococcus aureus
NGALGQGE

SEQ ID NO: 1568295 - protein, 17 aa, Staphylococcus aureus
NGDQRLQDAKDKAIQSI

SEQ ID NO: 1568296 - protein, 5 aa, Staphylococcus aureus
NGEKV

SEQ ID NO: 1568297 - protein, 9 aa, Staphylococcus aureus
NGLGSGAAN

SEQ ID NO: 1568298 - protein, 9 aa, Staphylococcus aureus
NGQTSSNKQ

SEQ ID NO: 1568299 - protein, 11 aa, Staphylococcus aureus
NHASHDHHSGH

SEQ ID NO: 1568300 - protein, 5 aa, Staphylococcus aureus
NHSEY

SEQ ID NO: 1568301 - protein, 11 aa, Staphylococcus aureus
NIANAKDKKLE

SEQ ID NO: 1568302 - protein, 6 aa, Staphylococcus aureus
NIEPKQ

SEQ ID NO: 1568303 - protein, 5 aa, Staphylococcus aureus
NITED

SEQ ID NO: 1568304 - protein, 36 aa, Staphylococcus aureus
NITGNEKSQAEAGGRPNFRTTGYSQSNATTDGQRQF

SEQ ID NO: 1568305 - protein, 26 aa, Staphylococcus aureus
NKDGSTVQTTNNKGGNQLDGQSKKFG

SEQ ID NO: 1568306 - protein, 10 aa, Staphylococcus aureus
NKDQDLNTAI

SEQ ID NO: 1568307 - protein, 9 aa, Staphylococcus aureus
NKKAQPLIS

SEQ ID NO: 1568308 - protein, 5 aa, Staphylococcus aureus
NKPDH

SEQ ID NO: 1568309 - protein, 5 aa, Staphylococcus aureus
NKSPL

SEQ ID NO: 1568310 - protein, 13 aa, Staphylococcus aureus
NKSTGPNTAQNAV

SEQ ID NO: 1568311 - protein, 6 aa, Staphylococcus aureus
NKTSSY

SEQ ID NO: 1568312 - protein, 10 aa, Staphylococcus aureus
NKVSTKKQTI

SEQ ID NO: 1568313 - protein, 7 aa, Staphylococcus aureus
NLNGKKE

SEQ ID NO: 1568314 - protein, 21 aa, Staphylococcus aureus
NLNTPQRQALENQINNAATRV

SEQ ID NO: 1568315 - protein, 18 aa, Staphylococcus aureus
NNANTNAFRPGGAQQLNE

SEQ ID NO: 1568316 - protein, 9 aa, Staphylococcus aureus
NNDFKSPQY

SEQ ID NO: 1568317 - protein, 8 aa, Staphylococcus aureus
NNKDYAYQ

SEQ ID NO: 1568318 - protein, 11 aa, Staphylococcus aureus
NNKPEGVNENS

SEQ ID NO: 1568319 - protein, 14 aa, Staphylococcus aureus
NNQAPTVESKSHDL

SEQ ID NO: 1568320 - protein, 25 aa, Staphylococcus aureus
NNQEPTVESNSHNLNPNINTTKPVH

SEQ ID NO: 1568321 - protein, 25 aa, Staphylococcus aureus
NPSNGYGGQPVTNSNTRANHSNSTV

SEQ ID NO: 1568322 - protein, 7 aa, Staphylococcus aureus
NQNGKEI

SEQ ID NO: 1568323 - protein, 5 aa, Staphylococcus aureus
NQNIR

SEQ ID NO: 1568324 - protein, 13 aa, Staphylococcus aureus
NQTTNPMLNPDDI

SEQ ID NO: 1568325 - protein, 44 aa, Staphylococcus aureus
NQTTSPTMNPDDVNGATTQVNNTKVALDGDENLAAAKQQANNRL

SEQ ID NO: 1568326 - protein, 29 aa, Staphylococcus aureus
NQVNTTKAALNGAQNLAQAKTNATNTINN

SEQ ID NO: 1568327 - protein, 30 aa, Staphylococcus aureus
NQVNTTKAALNGAQNLAQAKTNATNTINNA

SEQ ID NO: 1568328 - protein, 16 aa, Staphylococcus aureus
NRATMQNENKDPYGEK

SEQ ID NO: 1568329 - protein, 24 aa, Staphylococcus aureus
NSEDNKTLPKLESVRSSLANNSDI

SEQ ID NO: 1568330 - protein, 10 aa, Staphylococcus aureus
NSLKDYGEKM

SEQ ID NO: 1568331 - protein, 9 aa, Staphylococcus aureus
NSQQNGQVT

SEQ ID NO: 1568332 - protein, 11 aa, Staphylococcus aureus
NSRSAQIKDTF

SEQ ID NO: 1568333 - protein, 4 aa, Staphylococcus aureus
NSTF

SEQ ID NO: 1568334 - protein, 21 aa, Staphylococcus aureus
NSVKEAQEESKKKNKSNPKID

SEQ ID NO: 1568335 - protein, 39 aa, Staphylococcus aureus
NTIKPNSAITITPKAGTGHSASSNPSTLTAPAAHTVNTT

SEQ ID NO: 1568336 - protein, 7 aa, Staphylococcus aureus
NTITVNK

SEQ ID NO: 1568337 - protein, 11 aa, Staphylococcus aureus
NTKDGGKYTLE

SEQ ID NO: 1568338 - protein, 8 aa, Staphylococcus aureus
NTKKATGY

SEQ ID NO: 1568339 - protein, 8 aa, Staphylococcus aureus
NVKRDKNK

SEQ ID NO: 1568340 - protein, 27 aa, Staphylococcus aureus
NVNSTKTALNGDAKLNEAKAAAKQTLG

SEQ ID NO: 1568341 - protein, 197 aa, Staphylococcus aureus
NVTSPSVNSEMNNNETGTPHESNQAGNEGTGSNSRDANPDSNNVKPDSNNQNPSPDSKPDPNNPNPGPNPKPDPDKPKPNPEPKPDPKPDPDKPKPNPDPKPDPDKPKPNPDPKPDPDKPKPNPDPKPDPNPNPKPDPNKPNPNPSPNPNQPGDSNQSGGSKNGGTWNPNASDGSNQGQWQPNGNQGNSQNPTGNDF

SEQ ID NO: 1568342 - protein, 9 aa, Staphylococcus aureus
NYDNKPQNL

SEQ ID NO: 1568343 - protein, 7 aa, Staphylococcus aureus
NYNQNSA

SEQ ID NO: 1568344 - protein, 21 aa, Staphylococcus aureus
PAHQTKTPDDIKKELDSKKND

SEQ ID NO: 1568345 - protein, 21 aa, Staphylococcus aureus
PAHQTKTPDEIKKELESKKND

SEQ ID NO: 1568346 - protein, 17 aa, Staphylococcus aureus
PANQLKSPDDIKKELNK

SEQ ID NO: 1568347 - protein, 20 aa, Staphylococcus aureus
PANQLKSPDEIKEELDKKEG

SEQ ID NO: 1568348 - protein, 10 aa, Staphylococcus aureus
PDIKSKDDNI

SEQ ID NO: 1568349 - protein, 5 aa, Staphylococcus aureus
PDQVI

SEQ ID NO: 1568350 - protein, 7 aa, Staphylococcus aureus
PDSQLNQ

SEQ ID NO: 1568351 - protein, 5 aa, Staphylococcus aureus
PGIDD

SEQ ID NO: 1568352 - protein, 14 aa, Staphylococcus aureus
PGLNKLDADPETIQ

SEQ ID NO: 1568353 - protein, 6 aa, Staphylococcus aureus
PGNSHI

SEQ ID NO: 1568354 - protein, 4 aa, Staphylococcus aureus
PGVT

SEQ ID NO: 1568355 - protein, 11 aa, Staphylococcus aureus
PHQRDETNALA

SEQ ID NO: 1568356 - protein, 10 aa, Staphylococcus aureus
PIDKKSSFRA

SEQ ID NO: 1568357 - protein, 7 aa, Staphylococcus aureus
PISTQQH

SEQ ID NO: 1568358 - protein, 31 aa, Staphylococcus aureus
PKADASTQNSSSVQDKQLQKVEEVPNNSEKA

SEQ ID NO: 1568359 - protein, 7 aa, Staphylococcus aureus
PKERATA

SEQ ID NO: 1568360 - protein, 8 aa, Staphylococcus aureus
PKKSDMTS

SEQ ID NO: 1568361 - protein, 10 aa, Staphylococcus aureus
PKQASAKDAY

SEQ ID NO: 1568362 - protein, 7 aa, Staphylococcus aureus
PKSVTDD

SEQ ID NO: 1568363 - protein, 5 aa, Staphylococcus aureus
PLASL

SEQ ID NO: 1568364 - protein, 5 aa, Staphylococcus aureus
PLASS

SEQ ID NO: 1568365 - protein, 18 aa, Staphylococcus aureus
PLDSEESSRIEYDEDTGY

SEQ ID NO: 1568366 - protein, 9 aa, Staphylococcus aureus
PNSISSDYI

SEQ ID NO: 1568367 - protein, 7 aa, Staphylococcus aureus
PNTADEE

SEQ ID NO: 1568368 - protein, 6 aa, Staphylococcus aureus
PQEEFQ

SEQ ID NO: 1568369 - protein, 9 aa, Staphylococcus aureus
PQLQATTEG

SEQ ID NO: 1568370 - protein, 24 aa, Staphylococcus aureus
PRYKSKKGWYKDTPPKEKGGMPTE

SEQ ID NO: 1568371 - protein, 4 aa, Staphylococcus aureus
PSQC

SEQ ID NO: 1568372 - protein, 15 aa, Staphylococcus aureus
PTNATTNAFRPGGVQ

SEQ ID NO: 1568373 - protein, 10 aa, Staphylococcus aureus
PTNEQELDRE

SEQ ID NO: 1568374 - protein, 18 aa, Staphylococcus aureus
PTNQTTNGGSEADQIPSG

SEQ ID NO: 1568375 - protein, 7 aa, Staphylococcus aureus
PTTAGTM

SEQ ID NO: 1568376 - protein, 29 aa, Staphylococcus aureus
PVASEQPAKGQQGSKGSESGKDTQPIGKE

SEQ ID NO: 1568377 - protein, 12 aa, Staphylococcus aureus
QAQNDKSSAELL

SEQ ID NO: 1568378 - protein, 4 aa, Staphylococcus aureus
QDGL

SEQ ID NO: 1568379 - protein, 16 aa, Staphylococcus aureus
QDKTTEYARKTRRSVD

SEQ ID NO: 1568380 - protein, 6 aa, Staphylococcus aureus
QDLNAG

SEQ ID NO: 1568381 - protein, 5 aa, Staphylococcus aureus
QDQKW

SEQ ID NO: 1568382 - protein, 25 aa, Staphylococcus aureus
QEKENELNGNERVAEAKTQAKQTID

SEQ ID NO: 1568383 - protein, 12 aa, Staphylococcus aureus
QFQSKKPKKDDQ

SEQ ID NO: 1568384 - protein, 5 aa, Staphylococcus aureus
QGIAD

SEQ ID NO: 1568385 - protein, 4 aa, Staphylococcus aureus
QGKI

SEQ ID NO: 1568386 - protein, 4 aa, Staphylococcus aureus
QGSN

SEQ ID NO: 1568387 - protein, 42 aa, Staphylococcus aureus
QHPVITPSDVNNALSNVTSKEQALNGEAKLNAAKQEANTALG

SEQ ID NO: 1568388 - protein, 16 aa, Staphylococcus aureus
QIATAKQNIDQATQLQ

SEQ ID NO: 1568389 - protein, 21 aa, Staphylococcus aureus
QIRKSKDTSEDQAVSTTDNYH

SEQ ID NO: 1568390 - protein, 11 aa, Staphylococcus aureus
QISNTDKNVKK

SEQ ID NO: 1568391 - protein, 27 aa, Staphylococcus aureus
QKLQAQSKVDNKVISNDEVDKVSEGQK

SEQ ID NO: 1568392 - protein, 10 aa, Staphylococcus aureus
QKMGNQQVEV

SEQ ID NO: 1568393 - protein, 4 aa, Staphylococcus aureus
QLAQ

SEQ ID NO: 1568394 - protein, 11 aa, Staphylococcus aureus
QLSKNYTSDQL

SEQ ID NO: 1568395 - protein, 12 aa, Staphylococcus aureus
QNAEGNAESPGY

SEQ ID NO: 1568396 - protein, 5 aa, Staphylococcus aureus
QNSSN

SEQ ID NO: 1568397 - protein, 18 aa, Staphylococcus aureus
QPAKQKATSKAEVQRKGQ

SEQ ID NO: 1568398 - protein, 7 aa, Staphylococcus aureus
QQISTSG

SEQ ID NO: 1568399 - protein, 8 aa, Staphylococcus aureus
QQQGNIPH

SEQ ID NO: 1568400 - protein, 21 aa, Staphylococcus aureus
QQSTTVAEAQGNEQKANNVDA

SEQ ID NO: 1568401 - protein, 24 aa, Staphylococcus aureus
QRLQLGNPKIKTNTPLISVSSDRH

SEQ ID NO: 1568402 - protein, 31 aa, Staphylococcus aureus
QSGINNESQVKSSEKYRDADTNKQQEYDNAI

SEQ ID NO: 1568403 - protein, 6 aa, Staphylococcus aureus
QSIDEI

SEQ ID NO: 1568404 - protein, 7 aa, Staphylococcus aureus
QSLSQSV

SEQ ID NO: 1568405 - protein, 7 aa, Staphylococcus aureus
QSNAIAS

SEQ ID NO: 1568406 - protein, 16 aa, Staphylococcus aureus
QSRTYSRHNNEEKAQA

SEQ ID NO: 1568407 - protein, 22 aa, Staphylococcus aureus
QVIGPQKGSKPRQVLIDLNNDE

SEQ ID NO: 1568408 - protein, 13 aa, Staphylococcus aureus
QVNQAKGDLNGNH

SEQ ID NO: 1568409 - protein, 42 aa, Staphylococcus aureus
QYDNQNQNHRRQSEDASYRQQYAKGDPEEHPERYYNGRDYRR

SEQ ID NO: 1568410 - protein, 7 aa, Staphylococcus aureus
RDNNKHL

SEQ ID NO: 1568411 - protein, 6 aa, Staphylococcus aureus
RGLNKP

SEQ ID NO: 1568412 - protein, 18 aa, Staphylococcus aureus
RGRQTTKRSVKDNSGKKQ

SEQ ID NO: 1568413 - protein, 55 aa, Staphylococcus aureus
RGTVSSGTEGSDRALEGTAVSSKSGKQLANMSAPKGSAHEKQLPKTGTDQSSSPA

SEQ ID NO: 1568414 - protein, 19 aa, Staphylococcus aureus
RIGTTKRVEVSQGNVQTKK

SEQ ID NO: 1568415 - protein, 28 aa, Staphylococcus aureus
RKERKARKLEKQIEKYGYESAELRRKDK

SEQ ID NO: 1568416 - protein, 6 aa, Staphylococcus aureus
RKTSQL

SEQ ID NO: 1568417 - protein, 7 aa, Staphylococcus aureus
RNEEISH

SEQ ID NO: 1568418 - protein, 18 aa, Staphylococcus aureus
RNHSELRDKKVSLNDGDP

SEQ ID NO: 1568419 - protein, 8 aa, Staphylococcus aureus
RNKETKSY

SEQ ID NO: 1568420 - protein, 7 aa, Staphylococcus aureus
RNSLADP

SEQ ID NO: 1568421 - protein, 5 aa, Staphylococcus aureus
RQPDK

SEQ ID NO: 1568422 - protein, 10 aa, Staphylococcus aureus
RRIKQDGSYE

SEQ ID NO: 1568423 - protein, 19 aa, Staphylococcus aureus
RRNNTSPWVKEASADNVTG

SEQ ID NO: 1568424 - protein, 5 aa, Staphylococcus aureus
RSETF

SEQ ID NO: 1568425 - protein, 24 aa, Staphylococcus aureus
RSIDSSTGASKRMADTMESGLGGK

SEQ ID NO: 1568426 - protein, 9 aa, Staphylococcus aureus
SAFGSNYDR

SEQ ID NO: 1568427 - protein, 5 aa, Staphylococcus aureus
SAHSE

SEQ ID NO: 1568428 - protein, 6 aa, Staphylococcus aureus
SASAGS

SEQ ID NO: 1568429 - protein, 33 aa, Staphylococcus aureus
SATNNPEMNPDTINQKASQVNSAKSALNGDEKL

SEQ ID NO: 1568430 - protein, 18 aa, Staphylococcus aureus
SATRVSGVDTVKQNAQHL

SEQ ID NO: 1568431 - protein, 7 aa, Staphylococcus aureus
SDEYSSL

SEQ ID NO: 1568432 - protein, 5 aa, Staphylococcus aureus
SDGYD

SEQ ID NO: 1568433 - protein, 5 aa, Staphylococcus aureus
SDKHG

SEQ ID NO: 1568434 - protein, 4 aa, Staphylococcus aureus
SDNT

SEQ ID NO: 1568435 - protein, 9 aa, Staphylococcus aureus
SDTVPGQTV

SEQ ID NO: 1568436 - protein, 6 aa, Staphylococcus aureus
SEAGTS

SEQ ID NO: 1568437 - protein, 19 aa, Staphylococcus aureus
SEDIEDYVEKKEKEENSLK

SEQ ID NO: 1568438 - protein, 25 aa, Staphylococcus aureus
SEEITGNEGRTKGSTNYVNADTQVK

SEQ ID NO: 1568439 - protein, 11 aa, Staphylococcus aureus
SEHKIQKRTPK

SEQ ID NO: 1568440 - protein, 7 aa, Staphylococcus aureus
SEVSNVV

SEQ ID NO: 1568441 - protein, 8 aa, Staphylococcus aureus
SFNGKKSL

SEQ ID NO: 1568442 - protein, 5 aa, Staphylococcus aureus
SFSAG

SEQ ID NO: 1568443 - protein, 6 aa, Staphylococcus aureus
SFTLSG

SEQ ID NO: 1568444 - protein, 5 aa, Staphylococcus aureus
SGATG

SEQ ID NO: 1568445 - protein, 12 aa, Staphylococcus aureus
SGGQGPDEPISE

SEQ ID NO: 1568446 - protein, 13 aa, Staphylococcus aureus
SGLNKTDQANLNK

SEQ ID NO: 1568447 - protein, 8 aa, Staphylococcus aureus
SGNSTFKT

SEQ ID NO: 1568448 - protein, 7 aa, Staphylococcus aureus
SGTLASQ

SEQ ID NO: 1568449 - protein, 6 aa, Staphylococcus aureus
SGYGQG

SEQ ID NO: 1568450 - protein, 20 aa, Staphylococcus aureus
SIDTQTSTTGMTQDSINAYN

SEQ ID NO: 1568451 - protein, 4 aa, Staphylococcus aureus
SIGP

SEQ ID NO: 1568452 - protein, 4 aa, Staphylococcus aureus
SIPT

SEQ ID NO: 1568453 - protein, 31 aa, Staphylococcus aureus
SIQDNAATKANSKYINEDQPEQQNYDQAVQA

SEQ ID NO: 1568454 - protein, 204 aa, Staphylococcus aureus
SISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSTSLSGSESVSESSSLSDSISMSDSTSTSDSDSLSGSISLSGSTSLSTSDSLSDSKSLSSSQSMSGSESTSTSVSDSQSSSTSNSQFD

SEQ ID NO: 1568455 - protein, 6 aa, Staphylococcus aureus
SISNGQ

SEQ ID NO: 1568456 - protein, 14 aa, Staphylococcus aureus
SKANGGNATQTEVE

SEQ ID NO: 1568457 - protein, 168 aa, Staphylococcus aureus
SKEADASENSVTQSDSASNESKSNDSSSVSAAPKTDDTNVSDTKTSSNTNNGETSVAQNPAQQETTQSALTNATTEETPVTGEATTATNQANTPATTQSSNTNAEELVNQTSNETTSNDTNTVSSVNSPQNSTNAENVSTTQDTSTEATPSNNESAPQSTDASNKDVV

SEQ ID NO: 1568458 - protein, 8 aa, Staphylococcus aureus
SKEDQKTY

SEQ ID NO: 1568459 - protein, 5 aa, Staphylococcus aureus
SKEEF

SEQ ID NO: 1568460 - protein, 4 aa, Staphylococcus aureus
SKEG

SEQ ID NO: 1568461 - protein, 6 aa, Staphylococcus aureus
SKEKDD

SEQ ID NO: 1568462 - protein, 7 aa, Staphylococcus aureus
SKFGGKP

SEQ ID NO: 1568463 - protein, 11 aa, Staphylococcus aureus
SKHFRQDGYSD

SEQ ID NO: 1568464 - protein, 5 aa, Staphylococcus aureus
SKIAE

SEQ ID NO: 1568465 - protein, 12 aa, Staphylococcus aureus
SKLSKEKSHSWD

SEQ ID NO: 1568466 - protein, 6 aa, Staphylococcus aureus
SKVGLN

SEQ ID NO: 1568467 - protein, 8 aa, Staphylococcus aureus
SLDTNEKI

SEQ ID NO: 1568468 - protein, 34 aa, Staphylococcus aureus
SLEDNSEGNAVKSNVRKLEDAKANDDKKDTLSQL

SEQ ID NO: 1568469 - protein, 13 aa, Staphylococcus aureus
SLPKVQNSDEMAQ

SEQ ID NO: 1568470 - protein, 11 aa, Staphylococcus aureus
SLRDQVDKQVE

SEQ ID NO: 1568471 - protein, 149 aa, Staphylococcus aureus
SLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSESKSDSTSMS

SEQ ID NO: 1568472 - protein, 149 aa, Staphylococcus aureus
SLSESTSESTSESVSSSTSESTSLSDSTSESGSTSTSLSNSTSGSASISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMS

SEQ ID NO: 1568473 - protein, 7 aa, Staphylococcus aureus
SMSTQEI

SEQ ID NO: 1568474 - protein, 4 aa, Staphylococcus aureus
SNAL

SEQ ID NO: 1568475 - protein, 8 aa, Staphylococcus aureus
SNDSQNMG

SEQ ID NO: 1568476 - protein, 10 aa, Staphylococcus aureus
SNKTKDVNTH

SEQ ID NO: 1568477 - protein, 14 aa, Staphylococcus aureus
SNKYFKDNQKESMG

SEQ ID NO: 1568478 - protein, 8 aa, Staphylococcus aureus
SNNTSIAN

SEQ ID NO: 1568479 - protein, 10 aa, Staphylococcus aureus
SQAAKQQSIS

SEQ ID NO: 1568480 - protein, 58 aa, Staphylococcus aureus
SQAHAAETNQPASVVKQKQQSNNEQTENRESQVQNSQNSQNSQSLSATHENEQPNISQ

SEQ ID NO: 1568481 - protein, 6 aa, Staphylococcus aureus
SQEWKS

SEQ ID NO: 1568482 - protein, 4 aa, Staphylococcus aureus
SRDT

SEQ ID NO: 1568483 - protein, 6 aa, Staphylococcus aureus
SSATGH

SEQ ID NO: 1568484 - protein, 4 aa, Staphylococcus aureus
SSKI

SEQ ID NO: 1568485 - protein, 25 aa, Staphylococcus aureus
STGSGRMATGMAGSGAKLLVRKMLS

SEQ ID NO: 1568486 - protein, 18 aa, Staphylococcus aureus
STTDSGGGDGTVKPDEKL

SEQ ID NO: 1568487 - protein, 14 aa, Staphylococcus aureus
STYPINEQSTYKRH

SEQ ID NO: 1568488 - protein, 16 aa, Staphylococcus aureus
SVEPGVTKHIEEEVIK

SEQ ID NO: 1568489 - protein, 10 aa, Staphylococcus aureus
SVGGPASYST

SEQ ID NO: 1568490 - protein, 4 aa, Staphylococcus aureus
SVKG

SEQ ID NO: 1568491 - protein, 4 aa, Staphylococcus aureus
SVKQ

SEQ ID NO: 1568492 - protein, 11 aa, Staphylococcus aureus
SYKEEERSEKL

SEQ ID NO: 1568493 - protein, 4 aa, Staphylococcus aureus
TAEK

SEQ ID NO: 1568494 - protein, 34 aa, Staphylococcus aureus
TAQRNDLTNQISQATNLAGVESVKQNANSLDGAM

SEQ ID NO: 1568495 - protein, 6 aa, Staphylococcus aureus
TAVSGA

SEQ ID NO: 1568496 - protein, 23 aa, Staphylococcus aureus
TDITQHDTEVDNVDKTAKHSDLN

SEQ ID NO: 1568497 - protein, 9 aa, Staphylococcus aureus
TDPARKNEA

SEQ ID NO: 1568498 - protein, 31 aa, Staphylococcus aureus
TDPTSKGVSDSSIAQTYQAPRDSKKEEQQVT

SEQ ID NO: 1568499 - protein, 4 aa, Staphylococcus aureus
TDQP

SEQ ID NO: 1568500 - protein, 17 aa, Staphylococcus aureus
TDRPDLAQQFKQTINNK

SEQ ID NO: 1568501 - protein, 5 aa, Staphylococcus aureus
TDVGG

SEQ ID NO: 1568502 - protein, 5 aa, Staphylococcus aureus
TDVSY

SEQ ID NO: 1568503 - protein, 11 aa, Staphylococcus aureus
TEKDKANRYKT

SEQ ID NO: 1568504 - protein, 8 aa, Staphylococcus aureus
TFKPAKNN

SEQ ID NO: 1568505 - protein, 8 aa, Staphylococcus aureus
TGDATFGS

SEQ ID NO: 1568506 - protein, 4 aa, Staphylococcus aureus
TGKV

SEQ ID NO: 1568507 - protein, 8 aa, Staphylococcus aureus
TGSNYLET

SEQ ID NO: 1568508 - protein, 9 aa, Staphylococcus aureus
TIADKHKNQ

SEQ ID NO: 1568509 - protein, 4 aa, Staphylococcus aureus
TIAE

SEQ ID NO: 1568510 - protein, 25 aa, Staphylococcus aureus
TINLGNAEQARGSEIAKQAKDLTAH

SEQ ID NO: 1568511 - protein, 6 aa, Staphylococcus aureus
TISRAS

SEQ ID NO: 1568512 - protein, 7 aa, Staphylococcus aureus
TKGAGHS

SEQ ID NO: 1568513 - protein, 6 aa, Staphylococcus aureus
TKGETL

SEQ ID NO: 1568514 - protein, 8 aa, Staphylococcus aureus
TKLTTSQI

SEQ ID NO: 1568515 - protein, 6 aa, Staphylococcus aureus
TKNTAI

SEQ ID NO: 1568516 - protein, 7 aa, Staphylococcus aureus
TKQSYTQ

SEQ ID NO: 1568517 - protein, 4 aa, Staphylococcus aureus
TKTI

SEQ ID NO: 1568518 - protein, 8 aa, Staphylococcus aureus
TKVGKTGW

SEQ ID NO: 1568519 - protein, 6 aa, Staphylococcus aureus
TLADKL

SEQ ID NO: 1568520 - protein, 5 aa, Staphylococcus aureus
TLEEK

SEQ ID NO: 1568521 - protein, 9 aa, Staphylococcus aureus
TLSENGSYK

SEQ ID NO: 1568522 - protein, 10 aa, Staphylococcus aureus
TNERPDLDGG

SEQ ID NO: 1568523 - protein, 4 aa, Staphylococcus aureus
TNNI

SEQ ID NO: 1568524 - protein, 36 aa, Staphylococcus aureus
TNNQKSAISSQIDRAGHVSEVTATKNAATELNTQMG

SEQ ID NO: 1568525 - protein, 30 aa, Staphylococcus aureus
TPEVPAEPGKPVPPAKEEPKKPSKPVEQGK

SEQ ID NO: 1568526 - protein, 15 aa, Staphylococcus aureus
TPTSKAGNAAAVEES

SEQ ID NO: 1568527 - protein, 11 aa, Staphylococcus aureus
TQNLTNENYNI

SEQ ID NO: 1568528 - protein, 8 aa, Staphylococcus aureus
TQNSSGGL

SEQ ID NO: 1568529 - protein, 4 aa, Staphylococcus aureus
TQVY

SEQ ID NO: 1568530 - protein, 27 aa, Staphylococcus aureus
TRKNKQPASSEKGSSSHHGNAAMPQTK

SEQ ID NO: 1568531 - protein, 20 aa, Staphylococcus aureus
TRRNNTSPWVKEASADNVTG

SEQ ID NO: 1568532 - protein, 7 aa, Staphylococcus aureus
TSALDLE

SEQ ID NO: 1568533 - protein, 7 aa, Staphylococcus aureus
TSGRYSY

SEQ ID NO: 1568534 - protein, 4 aa, Staphylococcus aureus
TSQL

SEQ ID NO: 1568535 - protein, 11 aa, Staphylococcus aureus
TTFDPNQSGNT

SEQ ID NO: 1568536 - protein, 9 aa, Staphylococcus aureus
TTGNNEAVD

SEQ ID NO: 1568537 - protein, 10 aa, Staphylococcus aureus
TTKDDGIVQP

SEQ ID NO: 1568538 - protein, 28 aa, Staphylococcus aureus
TTPEGYTPTTVTSGSDIEKDSNGLTTTG

SEQ ID NO: 1568539 - protein, 12 aa, Staphylococcus aureus
TTVTKQGKQTVE

SEQ ID NO: 1568540 - protein, 7 aa, Staphylococcus aureus
VAGEAGA

SEQ ID NO: 1568541 - protein, 11 aa, Staphylococcus aureus
VAKENANNTID

SEQ ID NO: 1568542 - protein, 14 aa, Staphylococcus aureus
VATGTAWGSASTAG

SEQ ID NO: 1568543 - protein, 6 aa, Staphylococcus aureus
VDDTVI

SEQ ID NO: 1568544 - protein, 4 aa, Staphylococcus aureus
VDED

SEQ ID NO: 1568545 - protein, 23 aa, Staphylococcus aureus
VDESAITGESAPVIKESGGDFDG

SEQ ID NO: 1568546 - protein, 9 aa, Staphylococcus aureus
VDNETTQFD

SEQ ID NO: 1568547 - protein, 8 aa, Staphylococcus aureus
VDVTSETN

SEQ ID NO: 1568548 - protein, 41 aa, Staphylococcus aureus
VEAKEASDEKVETGTDVTSKVTVESGSIEAPQGNKVEPHAG

SEQ ID NO: 1568549 - protein, 13 aa, Staphylococcus aureus
VEKGQVPKKSIRQ

SEQ ID NO: 1568550 - protein, 10 aa, Staphylococcus aureus
VERQKGESKW

SEQ ID NO: 1568551 - protein, 10 aa, Staphylococcus aureus
VGRPDVKGRE

SEQ ID NO: 1568552 - protein, 9 aa, Staphylococcus aureus
VIRKTSIDE

SEQ ID NO: 1568553 - protein, 24 aa, Staphylococcus aureus
VITPNTDTTAYLPKGSKVYNGTQT

SEQ ID NO: 1568554 - protein, 8 aa, Staphylococcus aureus
VKDEETAV

SEQ ID NO: 1568555 - protein, 8 aa, Staphylococcus aureus
VKDQETTL

SEQ ID NO: 1568556 - protein, 17 aa, Staphylococcus aureus
VKEAQEESKNKSNPKID

SEQ ID NO: 1568557 - protein, 9 aa, Staphylococcus aureus
VKELDQNEF

SEQ ID NO: 1568558 - protein, 14 aa, Staphylococcus aureus
VKQNKQTDWSEDKL

SEQ ID NO: 1568559 - protein, 4 aa, Staphylococcus aureus
VLEG

SEQ ID NO: 1568560 - protein, 22 aa, Staphylococcus aureus
VMTTDVSTTVNGEVDPVDAETA

SEQ ID NO: 1568561 - protein, 32 aa, Staphylococcus aureus
VNDHTNVEQTVDYTQADSDKQKAYKQAIADAE

SEQ ID NO: 1568562 - protein, 6 aa, Staphylococcus aureus
VNEGMP

SEQ ID NO: 1568563 - protein, 6 aa, Staphylococcus aureus
VNFNNS

SEQ ID NO: 1568564 - protein, 12 aa, Staphylococcus aureus
VNNAKDALNGDA

SEQ ID NO: 1568565 - protein, 31 aa, Staphylococcus aureus
VNRATSAVTSNKNALNGDEKLAQSKTDAARA

SEQ ID NO: 1568566 - protein, 18 aa, Staphylococcus aureus
VNRATSAVTSNKNALNGY

SEQ ID NO: 1568567 - protein, 6 aa, Staphylococcus aureus
VPGHGI

SEQ ID NO: 1568568 - protein, 19 aa, Staphylococcus aureus
VPSTNGKKRLNDKYDATNI

SEQ ID NO: 1568569 - protein, 18 aa, Staphylococcus aureus
VPSTNGKNRLNDKYDATN

SEQ ID NO: 1568570 - protein, 18 aa, Staphylococcus aureus
VPSTNGNNRLTDKYDATN

SEQ ID NO: 1568571 - protein, 16 aa, Staphylococcus aureus
VQQDEDSIYLYHQKPA

SEQ ID NO: 1568572 - protein, 6 aa, Staphylococcus aureus
VQTGTA

SEQ ID NO: 1568573 - protein, 10 aa, Staphylococcus aureus
VRERSKSNEQ

SEQ ID NO: 1568574 - protein, 8 aa, Staphylococcus aureus
VSAGAITE

SEQ ID NO: 1568575 - protein, 7 aa, Staphylococcus aureus
VSAHSEQ

SEQ ID NO: 1568576 - protein, 7 aa, Staphylococcus aureus
VSEAENN

SEQ ID NO: 1568577 - protein, 8 aa, Staphylococcus aureus
VSERSLAD

SEQ ID NO: 1568578 - protein, 32 aa, Staphylococcus aureus
VSKEESQAERLANAAKQKQAKLTPGSKESQLT

SEQ ID NO: 1568579 - protein, 20 aa, Staphylococcus aureus
VSSTPTKDAQNNRDTKYKNQ

SEQ ID NO: 1568580 - protein, 16 aa, Staphylococcus aureus
VTDQNEARKILSSQAN

SEQ ID NO: 1568581 - protein, 4 aa, Staphylococcus aureus
VTNT

SEQ ID NO: 1568582 - protein, 18 aa, Staphylococcus aureus
VTRNESVDSNDSATVTVT

SEQ ID NO: 1568583 - protein, 9 aa, Staphylococcus aureus
WEGTQKVKP

SEQ ID NO: 1568584 - protein, 35 aa, Staphylococcus aureus
WKSSQDSSLTPELSAKAPKEYDTSQPFTDASNDVG

SEQ ID NO: 1568585 - protein, 6 aa, Staphylococcus aureus
YDMTEP

SEQ ID NO: 1568586 - protein, 8 aa, Staphylococcus aureus
YDSKPEDT

SEQ ID NO: 1568587 - protein, 13 aa, Staphylococcus aureus
YEEDTNPGGGQVI

SEQ ID NO: 1568588 - protein, 11 aa, Staphylococcus aureus
YFEDTTDENRQ

SEQ ID NO: 1568589 - protein, 18 aa, Staphylococcus aureus
YGDQSEKGSRSVSNKNNK

SEQ ID NO: 1568590 - protein, 9 aa, Staphylococcus aureus
YGSPEHNYQ

SEQ ID NO: 1568591 - protein, 15 aa, Staphylococcus aureus
YKNGNISSADNVPSF

SEQ ID NO: 1568592 - protein, 6 aa, Staphylococcus aureus
YKNLTN

SEQ ID NO: 1568593 - protein, 20 aa, Staphylococcus aureus
YLPSETLDKKGQQDRYDERQ

SEQ ID NO: 1568594 - protein, 16 aa, Staphylococcus aureus
YNQGMKATSGDQSLKV

SEQ ID NO: 1568595 - protein, 15 aa, Staphylococcus aureus
YNSADKFKTEEDYKA

SEQ ID NO: 1568596 - protein, 17 aa, Staphylococcus aureus
YNSRMTSFGTTKDYQDG

SEQ ID NO: 1568597 - protein, 7 aa, Staphylococcus aureus
YPAQSKA

SEQ ID NO: 1568598 - protein, 5 aa, Staphylococcus aureus
YPEAY

SEQ ID NO: 1568599 - protein, 6 aa, Staphylococcus aureus
YQGIDK

SEQ ID NO: 1568600 - protein, 19 aa, Staphylococcus aureus
YQQENAKKVIAESNQTTEL

SEQ ID NO: 1568601 - protein, 17 aa, Staphylococcus aureus
YRDDRPVDASYAKNRKI

SEQ ID NO: 1568602 - protein, 5 aa, Staphylococcus aureus
YRVPT

SEQ ID NO: 1568603 - protein, 10 aa, Staphylococcus aureus
YSNDNKTATV

SEQ ID NO: 1568604 - protein, 6 aa, Staphylococcus aureus
YSRKHN

SEQ ID NO: 1568605 - protein, 10 aa, Staphylococcus aureus
YTTQDEHGRA

SEQ ID NO: 1568606 - protein, 11 aa, Staphylococcus aureus
YTYSSGDGYHL

SEQ ID NO: 1568607 - protein, 101 aa, Staphylococcus aureus
YVPPQQQAPTKQRPAKEENDDKASKDESKDKDDNASQDKPDDNQKKTDDNKQPAQPKPQPQQPTPKPNNNQQNNQSNQQAKPQAPQQNSQSTTNKQNNAND

SEQ ID NO: 1568608 - protein, 241 aa, Staphylococcus aureus
YYEEETSDSDSDSDSDSDSDRDSDSDSDSDSDSDSDSDSDSDSDSDSDSDRDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNAT

SEQ ID NO: 1568609 - protein, 214 aa, Staphylococcus aureus
YYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTL

SEQ ID NO: 1568610 - protein, 8 aa, Staphylococcus aureus
YYERDGKT

SEQ ID NO: 1568611 - protein, 32 aa, Staphylococcus aureus
AAADTTTIQKSKGNANQASHKDTGKKELDSQD

SEQ ID NO: 1568612 - protein, 7 aa, Staphylococcus aureus
AAAKANV

SEQ ID NO: 1568613 - protein, 17 aa, Staphylococcus aureus
AADAKGTNVNGQVTASD

SEQ ID NO: 1568614 - protein, 18 aa, Staphylococcus aureus
AAFGNARGGIKGAVAGAA

SEQ ID NO: 1568615 - protein, 16 aa, Staphylococcus aureus
AANNNAQIHKQKSLSP

SEQ ID NO: 1568616 - protein, 7 aa, Staphylococcus aureus
AAQASGI

SEQ ID NO: 1568617 - protein, 17 aa, Staphylococcus aureus
AASIAQGKSLAKKGFSN

SEQ ID NO: 1568618 - protein, 7 aa, Staphylococcus aureus
ADAGNKK

SEQ ID NO: 1568619 - protein, 21 aa, Staphylococcus aureus
ADGTNVQWSNGAGAGANKPLP

SEQ ID NO: 1568620 - protein, 4 aa, Staphylococcus aureus
ADKE

SEQ ID NO: 1568621 - protein, 10 aa, Staphylococcus aureus
AEKKDLDNKE

SEQ ID NO: 1568622 - protein, 92 aa, Staphylococcus aureus
AFTKANADKTNKKEQQDNSAKKETTPATPSKPTTPPVEKESQKQDSQKDDNKQSASVEKENDASSESAKDKTPATKPAKAEVESSSITPTKV

SEQ ID NO: 1568623 - protein, 98 aa, Staphylococcus aureus
AFTKANTDKSNKKEQQDNSAKKEATPATPSKPTPSPVEKESQKQDSQKDDNKQLPSVEKENDASSESGKDKTPATKPAKGEVESSSTTPTKVVSTTQN

SEQ ID NO: 1568624 - protein, 47 aa, Staphylococcus aureus
AGGQGQSQSQSDNKQNSAMSDVNQASPQQNSKASASNNISGMPTAKL

SEQ ID NO: 1568625 - protein, 47 aa, Staphylococcus aureus
AGGQGQSQSQSDNKQNSAMSDVNQASPQQNSKVSASNNISGMPTAKL

SEQ ID NO: 1568626 - protein, 6 aa, Staphylococcus aureus
AGQAGS

SEQ ID NO: 1568627 - protein, 8 aa, Staphylococcus aureus
AGQTPVGR

SEQ ID NO: 1568628 - protein, 4 aa, Staphylococcus aureus
AGRE

SEQ ID NO: 1568629 - protein, 4 aa, Staphylococcus aureus
AGVQ

SEQ ID NO: 1568630 - protein, 9 aa, Staphylococcus aureus
AHAEQDQAW

SEQ ID NO: 1568631 - protein, 14 aa, Staphylococcus aureus
AIKFSDDSKFKETE

SEQ ID NO: 1568632 - protein, 28 aa, Staphylococcus aureus
AKANGTTADKIAADNKLADKNMIKPGQE

SEQ ID NO: 1568633 - protein, 14 aa, Staphylococcus aureus
AKASEVNENMKKQN

SEQ ID NO: 1568634 - protein, 7 aa, Staphylococcus aureus
AKDSSHF

SEQ ID NO: 1568635 - protein, 8 aa, Staphylococcus aureus
AKISQSKF

SEQ ID NO: 1568636 - protein, 12 aa, Staphylococcus aureus
AKSNKAGELDSE

SEQ ID NO: 1568637 - protein, 10 aa, Staphylococcus aureus
AKSNKPGVID

SEQ ID NO: 1568638 - protein, 10 aa, Staphylococcus aureus
AKSNKPGVLD

SEQ ID NO: 1568639 - protein, 15 aa, Staphylococcus aureus
AKTDIPDEIKTEVTA

SEQ ID NO: 1568640 - protein, 4 aa, Staphylococcus aureus
ALAG

SEQ ID NO: 1568641 - protein, 16 aa, Staphylococcus aureus
ALNQAKQNLTADTHEL

SEQ ID NO: 1568642 - protein, 14 aa, Staphylococcus aureus
ALPNGEIKARSSIS

SEQ ID NO: 1568643 - protein, 4 aa, Staphylococcus aureus
ALSV

SEQ ID NO: 1568644 - protein, 8 aa, Staphylococcus aureus
AMNKPNVA

SEQ ID NO: 1568645 - protein, 7 aa, Staphylococcus aureus
ANNQELA

SEQ ID NO: 1568646 - protein, 13 aa, Staphylococcus aureus
ANNSIDGDKTDNL

SEQ ID NO: 1568647 - protein, 15 aa, Staphylococcus aureus
ANRQDEPNDKNATSV

SEQ ID NO: 1568648 - protein, 17 aa, Staphylococcus aureus
ANTSTAIVGPSGSGKST

SEQ ID NO: 1568649 - protein, 15 aa, Staphylococcus aureus
APNTKKEKQPKRGDD

SEQ ID NO: 1568650 - protein, 6 aa, Staphylococcus aureus
APSIAD

SEQ ID NO: 1568651 - protein, 8 aa, Staphylococcus aureus
AQKAGIKK

SEQ ID NO: 1568652 - protein, 17 aa, Staphylococcus aureus
AQPRTVSESKPRVTRSA

SEQ ID NO: 1568653 - protein, 50 aa, Staphylococcus aureus
AQQAAIKEEASANNLSDTSQEAQEVQEAKKEAQAETDKSAAVSNEEPKAV

SEQ ID NO: 1568654 - protein, 14 aa, Staphylococcus aureus
AQSEINSQKERAIA

SEQ ID NO: 1568655 - protein, 7 aa, Staphylococcus aureus
AQTNNPT

SEQ ID NO: 1568656 - protein, 9 aa, Staphylococcus aureus
AREEWRKND

SEQ ID NO: 1568657 - protein, 4 aa, Staphylococcus aureus
AREF

SEQ ID NO: 1568658 - protein, 9 aa, Staphylococcus aureus
ARNNPFKKG

SEQ ID NO: 1568659 - protein, 29 aa, Staphylococcus aureus
ASAKEGYVESAKDINKKLKDNEVEEEINK

SEQ ID NO: 1568660 - protein, 9 aa, Staphylococcus aureus
ASDEDYQKL

SEQ ID NO: 1568661 - protein, 15 aa, Staphylococcus aureus
ASDKNKYKDVTNEMQ

SEQ ID NO: 1568662 - protein, 6 aa, Staphylococcus aureus
ASDLSN

SEQ ID NO: 1568663 - protein, 70 aa, Staphylococcus aureus
ASDSDSGSDSDSSSDSDSESDSNSDSESGSNNNVVPPNSPKNGTNASNKNEAKDSKEPLPDTGSEDEANT

SEQ ID NO: 1568664 - protein, 7 aa, Staphylococcus aureus
ASEGHPE

SEQ ID NO: 1568665 - protein, 114 aa, Staphylococcus aureus
ASESVSESTSESGSTSESTSESDSTSTSLSDSQSTSRSTSASGSASTSTSTSDSRSTSASTSTSMRTSTSDSQSMSLSTSTSTSVSDSTSLSDSVSDSTSDSTSTSTSGSMSAS

SEQ ID NO: 1568666 - protein, 7 aa, Staphylococcus aureus
ASGAGVS

SEQ ID NO: 1568667 - protein, 234 aa, Staphylococcus aureus
ASMNQSGVDSNSASQSASTSTSTSTSESDSQSTSSYTSQSTSQSESTSTSTSLSDSTSMSRSTSQSGSTSTSASLSGSESESDSQSISTSTSESKSESTSTSLSDSTSISNSGSASTSTSLSNSASASESDSSSTSLSDSTSASMQSSESDSQSTSRSTSASGSASTSTSTSDSRSTSASTSTSMRTSTSDSQSMSLSTSTSTSVSDSTSLSDSVSDSTSDSTSTSTSGSMSAS

SEQ ID NO: 1568668 - protein, 5 aa, Staphylococcus aureus
ASSLG

SEQ ID NO: 1568669 - protein, 7 aa, Staphylococcus aureus
ATDEHHH

SEQ ID NO: 1568670 - protein, 15 aa, Staphylococcus aureus
ATLSSEIKYTSPHDV

SEQ ID NO: 1568671 - protein, 4 aa, Staphylococcus aureus
ATNM

SEQ ID NO: 1568672 - protein, 5 aa, Staphylococcus aureus
ATPKD

SEQ ID NO: 1568673 - protein, 8 aa, Staphylococcus aureus
ATQLNQSM

SEQ ID NO: 1568674 - protein, 13 aa, Staphylococcus aureus
ATQTQKATQIQTA

SEQ ID NO: 1568675 - protein, 79 aa, Staphylococcus aureus
ATTDKQQVPPTKEAAHHYGEEAATNVSASAQGTADDTNNKVTSNAPSNKPSTAVSTTVNETRDVDTQQASTQKPTRTAT

SEQ ID NO: 1568676 - protein, 12 aa, Staphylococcus aureus
ATYQDGTTSTVT

SEQ ID NO: 1568677 - protein, 11 aa, Staphylococcus aureus
AVNESKRVNTK

SEQ ID NO: 1568678 - protein, 28 aa, Staphylococcus aureus
AVTRAKAALNGADNLRNAKTSATNTIDG

SEQ ID NO: 1568679 - protein, 10 aa, Staphylococcus aureus
AYNPKPKDLP

SEQ ID NO: 1568680 - protein, 8 aa, Staphylococcus aureus
AYNTRGKI

SEQ ID NO: 1568681 - protein, 12 aa, Staphylococcus aureus
AYVGSGAAQLKN

SEQ ID NO: 1568682 - protein, 6 aa, Staphylococcus aureus
CGASTL

SEQ ID NO: 1568683 - protein, 19 aa, Staphylococcus aureus
CGKGNKVKEDSKETQIKNS

SEQ ID NO: 1568684 - protein, 19 aa, Staphylococcus aureus
CKPDPNFSSVQSANPEDHH

SEQ ID NO: 1568685 - protein, 9 aa, Staphylococcus aureus
DAERSSSDI

SEQ ID NO: 1568686 - protein, 8 aa, Staphylococcus aureus
DAFGNGET

SEQ ID NO: 1568687 - protein, 7 aa, Staphylococcus aureus
DAISSAW

SEQ ID NO: 1568688 - protein, 111 aa, Staphylococcus aureus
DAKKTSKAKKDKQDTEVAVASSNSDNVNYEASATTPATTSSADTDSEDSEKSSKDEDKQNASKSDKSSVEKSESNEETAPVEPMPQSKPTTSEASPSQNIHNEDSMNDAST

SEQ ID NO: 1568689 - protein, 4 aa, Staphylococcus aureus
DALR

SEQ ID NO: 1568690 - protein, 7 aa, Staphylococcus aureus
DAQNTSI

SEQ ID NO: 1568691 - protein, 5 aa, Staphylococcus aureus
DATTT

SEQ ID NO: 1568692 - protein, 10 aa, Staphylococcus aureus
DDFPTDEYGE

SEQ ID NO: 1568693 - protein, 9 aa, Staphylococcus aureus
DDGIIDSKE

SEQ ID NO: 1568694 - protein, 12 aa, Staphylococcus aureus
DDKNGKIQNGDT

SEQ ID NO: 1568695 - protein, 59 aa, Staphylococcus aureus
DDVSKKQNSLDSVDQDTEKSKYYEQNSEATLSTKSTDKVESTEMRKLSSDKNKVGHEEQ

SEQ ID NO: 1568696 - protein, 58 aa, Staphylococcus aureus
DDVSKKQNSLDSVDQDTENAKYYDQNSEATLSTKSTDKVESTDMRKLSSDKNKVGHEE

SEQ ID NO: 1568697 - protein, 4 aa, Staphylococcus aureus
DEED

SEQ ID NO: 1568698 - protein, 13 aa, Staphylococcus aureus
DEIKKYKKDIDDA

SEQ ID NO: 1568699 - protein, 9 aa, Staphylococcus aureus
DEKEEQKSI

SEQ ID NO: 1568700 - protein, 25 aa, Staphylococcus aureus
DELPESVYANTNDQEKFKDVTNDMS

SEQ ID NO: 1568701 - protein, 141 aa, Staphylococcus aureus
DFEEDTLPKVSGQNEGQQTIEEDTTPPTPEVPSEPETPTPPTPEVPSEPETPTPPTPEVPSEPETPTPPTPEVPSEPETPTPPTPEVPSEPETPTPPTPEVPSEPGTPVPPTPEVPAEPGKPVPPAKDEPKKPSKPVEQGK

SEQ ID NO: 1568702 - protein, 85 aa, Staphylococcus aureus
DFEEDTLPKVSGQNEGQQTIEEDTTPPTPPTPEVPSEPGTPTPPTPEVPSEPTPPTPEVPAEPGKPVPPAKEEPKKPSKPVEQGK

SEQ ID NO: 1568703 - protein, 6 aa, Staphylococcus aureus
DGATVN

SEQ ID NO: 1568704 - protein, 11 aa, Staphylococcus aureus
DGNVSLPKAGV

SEQ ID NO: 1568705 - protein, 10 aa, Staphylococcus aureus
DGSAKLNNMT

SEQ ID NO: 1568706 - protein, 12 aa, Staphylococcus aureus
DGSTDETARVAR

SEQ ID NO: 1568707 - protein, 7 aa, Staphylococcus aureus
DGVTGIK

SEQ ID NO: 1568708 - protein, 16 aa, Staphylococcus aureus
DHVDKKSNTSANDQYH

SEQ ID NO: 1568709 - protein, 8 aa, Staphylococcus aureus
DIHNPNGT

SEQ ID NO: 1568710 - protein, 9 aa, Staphylococcus aureus
DIPTKQAPK

SEQ ID NO: 1568711 - protein, 10 aa, Staphylococcus aureus
DIQSNPEDLK

SEQ ID NO: 1568712 - protein, 18 aa, Staphylococcus aureus
DITKSKQLTEESYANRPL

SEQ ID NO: 1568713 - protein, 5 aa, Staphylococcus aureus
DKAYD

SEQ ID NO: 1568714 - protein, 8 aa, Staphylococcus aureus
DKGSPLEN

SEQ ID NO: 1568715 - protein, 4 aa, Staphylococcus aureus
DKIS

SEQ ID NO: 1568716 - protein, 7 aa, Staphylococcus aureus
DKLDDLT

SEQ ID NO: 1568717 - protein, 14 aa, Staphylococcus aureus
DKLTQNHKGKGHSK

SEQ ID NO: 1568718 - protein, 6 aa, Staphylococcus aureus
DKNEVV

SEQ ID NO: 1568719 - protein, 15 aa, Staphylococcus aureus
DKNKVNNTGTETNID

SEQ ID NO: 1568720 - protein, 11 aa, Staphylococcus aureus
DKNNHNGKAAK

SEQ ID NO: 1568721 - protein, 7 aa, Staphylococcus aureus
DKQNING

SEQ ID NO: 1568722 - protein, 15 aa, Staphylococcus aureus
DKTAGTNENKAAVEQ

SEQ ID NO: 1568723 - protein, 5 aa, Staphylococcus aureus
DKTRN

SEQ ID NO: 1568724 - protein, 17 aa, Staphylococcus aureus
DKVEDEKNKEKNAKNIR

SEQ ID NO: 1568725 - protein, 16 aa, Staphylococcus aureus
DKVQGSAIAKAEAEQL

SEQ ID NO: 1568726 - protein, 6 aa, Staphylococcus aureus
DLSTNE

SEQ ID NO: 1568727 - protein, 18 aa, Staphylococcus aureus
DLTNAQKEAAKRQIEGAT

SEQ ID NO: 1568728 - protein, 18 aa, Staphylococcus aureus
DNGDATPQQISEEKHRVD

SEQ ID NO: 1568729 - protein, 10 aa, Staphylococcus aureus
DNIGKKSWQE

SEQ ID NO: 1568730 - protein, 18 aa, Staphylococcus aureus
DNKTNKEVGRTITDDKGG

SEQ ID NO: 1568731 - protein, 38 aa, Staphylococcus aureus
DNLNNAQKQAVTDQINGAHTIDEANQIKQNAQNLNTAM

SEQ ID NO: 1568732 - protein, 37 aa, Staphylococcus aureus
DNLNNAQKQTVTDQINGAHTVDEANQIKQNAQNLNTA

SEQ ID NO: 1568733 - protein, 16 aa, Staphylococcus aureus
DNPDTWKNTVGNTHKT

SEQ ID NO: 1568734 - protein, 74 aa, Staphylococcus aureus
DNSALKTAKTKLDEEINKSVTTDGMTQSSIQAYENAKRAGQTESTNAQNVINNGDATDQQIAAEKTKVEEKYNS

SEQ ID NO: 1568735 - protein, 75 aa, Staphylococcus aureus
DNSALKTAKTKLDEEINKSVTTDGMTQSSIQAYENAKRAGQTESTNAQNVINNGDATDQQIAAEKTKVEEKYNSL

SEQ ID NO: 1568736 - protein, 75 aa, Staphylococcus aureus
DNSALRTAKTKLDEEINKSVTTDGMTQSSIQAYENAKRAGQTESTNAQNVINNGDATDQQIAAKKTKVEEKYNGL

SEQ ID NO: 1568737 - protein, 8 aa, Staphylococcus aureus
DPARRNDA

SEQ ID NO: 1568738 - protein, 9 aa, Staphylococcus aureus
DPNTNTNGI

SEQ ID NO: 1568739 - protein, 11 aa, Staphylococcus aureus
DQIPKNYTATQ

SEQ ID NO: 1568740 - protein, 14 aa, Staphylococcus aureus
DQNPNLTDKEKQAL

SEQ ID NO: 1568741 - protein, 33 aa, Staphylococcus aureus
DRHSGIKNTTITTLPNGWTSNLTKSDNKNGSLA

SEQ ID NO: 1568742 - protein, 34 aa, Staphylococcus aureus
DRHSGLKSTTITTLPSGWTSNLTKSDKKNGSLAI

SEQ ID NO: 1568743 - protein, 87 aa, Staphylococcus aureus
DSDSDSDSDSDSDSDSDSDSDSDSDSDSDSDSDSDSDSDSRVTPPNNEQKAPSNPKGEVNHSNKVSKQHKTDALPETGDKSENTNAT

SEQ ID NO: 1568744 - protein, 15 aa, Staphylococcus aureus
DSKGYAQSKDTKYPV

SEQ ID NO: 1568745 - protein, 198 aa, Staphylococcus aureus
DSMSTSGSLAASDSKSMSVSSSMSTSQSGSTSESLSDSQSTSDSDSKSLSLSTSQSGSTSTSTSTSSSVRMSESQSTSGSMSTSQSDSTSISTSFSDSTSDSKSASTASSESISQSVSTSTSDSMSTSTSLSTSNSERTSTSLSDSTSLSTSESDSTSDSTSTSDSISEAISGSESTSISLSESNSTSDSESKSASAF

SEQ ID NO: 1568746 - protein, 5 aa, Staphylococcus aureus
DSRNG

SEQ ID NO: 1568747 - protein, 7 aa, Staphylococcus aureus
DSTLQSL

SEQ ID NO: 1568748 - protein, 30 aa, Staphylococcus aureus
DTPETVKPNTPVQPFGKEASSYSKKTLTNQ

SEQ ID NO: 1568749 - protein, 13 aa, Staphylococcus aureus
DTPSTESISDSLT

SEQ ID NO: 1568750 - protein, 25 aa, Staphylococcus aureus
DTSKLSDSYYADPNDSNLKEVTGEF

SEQ ID NO: 1568751 - protein, 22 aa, Staphylococcus aureus
DTSVSSNITKQLPSSDIKTQTF

SEQ ID NO: 1568752 - protein, 25 aa, Staphylococcus aureus
DVQKTLQNDVDNGSFYKNKDQQVGA

SEQ ID NO: 1568753 - protein, 8 aa, Staphylococcus aureus
DVSARTQG

SEQ ID NO: 1568754 - protein, 15 aa, Staphylococcus aureus
DWNPFGKDEVAETVN

SEQ ID NO: 1568755 - protein, 12 aa, Staphylococcus aureus
DYAEQNVEHRNL

SEQ ID NO: 1568756 - protein, 16 aa, Staphylococcus aureus
DYDTPTGTPIRTPMGG

SEQ ID NO: 1568757 - protein, 9 aa, Staphylococcus aureus
EADLSDTSV

SEQ ID NO: 1568758 - protein, 14 aa, Staphylococcus aureus
EALAARDISSTNVT

SEQ ID NO: 1568759 - protein, 18 aa, Staphylococcus aureus
EASAANVAGIAGTNNGIT

SEQ ID NO: 1568760 - protein, 9 aa, Staphylococcus aureus
EASADNVTG

SEQ ID NO: 1568761 - protein, 20 aa, Staphylococcus aureus
EAVDKAKEALNKATGQNLTA

SEQ ID NO: 1568762 - protein, 11 aa, Staphylococcus aureus
EDAEKEVKKHK

SEQ ID NO: 1568763 - protein, 16 aa, Staphylococcus aureus
EDDSYVKTTEVSTRID

SEQ ID NO: 1568764 - protein, 5 aa, Staphylococcus aureus
EDEKL

SEQ ID NO: 1568765 - protein, 25 aa, Staphylococcus aureus
EDIAEGRLDEVQNTDSMLNQKNKRI

SEQ ID NO: 1568766 - protein, 4 aa, Staphylococcus aureus
EDIK

SEQ ID NO: 1568767 - protein, 6 aa, Staphylococcus aureus
EDKGTY

SEQ ID NO: 1568768 - protein, 42 aa, Staphylococcus aureus
EDREENLNQHQDKQNINNTTSKKADKQIHKDSIDKHERFKNS

SEQ ID NO: 1568769 - protein, 21 aa, Staphylococcus aureus
EDSQGTVNQTFKDSESGSERF

SEQ ID NO: 1568770 - protein, 7 aa, Staphylococcus aureus
EEELNSE

SEQ ID NO: 1568771 - protein, 10 aa, Staphylococcus aureus
EEGLDKGAKN

SEQ ID NO: 1568772 - protein, 11 aa, Staphylococcus aureus
EEKRKRETRKK

SEQ ID NO: 1568773 - protein, 12 aa, Staphylococcus aureus
EEQGATKDFDKD

SEQ ID NO: 1568774 - protein, 8 aa, Staphylococcus aureus
EESQHIEV

SEQ ID NO: 1568775 - protein, 6 aa, Staphylococcus aureus
EETGDI

SEQ ID NO: 1568776 - protein, 12 aa, Staphylococcus aureus
EETVAKSKFDTK

SEQ ID NO: 1568777 - protein, 16 aa, Staphylococcus aureus
EFPKPDKSKYNGQSYP

SEQ ID NO: 1568778 - protein, 17 aa, Staphylococcus aureus
EFSEDSGNGSISGQYDA

SEQ ID NO: 1568779 - protein, 15 aa, Staphylococcus aureus
EGFEGQTASSVKNYS

SEQ ID NO: 1568780 - protein, 18 aa, Staphylococcus aureus
EGKSSGFSGAISGGAEQL

SEQ ID NO: 1568781 - protein, 8 aa, Staphylococcus aureus
EGNLKKQS

SEQ ID NO: 1568782 - protein, 9 aa, Staphylococcus aureus
EHNKAHVKD

SEQ ID NO: 1568783 - protein, 23 aa, Staphylococcus aureus
EIKNNGDLSNDKRSEETKKYNDK

SEQ ID NO: 1568784 - protein, 27 aa, Staphylococcus aureus
EIPNAEQTVNYQNAEDNAKTNFDDAKR

SEQ ID NO: 1568785 - protein, 27 aa, Staphylococcus aureus
EIPTAEQTVNYQNADDVAKSNFDDAKR

SEQ ID NO: 1568786 - protein, 14 aa, Staphylococcus aureus
EITQNMNDTQRSEI

SEQ ID NO: 1568787 - protein, 9 aa, Staphylococcus aureus
EKDSKGVDD

SEQ ID NO: 1568788 - protein, 8 aa, Staphylococcus aureus
EKEENDVE

SEQ ID NO: 1568789 - protein, 10 aa, Staphylococcus aureus
EKGVENVPGL

SEQ ID NO: 1568790 - protein, 6 aa, Staphylococcus aureus
EKLGTG

SEQ ID NO: 1568791 - protein, 5 aa, Staphylococcus aureus
EKLSD

SEQ ID NO: 1568792 - protein, 11 aa, Staphylococcus aureus
EKNNEDTSSII

SEQ ID NO: 1568793 - protein, 9 aa, Staphylococcus aureus
EKNNRQRQY

SEQ ID NO: 1568794 - protein, 5 aa, Staphylococcus aureus
EKRAG

SEQ ID NO: 1568795 - protein, 13 aa, Staphylococcus aureus
EKTVDDNRTTLTD

SEQ ID NO: 1568796 - protein, 23 aa, Staphylococcus aureus
EKVGNGAEHSKTLNAVRGQNNQW

SEQ ID NO: 1568797 - protein, 4 aa, Staphylococcus aureus
ELDS

SEQ ID NO: 1568798 - protein, 4 aa, Staphylococcus aureus
ELMP

SEQ ID NO: 1568799 - protein, 8 aa, Staphylococcus aureus
EMSAKDTT

SEQ ID NO: 1568800 - protein, 14 aa, Staphylococcus aureus
ENFKNGAKQAQLQS

SEQ ID NO: 1568801 - protein, 9 aa, Staphylococcus aureus
ENINKNPKY

SEQ ID NO: 1568802 - protein, 4 aa, Staphylococcus aureus
ENKE

SEQ ID NO: 1568803 - protein, 11 aa, Staphylococcus aureus
ENKNVTEEQQL

SEQ ID NO: 1568804 - protein, 6 aa, Staphylococcus aureus
ENLEGG

SEQ ID NO: 1568805 - protein, 11 aa, Staphylococcus aureus
ENLTSKTALKK

SEQ ID NO: 1568806 - protein, 6 aa, Staphylococcus aureus
EPLITG

SEQ ID NO: 1568807 - protein, 11 aa, Staphylococcus aureus
EQIKNRQEQAA

SEQ ID NO: 1568808 - protein, 19 aa, Staphylococcus aureus
EQKRIKKAIASNELPQTQD

SEQ ID NO: 1568809 - protein, 48 aa, Staphylococcus aureus
ERAKQAANTAITNASDLNTKQKEALKAQVTSAGRVSAANGVEHTATEI

SEQ ID NO: 1568810 - protein, 13 aa, Staphylococcus aureus
ERSMEGETVGIND

SEQ ID NO: 1568811 - protein, 24 aa, Staphylococcus aureus
ESQIRDYESKSKKVKEKAKSYIKE

SEQ ID NO: 1568812 - protein, 10 aa, Staphylococcus aureus
ESQLKKYRGK

SEQ ID NO: 1568813 - protein, 110 aa, Staphylococcus aureus
ESSRTDSDSSMQTEKIKKDSSDGNKGSNLKSEIISDKSNTVTKLSESDDEVNNQKPLTLPEEQKLKRQQSQNEQTKTYTYGDSEQNDKSNHENDLSHHTPSISDDKDNVM

SEQ ID NO: 1568814 - protein, 43 aa, Staphylococcus aureus
ESSRTDSDSSMQTEKIKKDSSDGNKSSNLKSEVISDKSNSVPI

SEQ ID NO: 1568815 - protein, 5 aa, Staphylococcus aureus
ETFRK

SEQ ID NO: 1568816 - protein, 7 aa, Staphylococcus aureus
ETGNGKL

SEQ ID NO: 1568817 - protein, 4 aa, Staphylococcus aureus
ETIN

SEQ ID NO: 1568818 - protein, 7 aa, Staphylococcus aureus
ETPTGYL

SEQ ID NO: 1568819 - protein, 17 aa, Staphylococcus aureus
EYKEDTLTETVTGQYDE

SEQ ID NO: 1568820 - protein, 9 aa, Staphylococcus aureus
EYKKKGNVG

SEQ ID NO: 1568821 - protein, 11 aa, Staphylococcus aureus
FDAENSSNNIV

SEQ ID NO: 1568822 - protein, 15 aa, Staphylococcus aureus
FDEMEEKYDYHEDNK

SEQ ID NO: 1568823 - protein, 5 aa, Staphylococcus aureus
FEDKG

SEQ ID NO: 1568824 - protein, 196 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1568825 - protein, 200 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1568826 - protein, 188 aa, Staphylococcus aureus
FEEDTSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1568827 - protein, 242 aa, Staphylococcus aureus
FEEDTSDSDSDSDSDSDSESDSDSDSESDSDSDSDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1568828 - protein, 52 aa, Staphylococcus aureus
FKKEESKDENNDSASSHANDNNIDDSTDSNIENEDYRYNQEIDDQNESNGFA

SEQ ID NO: 1568829 - protein, 8 aa, Staphylococcus aureus
FKSDIAKS

SEQ ID NO: 1568830 - protein, 13 aa, Staphylococcus aureus
FKSSKDANGAISD

SEQ ID NO: 1568831 - protein, 14 aa, Staphylococcus aureus
FKYTEKSTDSYKQR

SEQ ID NO: 1568832 - protein, 10 aa, Staphylococcus aureus
FNDNKDDEAF

SEQ ID NO: 1568833 - protein, 13 aa, Staphylococcus aureus
FNDNSKSQIERQQ

SEQ ID NO: 1568834 - protein, 381 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANT

SEQ ID NO: 1568835 - protein, 393 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1568836 - protein, 9 aa, Staphylococcus aureus
FNQDSEKAQ

SEQ ID NO: 1568837 - protein, 21 aa, Staphylococcus aureus
FNSNSTSEEHNKRPVEQNPNQ

SEQ ID NO: 1568838 - protein, 5 aa, Staphylococcus aureus
FSAES

SEQ ID NO: 1568839 - protein, 8 aa, Staphylococcus aureus
FSGAGDGF

SEQ ID NO: 1568840 - protein, 8 aa, Staphylococcus aureus
FSGTGELE

SEQ ID NO: 1568841 - protein, 9 aa, Staphylococcus aureus
FSGTKQAGK

SEQ ID NO: 1568842 - protein, 9 aa, Staphylococcus aureus
FSKENASLR

SEQ ID NO: 1568843 - protein, 10 aa, Staphylococcus aureus
FSKGGKSDLS

SEQ ID NO: 1568844 - protein, 25 aa, Staphylococcus aureus
FSNEKINSIRNSEIGTTDEKQAAMN

SEQ ID NO: 1568845 - protein, 45 aa, Staphylococcus aureus
FSSSKTYGPYPQNKDITISASGKAKGKTFTTQTKTIKASDLKYNT

SEQ ID NO: 1568846 - protein, 12 aa, Staphylococcus aureus
FTPDTSKLKDVT

SEQ ID NO: 1568847 - protein, 11 aa, Staphylococcus aureus
FTPKNSRSAGW

SEQ ID NO: 1568848 - protein, 15 aa, Staphylococcus aureus
FTPKNSSSAGWIAGG

SEQ ID NO: 1568849 - protein, 39 aa, Staphylococcus aureus
FTQADQDKQQAYNNAANQAQQIANGIPTPVLTPDTVTQA

SEQ ID NO: 1568850 - protein, 39 aa, Staphylococcus aureus
FTQADQDKQQAYNNAANQAQQIANGTPTPVLAPDTVTQA

SEQ ID NO: 1568851 - protein, 8 aa, Staphylococcus aureus
FTTGSNEV

SEQ ID NO: 1568852 - protein, 11 aa, Staphylococcus aureus
FYANNSEISEI

SEQ ID NO: 1568853 - protein, 13 aa, Staphylococcus aureus
GAENPGPKIEQGL

SEQ ID NO: 1568854 - protein, 9 aa, Staphylococcus aureus
GAKNDPQSL

SEQ ID NO: 1568855 - protein, 7 aa, Staphylococcus aureus
GDGNEYL

SEQ ID NO: 1568856 - protein, 9 aa, Staphylococcus aureus
GDIKGSSIG

SEQ ID NO: 1568857 - protein, 4 aa, Staphylococcus aureus
GDIQ

SEQ ID NO: 1568858 - protein, 12 aa, Staphylococcus aureus
GDLDEQNDLSSI

SEQ ID NO: 1568859 - protein, 9 aa, Staphylococcus aureus
GDNAPQGVA

SEQ ID NO: 1568860 - protein, 11 aa, Staphylococcus aureus
GDSDVKTHQTL

SEQ ID NO: 1568861 - protein, 41 aa, Staphylococcus aureus
GDTIPHNHNDSEKMDYKSYAADKAKANKEAHKAKQKNGKLN

SEQ ID NO: 1568862 - protein, 49 aa, Staphylococcus aureus
GEAKAAEETGGTNTEAQPKTEAVASPTTTTEKAPEAKPVANAVSVSNKE

SEQ ID NO: 1568863 - protein, 5 aa, Staphylococcus aureus
GEGYR

SEQ ID NO: 1568864 - protein, 9 aa, Staphylococcus aureus
GEIGSPINN

SEQ ID NO: 1568865 - protein, 14 aa, Staphylococcus aureus
GEKEVRKSNVQKFE

SEQ ID NO: 1568866 - protein, 14 aa, Staphylococcus aureus
GEKVKTLDVTSETN

SEQ ID NO: 1568867 - protein, 10 aa, Staphylococcus aureus
GENETKNDYK

SEQ ID NO: 1568868 - protein, 11 aa, Staphylococcus aureus
GERPTESPGVP

SEQ ID NO: 1568869 - protein, 34 aa, Staphylococcus aureus
GFKHPGEWKNQDLGTGAGNKSVEVTVKGPSMDAI

SEQ ID NO: 1568870 - protein, 47 aa, Staphylococcus aureus
GGEKPKDPKGPENPEKPSRPTHPSGPVNPDNPGLSKDRAKPNEPVHS

SEQ ID NO: 1568871 - protein, 5 aa, Staphylococcus aureus
GGETG

SEQ ID NO: 1568872 - protein, 8 aa, Staphylococcus aureus
GGETTSKG

SEQ ID NO: 1568873 - protein, 5 aa, Staphylococcus aureus
GGHAV

SEQ ID NO: 1568874 - protein, 9 aa, Staphylococcus aureus
GGLTGSNEV

SEQ ID NO: 1568875 - protein, 22 aa, Staphylococcus aureus
GGNYTNTSPDKQGAYTDAYNAA

SEQ ID NO: 1568876 - protein, 6 aa, Staphylococcus aureus
GGQAGG

SEQ ID NO: 1568877 - protein, 8 aa, Staphylococcus aureus
GHSQQEYP

SEQ ID NO: 1568878 - protein, 6 aa, Staphylococcus aureus
GIRPGE

SEQ ID NO: 1568879 - protein, 4 aa, Staphylococcus aureus
GITK

SEQ ID NO: 1568880 - protein, 5 aa, Staphylococcus aureus
GKALK

SEQ ID NO: 1568881 - protein, 14 aa, Staphylococcus aureus
GKELAKLNNPKDAF

SEQ ID NO: 1568882 - protein, 9 aa, Staphylococcus aureus
GKLPDEKNY

SEQ ID NO: 1568883 - protein, 11 aa, Staphylococcus aureus
GKLPKKKKSKR

SEQ ID NO: 1568884 - protein, 46 aa, Staphylococcus aureus
GKQHEAEKKEKKTEFKTTKKKVDKKDKQEDKQTANSKEDIKKSSPL

SEQ ID NO: 1568885 - protein, 13 aa, Staphylococcus aureus
GKRMNGKKANTIN

SEQ ID NO: 1568886 - protein, 11 aa, Staphylococcus aureus
GKTDPMEKRTR

SEQ ID NO: 1568887 - protein, 7 aa, Staphylococcus aureus
GLDKSEA

SEQ ID NO: 1568888 - protein, 8 aa, Staphylococcus aureus
GLEGKKKI

SEQ ID NO: 1568889 - protein, 6 aa, Staphylococcus aureus
GLQDKN

SEQ ID NO: 1568890 - protein, 5 aa, Staphylococcus aureus
GLTDR

SEQ ID NO: 1568891 - protein, 4 aa, Staphylococcus aureus
GNLG

SEQ ID NO: 1568892 - protein, 32 aa, Staphylococcus aureus
GNVDQAVKGMKRDDSFNKKDIEKTLKKEKKYE

SEQ ID NO: 1568893 - protein, 9 aa, Staphylococcus aureus
GNVEDPGYY

SEQ ID NO: 1568894 - protein, 6 aa, Staphylococcus aureus
GPDNKI

SEQ ID NO: 1568895 - protein, 5 aa, Staphylococcus aureus
GPETV

SEQ ID NO: 1568896 - protein, 9 aa, Staphylococcus aureus
GQAIPSGTF

SEQ ID NO: 1568897 - protein, 30 aa, Staphylococcus aureus
GQAIPSSSFTNITSDRTIPTAQEVSQMNAG

SEQ ID NO: 1568898 - protein, 14 aa, Staphylococcus aureus
GQAPNKNNTTIGQD

SEQ ID NO: 1568899 - protein, 14 aa, Staphylococcus aureus
GQDFPAGNGSSAAD

SEQ ID NO: 1568900 - protein, 15 aa, Staphylococcus aureus
GQDFPTGNGASASDY

SEQ ID NO: 1568901 - protein, 65 aa, Staphylococcus aureus
GQKITKDKVKAADKNKKVVTEPKNTKVETDKVTTSVETKTEKAQDSLNDNTTKTMTSDKPEDNQP

SEQ ID NO: 1568902 - protein, 8 aa, Staphylococcus aureus
GQQSSVTK

SEQ ID NO: 1568903 - protein, 6 aa, Staphylococcus aureus
GQSFSI

SEQ ID NO: 1568904 - protein, 7 aa, Staphylococcus aureus
GQTSIDE

SEQ ID NO: 1568905 - protein, 4 aa, Staphylococcus aureus
GSAI

SEQ ID NO: 1568906 - protein, 12 aa, Staphylococcus aureus
GSGNLKGSSVGY

SEQ ID NO: 1568907 - protein, 13 aa, Staphylococcus aureus
GSIETFDKEKNKF

SEQ ID NO: 1568908 - protein, 4 aa, Staphylococcus aureus
GSKR

SEQ ID NO: 1568909 - protein, 8 aa, Staphylococcus aureus
GSVAGAAM

SEQ ID NO: 1568910 - protein, 10 aa, Staphylococcus aureus
GTEAPETTYY

SEQ ID NO: 1568911 - protein, 12 aa, Staphylococcus aureus
GTEQHTANHFPG

SEQ ID NO: 1568912 - protein, 6 aa, Staphylococcus aureus
GTIAGY

SEQ ID NO: 1568913 - protein, 14 aa, Staphylococcus aureus
GTIDQVDKTNNTYR

SEQ ID NO: 1568914 - protein, 4 aa, Staphylococcus aureus
GTIG

SEQ ID NO: 1568915 - protein, 7 aa, Staphylococcus aureus
GTPEKVS

SEQ ID NO: 1568916 - protein, 12 aa, Staphylococcus aureus
GTRGKEKNPGNF

SEQ ID NO: 1568917 - protein, 5 aa, Staphylococcus aureus
GTRVP

SEQ ID NO: 1568918 - protein, 10 aa, Staphylococcus aureus
GVGEDIPSDY

SEQ ID NO: 1568919 - protein, 4 aa, Staphylococcus aureus
GYAN

SEQ ID NO: 1568920 - protein, 5 aa, Staphylococcus aureus
GYHED

SEQ ID NO: 1568921 - protein, 7 aa, Staphylococcus aureus
GYNKKTV

SEQ ID NO: 1568922 - protein, 6 aa, Staphylococcus aureus
HATNTI

SEQ ID NO: 1568923 - protein, 10 aa, Staphylococcus aureus
HDEKEKQKAL

SEQ ID NO: 1568924 - protein, 31 aa, Staphylococcus aureus
HDQNTVKQGVNFTDADKAKRDAYTNAVSRAE

SEQ ID NO: 1568925 - protein, 143 aa, Staphylococcus aureus
HEAQASEKTLTSNAAAQKETLNQPGEQGNAITSHQMQSGKQLDDMHKENGKSGTVTEGKDTLQSSKHQSTQNSKTIRTQNDNQVKQDSERQGSKQSHQNNATNKTERQNDQVQNTHHAERNGSQSTTSQSNDVDKSQPSIPAQ

SEQ ID NO: 1568926 - protein, 37 aa, Staphylococcus aureus
HEQAQNKKAKRENQRDEPAPPLQNDNDLRRRQQDKPM

SEQ ID NO: 1568927 - protein, 10 aa, Staphylococcus aureus
HIKKPKDAIN

SEQ ID NO: 1568928 - protein, 6 aa, Staphylococcus aureus
HISTSR

SEQ ID NO: 1568929 - protein, 27 aa, Staphylococcus aureus
HKDEATTKVDSDNTEPPIESKDHDSKK

SEQ ID NO: 1568930 - protein, 4 aa, Staphylococcus aureus
HKEV

SEQ ID NO: 1568931 - protein, 9 aa, Staphylococcus aureus
HKSEAGTSS

SEQ ID NO: 1568932 - protein, 11 aa, Staphylococcus aureus
HLNKDTGKTEF

SEQ ID NO: 1568933 - protein, 8 aa, Staphylococcus aureus
HNNTSPWV

SEQ ID NO: 1568934 - protein, 9 aa, Staphylococcus aureus
HPTGPSTVT

SEQ ID NO: 1568935 - protein, 83 aa, Staphylococcus aureus
HQAQASEQSNDTTQSSKNNASADSEKNNMIETPQLNTTANDTSDISANTNSANVDSTAKPMSTQTSNTTTTEPASTNETPQLT

SEQ ID NO: 1568936 - protein, 5 aa, Staphylococcus aureus
HQFGE

SEQ ID NO: 1568937 - protein, 5 aa, Staphylococcus aureus
HQTVE

SEQ ID NO: 1568938 - protein, 12 aa, Staphylococcus aureus
HRGKRYGKKKRS

SEQ ID NO: 1568939 - protein, 58 aa, Staphylococcus aureus
HSNKAKERMLNEQKQEQKEKRQKENAEKERKKKQQEEKEQNELDSQANQYQQLPQQNQ

SEQ ID NO: 1568940 - protein, 18 aa, Staphylococcus aureus
HYEQKSDSSNVHTLNSSS

SEQ ID NO: 1568941 - protein, 34 aa, Staphylococcus aureus
IADKADTKTSGNYVNADANKRQAYDEKVTAAESI

SEQ ID NO: 1568942 - protein, 8 aa, Staphylococcus aureus
IADPTRDG

SEQ ID NO: 1568943 - protein, 8 aa, Staphylococcus aureus
IADPTRNG

SEQ ID NO: 1568944 - protein, 4 aa, Staphylococcus aureus
IAIE

SEQ ID NO: 1568945 - protein, 27 aa, Staphylococcus aureus
IAKKSVANQEKKRAELPKTGAESTQKG

SEQ ID NO: 1568946 - protein, 7 aa, Staphylococcus aureus
IAKTRGL

SEQ ID NO: 1568947 - protein, 14 aa, Staphylococcus aureus
IDAATSSGSGLDPH

SEQ ID NO: 1568948 - protein, 6 aa, Staphylococcus aureus
IDEQIG

SEQ ID NO: 1568949 - protein, 7 aa, Staphylococcus aureus
IDKNNKP

SEQ ID NO: 1568950 - protein, 9 aa, Staphylococcus aureus
IDNATTVAG

SEQ ID NO: 1568951 - protein, 61 aa, Staphylococcus aureus
IDNQTESNHDEDHDITSESVESAESVKHAPQSDGLTNDSNEDETEQSLKEPATYKEDRRSS

SEQ ID NO: 1568952 - protein, 4 aa, Staphylococcus aureus
IEDK

SEQ ID NO: 1568953 - protein, 8 aa, Staphylococcus aureus
IEPDSQNA

SEQ ID NO: 1568954 - protein, 12 aa, Staphylococcus aureus
IEPTEALEDSEN

SEQ ID NO: 1568955 - protein, 7 aa, Staphylococcus aureus
IEQGTRE

SEQ ID NO: 1568956 - protein, 11 aa, Staphylococcus aureus
IESGDTVYPHQ

SEQ ID NO: 1568957 - protein, 6 aa, Staphylococcus aureus
IETEED

SEQ ID NO: 1568958 - protein, 12 aa, Staphylococcus aureus
IGASAAAGAAVG

SEQ ID NO: 1568959 - protein, 5 aa, Staphylococcus aureus
IGGNR

SEQ ID NO: 1568960 - protein, 4 aa, Staphylococcus aureus
IGNK

SEQ ID NO: 1568961 - protein, 61 aa, Staphylococcus aureus
IGNQTESNHDEDHDITSESVESAESVKQAPQSDDLTNDSNEDEIEQSLKEPVTYKEDRRSS

SEQ ID NO: 1568962 - protein, 47 aa, Staphylococcus aureus
IGQTTSPSMNAQEINQAKDQVTAKQQALNGQENLRTAQTNAKQHLNG

SEQ ID NO: 1568963 - protein, 26 aa, Staphylococcus aureus
IHGQNKGNQSFEEDTEKDKPKYEHGG

SEQ ID NO: 1568964 - protein, 37 aa, Staphylococcus aureus
IHKSKDASKDTSEDPAVSTTDNNHEVAKTPNNDGSGH

SEQ ID NO: 1568965 - protein, 8 aa, Staphylococcus aureus
IKGSSIGY

SEQ ID NO: 1568966 - protein, 5 aa, Staphylococcus aureus
IKWTG

SEQ ID NO: 1568967 - protein, 12 aa, Staphylococcus aureus
ILGPKGMENSAG

SEQ ID NO: 1568968 - protein, 31 aa, Staphylococcus aureus
INDYKDGDISYNPNVPSYSAKYQLKNDDYNV

SEQ ID NO: 1568969 - protein, 26 aa, Staphylococcus aureus
INGLTNPVKVDNEKLNKVKDHQVGGN

SEQ ID NO: 1568970 - protein, 34 aa, Staphylococcus aureus
INQAKDQVTAKQQALNGQENLRTAQTNAKQHLNG

SEQ ID NO: 1568971 - protein, 7 aa, Staphylococcus aureus
INTGNAA

SEQ ID NO: 1568972 - protein, 6 aa, Staphylococcus aureus
IPKEQR

SEQ ID NO: 1568973 - protein, 12 aa, Staphylococcus aureus
IPKIADKNYTEK

SEQ ID NO: 1568974 - protein, 4 aa, Staphylococcus aureus
IQDR

SEQ ID NO: 1568975 - protein, 7 aa, Staphylococcus aureus
IRGVTSA

SEQ ID NO: 1568976 - protein, 6 aa, Staphylococcus aureus
IRPGEK

SEQ ID NO: 1568977 - protein, 234 aa, Staphylococcus aureus
ISASESDSMSTSDSSSISGSNSTSTSLSTSDSMSGSVSVSTSTSLSDSISGSISVSDSSSTSTSESLSDSMAQSQSTSTSASGSLSTSISSSMSASASTSTSQSTSVSTSLSTSDSISDSTSISISGSQSAVESESTSDSTSISDSESLSTSGSDSTSTSTSDSTSTSLSLSTSGSISGSTSTSASGSLSMSNSGSTSVSDSLSTSGSLSTSGSTSVSDSTSMSESNSASISMS

SEQ ID NO: 1568978 - protein, 216 aa, Staphylococcus aureus
ISASESDSMSTSDSSSISGSNSTSTSLSTSDSMSGSVSVSTSTSLSDSISGSISVSDSSSTSTSESLSDSMAQSQSTSTSASGSLSTSISSSMSASASTSTSQSTSVSTSLSTSDSISDSTSISISGSQSAVESESTSDSTSISDSESLSTSGSDSTSTSTSDSTSTSLSLSTSGSISGSTSTSASGSLSMSNSGSTSVSDSTSMSESNSASISMS

SEQ ID NO: 1568979 - protein, 92 aa, Staphylococcus aureus
ISASESDSMSTSDSSSISGSNSTSTSLSTSDSMSGSVSVSTSTSLSDSISGSTSLSDSSSTSTSTSLSDSMSQSQSTSTSASGSLSTSISTS

SEQ ID NO: 1568980 - protein, 93 aa, Staphylococcus aureus
ISASESDSMSTSDSSSISGSNSTSTSLSTSDSMSGSVSVSTSTSLSDSISGSTSLSDSSSTSTSTSLSDSMSQSQSTSTSASGSLSTSISTSM

SEQ ID NO: 1568981 - protein, 93 aa, Staphylococcus aureus
ISASESDSMSTSDSSSISGSNSTSTSLSTSDSMSGSVSVSTSTSLSDSISGSTSVSDSSSTSTSTSLSDSMSQSQSTSTSASGSLSTSISTSM

SEQ ID NO: 1568982 - protein, 288 aa, Staphylococcus aureus
ISASESDSVSTSDSSSISRSNSTSTSLSTSDSMSGSVSVSTSTSLSDSISGSTSVSDSSSTSTSESLSDSMAQSQSTSTSASGSLSTSISTSMSMSASKSTSQSTSVSTSLSTSDSISDSTSISISGSQSAVESESTSDSTSISDSESLSTSDSDSTSTSTSGSTSGSTSTSTSESLSMSGSDSTSVSDSTSMSESDSTSVSMSQDKSDSTSISDSESVSTSTSMSLSTSDSTSTSESLSTSMSGSQSISDSTSTSMSNSTSMSNSTSTSMSGSTSTSESNSMHPSDS

SEQ ID NO: 1568983 - protein, 6 aa, Staphylococcus aureus
ISDDAH

SEQ ID NO: 1568984 - protein, 13 aa, Staphylococcus aureus
ISGGQFKDSPPME

SEQ ID NO: 1568985 - protein, 72 aa, Staphylococcus aureus
ISSRDGEDFKRPSSVSGSIPSINVSGSQDNNTTNRSAHGGSDTSANSSGTAQSNNNTRSQQSRNSGGLTGIF

SEQ ID NO: 1568986 - protein, 14 aa, Staphylococcus aureus
ISVTNTPNGSNVST

SEQ ID NO: 1568987 - protein, 4 aa, Staphylococcus aureus
ITST

SEQ ID NO: 1568988 - protein, 7 aa, Staphylococcus aureus
ITTDEIS

SEQ ID NO: 1568989 - protein, 8 aa, Staphylococcus aureus
ITTSESPT

SEQ ID NO: 1568990 - protein, 18 aa, Staphylococcus aureus
ITYPAYKEADNNSIGSAF

SEQ ID NO: 1568991 - protein, 9 aa, Staphylococcus aureus
IYTDGQEKF

SEQ ID NO: 1568992 - protein, 20 aa, Staphylococcus aureus
KAANPFAKELEKRKKSAISK

SEQ ID NO: 1568993 - protein, 20 aa, Staphylococcus aureus
KAANPFAKELKNRKKAAISK

SEQ ID NO: 1568994 - protein, 5 aa, Staphylococcus aureus
KAAVT

SEQ ID NO: 1568995 - protein, 16 aa, Staphylococcus aureus
KADASTQNSPSVQDKQ

SEQ ID NO: 1568996 - protein, 17 aa, Staphylococcus aureus
KADASTQNSPSVQDKQF

SEQ ID NO: 1568997 - protein, 12 aa, Staphylococcus aureus
KADRDGYIIFPK

SEQ ID NO: 1568998 - protein, 62 aa, Staphylococcus aureus
KAKEDAKNAIKALTNAKRDQINSNPDLTLEQKAKALKEIDEAEKRALENIENAQTKDQLNQG

SEQ ID NO: 1568999 - protein, 5 aa, Staphylococcus aureus
KALNR

SEQ ID NO: 1569000 - protein, 33 aa, Staphylococcus aureus
KAPLENAKNQLQQSIDTQTSTTGMTQDSINAYN

SEQ ID NO: 1569001 - protein, 27 aa, Staphylococcus aureus
KAPLQTAKTQLEQSINQPTDTTGMTTA

SEQ ID NO: 1569002 - protein, 16 aa, Staphylococcus aureus
KAQGPNTAKDNVESAL

SEQ ID NO: 1569003 - protein, 7 aa, Staphylococcus aureus
KASDAKE

SEQ ID NO: 1569004 - protein, 7 aa, Staphylococcus aureus
KDAEPIK

SEQ ID NO: 1569005 - protein, 5 aa, Staphylococcus aureus
KDCRQ

SEQ ID NO: 1569006 - protein, 19 aa, Staphylococcus aureus
KDDNEAPNNAVKAKDSKIV

SEQ ID NO: 1569007 - protein, 7 aa, Staphylococcus aureus
KDGAVTF

SEQ ID NO: 1569008 - protein, 7 aa, Staphylococcus aureus
KDIDQTV

SEQ ID NO: 1569009 - protein, 27 aa, Staphylococcus aureus
KDIENKYNKQATLKQTGETVSNGHQKD

SEQ ID NO: 1569010 - protein, 5 aa, Staphylococcus aureus
KDKQT

SEQ ID NO: 1569011 - protein, 12 aa, Staphylococcus aureus
KDLNDRYSPSKL

SEQ ID NO: 1569012 - protein, 20 aa, Staphylococcus aureus
KDLNSERENVEDRKDNAQSG

SEQ ID NO: 1569013 - protein, 57 aa, Staphylococcus aureus
KDNSTSNQSSKTQLTQKDEDKSENMPEEKSESETDKDFQSTEEVPANENTENNQHEI

SEQ ID NO: 1569014 - protein, 17 aa, Staphylococcus aureus
KDPMDKEEKQAGQGFKG

SEQ ID NO: 1569015 - protein, 69 aa, Staphylococcus aureus
KDQATAAKMQDQTVPQEANSQVDNKTTNDANSIATNSELKNPQTLDLPQSSPQTISNAQGTSKPSVRTR

SEQ ID NO: 1569016 - protein, 5 aa, Staphylococcus aureus
KDQSG

SEQ ID NO: 1569017 - protein, 13 aa, Staphylococcus aureus
KDSLNNDESLDKV

SEQ ID NO: 1569018 - protein, 17 aa, Staphylococcus aureus
KDSSYISKSDNGEVEMT

SEQ ID NO: 1569019 - protein, 4 aa, Staphylococcus aureus
KEEF

SEQ ID NO: 1569020 - protein, 17 aa, Staphylococcus aureus
KEGFRDQEFEKGDKGNW

SEQ ID NO: 1569021 - protein, 8 aa, Staphylococcus aureus
KEGKQNKI

SEQ ID NO: 1569022 - protein, 12 aa, Staphylococcus aureus
KEKNKSINIENQ

SEQ ID NO: 1569023 - protein, 13 aa, Staphylococcus aureus
KELEREAKQNRNT

SEQ ID NO: 1569024 - protein, 8 aa, Staphylococcus aureus
KELSSTLT

SEQ ID NO: 1569025 - protein, 5 aa, Staphylococcus aureus
KENSK

SEQ ID NO: 1569026 - protein, 9 aa, Staphylococcus aureus
KENTISEPK

SEQ ID NO: 1569027 - protein, 6 aa, Staphylococcus aureus
KESQIT

SEQ ID NO: 1569028 - protein, 4 aa, Staphylococcus aureus
KFGP

SEQ ID NO: 1569029 - protein, 7 aa, Staphylococcus aureus
KFNPNAK

SEQ ID NO: 1569030 - protein, 78 aa, Staphylococcus aureus
KGEPKEEITKDPINELTEYGPETITPGHRDEFDPKLPTGEKEEVPGKPGIKNPETGDVVRPPVDSVTKYGPVKGDSIV

SEQ ID NO: 1569031 - protein, 4 aa, Staphylococcus aureus
KGGI

SEQ ID NO: 1569032 - protein, 11 aa, Staphylococcus aureus
KGKNGEKAKEN

SEQ ID NO: 1569033 - protein, 39 aa, Staphylococcus aureus
KGKTPEEAALEHDDNNKNHYNENTRYEYDEDTNSTHQRT

SEQ ID NO: 1569034 - protein, 39 aa, Staphylococcus aureus
KGKTPEEAALEHDDNNKNHYNENTRYEYDEETNATHQRT

SEQ ID NO: 1569035 - protein, 7 aa, Staphylococcus aureus
KGQSFSI

SEQ ID NO: 1569036 - protein, 6 aa, Staphylococcus aureus
KGQSIG

SEQ ID NO: 1569037 - protein, 4 aa, Staphylococcus aureus
KGRF

SEQ ID NO: 1569038 - protein, 12 aa, Staphylococcus aureus
KGRLTKSFTSNL

SEQ ID NO: 1569039 - protein, 6 aa, Staphylococcus aureus
KHINDN

SEQ ID NO: 1569040 - protein, 7 aa, Staphylococcus aureus
KHNSNKK

SEQ ID NO: 1569041 - protein, 15 aa, Staphylococcus aureus
KHQLNSKKQATNIEQ

SEQ ID NO: 1569042 - protein, 15 aa, Staphylococcus aureus
KHQLNSKQQATNIEQ

SEQ ID NO: 1569043 - protein, 12 aa, Staphylococcus aureus
KHRQSTASLSNI

SEQ ID NO: 1569044 - protein, 9 aa, Staphylococcus aureus
KHSNEMSNE

SEQ ID NO: 1569045 - protein, 11 aa, Staphylococcus aureus
KIATGTPDGVH

SEQ ID NO: 1569046 - protein, 10 aa, Staphylococcus aureus
KIDDDRKLDE

SEQ ID NO: 1569047 - protein, 7 aa, Staphylococcus aureus
KIPNTDA

SEQ ID NO: 1569048 - protein, 5 aa, Staphylococcus aureus
KKAHK

SEQ ID NO: 1569049 - protein, 4 aa, Staphylococcus aureus
KKDF

SEQ ID NO: 1569050 - protein, 6 aa, Staphylococcus aureus
KKDGGI

SEQ ID NO: 1569051 - protein, 8 aa, Staphylococcus aureus
KKDLDNKE

SEQ ID NO: 1569052 - protein, 4 aa, Staphylococcus aureus
KKEI

SEQ ID NO: 1569053 - protein, 4 aa, Staphylococcus aureus
KKGY

SEQ ID NO: 1569054 - protein, 8 aa, Staphylococcus aureus
KKKAEVEL

SEQ ID NO: 1569055 - protein, 13 aa, Staphylococcus aureus
KKKKDENEQDDSQ

SEQ ID NO: 1569056 - protein, 12 aa, Staphylococcus aureus
KKLKGAASAAGI

SEQ ID NO: 1569057 - protein, 15 aa, Staphylococcus aureus
KKLSNKEETLSENDA

SEQ ID NO: 1569058 - protein, 6 aa, Staphylococcus aureus
KKMESR

SEQ ID NO: 1569059 - protein, 28 aa, Staphylococcus aureus
KKNDVSETETVNTDNKDTVKQKEAKFEN

SEQ ID NO: 1569060 - protein, 38 aa, Staphylococcus aureus
KKNIDDLAKQYDKVSQEQGENSTKAQNLRQEYNKQANE

SEQ ID NO: 1569061 - protein, 41 aa, Staphylococcus aureus
KKNQKDNQSKGKKSASKKPSKKVAAKKKKKKSKKIKNNLFL

SEQ ID NO: 1569062 - protein, 21 aa, Staphylococcus aureus
KKSLDAFSNKNVKAKLDASIQ

SEQ ID NO: 1569063 - protein, 88 aa, Staphylococcus aureus
KLNDAQAPKEEDNKKPGKEDGNKPGKEDNKKPGKEDGNKPGKEDNNKPGKEDGNKPGKEDNNKPGKEDGNKPGKEDGNKPGKEDGNGV

SEQ ID NO: 1569064 - protein, 80 aa, Staphylococcus aureus
KLNDAQAPKEEDNNKPGKEDGNKPGKEDNKKPGKEDGNKPGKEDNKKPGKEDGNKPGKEDGNKPGKEDGNKPGKEDGNGV

SEQ ID NO: 1569065 - protein, 96 aa, Staphylococcus aureus
KLNDAQAPKEEDNNKPGKEDNNKPGKEDGNKPGKEDNKKPGKEDGNKPGKEDNKKPGKEDGNKPGKEDGNKPGKEDGNKPGKEDGNKPGKEDGNGV

SEQ ID NO: 1569066 - protein, 35 aa, Staphylococcus aureus
KLNGQKPNTKTSANNNQKKATSKLNKGRATNNNYS

SEQ ID NO: 1569067 - protein, 10 aa, Staphylococcus aureus
KLNNSDENVK

SEQ ID NO: 1569068 - protein, 13 aa, Staphylococcus aureus
KLTQNHKGKGHSK

SEQ ID NO: 1569069 - protein, 11 aa, Staphylococcus aureus
KMDRKQRNEVK

SEQ ID NO: 1569070 - protein, 11 aa, Staphylococcus aureus
KMGNSDSNVKK

SEQ ID NO: 1569071 - protein, 11 aa, Staphylococcus aureus
KMTYGSNQSVN

SEQ ID NO: 1569072 - protein, 5 aa, Staphylococcus aureus
KNAKM

SEQ ID NO: 1569073 - protein, 32 aa, Staphylococcus aureus
KNANGTSNNSAVNPSIKANDVHTKSNKQMAKQ

SEQ ID NO: 1569074 - protein, 15 aa, Staphylococcus aureus
KNDDHTHASILLSSN

SEQ ID NO: 1569075 - protein, 16 aa, Staphylococcus aureus
KNDKDGRPQENEKRYP

SEQ ID NO: 1569076 - protein, 6 aa, Staphylococcus aureus
KNEFKS

SEQ ID NO: 1569077 - protein, 4 aa, Staphylococcus aureus
KNHP

SEQ ID NO: 1569078 - protein, 5 aa, Staphylococcus aureus
KNHPI

SEQ ID NO: 1569079 - protein, 6 aa, Staphylococcus aureus
KNKAID

SEQ ID NO: 1569080 - protein, 8 aa, Staphylococcus aureus
KNKSENEK

SEQ ID NO: 1569081 - protein, 15 aa, Staphylococcus aureus
KNKTFTNGKVGKSDS

SEQ ID NO: 1569082 - protein, 10 aa, Staphylococcus aureus
KNPESEEYKV

SEQ ID NO: 1569083 - protein, 7 aa, Staphylococcus aureus
KNPPESW

SEQ ID NO: 1569084 - protein, 32 aa, Staphylococcus aureus
KNSTKKAVDSVESAVGEATKSISNHINPMKWS

SEQ ID NO: 1569085 - protein, 7 aa, Staphylococcus aureus
KNTNKVY

SEQ ID NO: 1569086 - protein, 8 aa, Staphylococcus aureus
KNVGKEIQ

SEQ ID NO: 1569087 - protein, 16 aa, Staphylococcus aureus
KNVSFTNPQDVNNIPG

SEQ ID NO: 1569088 - protein, 14 aa, Staphylococcus aureus
KNYKNGKISSNEKV

SEQ ID NO: 1569089 - protein, 7 aa, Staphylococcus aureus
KPDGKEV

SEQ ID NO: 1569090 - protein, 5 aa, Staphylococcus aureus
KPGLD

SEQ ID NO: 1569091 - protein, 5 aa, Staphylococcus aureus
KPIKG

SEQ ID NO: 1569092 - protein, 6 aa, Staphylococcus aureus
KPNTST

SEQ ID NO: 1569093 - protein, 4 aa, Staphylococcus aureus
KPSE

SEQ ID NO: 1569094 - protein, 5 aa, Staphylococcus aureus
KPSKV

SEQ ID NO: 1569095 - protein, 10 aa, Staphylococcus aureus
KPVAKNDLNE

SEQ ID NO: 1569096 - protein, 7 aa, Staphylococcus aureus
KQAKKAI

SEQ ID NO: 1569097 - protein, 4 aa, Staphylococcus aureus
KQAP

SEQ ID NO: 1569098 - protein, 21 aa, Staphylococcus aureus
KQKLTKDIAEAENKLSELEKK

SEQ ID NO: 1569099 - protein, 28 aa, Staphylococcus aureus
KQLKEEKDSTKDKDKKKEIQKDIEELEK

SEQ ID NO: 1569100 - protein, 8 aa, Staphylococcus aureus
KQNNGGLT

SEQ ID NO: 1569101 - protein, 8 aa, Staphylococcus aureus
KQPEGDQR

SEQ ID NO: 1569102 - protein, 7 aa, Staphylococcus aureus
KQQTTNP

SEQ ID NO: 1569103 - protein, 15 aa, Staphylococcus aureus
KQTGPNTAKTAVEQA

SEQ ID NO: 1569104 - protein, 12 aa, Staphylococcus aureus
KREIQELKNLKM

SEQ ID NO: 1569105 - protein, 12 aa, Staphylococcus aureus
KRYKRKEKAVEM

SEQ ID NO: 1569106 - protein, 25 aa, Staphylococcus aureus
KSDAIKSNAETLVDNNSNSNNENNA

SEQ ID NO: 1569107 - protein, 8 aa, Staphylococcus aureus
KSEAGTSS

SEQ ID NO: 1569108 - protein, 4 aa, Staphylococcus aureus
KSEG

SEQ ID NO: 1569109 - protein, 9 aa, Staphylococcus aureus
KSEKVKVEK

SEQ ID NO: 1569110 - protein, 6 aa, Staphylococcus aureus
KSEPIE

SEQ ID NO: 1569111 - protein, 8 aa, Staphylococcus aureus
KSETVKVS

SEQ ID NO: 1569112 - protein, 10 aa, Staphylococcus aureus
KSIDSSLSAI

SEQ ID NO: 1569113 - protein, 31 aa, Staphylococcus aureus
KSKFTEFDNKTDESIEKGKFDDEGGAAPNNN

SEQ ID NO: 1569114 - protein, 148 aa, Staphylococcus aureus
KSKNEQAALKAQQAAIKEEASANNLSDTSQEAQEIQEAKREAQTETDKSAAVSNEESKASALKAQQAAIKEEASANNLSDTSQEAQAIQEAKKEAQAETDKSADVSNEESKASTLNVSKEESQAERLANAAKQKQAKLTLGSKESQLT

SEQ ID NO: 1569115 - protein, 148 aa, Staphylococcus aureus
KSKNEQAALKAQQAAIKEEASANNLSDTSQEAQEIQEAKREAQTETDKSAAVSNEESKASALKAQQAAIKEEASANNLSDTSQEAQAIQEVKKEAQAETDKSADVSNEESKASTLNVSKEESQAERLANAAKQKQAKLTPGSKESQLT

SEQ ID NO: 1569116 - protein, 146 aa, Staphylococcus aureus
KSKNEQATLKAQQAAIKEEASANNLSDTSQEAQEIQEAKKEVQAEADKSAAVSNKESKASALKAQQAAIKEEVSANNLSDTSQEAQEIQEAKKEAQAEKDSDTSTKDASAAKVEVSKPESQAERLANAAKQKQAKLTPGSKESQLT

SEQ ID NO: 1569117 - protein, 24 aa, Staphylococcus aureus
KSKSGHKQQLKELPKTGVNNESNT

SEQ ID NO: 1569118 - protein, 6 aa, Staphylococcus aureus
KSLQAQ

SEQ ID NO: 1569119 - protein, 9 aa, Staphylococcus aureus
KSSASSAFN

SEQ ID NO: 1569120 - protein, 8 aa, Staphylococcus aureus
KSTENGDF

SEQ ID NO: 1569121 - protein, 4 aa, Staphylococcus aureus
KTDW

SEQ ID NO: 1569122 - protein, 8 aa, Staphylococcus aureus
KTELKHND

SEQ ID NO: 1569123 - protein, 24 aa, Staphylococcus aureus
KTEMAQKSSAEQNGNRNHDIEGNV

SEQ ID NO: 1569124 - protein, 6 aa, Staphylococcus aureus
KTEYDY

SEQ ID NO: 1569125 - protein, 6 aa, Staphylococcus aureus
KTGSAK

SEQ ID NO: 1569126 - protein, 6 aa, Staphylococcus aureus
KTPKYS

SEQ ID NO: 1569127 - protein, 25 aa, Staphylococcus aureus
KTSKVTQTDNQQDVANDSTDEADTS

SEQ ID NO: 1569128 - protein, 13 aa, Staphylococcus aureus
KTSNTAKKAFESL

SEQ ID NO: 1569129 - protein, 34 aa, Staphylococcus aureus
KTSQDTSLTPELSTKAPKEYDTSQPFTDTSNEIG

SEQ ID NO: 1569130 - protein, 4 aa, Staphylococcus aureus
KTTE

SEQ ID NO: 1569131 - protein, 9 aa, Staphylococcus aureus
KTVKEAEQI

SEQ ID NO: 1569132 - protein, 58 aa, Staphylococcus aureus
KVAQSSTTNDEQPASQNVNTKKDSATAATTQPDKEEGKHKQNESQSANKNGNDNRAAH

SEQ ID NO: 1569133 - protein, 19 aa, Staphylococcus aureus
KVDQQRKKQQQKVDIRRRF

SEQ ID NO: 1569134 - protein, 14 aa, Staphylococcus aureus
KVEPSNDFKPKKGG

SEQ ID NO: 1569135 - protein, 79 aa, Staphylococcus aureus
KVVKDEDSEFNDGKFGKSYEEIRKEQLEDGQRDESEDRKEEKDIAEDKKEADKSDEKDEPAHRQAPNIEKPYDPNHPDN

SEQ ID NO: 1569136 - protein, 7 aa, Staphylococcus aureus
KYTKPKH

SEQ ID NO: 1569137 - protein, 14 aa, Staphylococcus aureus
KYTPETTSINGEKV

SEQ ID NO: 1569138 - protein, 11 aa, Staphylococcus aureus
LAKTNGKHDIE

SEQ ID NO: 1569139 - protein, 4 aa, Staphylococcus aureus
LAND

SEQ ID NO: 1569140 - protein, 27 aa, Staphylococcus aureus
LAPLQAAKTQLQNDIDQPTSTTGMTSA

SEQ ID NO: 1569141 - protein, 28 aa, Staphylococcus aureus
LAPLQTAKTQLQNDIDQPTSTTGMTSTS

SEQ ID NO: 1569142 - protein, 22 aa, Staphylococcus aureus
LARASDYFSEAGATPATKAFGR

SEQ ID NO: 1569143 - protein, 19 aa, Staphylococcus aureus
LDALPNKKTTKVDVDTNGL

SEQ ID NO: 1569144 - protein, 33 aa, Staphylococcus aureus
LDKAKEKRRKENPSSPVQNNQQHVRKRQQTVTP

SEQ ID NO: 1569145 - protein, 22 aa, Staphylococcus aureus
LDKDGTAFSVGSTGKYEEQSKR

SEQ ID NO: 1569146 - protein, 4 aa, Staphylococcus aureus
LDQS

SEQ ID NO: 1569147 - protein, 32 aa, Staphylococcus aureus
LDTDKTKYSWSNSYSNVNGSSTANGDQKKYNL

SEQ ID NO: 1569148 - protein, 10 aa, Staphylococcus aureus
LEEKETDDMT

SEQ ID NO: 1569149 - protein, 9 aa, Staphylococcus aureus
LEKTTAEFE

SEQ ID NO: 1569150 - protein, 11 aa, Staphylococcus aureus
LEQTSDKTLRQ

SEQ ID NO: 1569151 - protein, 32 aa, Staphylococcus aureus
LETQNGKSSWSNSYSSVNGSSTANGDQKKYNL

SEQ ID NO: 1569152 - protein, 8 aa, Staphylococcus aureus
LGRGGDQV

SEQ ID NO: 1569153 - protein, 11 aa, Staphylococcus aureus
LGTDQAAKVGQ

SEQ ID NO: 1569154 - protein, 7 aa, Staphylococcus aureus
LISGTPD

SEQ ID NO: 1569155 - protein, 21 aa, Staphylococcus aureus
LKDKDGNVETTTSIESKDEDV

SEQ ID NO: 1569156 - protein, 7 aa, Staphylococcus aureus
LKDQSIQ

SEQ ID NO: 1569157 - protein, 7 aa, Staphylococcus aureus
LKEKEKL

SEQ ID NO: 1569158 - protein, 19 aa, Staphylococcus aureus
LKSYNNGDVSINSNVPSYD

SEQ ID NO: 1569159 - protein, 5 aa, Staphylococcus aureus
LLPKG

SEQ ID NO: 1569160 - protein, 16 aa, Staphylococcus aureus
LNAYNQKLQAARQKLT

SEQ ID NO: 1569161 - protein, 6 aa, Staphylococcus aureus
LNDKNN

SEQ ID NO: 1569162 - protein, 6 aa, Staphylococcus aureus
LNEKQL

SEQ ID NO: 1569163 - protein, 22 aa, Staphylococcus aureus
LNNAQKAKLKEQVQSATTLEGV

SEQ ID NO: 1569164 - protein, 20 aa, Staphylococcus aureus
LNNAQQDGFKGRIDQSNDLN

SEQ ID NO: 1569165 - protein, 42 aa, Staphylococcus aureus
LNQAKNDLNGDNKVAQAKESAKRALASYSNLNNAQSTAAISQ

SEQ ID NO: 1569166 - protein, 65 aa, Staphylococcus aureus
LNQAKNDLNGDNKVAQAKESAKRALASYSNLNNAQSTAATSQIDNATTVAGVTAAQNTANELNTA

SEQ ID NO: 1569167 - protein, 110 aa, Staphylococcus aureus
LNQEDNTKNDNQKEMVSSQGNETTSNGNKSIEKESVQSTTGNKVEVSTAKSDEQASPKSTNEDLNTKQTISNQEALQPDLQENKSVVNAQPTNEENKKVDAKTESTTLNV

SEQ ID NO: 1569168 - protein, 8 aa, Staphylococcus aureus
LNQPQRDA

SEQ ID NO: 1569169 - protein, 12 aa, Staphylococcus aureus
LNSAKNNLDGTR

SEQ ID NO: 1569170 - protein, 22 aa, Staphylococcus aureus
LNTPQKAKLKEQVGQANTLDDA

SEQ ID NO: 1569171 - protein, 35 aa, Staphylococcus aureus
LNTPQKTALKQQVNAAQRVSGVTDLKNSATSLDNA

SEQ ID NO: 1569172 - protein, 9 aa, Staphylococcus aureus
LPKPKINNL

SEQ ID NO: 1569173 - protein, 13 aa, Staphylococcus aureus
LPKVQNSDEMAQQ

SEQ ID NO: 1569174 - protein, 30 aa, Staphylococcus aureus
LQAPKTRSTTNAAADAKKIRPLKANQVQPL

SEQ ID NO: 1569175 - protein, 7 aa, Staphylococcus aureus
LQATTEG

SEQ ID NO: 1569176 - protein, 26 aa, Staphylococcus aureus
LQEKENELNGNERVAEAKTQAKQTID

SEQ ID NO: 1569177 - protein, 51 aa, Staphylococcus aureus
LQNKEDNSQLVTSKNNLQSSVNQVPSTTGMTQQSIDNYNAKKREAESEITA

SEQ ID NO: 1569178 - protein, 7 aa, Staphylococcus aureus
LQNQGKT

SEQ ID NO: 1569179 - protein, 10 aa, Staphylococcus aureus
LQQAARTGSP

SEQ ID NO: 1569180 - protein, 11 aa, Staphylococcus aureus
LQQTSDNTLRQ

SEQ ID NO: 1569181 - protein, 6 aa, Staphylococcus aureus
LQSNFK

SEQ ID NO: 1569182 - protein, 10 aa, Staphylococcus aureus
LRRTGEQIKA

SEQ ID NO: 1569183 - protein, 11 aa, Staphylococcus aureus
LRRTGEQIKAG

SEQ ID NO: 1569184 - protein, 5 aa, Staphylococcus aureus
LSADG

SEQ ID NO: 1569185 - protein, 19 aa, Staphylococcus aureus
LSASSKAQLNEAKTASQID

SEQ ID NO: 1569186 - protein, 8 aa, Staphylococcus aureus
LSDDSKRS

SEQ ID NO: 1569187 - protein, 82 aa, Staphylococcus aureus
LSDSSNISGSNSTSTSLSTSDSMSGSVSVSTSTSLSDSISGSTSVSDSSSTSTSTSLSDSMSQSQSTSTSASGSLSTSISTS

SEQ ID NO: 1569188 - protein, 4 aa, Staphylococcus aureus
LSEQ

SEQ ID NO: 1569189 - protein, 6 aa, Staphylococcus aureus
LSEYND

SEQ ID NO: 1569190 - protein, 11 aa, Staphylococcus aureus
LSNAKTASLSP

SEQ ID NO: 1569191 - protein, 6 aa, Staphylococcus aureus
LSPSIE

SEQ ID NO: 1569192 - protein, 6 aa, Staphylococcus aureus
LSRPNL

SEQ ID NO: 1569193 - protein, 38 aa, Staphylococcus aureus
LSSSANASQTDNGINRSGSEDPTVYSATSTKKLHKEPA

SEQ ID NO: 1569194 - protein, 15 aa, Staphylococcus aureus
LSSTGNKSVSTGNAL

SEQ ID NO: 1569195 - protein, 7 aa, Staphylococcus aureus
LTEAQAL

SEQ ID NO: 1569196 - protein, 14 aa, Staphylococcus aureus
LTKEEIEQAKAQLA

SEQ ID NO: 1569197 - protein, 8 aa, Staphylococcus aureus
LTKKPGAF

SEQ ID NO: 1569198 - protein, 5 aa, Staphylococcus aureus
LTKTL

SEQ ID NO: 1569199 - protein, 13 aa, Staphylococcus aureus
LTNEKTYSRKANE

SEQ ID NO: 1569200 - protein, 6 aa, Staphylococcus aureus
LTNENF

SEQ ID NO: 1569201 - protein, 10 aa, Staphylococcus aureus
LTSAKNSANA

SEQ ID NO: 1569202 - protein, 105 aa, Staphylococcus aureus
LVKSDTNDAVATNDQSSSDASNQTNTNTSNQNTSTTNNTNDQPQATNNMSQPAQPKASANSEQASSQPAHETNSNDNTNDVTNASSNQSNGNQQYPPADESLQDA

SEQ ID NO: 1569203 - protein, 105 aa, Staphylococcus aureus
LVKSDTNDAVVTNDQSSSDASNQTNTNTSNQNTSTINNANNQPQATTNMSQPAQPKSSANADQASSQPAHETNSNGNTNDKTNESSNQSDVNQQYPPADESLQDA

SEQ ID NO: 1569204 - protein, 6 aa, Staphylococcus aureus
LVTGAT

SEQ ID NO: 1569205 - protein, 6 aa, Staphylococcus aureus
LYTGNV

SEQ ID NO: 1569206 - protein, 10 aa, Staphylococcus aureus
MATQNKGEAL

SEQ ID NO: 1569207 - protein, 38 aa, Staphylococcus aureus
MDKNDKVKKSKIAKKSVANQEKKRAELPKTGAESTQKG

SEQ ID NO: 1569208 - protein, 5 aa, Staphylococcus aureus
MGKPI

SEQ ID NO: 1569209 - protein, 5 aa, Staphylococcus aureus
MGSKR

SEQ ID NO: 1569210 - protein, 18 aa, Staphylococcus aureus
MKPNRARISSTSGKIEGA

SEQ ID NO: 1569211 - protein, 6 aa, Staphylococcus aureus
MNPEKL

SEQ ID NO: 1569212 - protein, 6 aa, Staphylococcus aureus
MPGTDM

SEQ ID NO: 1569213 - protein, 15 aa, Staphylococcus aureus
MPKKSINEQQKLEQA

SEQ ID NO: 1569214 - protein, 67 aa, Staphylococcus aureus
MSDSTSTSDSDSLSGSISLSGSTSLSTSDSLSDSKSLSSSQSMSGSESTSTSVSDSQSSSTSNSQFD

SEQ ID NO: 1569215 - protein, 14 aa, Staphylococcus aureus
MSTEQLDTSHIQHN

SEQ ID NO: 1569216 - protein, 4 aa, Staphylococcus aureus
NADS

SEQ ID NO: 1569217 - protein, 17 aa, Staphylococcus aureus
NADTDKQTAYTTAVNEA

SEQ ID NO: 1569218 - protein, 17 aa, Staphylococcus aureus
NAERFNRNEEIKDPKAR

SEQ ID NO: 1569219 - protein, 13 aa, Staphylococcus aureus
NAETLNKASRAIN

SEQ ID NO: 1569220 - protein, 9 aa, Staphylococcus aureus
NANTYGKDI

SEQ ID NO: 1569221 - protein, 5 aa, Staphylococcus aureus
NAPDV

SEQ ID NO: 1569222 - protein, 7 aa, Staphylococcus aureus
NAPKFDN

SEQ ID NO: 1569223 - protein, 6 aa, Staphylococcus aureus
NATKVN

SEQ ID NO: 1569224 - protein, 40 aa, Staphylococcus aureus
NDAAKKQINNYTSQQVSNKKNDAWRDASATEIKSAMDSGT

SEQ ID NO: 1569225 - protein, 41 aa, Staphylococcus aureus
NDAAKKQINNYTSQQVSNKKNNAWRDASATEIKSAMDSGTF

SEQ ID NO: 1569226 - protein, 60 aa, Staphylococcus aureus
NDDEETNHTEAEKSSSNIKDVEKTGVATASTVGIAKNDTENTVADEPSIHEGTEKTEAQH

SEQ ID NO: 1569227 - protein, 18 aa, Staphylococcus aureus
NDDGQNIADKPASKQAGH

SEQ ID NO: 1569228 - protein, 8 aa, Staphylococcus aureus
NDENSRMS

SEQ ID NO: 1569229 - protein, 11 aa, Staphylococcus aureus
NDERATPQQVN

SEQ ID NO: 1569230 - protein, 99 aa, Staphylococcus aureus
NDIPVQKDKVQQDSNKKIENERPKASDTLKVENSSPTAKKVENNHKEQQKHKDEKSKKEKKKVVEKEKALPAFNRDDDSKNSSQLSSDIKELDEPNHKK

SEQ ID NO: 1569231 - protein, 99 aa, Staphylococcus aureus
NDIPVQKDKVQQDSNKKIENERPKASGTLKVENSPPTVKKVENDHKEQPKHKDEKSKKEKKKVVEKEKALPAFNRDDDSKNSSQLSSDIKELDEPNHKK

SEQ ID NO: 1569232 - protein, 98 aa, Staphylococcus aureus
NDIPVQKDKVQQDSNKKIENERPKASGTLKVENSPPTVKKVENNHKEQPKHKDEKSKKEKKKVVEKEKALPAFNRDDDSKNSSQLSSDIKELDEPNHK

SEQ ID NO: 1569233 - protein, 6 aa, Staphylococcus aureus
NDSRSW

SEQ ID NO: 1569234 - protein, 5 aa, Staphylococcus aureus
NDTLS

SEQ ID NO: 1569235 - protein, 6 aa, Staphylococcus aureus
NEAVTS

SEQ ID NO: 1569236 - protein, 7 aa, Staphylococcus aureus
NEGDVTI

SEQ ID NO: 1569237 - protein, 8 aa, Staphylococcus aureus
NEKIKNEH

SEQ ID NO: 1569238 - protein, 28 aa, Staphylococcus aureus
NENGKQVDKEYELEQGSQDRLQLIKTSE

SEQ ID NO: 1569239 - protein, 6 aa, Staphylococcus aureus
NENKEA

SEQ ID NO: 1569240 - protein, 8 aa, Staphylococcus aureus
NENKKDDF

SEQ ID NO: 1569241 - protein, 10 aa, Staphylococcus aureus
NEPAANGASA

SEQ ID NO: 1569242 - protein, 10 aa, Staphylococcus aureus
NESAANGAGA

SEQ ID NO: 1569243 - protein, 11 aa, Staphylococcus aureus
NGDKHAGETLT

SEQ ID NO: 1569244 - protein, 15 aa, Staphylococcus aureus
NGEKVKTLDVTSETN

SEQ ID NO: 1569245 - protein, 16 aa, Staphylococcus aureus
NGEKVKTLDVTSETNW

SEQ ID NO: 1569246 - protein, 30 aa, Staphylococcus aureus
NGINDETQTKQTQKYLDAEPNKKSAYDQAV

SEQ ID NO: 1569247 - protein, 8 aa, Staphylococcus aureus
NGKITRDT

SEQ ID NO: 1569248 - protein, 8 aa, Staphylococcus aureus
NGKTEYAG

SEQ ID NO: 1569249 - protein, 13 aa, Staphylococcus aureus
NGQEYAIPLTIRF

SEQ ID NO: 1569250 - protein, 4 aa, Staphylococcus aureus
NGRL

SEQ ID NO: 1569251 - protein, 11 aa, Staphylococcus aureus
NGSAKLNNMTS

SEQ ID NO: 1569252 - protein, 10 aa, Staphylococcus aureus
NGSSTSSHKV

SEQ ID NO: 1569253 - protein, 6 aa, Staphylococcus aureus
NGVGTY

SEQ ID NO: 1569254 - protein, 22 aa, Staphylococcus aureus
NHPYNSTTIGHKKKLDQDDEID

SEQ ID NO: 1569255 - protein, 11 aa, Staphylococcus aureus
NHQSVTTGADG

SEQ ID NO: 1569256 - protein, 36 aa, Staphylococcus aureus
NIAGNEKAQAEAGGRPNYKTTGYSQSNPTSDGQRQF

SEQ ID NO: 1569257 - protein, 5 aa, Staphylococcus aureus
NIDEN

SEQ ID NO: 1569258 - protein, 9 aa, Staphylococcus aureus
NIPTNKAPK

SEQ ID NO: 1569259 - protein, 16 aa, Staphylococcus aureus
NITSSRDIHPIYFMTK

SEQ ID NO: 1569260 - protein, 19 aa, Staphylococcus aureus
NKADDLRVSYGNNRGYNRF

SEQ ID NO: 1569261 - protein, 16 aa, Staphylococcus aureus
NKGQTALSNVQSKLNT

SEQ ID NO: 1569262 - protein, 6 aa, Staphylococcus aureus
NKMGDF

SEQ ID NO: 1569263 - protein, 7 aa, Staphylococcus aureus
NKNMPIS

SEQ ID NO: 1569264 - protein, 11 aa, Staphylococcus aureus
NKPAKYKKDSN

SEQ ID NO: 1569265 - protein, 8 aa, Staphylococcus aureus
NKRSTKSL

SEQ ID NO: 1569266 - protein, 12 aa, Staphylococcus aureus
NKSIGKNELTGA

SEQ ID NO: 1569267 - protein, 15 aa, Staphylococcus aureus
NKSKKMRQRIIMHKI

SEQ ID NO: 1569268 - protein, 16 aa, Staphylococcus aureus
NKSRATDKKLKGGEEN

SEQ ID NO: 1569269 - protein, 8 aa, Staphylococcus aureus
NKTETKTV

SEQ ID NO: 1569270 - protein, 5 aa, Staphylococcus aureus
NKTRN

SEQ ID NO: 1569271 - protein, 8 aa, Staphylococcus aureus
NLDKPNNV

SEQ ID NO: 1569272 - protein, 15 aa, Staphylococcus aureus
NLKQQEQNKADSKLT

SEQ ID NO: 1569273 - protein, 20 aa, Staphylococcus aureus
NLNQAQRDEYNKQITQATHV

SEQ ID NO: 1569274 - protein, 17 aa, Staphylococcus aureus
NLTTEKATVEYNPNQHD

SEQ ID NO: 1569275 - protein, 8 aa, Staphylococcus aureus
NNADTVTG

SEQ ID NO: 1569276 - protein, 8 aa, Staphylococcus aureus
NNANKTSI

SEQ ID NO: 1569277 - protein, 58 aa, Staphylococcus aureus
NNDNSTNNQSSKTQLTQKDENKNEDKPEEKSETATDEDLQSTEEVPANENTENNQHEI

SEQ ID NO: 1569278 - protein, 13 aa, Staphylococcus aureus
NNDRATPQQVSDA

SEQ ID NO: 1569279 - protein, 22 aa, Staphylococcus aureus
NNGVEGLEDYENEVERIRKRFK

SEQ ID NO: 1569280 - protein, 37 aa, Staphylococcus aureus
NNITGNEKAQAEAGGRPNFRTTGYSQSNATTDGQRQF

SEQ ID NO: 1569281 - protein, 37 aa, Staphylococcus aureus
NNITGNEKSQAEAGGRPNFRTTGYSQSNATTDGQRQF

SEQ ID NO: 1569282 - protein, 27 aa, Staphylococcus aureus
NNPTINKGNVSSATQAVTSSKNALDGV

SEQ ID NO: 1569283 - protein, 19 aa, Staphylococcus aureus
NNQAPKGYIANQSVTANTE

SEQ ID NO: 1569284 - protein, 6 aa, Staphylococcus aureus
NNSQDT

SEQ ID NO: 1569285 - protein, 4 aa, Staphylococcus aureus
NNST

SEQ ID NO: 1569286 - protein, 10 aa, Staphylococcus aureus
NNSTHNAADA

SEQ ID NO: 1569287 - protein, 25 aa, Staphylococcus aureus
NNVNNAKHALNGTQNLNNAKQAAIT

SEQ ID NO: 1569288 - protein, 25 aa, Staphylococcus aureus
NNVNSAKHALNGTQNLNNAKQAAIT

SEQ ID NO: 1569289 - protein, 8 aa, Staphylococcus aureus
NPKTKKTE

SEQ ID NO: 1569290 - protein, 10 aa, Staphylococcus aureus
NPLESPNGQH

SEQ ID NO: 1569291 - protein, 14 aa, Staphylococcus aureus
NPYLSTSTHRIKEE

SEQ ID NO: 1569292 - protein, 18 aa, Staphylococcus aureus
NQAAITGESVPVAKTVDD

SEQ ID NO: 1569293 - protein, 7 aa, Staphylococcus aureus
NQAYNSD

SEQ ID NO: 1569294 - protein, 103 aa, Staphylococcus aureus
NQEAKAAENTSTENAKQDDATTSDNKEVVSEAENNSTTENDSTNPIKKETNTDSQPEAKEESTKSSTQQQQNNVTATTETKPQNIEKENVKPSTDKTATEDTS

SEQ ID NO: 1569295 - protein, 14 aa, Staphylococcus aureus
NQGMEATSGNQSLK

SEQ ID NO: 1569296 - protein, 10 aa, Staphylococcus aureus
NQNTDNTNEA

SEQ ID NO: 1569297 - protein, 16 aa, Staphylococcus aureus
NQTQTATQIQTATQTR

SEQ ID NO: 1569298 - protein, 10 aa, Staphylococcus aureus
NRGKFSDDTA

SEQ ID NO: 1569299 - protein, 12 aa, Staphylococcus aureus
NRQQPNNQQAGV

SEQ ID NO: 1569300 - protein, 17 aa, Staphylococcus aureus
NRTGTTTGKKPASITAY

SEQ ID NO: 1569301 - protein, 74 aa, Staphylococcus aureus
NSALRTAKTKLDEEINKSVTTDGMTQSSIQAYENAKRAGQTETTNAQNVINNGDATDQQIAAEKTKVEEKYNSL

SEQ ID NO: 1569302 - protein, 10 aa, Staphylococcus aureus
NSIDTTDGKF

SEQ ID NO: 1569303 - protein, 18 aa, Staphylococcus aureus
NSQVGEGSTFKVILKDYK

SEQ ID NO: 1569304 - protein, 26 aa, Staphylococcus aureus
NSSNDLNQAQKNALKQQVQNATTVAG

SEQ ID NO: 1569305 - protein, 13 aa, Staphylococcus aureus
NSTIGTAEERQAA

SEQ ID NO: 1569306 - protein, 8 aa, Staphylococcus aureus
NTKTTKGY

SEQ ID NO: 1569307 - protein, 10 aa, Staphylococcus aureus
NTKVSTLSSS

SEQ ID NO: 1569308 - protein, 8 aa, Staphylococcus aureus
NTRTTKGN

SEQ ID NO: 1569309 - protein, 16 aa, Staphylococcus aureus
NTSKDLTDKEKQEAIS

SEQ ID NO: 1569310 - protein, 9 aa, Staphylococcus aureus
NVDPATGKD

SEQ ID NO: 1569311 - protein, 9 aa, Staphylococcus aureus
NYGNENLGS

SEQ ID NO: 1569312 - protein, 19 aa, Staphylococcus aureus
NYLNADPDKQNAYKQAVAK

SEQ ID NO: 1569313 - protein, 9 aa, Staphylococcus aureus
NYRESNRVP

SEQ ID NO: 1569314 - protein, 8 aa, Staphylococcus aureus
PAAVASNN

SEQ ID NO: 1569315 - protein, 19 aa, Staphylococcus aureus
PAHERKSPDDIKKELNKKS

SEQ ID NO: 1569316 - protein, 26 aa, Staphylococcus aureus
PAHHQQFQKPEGTLYEPKPKKKSTRK

SEQ ID NO: 1569317 - protein, 26 aa, Staphylococcus aureus
PAHHQQFQKPEGTVYEPTPKKKSTRK

SEQ ID NO: 1569318 - protein, 5 aa, Staphylococcus aureus
PALPV

SEQ ID NO: 1569319 - protein, 4 aa, Staphylococcus aureus
PDVA

SEQ ID NO: 1569320 - protein, 6 aa, Staphylococcus aureus
PEDKES

SEQ ID NO: 1569321 - protein, 12 aa, Staphylococcus aureus
PEGLEDTREVSK

SEQ ID NO: 1569322 - protein, 4 aa, Staphylococcus aureus
PEQT

SEQ ID NO: 1569323 - protein, 15 aa, Staphylococcus aureus
PEYQTANAAKTATVT

SEQ ID NO: 1569324 - protein, 17 aa, Staphylococcus aureus
PGANQTVNTHAGNVTTY

SEQ ID NO: 1569325 - protein, 29 aa, Staphylococcus aureus
PGDPFSDLQNGKIKQEAINAQREKLGLND

SEQ ID NO: 1569326 - protein, 17 aa, Staphylococcus aureus
PHTPRITTTAEELRGTA

SEQ ID NO: 1569327 - protein, 10 aa, Staphylococcus aureus
PKGEQRINGK

SEQ ID NO: 1569328 - protein, 9 aa, Staphylococcus aureus
PKKVSTNGF

SEQ ID NO: 1569329 - protein, 35 aa, Staphylococcus aureus
PNHDNAAPTSTTPPSNDKTAPKSTKAQDATTDKHL

SEQ ID NO: 1569330 - protein, 17 aa, Staphylococcus aureus
PNSKTFKVGDDDKNIKT

SEQ ID NO: 1569331 - protein, 10 aa, Staphylococcus aureus
PPSKNDLTTY

SEQ ID NO: 1569332 - protein, 13 aa, Staphylococcus aureus
PQEINQQVKQQQA

SEQ ID NO: 1569333 - protein, 18 aa, Staphylococcus aureus
PQGATNVSKHQDVHGQDD

SEQ ID NO: 1569334 - protein, 19 aa, Staphylococcus aureus
PQGATNVSKHQDVHGQDDV

SEQ ID NO: 1569335 - protein, 21 aa, Staphylococcus aureus
PQGATNVSKNQDVHGQDDARS

SEQ ID NO: 1569336 - protein, 11 aa, Staphylococcus aureus
PQGMTQAQYTE

SEQ ID NO: 1569337 - protein, 7 aa, Staphylococcus aureus
PQGYGSL

SEQ ID NO: 1569338 - protein, 7 aa, Staphylococcus aureus
PQGYGSY

SEQ ID NO: 1569339 - protein, 39 aa, Staphylococcus aureus
PQRQQTSRRSSRIQTRSIESRAAEPRSVSDYQNANSSYY

SEQ ID NO: 1569340 - protein, 5 aa, Staphylococcus aureus
PRLRR

SEQ ID NO: 1569341 - protein, 6 aa, Staphylococcus aureus
PSIEPT

SEQ ID NO: 1569342 - protein, 24 aa, Staphylococcus aureus
PSNGFGGQPVTNSNVRANHSNSTV

SEQ ID NO: 1569343 - protein, 8 aa, Staphylococcus aureus
PTNEQELD

SEQ ID NO: 1569344 - protein, 19 aa, Staphylococcus aureus
PTSANTNAFRPGGVNPLNE

SEQ ID NO: 1569345 - protein, 19 aa, Staphylococcus aureus
PYGYTPYEKDGTLKSDKDL

SEQ ID NO: 1569346 - protein, 16 aa, Staphylococcus aureus
QAAITGESVPVSKAVD

SEQ ID NO: 1569347 - protein, 13 aa, Staphylococcus aureus
QAINDKAQTLADG

SEQ ID NO: 1569348 - protein, 11 aa, Staphylococcus aureus
QAVNESKRINT

SEQ ID NO: 1569349 - protein, 18 aa, Staphylococcus aureus
QDGKATGKTAKLNESNNW

SEQ ID NO: 1569350 - protein, 37 aa, Staphylococcus aureus
QDKEAAASEQKTTTVEENGNSATDNKTSETQTTATNV

SEQ ID NO: 1569351 - protein, 5 aa, Staphylococcus aureus
QEGDV

SEQ ID NO: 1569352 - protein, 12 aa, Staphylococcus aureus
QEHGKEEVNGKA

SEQ ID NO: 1569353 - protein, 13 aa, Staphylococcus aureus
QEHGKEEVNGKSF

SEQ ID NO: 1569354 - protein, 23 aa, Staphylococcus aureus
QEITGNEGRTKGSTNYVNADTQV

SEQ ID NO: 1569355 - protein, 8 aa, Staphylococcus aureus
QENTFHSD

SEQ ID NO: 1569356 - protein, 13 aa, Staphylococcus aureus
QETENAIREDARR

SEQ ID NO: 1569357 - protein, 21 aa, Staphylococcus aureus
QFQKPEGTVYEPKPKKKSTRK

SEQ ID NO: 1569358 - protein, 4 aa, Staphylococcus aureus
QGSV

SEQ ID NO: 1569359 - protein, 11 aa, Staphylococcus aureus
QGTPTSTVEQV

SEQ ID NO: 1569360 - protein, 6 aa, Staphylococcus aureus
QGYQSV

SEQ ID NO: 1569361 - protein, 42 aa, Staphylococcus aureus
QHPVITPSDVNNALSNVTSKEHALNGEAKLNAAKQEANTALG

SEQ ID NO: 1569362 - protein, 8 aa, Staphylococcus aureus
QHRSDSSV

SEQ ID NO: 1569363 - protein, 10 aa, Staphylococcus aureus
QHYNGESDVT

SEQ ID NO: 1569364 - protein, 39 aa, Staphylococcus aureus
QINSNPDLTPEQKAKALKEIDEAEKRALQNVENAQTIDQ

SEQ ID NO: 1569365 - protein, 8 aa, Staphylococcus aureus
QITTTTAD

SEQ ID NO: 1569366 - protein, 7 aa, Staphylococcus aureus
QKDNQIS

SEQ ID NO: 1569367 - protein, 19 aa, Staphylococcus aureus
QKKQSEPVPHEVKGTGSDL

SEQ ID NO: 1569368 - protein, 5 aa, Staphylococcus aureus
QLGQA

SEQ ID NO: 1569369 - protein, 5 aa, Staphylococcus aureus
QLNDI

SEQ ID NO: 1569370 - protein, 6 aa, Staphylococcus aureus
QLRSYS

SEQ ID NO: 1569371 - protein, 15 aa, Staphylococcus aureus
QMSSSKKKKSISDDP

SEQ ID NO: 1569372 - protein, 20 aa, Staphylococcus aureus
QNALNGDQNLANAKDKANAF

SEQ ID NO: 1569373 - protein, 22 aa, Staphylococcus aureus
QNKEVYQGTITDKYNKRQDKED

SEQ ID NO: 1569374 - protein, 17 aa, Staphylococcus aureus
QNLGEKLGNPKSGSAIL

SEQ ID NO: 1569375 - protein, 19 aa, Staphylococcus aureus
QNLNGEQRLQEAKDKAIQN

SEQ ID NO: 1569376 - protein, 19 aa, Staphylococcus aureus
QNQQNQQNQQYRQKKSKKG

SEQ ID NO: 1569377 - protein, 29 aa, Staphylococcus aureus
QNVQRAKNELNGNQNVANAKTTAKNALNN

SEQ ID NO: 1569378 - protein, 5 aa, Staphylococcus aureus
QPGKN

SEQ ID NO: 1569379 - protein, 10 aa, Staphylococcus aureus
QPNRKSNDES

SEQ ID NO: 1569380 - protein, 8 aa, Staphylococcus aureus
QPTEQRLT

SEQ ID NO: 1569381 - protein, 5 aa, Staphylococcus aureus
QQAIE

SEQ ID NO: 1569382 - protein, 18 aa, Staphylococcus aureus
QQGRNEGVGKAKITRGYN

SEQ ID NO: 1569383 - protein, 9 aa, Staphylococcus aureus
QQKHELEEK

SEQ ID NO: 1569384 - protein, 10 aa, Staphylococcus aureus
QQTSDNTLRQ

SEQ ID NO: 1569385 - protein, 35 aa, Staphylococcus aureus
QRGINDEAATKAAQKYTEADRDKQTAYNDAVTAAK

SEQ ID NO: 1569386 - protein, 11 aa, Staphylococcus aureus
QSEVDNNASAI

SEQ ID NO: 1569387 - protein, 35 aa, Staphylococcus aureus
QSIADNATTKQNQNYTDSSPNKKDAYNNAVTTAQG

SEQ ID NO: 1569388 - protein, 35 aa, Staphylococcus aureus
QSIASKDATKASEDYHDANTDLQNAYNDAVTNAEG

SEQ ID NO: 1569389 - protein, 113 aa, Staphylococcus aureus
QSISGSTSGSTSISTSESLSMSGSTHNSTSVSDSDSVSMSNSTSTSMSDSTSVSDSESVSTSASTSLSTSDSTSTSESLSASMSGSQSISDSTSTSMSDSTSMSDSESVSMSN

SEQ ID NO: 1569390 - protein, 9 aa, Staphylococcus aureus
QSNDSQNMG

SEQ ID NO: 1569391 - protein, 4 aa, Staphylococcus aureus
QSNI

SEQ ID NO: 1569392 - protein, 16 aa, Staphylococcus aureus
QSNIHRGKRYGKKKRS

SEQ ID NO: 1569393 - protein, 7 aa, Staphylococcus aureus
QSQRFSR

SEQ ID NO: 1569394 - protein, 10 aa, Staphylococcus aureus
QTPALQKETE

SEQ ID NO: 1569395 - protein, 8 aa, Staphylococcus aureus
QTPHGKGY

SEQ ID NO: 1569396 - protein, 17 aa, Staphylococcus aureus
QTQTVTQTQTATQTQIA

SEQ ID NO: 1569397 - protein, 22 aa, Staphylococcus aureus
QTSYTTTVGGTLASGTQASGYA

SEQ ID NO: 1569398 - protein, 12 aa, Staphylococcus aureus
QTVKNSSQTLNT

SEQ ID NO: 1569399 - protein, 6 aa, Staphylococcus aureus
QVINPY

SEQ ID NO: 1569400 - protein, 15 aa, Staphylococcus aureus
QVKDGDNSKNKGPVY

SEQ ID NO: 1569401 - protein, 24 aa, Staphylococcus aureus
QVNSSKTALNGDENLATAKLNAKT

SEQ ID NO: 1569402 - protein, 27 aa, Staphylococcus aureus
QVTDAKNSLNGEAKLATEKQNAKDAVN

SEQ ID NO: 1569403 - protein, 8 aa, Staphylococcus aureus
QYDKLKGK

SEQ ID NO: 1569404 - protein, 6 aa, Staphylococcus aureus
QYDQNN

SEQ ID NO: 1569405 - protein, 9 aa, Staphylococcus aureus
QYTTSESPT

SEQ ID NO: 1569406 - protein, 5 aa, Staphylococcus aureus
RAKSM

SEQ ID NO: 1569407 - protein, 6 aa, Staphylococcus aureus
RATNPL

SEQ ID NO: 1569408 - protein, 7 aa, Staphylococcus aureus
RATSHEK

SEQ ID NO: 1569409 - protein, 33 aa, Staphylococcus aureus
RDSIANEATIKAGQNYADASPNNRNEYDSAVTA

SEQ ID NO: 1569410 - protein, 32 aa, Staphylococcus aureus
RDSIANEATIKAGQNYTDASPNNRSEYDSAVT

SEQ ID NO: 1569411 - protein, 33 aa, Staphylococcus aureus
RDSIANEATIKAGQNYTDASPTNRNEYDSAVTA

SEQ ID NO: 1569412 - protein, 6 aa, Staphylococcus aureus
REETER

SEQ ID NO: 1569413 - protein, 55 aa, Staphylococcus aureus
REFNPDLKPGEEKVTQEGQTGEKTTTTPTTINPLTGEKVGEGEPTTEVTKEPVDE

SEQ ID NO: 1569414 - protein, 9 aa, Staphylococcus aureus
RELTRAKSM

SEQ ID NO: 1569415 - protein, 57 aa, Staphylococcus aureus
REPKQDLEAATAQMENTKGKKSSVASKLVSSDKNVNTEENASGNVSETSSLDDDPEA

SEQ ID NO: 1569416 - protein, 9 aa, Staphylococcus aureus
RESNYTANA

SEQ ID NO: 1569417 - protein, 10 aa, Staphylococcus aureus
RESNYTANAV

SEQ ID NO: 1569418 - protein, 4 aa, Staphylococcus aureus
RGES

SEQ ID NO: 1569419 - protein, 7 aa, Staphylococcus aureus
RGFPTGT

SEQ ID NO: 1569420 - protein, 7 aa, Staphylococcus aureus
RHKTSEE

SEQ ID NO: 1569421 - protein, 13 aa, Staphylococcus aureus
RHTQQSGNEKRGT

SEQ ID NO: 1569422 - protein, 11 aa, Staphylococcus aureus
RIKTEKDVESQ

SEQ ID NO: 1569423 - protein, 107 aa, Staphylococcus aureus
RKADEKTTDNTDVDKKSGKQPKKTTPSNKRNASKASTNKTSGQKKQHNKKASQGAKKQSSSSKSTQKNNQTSNKNSKTTNAKSSNASKKSNAKVEKAKSKIEKRTFN

SEQ ID NO: 1569424 - protein, 107 aa, Staphylococcus aureus
RKADEKTTNNTAVDKKSGKQSKKTTPSNKRNASKASTNKTSGQKKQHNKKSSQGAKKQSSSSKSTQKNNQTSNKNSKTTNAKSSNASKTPNAKVEKANSKIEKRTFN

SEQ ID NO: 1569425 - protein, 36 aa, Staphylococcus aureus
RKDSRDKLKAEYNKYKQDPQSYKDNAKDKATQLGTI

SEQ ID NO: 1569426 - protein, 4 aa, Staphylococcus aureus
RKEI

SEQ ID NO: 1569427 - protein, 8 aa, Staphylococcus aureus
RKEIGKPV

SEQ ID NO: 1569428 - protein, 14 aa, Staphylococcus aureus
RKKKKDENEQDDSQ

SEQ ID NO: 1569429 - protein, 7 aa, Staphylococcus aureus
RKVQQVE

SEQ ID NO: 1569430 - protein, 12 aa, Staphylococcus aureus
RLPDGRWPSQTE

SEQ ID NO: 1569431 - protein, 7 aa, Staphylococcus aureus
RNEEERI

SEQ ID NO: 1569432 - protein, 6 aa, Staphylococcus aureus
RNRSGQ

SEQ ID NO: 1569433 - protein, 32 aa, Staphylococcus aureus
RNTSKKRRQRKRSKATHFSNQNKDDTSQQAEF

SEQ ID NO: 1569434 - protein, 14 aa, Staphylococcus aureus
RPSRQRKNDESINK

SEQ ID NO: 1569435 - protein, 13 aa, Staphylococcus aureus
RQYGEGYYSRREA

SEQ ID NO: 1569436 - protein, 83 aa, Staphylococcus aureus
RRAQDLNRRNQQQIPQNSAANNETSNSAPAAGNGVASTPPSAPSGDTAPNNNVTQNTAPNSNNAPVSTTPQITSGKKDGQSFA

SEQ ID NO: 1569437 - protein, 7 aa, Staphylococcus aureus
RRERNDN

SEQ ID NO: 1569438 - protein, 6 aa, Staphylococcus aureus
RRGESF

SEQ ID NO: 1569439 - protein, 8 aa, Staphylococcus aureus
RRKEDEED

SEQ ID NO: 1569440 - protein, 28 aa, Staphylococcus aureus
RRKEDEEDVEVTNENTDEKVLQDNEHSP

SEQ ID NO: 1569441 - protein, 22 aa, Staphylococcus aureus
RRKEKDGDVETTTSIESNDDAP

SEQ ID NO: 1569442 - protein, 7 aa, Staphylococcus aureus
RSELNTN

SEQ ID NO: 1569443 - protein, 13 aa, Staphylococcus aureus
RSLEENKIEDNAI

SEQ ID NO: 1569444 - protein, 5 aa, Staphylococcus aureus
RSLGS

SEQ ID NO: 1569445 - protein, 9 aa, Staphylococcus aureus
RSNKQLAKT

SEQ ID NO: 1569446 - protein, 4 aa, Staphylococcus aureus
RSSI

SEQ ID NO: 1569447 - protein, 8 aa, Staphylococcus aureus
RTGKGTKY

SEQ ID NO: 1569448 - protein, 14 aa, Staphylococcus aureus
RVTTVSKDTKNNSR

SEQ ID NO: 1569449 - protein, 345 aa, Staphylococcus aureus
RYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNAT

SEQ ID NO: 1569450 - protein, 359 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETGDKSENTNAT

SEQ ID NO: 1569451 - protein, 319 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSDSDSDSDSDSDSDSDSNSDSDSDSDSDSDSDSDSDSDSDSESDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNAT

SEQ ID NO: 1569452 - protein, 325 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSDSDSDSDSDSDSDSDSDSDSESDSDSDSDSDSDSDSDSDSDSDSDSDSDSDSDSDSESDSESDSDSDSESDSDSDPDSESDSDSDSDSDSDSDSDSESDSDSESDSDSDSDSDSDSDSRVTPPNNEQKAPSNPKGEVNHSNKASKQHQTDALPETGDKSENTNAT

SEQ ID NO: 1569453 - protein, 11 aa, Staphylococcus aureus
RYKRKEKAVEM

SEQ ID NO: 1569454 - protein, 5 aa, Staphylococcus aureus
SAFGS

SEQ ID NO: 1569455 - protein, 14 aa, Staphylococcus aureus
SANEGIGLSGVHED

SEQ ID NO: 1569456 - protein, 8 aa, Staphylococcus aureus
SANLNRSL

SEQ ID NO: 1569457 - protein, 8 aa, Staphylococcus aureus
SATFKDTT

SEQ ID NO: 1569458 - protein, 10 aa, Staphylococcus aureus
SAVDKFSGNA

SEQ ID NO: 1569459 - protein, 6 aa, Staphylococcus aureus
SAVSEA

SEQ ID NO: 1569460 - protein, 6 aa, Staphylococcus aureus
SDEYSS

SEQ ID NO: 1569461 - protein, 21 aa, Staphylococcus aureus
SDLNQAQKNALTQQVNSAQNV

SEQ ID NO: 1569462 - protein, 67 aa, Staphylococcus aureus
SEPETPTPPTPEVPSEPETPTPPTPEVPSEPETPTPPTPEVPAEPGKPVPPAKEEPKKPSKPVEQGK

SEQ ID NO: 1569463 - protein, 10 aa, Staphylococcus aureus
SEQVGQSQGF

SEQ ID NO: 1569464 - protein, 16 aa, Staphylococcus aureus
SESFDSKPKDESSRKM

SEQ ID NO: 1569465 - protein, 11 aa, Staphylococcus aureus
SFDPKSSDYNA

SEQ ID NO: 1569466 - protein, 4 aa, Staphylococcus aureus
SGEI

SEQ ID NO: 1569467 - protein, 14 aa, Staphylococcus aureus
SGKRMNGKKANTIN

SEQ ID NO: 1569468 - protein, 16 aa, Staphylococcus aureus
SGSQTDKNGTTKELKG

SEQ ID NO: 1569469 - protein, 11 aa, Staphylococcus aureus
SGTISAKEAAN

SEQ ID NO: 1569470 - protein, 9 aa, Staphylococcus aureus
SHNPKDYNG

SEQ ID NO: 1569471 - protein, 28 aa, Staphylococcus aureus
SIANNDATKASEDYVDANNDKQTAYNNA

SEQ ID NO: 1569472 - protein, 9 aa, Staphylococcus aureus
SIETSPNMK

SEQ ID NO: 1569473 - protein, 8 aa, Staphylococcus aureus
SIKDNTVG

SEQ ID NO: 1569474 - protein, 22 aa, Staphylococcus aureus
SINNAQKEALKSQIDSATTVAG

SEQ ID NO: 1569475 - protein, 22 aa, Staphylococcus aureus
SINNAQKEALKSQIEGATTVAG

SEQ ID NO: 1569476 - protein, 30 aa, Staphylococcus aureus
SIQDNAATKANSKYINEDQPEKQNYDQAVQ

SEQ ID NO: 1569477 - protein, 133 aa, Staphylococcus aureus
SISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSSSLNGSESVSESSSLS

SEQ ID NO: 1569478 - protein, 9 aa, Staphylococcus aureus
SKARKELNE

SEQ ID NO: 1569479 - protein, 9 aa, Staphylococcus aureus
SKATTITPF

SEQ ID NO: 1569480 - protein, 31 aa, Staphylococcus aureus
SKDGSTGKNENKKVDIESTENQFESKDKITK

SEQ ID NO: 1569481 - protein, 179 aa, Staphylococcus aureus
SKEADASENSVTQSDSASNESKSNNPSSVNAAPKTDNTNVSDTKTTSNTNNSETSVAQNPAQQETTQSASTNATTEETPVTGEGTTTATNQANTPAATQSNNTNAEELVNQTSNETTSNDTNTVSSVNSPQNSTNAENVSTTQDTSTEATPSNNESAPQSTDASNKDVVSQAVNPSAPR

SEQ ID NO: 1569482 - protein, 9 aa, Staphylococcus aureus
SKEENSELS

SEQ ID NO: 1569483 - protein, 30 aa, Staphylococcus aureus
SKGESKEEITKDPINELTEYGGEKIPQGHK

SEQ ID NO: 1569484 - protein, 6 aa, Staphylococcus aureus
SKGNGL

SEQ ID NO: 1569485 - protein, 9 aa, Staphylococcus aureus
SKHDNSNGL

SEQ ID NO: 1569486 - protein, 16 aa, Staphylococcus aureus
SKKARTLKKHAANEQA

SEQ ID NO: 1569487 - protein, 5 aa, Staphylococcus aureus
SKKDF

SEQ ID NO: 1569488 - protein, 14 aa, Staphylococcus aureus
SKKDGSVVKDNQKE

SEQ ID NO: 1569489 - protein, 25 aa, Staphylococcus aureus
SKKDGSVVKDNQKEIEIKTDANGIA

SEQ ID NO: 1569490 - protein, 20 aa, Staphylococcus aureus
SKLTGEDEEIAKENGITNQQ

SEQ ID NO: 1569491 - protein, 7 aa, Staphylococcus aureus
SKNGKHF

SEQ ID NO: 1569492 - protein, 5 aa, Staphylococcus aureus
SKNQL

SEQ ID NO: 1569493 - protein, 6 aa, Staphylococcus aureus
SKNTPY

SEQ ID NO: 1569494 - protein, 45 aa, Staphylococcus aureus
SKPANKYGESPKYPSSIKNQPVTSETPEKAGTSETPKTPEETDNQ

SEQ ID NO: 1569495 - protein, 6 aa, Staphylococcus aureus
SLDGSL

SEQ ID NO: 1569496 - protein, 12 aa, Staphylococcus aureus
SLESTKIEGTQV

SEQ ID NO: 1569497 - protein, 10 aa, Staphylococcus aureus
SLKKGQDGFK

SEQ ID NO: 1569498 - protein, 4 aa, Staphylococcus aureus
SLQA

SEQ ID NO: 1569499 - protein, 15 aa, Staphylococcus aureus
SLSDSTSTSTSASEV

SEQ ID NO: 1569500 - protein, 149 aa, Staphylococcus aureus
SLSESTSESTSESLSGSTSDSTSLSDSNSESGSTSTSLSNSTSSSTSISTSISGSASTSAYKSDSVSTSLSTSTSTSLSDSTSLSTSLSDSASGSKSNSLSASMSTSDSISTRKSESLSTSTSLSGSTSESESGSTSSSESKSDSTSMS

SEQ ID NO: 1569501 - protein, 199 aa, Staphylococcus aureus
SLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESNSTSISDSESVSTSTSTSLSTSDSTSTSESLSTSMSGSQSISDSTSTSMSGSTSTSESNSMHPSDS

SEQ ID NO: 1569502 - protein, 16 aa, Staphylococcus aureus
SLSRKISNKELTIDEA

SEQ ID NO: 1569503 - protein, 12 aa, Staphylococcus aureus
SLSVDNDKTYLN

SEQ ID NO: 1569504 - protein, 21 aa, Staphylococcus aureus
SLSYSSKSSKNIYKIANDFMI

SEQ ID NO: 1569505 - protein, 17 aa, Staphylococcus aureus
SNDSGGGDGTVKPEEKL

SEQ ID NO: 1569506 - protein, 18 aa, Staphylococcus aureus
SNNAQGDGKDKPNDPIIE

SEQ ID NO: 1569507 - protein, 11 aa, Staphylococcus aureus
SNNTKDVNTHF

SEQ ID NO: 1569508 - protein, 11 aa, Staphylococcus aureus
SNTGTANSVSP

SEQ ID NO: 1569509 - protein, 14 aa, Staphylococcus aureus
SNTNAEKVVSEKDG

SEQ ID NO: 1569510 - protein, 7 aa, Staphylococcus aureus
SPEYNQH

SEQ ID NO: 1569511 - protein, 16 aa, Staphylococcus aureus
SPNKKDAYNNAVTTAQ

SEQ ID NO: 1569512 - protein, 7 aa, Staphylococcus aureus
SPYGPKQ

SEQ ID NO: 1569513 - protein, 5 aa, Staphylococcus aureus
SQHPL

SEQ ID NO: 1569514 - protein, 9 aa, Staphylococcus aureus
SQIKETAKE

SEQ ID NO: 1569515 - protein, 10 aa, Staphylococcus aureus
SQRQGTSQGV

SEQ ID NO: 1569516 - protein, 15 aa, Staphylococcus aureus
SQTSLKDDSRDNIKS

SEQ ID NO: 1569517 - protein, 4 aa, Staphylococcus aureus
SQVG

SEQ ID NO: 1569518 - protein, 15 aa, Staphylococcus aureus
SRADTKKNYISCIRR

SEQ ID NO: 1569519 - protein, 4 aa, Staphylococcus aureus
SRIE

SEQ ID NO: 1569520 - protein, 11 aa, Staphylococcus aureus
SRKNPDLHKNA

SEQ ID NO: 1569521 - protein, 15 aa, Staphylococcus aureus
SRTYSRHSNEEKAQA

SEQ ID NO: 1569522 - protein, 10 aa, Staphylococcus aureus
SRVGDYQDAI

SEQ ID NO: 1569523 - protein, 13 aa, Staphylococcus aureus
SSDGAQLSTDASE

SEQ ID NO: 1569524 - protein, 11 aa, Staphylococcus aureus
SSELTKERYAK

SEQ ID NO: 1569525 - protein, 10 aa, Staphylococcus aureus
SSNPVTVDNH

SEQ ID NO: 1569526 - protein, 21 aa, Staphylococcus aureus
SSSENAKKSKEDSKEEQIKKS

SEQ ID NO: 1569527 - protein, 44 aa, Staphylococcus aureus
SSSKTYGPYPQNKDITISASGKAKDKTFTTQTKTIKASDLKYNT

SEQ ID NO: 1569528 - protein, 8 aa, Staphylococcus aureus
SSSSSLGL

SEQ ID NO: 1569529 - protein, 7 aa, Staphylococcus aureus
STKLKAD

SEQ ID NO: 1569530 - protein, 9 aa, Staphylococcus aureus
STPSLNSTL

SEQ ID NO: 1569531 - protein, 8 aa, Staphylococcus aureus
STQDYQQR

SEQ ID NO: 1569532 - protein, 201 aa, Staphylococcus aureus
STSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSESASTSDSISISNSIANSQSASTSKSDSQSTSISLSTSDSKSMSTSESLSDSTSTSGSVSGSLS

SEQ ID NO: 1569533 - protein, 149 aa, Staphylococcus aureus
STSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSASLSDSTSNAISTSESLSESASTSDSISIS

SEQ ID NO: 1569534 - protein, 171 aa, Staphylococcus aureus
STSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSDSTSTSDSVSGSLSIATSQSVSTSSSDSMSTSEM

SEQ ID NO: 1569535 - protein, 221 aa, Staphylococcus aureus
STSASTSKSTSVSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSDSTSNSISTSESLSESASTSDSISISNSIANSQSASTSKSDSQSTSISLSTSDSKSMSTSESLSDSTSTSDSVSGSLSIATSQSVSTSSSDSMSTSEM

SEQ ID NO: 1569536 - protein, 10 aa, Staphylococcus aureus
STVKDIEQKM

SEQ ID NO: 1569537 - protein, 14 aa, Staphylococcus aureus
SVGPSIAPTNAKGT

SEQ ID NO: 1569538 - protein, 20 aa, Staphylococcus aureus
SVKETQEESKKKNKSNPKID

SEQ ID NO: 1569539 - protein, 5 aa, Staphylococcus aureus
SVKQT

SEQ ID NO: 1569540 - protein, 6 aa, Staphylococcus aureus
SVPASL

SEQ ID NO: 1569541 - protein, 12 aa, Staphylococcus aureus
SVRSSLANNSDI

SEQ ID NO: 1569542 - protein, 12 aa, Staphylococcus aureus
SVTNRESSSGLK

SEQ ID NO: 1569543 - protein, 5 aa, Staphylococcus aureus
SVVGS

SEQ ID NO: 1569544 - protein, 10 aa, Staphylococcus aureus
SYTNDKDERI

SEQ ID NO: 1569545 - protein, 10 aa, Staphylococcus aureus
SYTNDKDERV

SEQ ID NO: 1569546 - protein, 5 aa, Staphylococcus aureus
TAAAQ

SEQ ID NO: 1569547 - protein, 43 aa, Staphylococcus aureus
TAINGASDLNQKQKDALKAQANGAQRVSNANDVQRNATELNTA

SEQ ID NO: 1569548 - protein, 12 aa, Staphylococcus aureus
TALTGDEKQRIT

SEQ ID NO: 1569549 - protein, 13 aa, Staphylococcus aureus
TDHAKGSEQDQEL

SEQ ID NO: 1569550 - protein, 27 aa, Staphylococcus aureus
TDITQHDTEVDNVDKTAKHSHLNKPSH

SEQ ID NO: 1569551 - protein, 11 aa, Staphylococcus aureus
TDNDPKSQRKV

SEQ ID NO: 1569552 - protein, 7 aa, Staphylococcus aureus
TDRGNIK

SEQ ID NO: 1569553 - protein, 12 aa, Staphylococcus aureus
TDYNKNMEEQLE

SEQ ID NO: 1569554 - protein, 4 aa, Staphylococcus aureus
TEGI

SEQ ID NO: 1569555 - protein, 11 aa, Staphylococcus aureus
TEPQIDDSNDG

SEQ ID NO: 1569556 - protein, 26 aa, Staphylococcus aureus
TFTSELGSTLTDGFNDSLTPSVDGHM

SEQ ID NO: 1569557 - protein, 27 aa, Staphylococcus aureus
TGADGTTAKVGTNIPTRGKADNSFQYA

SEQ ID NO: 1569558 - protein, 4 aa, Staphylococcus aureus
TGDI

SEQ ID NO: 1569559 - protein, 6 aa, Staphylococcus aureus
TGGASL

SEQ ID NO: 1569560 - protein, 10 aa, Staphylococcus aureus
TGIGSTTANK

SEQ ID NO: 1569561 - protein, 11 aa, Staphylococcus aureus
TGIGSTTANKT

SEQ ID NO: 1569562 - protein, 7 aa, Staphylococcus aureus
TGITKTN

SEQ ID NO: 1569563 - protein, 7 aa, Staphylococcus aureus
TGSEGVQ

SEQ ID NO: 1569564 - protein, 15 aa, Staphylococcus aureus
TGTHSNYYSGPNAIT

SEQ ID NO: 1569565 - protein, 15 aa, Staphylococcus aureus
TGTHSNYYSGSNAIT

SEQ ID NO: 1569566 - protein, 8 aa, Staphylococcus aureus
TIADKHKN

SEQ ID NO: 1569567 - protein, 10 aa, Staphylococcus aureus
TIENNGYEAD

SEQ ID NO: 1569568 - protein, 13 aa, Staphylococcus aureus
TKEEIEQAKAQLA

SEQ ID NO: 1569569 - protein, 4 aa, Staphylococcus aureus
TKHG

SEQ ID NO: 1569570 - protein, 6 aa, Staphylococcus aureus
TKKDGK

SEQ ID NO: 1569571 - protein, 29 aa, Staphylococcus aureus
TKNGGKYTLESHKELQKDRENVKINTDDI

SEQ ID NO: 1569572 - protein, 8 aa, Staphylococcus aureus
TKNHNEYN

SEQ ID NO: 1569573 - protein, 10 aa, Staphylococcus aureus
TKNKTQDQIP

SEQ ID NO: 1569574 - protein, 9 aa, Staphylococcus aureus
TKPIADDKL

SEQ ID NO: 1569575 - protein, 6 aa, Staphylococcus aureus
TKYGAP

SEQ ID NO: 1569576 - protein, 11 aa, Staphylococcus aureus
TLPEEVRQERG

SEQ ID NO: 1569577 - protein, 7 aa, Staphylococcus aureus
TLSQSDE

SEQ ID NO: 1569578 - protein, 11 aa, Staphylococcus aureus
TLTPEQKEAAI

SEQ ID NO: 1569579 - protein, 17 aa, Staphylococcus aureus
TMKSVGPSIAPTNAKGT

SEQ ID NO: 1569580 - protein, 17 aa, Staphylococcus aureus
TMKSVGPSLAPTNAKGT

SEQ ID NO: 1569581 - protein, 10 aa, Staphylococcus aureus
TNDGKDLPQS

SEQ ID NO: 1569582 - protein, 9 aa, Staphylococcus aureus
TNHAGELVR

SEQ ID NO: 1569583 - protein, 6 aa, Staphylococcus aureus
TNITSD

SEQ ID NO: 1569584 - protein, 7 aa, Staphylococcus aureus
TNKEHKE

SEQ ID NO: 1569585 - protein, 32 aa, Staphylococcus aureus
TNNQKSAISSQIDRAGHVSEVTAAKNAATELN

SEQ ID NO: 1569586 - protein, 35 aa, Staphylococcus aureus
TNNQKSAISSQIDRAGHVSEVTATKNAATELNTQM

SEQ ID NO: 1569587 - protein, 26 aa, Staphylococcus aureus
TPAGYLPTKVNGTTDGEKDSNGSSVT

SEQ ID NO: 1569588 - protein, 6 aa, Staphylococcus aureus
TPEHNY

SEQ ID NO: 1569589 - protein, 15 aa, Staphylococcus aureus
TPKNTYLKSEQQTAK

SEQ ID NO: 1569590 - protein, 6 aa, Staphylococcus aureus
TQERKI

SEQ ID NO: 1569591 - protein, 6 aa, Staphylococcus aureus
TQGPTI

SEQ ID NO: 1569592 - protein, 8 aa, Staphylococcus aureus
TQTATQTQ

SEQ ID NO: 1569593 - protein, 24 aa, Staphylococcus aureus
TQVSTANENTQNITDKDVKSMEAA

SEQ ID NO: 1569594 - protein, 10 aa, Staphylococcus aureus
TRGRKTTQSE

SEQ ID NO: 1569595 - protein, 262 aa, Staphylococcus aureus
TRNSMSDSVSTSGSTQQSQSVSTSKADSQSASTSTSGSIMTSTSVSTSKSTSTSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSNSTSNSISTSESLSESVSTSESISISNSISNSVSASTSKSDSQSTSISLSTSDSKSMSTSESLSDSMSTSDSVSGSLSVAGSQSVSTSTSDSMSTSEM

SEQ ID NO: 1569596 - protein, 262 aa, Staphylococcus aureus
TRNSMSDSVSTSGSTQQSQSVSTSKADSQSASTSTSGSIMTSTSVSTSKSTSTSLSDSVSASKSLSTSESNSVSSSTSTSLVNSQSVSSSMSGSVSKSTSLSDSISNSSSTEKSESLSTSTSDSLRTSTSLSDSVSMSTSGSLSKSQSLSTSTSDSASTSQSVSNSTSNSISTSESLSESVSTSESISISNSISNSVSASTSKSDSQSTSISLSTSDSKSMSTSESLSDSTSTSDSVSGSLSVAGSQSVSTSTSDSMSTSEM

SEQ ID NO: 1569597 - protein, 6 aa, Staphylococcus aureus
TRQPKL

SEQ ID NO: 1569598 - protein, 34 aa, Staphylococcus aureus
TSNAPNRNYATASANEITSKTVSNVSRTGNNAQV

SEQ ID NO: 1569599 - protein, 15 aa, Staphylococcus aureus
TSPSHLTSNEIKQQS

SEQ ID NO: 1569600 - protein, 124 aa, Staphylococcus aureus
TSQAQAAETNQPASALKQKQQNGDTQTENREVEVQNSQNGQSLSAPIENEQPNNNQTNHVDASAVQSSTTEHDQPVSQNEQAKKDTAAATPTQSAKAASKHEQSESRAANKKENDNKATHVESH

SEQ ID NO: 1569601 - protein, 18 aa, Staphylococcus aureus
TSQTRDGGSEADQIPSGY

SEQ ID NO: 1569602 - protein, 21 aa, Staphylococcus aureus
TSRSKGDKVTKKVKIEEAQAH

SEQ ID NO: 1569603 - protein, 7 aa, Staphylococcus aureus
TSTIDGN

SEQ ID NO: 1569604 - protein, 7 aa, Staphylococcus aureus
TTDIYAP

SEQ ID NO: 1569605 - protein, 4 aa, Staphylococcus aureus
TTEI

SEQ ID NO: 1569606 - protein, 5 aa, Staphylococcus aureus
TTQYP

SEQ ID NO: 1569607 - protein, 37 aa, Staphylococcus aureus
TVDKTVKTKEKAGTPSKENKLSQSKMLPKTGETTSSL

SEQ ID NO: 1569608 - protein, 33 aa, Staphylococcus aureus
TVPTTSQLTGTVDNNHQHVSATAPNVTSTTNKT

SEQ ID NO: 1569609 - protein, 8 aa, Staphylococcus aureus
TVQENGNY

SEQ ID NO: 1569610 - protein, 14 aa, Staphylococcus aureus
TVSHAGNAEDPGYY

SEQ ID NO: 1569611 - protein, 15 aa, Staphylococcus aureus
TVSPTKIEDGGKTTV

SEQ ID NO: 1569612 - protein, 9 aa, Staphylococcus aureus
TYATTPPTI

SEQ ID NO: 1569613 - protein, 4 aa, Staphylococcus aureus
TYDE

SEQ ID NO: 1569614 - protein, 11 aa, Staphylococcus aureus
TYTTQDEHGRA

SEQ ID NO: 1569615 - protein, 10 aa, Staphylococcus aureus
TYTYNQNKEN

SEQ ID NO: 1569616 - protein, 11 aa, Staphylococcus aureus
VATEKSSPPWN

SEQ ID NO: 1569617 - protein, 18 aa, Staphylococcus aureus
VATQGSGETISDEQRSDD

SEQ ID NO: 1569618 - protein, 6 aa, Staphylococcus aureus
VDAKDA

SEQ ID NO: 1569619 - protein, 9 aa, Staphylococcus aureus
VDKISSKNQ

SEQ ID NO: 1569620 - protein, 9 aa, Staphylococcus aureus
VDKKTSDFV

SEQ ID NO: 1569621 - protein, 7 aa, Staphylococcus aureus
VDRNDIE

SEQ ID NO: 1569622 - protein, 16 aa, Staphylococcus aureus
VDSAHPIDDVNTEKYN

SEQ ID NO: 1569623 - protein, 16 aa, Staphylococcus aureus
VDSAHPIDDVNTKKYN

SEQ ID NO: 1569624 - protein, 10 aa, Staphylococcus aureus
VEGAEGHAEG

SEQ ID NO: 1569625 - protein, 17 aa, Staphylococcus aureus
VEIDGDASGLKRNVATS

SEQ ID NO: 1569626 - protein, 9 aa, Staphylococcus aureus
VKEPDTDTT

SEQ ID NO: 1569627 - protein, 8 aa, Staphylococcus aureus
VKIQNGDT

SEQ ID NO: 1569628 - protein, 8 aa, Staphylococcus aureus
VKNPTTKN

SEQ ID NO: 1569629 - protein, 102 aa, Staphylococcus aureus
VKPAVTAPSKAENTQTTKVVSTEATKDQSQTQSARTVKTTQTAQEQNKVQTPVKDVTTAKSESNNQAVSENKSQQTNKVTKQNETPKQASKAKELPKTGLTS

SEQ ID NO: 1569630 - protein, 106 aa, Staphylococcus aureus
VKPAVTAPSKNENRQTTKVVSSEATKDQSQTKSARTVKTTQTAQDQNKVQTPVKDVATAKSESNNQAVSDNKSQQTNKVTKQNEVHKQGPSKDSKAKELPKTGLTS

SEQ ID NO: 1569631 - protein, 70 aa, Staphylococcus aureus
VKPTTASSKTTKDVVQTSAGSSEAKDSAPLQKANIKNTNDGHTQSQNNKNTQENKAKSLPQTGEESNKDM

SEQ ID NO: 1569632 - protein, 8 aa, Staphylococcus aureus
VKQTATSL

SEQ ID NO: 1569633 - protein, 7 aa, Staphylococcus aureus
VKSPSAK

SEQ ID NO: 1569634 - protein, 4 aa, Staphylococcus aureus
VLDN

SEQ ID NO: 1569635 - protein, 20 aa, Staphylococcus aureus
VNAQGEDTTPEGYTKKENGL

SEQ ID NO: 1569636 - protein, 20 aa, Staphylococcus aureus
VNAQGKDTTPEGYTKKEDGL

SEQ ID NO: 1569637 - protein, 13 aa, Staphylococcus aureus
VNESQSSLHHTEK

SEQ ID NO: 1569638 - protein, 6 aa, Staphylococcus aureus
VNGKPF

SEQ ID NO: 1569639 - protein, 32 aa, Staphylococcus aureus
VNGTPTPTLTPSDVTNAATQVTNAKTQLNGNH

SEQ ID NO: 1569640 - protein, 16 aa, Staphylococcus aureus
VNNQAPTVESKSHDLN

SEQ ID NO: 1569641 - protein, 31 aa, Staphylococcus aureus
VNRATSAVTTNKNALNGDEKLVQSKTDAARA

SEQ ID NO: 1569642 - protein, 8 aa, Staphylococcus aureus
VNRKSKGI

SEQ ID NO: 1569643 - protein, 21 aa, Staphylococcus aureus
VNRTPEERQNIDTNQDSEYNS

SEQ ID NO: 1569644 - protein, 26 aa, Staphylococcus aureus
VNTAKTALNGDARLNEAKNTAKQQVA

SEQ ID NO: 1569645 - protein, 10 aa, Staphylococcus aureus
VPNSPVKGDT

SEQ ID NO: 1569646 - protein, 12 aa, Staphylococcus aureus
VQPAKPTVTETA

SEQ ID NO: 1569647 - protein, 14 aa, Staphylococcus aureus
VQPAKPTVTETAAG

SEQ ID NO: 1569648 - protein, 14 aa, Staphylococcus aureus
VQQQSVKVQQQTQI

SEQ ID NO: 1569649 - protein, 9 aa, Staphylococcus aureus
VRERSRSNE

SEQ ID NO: 1569650 - protein, 16 aa, Staphylococcus aureus
VSDLTTAKKIKTENLA

SEQ ID NO: 1569651 - protein, 18 aa, Staphylococcus aureus
VSEEVDELQRDIKKNEKL

SEQ ID NO: 1569652 - protein, 4 aa, Staphylococcus aureus
VSGA

SEQ ID NO: 1569653 - protein, 15 aa, Staphylococcus aureus
VSGTPNANVDPQQVA

SEQ ID NO: 1569654 - protein, 9 aa, Staphylococcus aureus
VSKEKRKRK

SEQ ID NO: 1569655 - protein, 4 aa, Staphylococcus aureus
VSQI

SEQ ID NO: 1569656 - protein, 7 aa, Staphylococcus aureus
VSQMNAG

SEQ ID NO: 1569657 - protein, 14 aa, Staphylococcus aureus
VSSLKSSRKDMESV

SEQ ID NO: 1569658 - protein, 11 aa, Staphylococcus aureus
VSTPAEGIPKE

SEQ ID NO: 1569659 - protein, 77 aa, Staphylococcus aureus
VSTTQNVAKPTTASSETTKDVVQTSAGSSEAKDSAPLQKANIKNTNDGHTQSQNNKNTQENKAKSLPQTGEESNKDM

SEQ ID NO: 1569660 - protein, 19 aa, Staphylococcus aureus
VTAANATKTALDQARNGLT

SEQ ID NO: 1569661 - protein, 17 aa, Staphylococcus aureus
VTASDSSDSGNVQHDRN

SEQ ID NO: 1569662 - protein, 35 aa, Staphylococcus aureus
VTDYTKKGINSGINKAKSAVSSGFKSVTRGFKAVF

SEQ ID NO: 1569663 - protein, 6 aa, Staphylococcus aureus
VTGGGK

SEQ ID NO: 1569664 - protein, 4 aa, Staphylococcus aureus
VTIN

SEQ ID NO: 1569665 - protein, 11 aa, Staphylococcus aureus
VTNNKTETDVI

SEQ ID NO: 1569666 - protein, 11 aa, Staphylococcus aureus
VTNNKTETNVI

SEQ ID NO: 1569667 - protein, 16 aa, Staphylococcus aureus
VTRNESVDSNDSASVH

SEQ ID NO: 1569668 - protein, 7 aa, Staphylococcus aureus
VTSETNW

SEQ ID NO: 1569669 - protein, 35 aa, Staphylococcus aureus
VVAPTTETKEAKEVKAPKETKEVKPAAKSDNNTYP

SEQ ID NO: 1569670 - protein, 15 aa, Staphylococcus aureus
WDDKDNQDGKRPEKV

SEQ ID NO: 1569671 - protein, 10 aa, Staphylococcus aureus
WDKSNSKSKV

SEQ ID NO: 1569672 - protein, 9 aa, Staphylococcus aureus
WEQEQRNNV

SEQ ID NO: 1569673 - protein, 15 aa, Staphylococcus aureus
WPTSGTVKIEGYSKT

SEQ ID NO: 1569674 - protein, 18 aa, Staphylococcus aureus
WPTSGTVKIEGYSKTVPL

SEQ ID NO: 1569675 - protein, 10 aa, Staphylococcus aureus
YAKQMQSNNY

SEQ ID NO: 1569676 - protein, 21 aa, Staphylococcus aureus
YAQATNSDVTPVQAANQYGYA

SEQ ID NO: 1569677 - protein, 7 aa, Staphylococcus aureus
YASSTAE

SEQ ID NO: 1569678 - protein, 19 aa, Staphylococcus aureus
YDKEGYRDGEFEKGDKGTW

SEQ ID NO: 1569679 - protein, 11 aa, Staphylococcus aureus
YDKTGKNLKTQ

SEQ ID NO: 1569680 - protein, 6 aa, Staphylococcus aureus
YDRKTI

SEQ ID NO: 1569681 - protein, 14 aa, Staphylococcus aureus
YDTPTGTPIRTPMG

SEQ ID NO: 1569682 - protein, 9 aa, Staphylococcus aureus
YGSPEENYQ

SEQ ID NO: 1569683 - protein, 28 aa, Staphylococcus aureus
YGYQDVDKKAKASPTTKYEIASNTKAFT

SEQ ID NO: 1569684 - protein, 25 aa, Staphylococcus aureus
YHNTSKPNAAAKANANPSNVAGGGA

SEQ ID NO: 1569685 - protein, 25 aa, Staphylococcus aureus
YHNTSTPNASAKAKADPSSVAGGGA

SEQ ID NO: 1569686 - protein, 11 aa, Staphylococcus aureus
YHSANPPLYDS

SEQ ID NO: 1569687 - protein, 8 aa, Staphylococcus aureus
YKKENRPI

SEQ ID NO: 1569688 - protein, 16 aa, Staphylococcus aureus
YKTPGLSKAASDIITQ

SEQ ID NO: 1569689 - protein, 8 aa, Staphylococcus aureus
YLNGTNEV

SEQ ID NO: 1569690 - protein, 10 aa, Staphylococcus aureus
YNDSSTEEVQ

SEQ ID NO: 1569691 - protein, 12 aa, Staphylococcus aureus
YNEEDKMPQRKD

SEQ ID NO: 1569692 - protein, 6 aa, Staphylococcus aureus
YNEKSG

SEQ ID NO: 1569693 - protein, 8 aa, Staphylococcus aureus
YNIPTEKA

SEQ ID NO: 1569694 - protein, 8 aa, Staphylococcus aureus
YNPKNERS

SEQ ID NO: 1569695 - protein, 12 aa, Staphylococcus aureus
YNTEDVDAHNYN

SEQ ID NO: 1569696 - protein, 8 aa, Staphylococcus aureus
YNTKNKRS

SEQ ID NO: 1569697 - protein, 4 aa, Staphylococcus aureus
YNTR

SEQ ID NO: 1569698 - protein, 18 aa, Staphylococcus aureus
YPDGTTKSVRTDAKGHYE

SEQ ID NO: 1569699 - protein, 11 aa, Staphylococcus aureus
YRDGSSTTLDA

SEQ ID NO: 1569700 - protein, 4 aa, Staphylococcus aureus
YSAT

SEQ ID NO: 1569701 - protein, 8 aa, Staphylococcus aureus
YSETANEF

SEQ ID NO: 1569702 - protein, 4 aa, Staphylococcus aureus
YTGI

SEQ ID NO: 1569703 - protein, 10 aa, Staphylococcus aureus
YTIDDSVKEG

SEQ ID NO: 1569704 - protein, 12 aa, Staphylococcus aureus
YTSITQDNIEAA

SEQ ID NO: 1569705 - protein, 8 aa, Staphylococcus aureus
YTSSFAER

SEQ ID NO: 1569706 - protein, 4 aa, Staphylococcus aureus
YYPQ

SEQ ID NO: 1569707 - protein, 33 aa, Staphylococcus aureus
AAASEQKTTTVEENGNSATDNKVNATQTTTTNV

SEQ ID NO: 1569708 - protein, 77 aa, Staphylococcus aureus
AAASEQKTTTVEENGNSATDNKVNETQTTTTNVNTIDETQSFSATATEQPSNATQVTTEKAPKAVQAPQTAQPANFE

SEQ ID NO: 1569709 - protein, 66 aa, Staphylococcus aureus
AAASEQNNTTVEESGSSATESKASETQTTTNNVNTIDETQSYSATSTEQPSQSTQVTTEEAPITVQ

SEQ ID NO: 1569710 - protein, 76 aa, Staphylococcus aureus
AAASEQNNTTVEESGSSATESKASETQTTTNNVNTIDETQSYSATSTEQPSQSTQVTTEEAPTTVQAPKVETSRVD

SEQ ID NO: 1569711 - protein, 30 aa, Staphylococcus aureus
AADINGLTNPVKVDNEKLNKVKDHQAGGNA

SEQ ID NO: 1569712 - protein, 8 aa, Staphylococcus aureus
AADKDKHY

SEQ ID NO: 1569713 - protein, 6 aa, Staphylococcus aureus
AADNIR

SEQ ID NO: 1569714 - protein, 110 aa, Staphylococcus aureus
AAEHTNGELNQSKNEATAPSENKTTEKVDSRQQNNVEQSTTSNQPKVNESDNTSVKETTEEPQNTTSTQPTKKNNDATANKDNLAAQNISTQANDVSATPKTTTIKPRTL

SEQ ID NO: 1569715 - protein, 98 aa, Staphylococcus aureus
AAENTSTENAKQDEASASDNKEVVSETENNSTQKNDLTNPIKKETNTDSHQEAKEAPTTSSTQQQQNNATTSTETKPQNIEKENVKPSTDKTATEDTS

SEQ ID NO: 1569716 - protein, 91 aa, Staphylococcus aureus
AAEQHTPMKAQAATTDKQQVTPTKEAAHQSGEEAATNVSASVQGTADDTNNKVTSNAPSNKPSTAVSTTVNETRDVDAQQASTQKPTQSAT

SEQ ID NO: 1569717 - protein, 10 aa, Staphylococcus aureus
AAGKDYSGTA

SEQ ID NO: 1569718 - protein, 32 aa, Staphylococcus aureus
AAGQVSTTKNALNSNENLEAAKQQATQSLGSL

SEQ ID NO: 1569719 - protein, 10 aa, Staphylococcus aureus
AAMGQGIAKA

SEQ ID NO: 1569720 - protein, 6 aa, Staphylococcus aureus
AANGGV

SEQ ID NO: 1569721 - protein, 7 aa, Staphylococcus aureus
AANTMNN

SEQ ID NO: 1569722 - protein, 7 aa, Staphylococcus aureus
AAPGGVN

SEQ ID NO: 1569723 - protein, 8 aa, Staphylococcus aureus
AASGEELE

SEQ ID NO: 1569724 - protein, 28 aa, Staphylococcus aureus
AATSTITATYAGKTWKATTDDLGIDKSQ

SEQ ID NO: 1569725 - protein, 15 aa, Staphylococcus aureus
AAVNGHKQTAETLNT

SEQ ID NO: 1569726 - protein, 6 aa, Staphylococcus aureus
AAVQNA

SEQ ID NO: 1569727 - protein, 7 aa, Staphylococcus aureus
ADATSAL

SEQ ID NO: 1569728 - protein, 34 aa, Staphylococcus aureus
ADDEATKEEEAEAEAQQVATVEANQDTNGSNEPY

SEQ ID NO: 1569729 - protein, 105 aa, Staphylococcus aureus
ADEKTTNNTAVDKKSGKQSKKTTPSNKRNASKASTNKTSGQKKQHNKKSSQGAKKQSSSSKSTQKNNQTSNKNSKTTNAKSSNASKTPNAKVEKAKSKIEKRTFN

SEQ ID NO: 1569730 - protein, 8 aa, Staphylococcus aureus
ADGGGATR

SEQ ID NO: 1569731 - protein, 10 aa, Staphylococcus aureus
ADGGGATRIA

SEQ ID NO: 1569732 - protein, 8 aa, Staphylococcus aureus
ADGNVVER

SEQ ID NO: 1569733 - protein, 5 aa, Staphylococcus aureus
ADKEC

SEQ ID NO: 1569734 - protein, 6 aa, Staphylococcus aureus
ADKHQK

SEQ ID NO: 1569735 - protein, 15 aa, Staphylococcus aureus
ADKYPAQQAGIQKGD

SEQ ID NO: 1569736 - protein, 9 aa, Staphylococcus aureus
ADQLSPEIS

SEQ ID NO: 1569737 - protein, 19 aa, Staphylococcus aureus
ADQTKDVELNANDKNLQKT

SEQ ID NO: 1569738 - protein, 31 aa, Staphylococcus aureus
ADSQQVNAATEATNANNNQSAQVSQATSQPI

SEQ ID NO: 1569739 - protein, 6 aa, Staphylococcus aureus
ADVSDE

SEQ ID NO: 1569740 - protein, 19 aa, Staphylococcus aureus
ADYNKNALESAKSYAKSLN

SEQ ID NO: 1569741 - protein, 14 aa, Staphylococcus aureus
AEELEEQKKKEEAI

SEQ ID NO: 1569742 - protein, 11 aa, Staphylococcus aureus
AEIEKTPDIAS

SEQ ID NO: 1569743 - protein, 14 aa, Staphylococcus aureus
AEIEKTPDIASATS

SEQ ID NO: 1569744 - protein, 47 aa, Staphylococcus aureus
AEKDNTKRSVNYTDADQPKQQAYDTAVTQAEAITNANGSNANETTVQ

SEQ ID NO: 1569745 - protein, 8 aa, Staphylococcus aureus
AEKETLNK

SEQ ID NO: 1569746 - protein, 4 aa, Staphylococcus aureus
AELG

SEQ ID NO: 1569747 - protein, 5 aa, Staphylococcus aureus
AELRK

SEQ ID NO: 1569748 - protein, 7 aa, Staphylococcus aureus
AENESED

SEQ ID NO: 1569749 - protein, 9 aa, Staphylococcus aureus
AESKPTFEN

SEQ ID NO: 1569750 - protein, 6 aa, Staphylococcus aureus
AEVDKG

SEQ ID NO: 1569751 - protein, 14 aa, Staphylococcus aureus
AFAARDISSTNVTD

SEQ ID NO: 1569752 - protein, 7 aa, Staphylococcus aureus
AFQQTNK

SEQ ID NO: 1569753 - protein, 169 aa, Staphylococcus aureus
AFTKANADKSNKKEQQDNSAKKETTPATPSKPTTAPVEKESQKQDSQKDDNKQSPSVEKEIDASSESGKDKTPATKPAKGEVESSSTTPTKVVSATQNVAKPTSASSETTKGVVQTSAGSSEAKDNAPLQKANIKNTNDGHTQSQNNKNTQENKAKSLPQTGEESNKDM

SEQ ID NO: 1569754 - protein, 169 aa, Staphylococcus aureus
AFTKANADKTNKKEQQDNSAKKETTPATPSKPTTPPVEKESQKQDSQKDDNKQSPSVEKENDASSESGKDKTPATKPAKGEVESSSTTPTKVVSTTQNAAKPTTASSETTKDVVQTSAGSSEAKDSAPLQKANIKNTNDGHTQSENNKNTQENKAKSLPQTGEESNKDM

SEQ ID NO: 1569755 - protein, 4 aa, Staphylococcus aureus
AFTT

SEQ ID NO: 1569756 - protein, 7 aa, Staphylococcus aureus
AGEAGAP

SEQ ID NO: 1569757 - protein, 23 aa, Staphylococcus aureus
AGESHAQTKNVEAAKKYDQYQTN

SEQ ID NO: 1569758 - protein, 7 aa, Staphylococcus aureus
AGESMTS

SEQ ID NO: 1569759 - protein, 45 aa, Staphylococcus aureus
AGGQGQSQSQSDNKQNSAMSDVNQASPQQNSKASASNNISGMPTA

SEQ ID NO: 1569760 - protein, 30 aa, Staphylococcus aureus
AGITGNLGGNSSKETNKTHKIGETVKNGDL

SEQ ID NO: 1569761 - protein, 10 aa, Staphylococcus aureus
AGNPSKGDQT

SEQ ID NO: 1569762 - protein, 10 aa, Staphylococcus aureus
AGNPTKGNKT

SEQ ID NO: 1569763 - protein, 10 aa, Staphylococcus aureus
AGNPTKGNQT

SEQ ID NO: 1569764 - protein, 6 aa, Staphylococcus aureus
AGRFGD

SEQ ID NO: 1569765 - protein, 6 aa, Staphylococcus aureus
AGTGAG

SEQ ID NO: 1569766 - protein, 8 aa, Staphylococcus aureus
AGTTGSWK

SEQ ID NO: 1569767 - protein, 30 aa, Staphylococcus aureus
AGVTGNLGGNSSKEANKTHKIGETVKNGDL

SEQ ID NO: 1569768 - protein, 26 aa, Staphylococcus aureus
AHADTTSINVSNKQSQNVQNHRPYGG

SEQ ID NO: 1569769 - protein, 9 aa, Staphylococcus aureus
AHAEQNQTW

SEQ ID NO: 1569770 - protein, 6 aa, Staphylococcus aureus
AHDTAV

SEQ ID NO: 1569771 - protein, 12 aa, Staphylococcus aureus
AIDDNQLSDADA

SEQ ID NO: 1569772 - protein, 6 aa, Staphylococcus aureus
AIGPSG

SEQ ID NO: 1569773 - protein, 8 aa, Staphylococcus aureus
AIKPDKGK

SEQ ID NO: 1569774 - protein, 7 aa, Staphylococcus aureus
AISQAAQ

SEQ ID NO: 1569775 - protein, 21 aa, Staphylococcus aureus
AKANGTTADKIASDNKLADKN

SEQ ID NO: 1569776 - protein, 339 aa, Staphylococcus aureus
AKDDSDADSDSDADSDSDADSDSDADSDSDADSDSDSDSDSDSDSDSDADSDSDADSDSDSDSDSDADSDSDADSDSDADSDSDADSDSDSDSDSDADSDSDSDSDSDADSDSDADSDSDADSDSDADSDSDSDSDSDADSDSDSDSDSDSDADSDSDSDSDADSDSDADSDSDADSDSDADSDSDSDSDSDSDSDSDSDSDRDSDADSDSDADSDSDSDSDSDADSDSDSDSDSDADSDSDADSDSDSDADSDSDSDSDSDADSDSDADSDSDADSDSDADSDSDSDSDSDSDSDSDADSDSDADSDSDADRDHNDKTDKPNNKELPDTGNDAQNNGT

SEQ ID NO: 1569777 - protein, 15 aa, Staphylococcus aureus
AKDNLNGEKPTTNLN

SEQ ID NO: 1569778 - protein, 12 aa, Staphylococcus aureus
AKGNKSDELDDE

SEQ ID NO: 1569779 - protein, 8 aa, Staphylococcus aureus
AKISEKEF

SEQ ID NO: 1569780 - protein, 11 aa, Staphylococcus aureus
AKKAKKTVVAT

SEQ ID NO: 1569781 - protein, 23 aa, Staphylococcus aureus
AKKLNESQAPKADNNFNKDQQNA

SEQ ID NO: 1569782 - protein, 22 aa, Staphylococcus aureus
AKKLNESQAPKADNNFNKEQQN

SEQ ID NO: 1569783 - protein, 16 aa, Staphylococcus aureus
AKKLSNKEETLSENDA

SEQ ID NO: 1569784 - protein, 17 aa, Staphylococcus aureus
AKKLSNKEETLSKNDAK

SEQ ID NO: 1569785 - protein, 9 aa, Staphylococcus aureus
AKKTGATVI

SEQ ID NO: 1569786 - protein, 7 aa, Staphylococcus aureus
AKKYIEG

SEQ ID NO: 1569787 - protein, 9 aa, Staphylococcus aureus
AKNKAEALA

SEQ ID NO: 1569788 - protein, 19 aa, Staphylococcus aureus
AKNPESEEYKVNEKIKKEH

SEQ ID NO: 1569789 - protein, 6 aa, Staphylococcus aureus
AKPGQS

SEQ ID NO: 1569790 - protein, 8 aa, Staphylococcus aureus
AKPGQSMA

SEQ ID NO: 1569791 - protein, 5 aa, Staphylococcus aureus
AKPSL

SEQ ID NO: 1569792 - protein, 18 aa, Staphylococcus aureus
AKQDDNVHQSDQKPQVGD

SEQ ID NO: 1569793 - protein, 13 aa, Staphylococcus aureus
AKQGEVGRSKLNN

SEQ ID NO: 1569794 - protein, 6 aa, Staphylococcus aureus
AKSDIT

SEQ ID NO: 1569795 - protein, 12 aa, Staphylococcus aureus
AKSNKQGELSNE

SEQ ID NO: 1569796 - protein, 13 aa, Staphylococcus aureus
AKSPFEFGPYLIL

SEQ ID NO: 1569797 - protein, 14 aa, Staphylococcus aureus
AKSSEVNENMKKQN

SEQ ID NO: 1569798 - protein, 16 aa, Staphylococcus aureus
AKTDIPDEIKTEVTAN

SEQ ID NO: 1569799 - protein, 4 aa, Staphylococcus aureus
AKYI

SEQ ID NO: 1569800 - protein, 5 aa, Staphylococcus aureus
AKYIS

SEQ ID NO: 1569801 - protein, 8 aa, Staphylococcus aureus
ALEDYGKK

SEQ ID NO: 1569802 - protein, 25 aa, Staphylococcus aureus
ALEEQEATFGRKRHSGASLTGGKEF

SEQ ID NO: 1569803 - protein, 6 aa, Staphylococcus aureus
ALGASG

SEQ ID NO: 1569804 - protein, 17 aa, Staphylococcus aureus
ALKKATEQANFIYHFFF

SEQ ID NO: 1569805 - protein, 14 aa, Staphylococcus aureus
ALNKESKKQEFENS

SEQ ID NO: 1569806 - protein, 16 aa, Staphylococcus aureus
ALNQAKQNLTADTHTL

SEQ ID NO: 1569807 - protein, 17 aa, Staphylococcus aureus
ALNQAKQNLTADTHTLE

SEQ ID NO: 1569808 - protein, 4 aa, Staphylococcus aureus
ALPS

SEQ ID NO: 1569809 - protein, 5 aa, Staphylococcus aureus
ALTPS

SEQ ID NO: 1569810 - protein, 7 aa, Staphylococcus aureus
ALYSGSN

SEQ ID NO: 1569811 - protein, 12 aa, Staphylococcus aureus
AMAGAVGGGGIG

SEQ ID NO: 1569812 - protein, 4 aa, Staphylococcus aureus
AMGP

SEQ ID NO: 1569813 - protein, 11 aa, Staphylococcus aureus
AMGRGTEVTSG

SEQ ID NO: 1569814 - protein, 5 aa, Staphylococcus aureus
ANAFH

SEQ ID NO: 1569815 - protein, 11 aa, Staphylococcus aureus
ANAGIEGTVKG

SEQ ID NO: 1569816 - protein, 4 aa, Staphylococcus aureus
ANDD

SEQ ID NO: 1569817 - protein, 25 aa, Staphylococcus aureus
ANELDSKDNKGSQIELNGESDIDSK

SEQ ID NO: 1569818 - protein, 26 aa, Staphylococcus aureus
ANELDSKDNKGSQIEMNGQSDIDSKL

SEQ ID NO: 1569819 - protein, 26 aa, Staphylococcus aureus
ANELDSKDNKSSHSEMNGQSDIDSKL

SEQ ID NO: 1569820 - protein, 4 aa, Staphylococcus aureus
ANFD

SEQ ID NO: 1569821 - protein, 15 aa, Staphylococcus aureus
ANKHDDVIDKLINIL

SEQ ID NO: 1569822 - protein, 13 aa, Staphylococcus aureus
ANKYKNSDKQIFL

SEQ ID NO: 1569823 - protein, 7 aa, Staphylococcus aureus
ANMHPSN

SEQ ID NO: 1569824 - protein, 17 aa, Staphylococcus aureus
ANMHSSKHQINQSNKKV

SEQ ID NO: 1569825 - protein, 8 aa, Staphylococcus aureus
ANNANRAD

SEQ ID NO: 1569826 - protein, 6 aa, Staphylococcus aureus
ANNGYR

SEQ ID NO: 1569827 - protein, 10 aa, Staphylococcus aureus
ANNKVTGNNA

SEQ ID NO: 1569828 - protein, 15 aa, Staphylococcus aureus
ANNNKAKSDSHSKQL

SEQ ID NO: 1569829 - protein, 13 aa, Staphylococcus aureus
ANNNQGNTTGADG

SEQ ID NO: 1569830 - protein, 6 aa, Staphylococcus aureus
ANNRIN

SEQ ID NO: 1569831 - protein, 5 aa, Staphylococcus aureus
ANSST

SEQ ID NO: 1569832 - protein, 13 aa, Staphylococcus aureus
ANVKSDLSQTYDQ

SEQ ID NO: 1569833 - protein, 8 aa, Staphylococcus aureus
ANVQRTSY

SEQ ID NO: 1569834 - protein, 7 aa, Staphylococcus aureus
APAQHTQ

SEQ ID NO: 1569835 - protein, 11 aa, Staphylococcus aureus
APDGNTISATE

SEQ ID NO: 1569836 - protein, 9 aa, Staphylococcus aureus
APEKARRRV

SEQ ID NO: 1569837 - protein, 7 aa, Staphylococcus aureus
APENRGK

SEQ ID NO: 1569838 - protein, 22 aa, Staphylococcus aureus
APIYQSETNYHSKDPGKSKSGI

SEQ ID NO: 1569839 - protein, 10 aa, Staphylococcus aureus
APKTSHSDSI

SEQ ID NO: 1569840 - protein, 19 aa, Staphylococcus aureus
APKVETEMKPQEDLPSEKV

SEQ ID NO: 1569841 - protein, 7 aa, Staphylococcus aureus
APQATSI

SEQ ID NO: 1569842 - protein, 4 aa, Staphylococcus aureus
APQN

SEQ ID NO: 1569843 - protein, 6 aa, Staphylococcus aureus
APRDRK

SEQ ID NO: 1569844 - protein, 7 aa, Staphylococcus aureus
APSINPL

SEQ ID NO: 1569845 - protein, 6 aa, Staphylococcus aureus
APSNQD

SEQ ID NO: 1569846 - protein, 6 aa, Staphylococcus aureus
APSSLP

SEQ ID NO: 1569847 - protein, 6 aa, Staphylococcus aureus
APTGTF

SEQ ID NO: 1569848 - protein, 15 aa, Staphylococcus aureus
APTKYKDQERTVTTA

SEQ ID NO: 1569849 - protein, 6 aa, Staphylococcus aureus
APVSST

SEQ ID NO: 1569850 - protein, 11 aa, Staphylococcus aureus
APYKKAETLER

SEQ ID NO: 1569851 - protein, 13 aa, Staphylococcus aureus
AQAASENDTEISK

SEQ ID NO: 1569852 - protein, 13 aa, Staphylococcus aureus
AQAKTNATNTINN

SEQ ID NO: 1569853 - protein, 13 aa, Staphylococcus aureus
AQASLEHKSLKKQ

SEQ ID NO: 1569854 - protein, 82 aa, Staphylococcus aureus
AQDLNRRNQQQIPQNSAANNETSNSAPAAGNGVTSTPPSAPNGNTTPNNNVTQNTAPNSNNAPVSTTPQSTSGKKDGQSFAD

SEQ ID NO: 1569855 - protein, 10 aa, Staphylococcus aureus
AQGERAPAQA

SEQ ID NO: 1569856 - protein, 10 aa, Staphylococcus aureus
AQGERAPSQA

SEQ ID NO: 1569857 - protein, 6 aa, Staphylococcus aureus
AQKHME

SEQ ID NO: 1569858 - protein, 8 aa, Staphylococcus aureus
AQKNDLEA

SEQ ID NO: 1569859 - protein, 10 aa, Staphylococcus aureus
AQKNVEPQFG

SEQ ID NO: 1569860 - protein, 20 aa, Staphylococcus aureus
AQKTCKSGESITISNGEAVA

SEQ ID NO: 1569861 - protein, 13 aa, Staphylococcus aureus
AQQAAIKEEASAN

SEQ ID NO: 1569862 - protein, 50 aa, Staphylococcus aureus
AQQAAIKEEASANNLSDTSQEAQEIQEAKREAQAETDKSVAVSNEESKAV

SEQ ID NO: 1569863 - protein, 83 aa, Staphylococcus aureus
AQQAAIKEEASANNLSDTSQEAQEVQEAKKEAQAEKDSDTLTKDASAAKVEVSKPESQAERLANAAKQKQAKLTPGSKESQLT

SEQ ID NO: 1569864 - protein, 7 aa, Staphylococcus aureus
AQTLNTA

SEQ ID NO: 1569865 - protein, 20 aa, Staphylococcus aureus
AQVDNKNDKSIKVNRKKDRI

SEQ ID NO: 1569866 - protein, 4 aa, Staphylococcus aureus
ARFS

SEQ ID NO: 1569867 - protein, 12 aa, Staphylococcus aureus
ARKLNKNNGNVL

SEQ ID NO: 1569868 - protein, 12 aa, Staphylococcus aureus
ARNNDKKYATQS

SEQ ID NO: 1569869 - protein, 5 aa, Staphylococcus aureus
ASAAK

SEQ ID NO: 1569870 - protein, 20 aa, Staphylococcus aureus
ASAATTTAVTANTITVNKDN

SEQ ID NO: 1569871 - protein, 4 aa, Staphylococcus aureus
ASAK

SEQ ID NO: 1569872 - protein, 8 aa, Staphylococcus aureus
ASANDGLR

SEQ ID NO: 1569873 - protein, 8 aa, Staphylococcus aureus
ASAQAING

SEQ ID NO: 1569874 - protein, 10 aa, Staphylococcus aureus
ASDEDYQKLT

SEQ ID NO: 1569875 - protein, 6 aa, Staphylococcus aureus
ASEGWG

SEQ ID NO: 1569876 - protein, 40 aa, Staphylococcus aureus
ASEKVADKKTTGTQVDTAQPSNVSEIKPRMKRSTDVAEVA

SEQ ID NO: 1569877 - protein, 7 aa, Staphylococcus aureus
ASENTEK

SEQ ID NO: 1569878 - protein, 17 aa, Staphylococcus aureus
ASERTIDTETTGGNTKV

SEQ ID NO: 1569879 - protein, 7 aa, Staphylococcus aureus
ASGTSNF

SEQ ID NO: 1569880 - protein, 14 aa, Staphylococcus aureus
ASIDSGSDNQYQKD

SEQ ID NO: 1569881 - protein, 14 aa, Staphylococcus aureus
ASIDSGSNNQYQKD

SEQ ID NO: 1569882 - protein, 6 aa, Staphylococcus aureus
ASKDII

SEQ ID NO: 1569883 - protein, 8 aa, Staphylococcus aureus
ASKNKKNE

SEQ ID NO: 1569884 - protein, 5 aa, Staphylococcus aureus
ASLSN

SEQ ID NO: 1569885 - protein, 173 aa, Staphylococcus aureus
ASMNQSGVDSNSASQSASNSTSTSTSESDSQSTSSYTSQSTSQSESTSTSTSLSDSTSISKSTSQSGSVSTSASLSGSESESDSQSISTSASESTSESASTSLSDSTSASNSGSASTSTSLSNSASASESDSSSTSLSDSTSASMQSSESDSQSTSASLSDSLSTSTSNRMST

SEQ ID NO: 1569886 - protein, 53 aa, Staphylococcus aureus
ASMNQSGVDSNSASQSASNSTSTSTSLSDSMSQSQSTSTSASGSLSTSISTSM

SEQ ID NO: 1569887 - protein, 169 aa, Staphylococcus aureus
ASMNQSGVDSNSASQSASTSTSTSTSESDSQSTSSYTSQSTSQSESTSTSTSLSDSTSMSKSTSQSGSTSTSASLSGSESESDSQSVSTSASESTSESASTSLSDSTSTSNSTSESTSNAISTSASASESDSSSTSLSDSTSASMQSSESDSQSTSTSLSNSQSTSTSI

SEQ ID NO: 1569888 - protein, 210 aa, Staphylococcus aureus
ASMNQSGVDSNSASQSASTSTSTSTSESDSQSTSSYTSQSTSQSESTSTSTSLSDSTSMSRSTSQSGSTSTSASLSASESESDSQSISTSASDSTSESTSTSLSDSTSTSNSTSESTSKAISTSASASESDSTSISDSESVSTSTSMSLSTSDSTSTSESLSTSMSGSQSISDSTSTSMSNSTSMSNSTSTSMSGSTSTSESNSMHPSDS

SEQ ID NO: 1569889 - protein, 198 aa, Staphylococcus aureus
ASMNQSGVDSNSASQSASTSTSTSTSESDSQSTSSYTSQSTSQSESTSTSTSLSDSTSMSRSTSQSGSTSTSASLSGSESESDSQSISTSASDSTSESTSTSLSDSTSTSNSTSESTSKAISTSASASESDSTSTSDSRSTSASTSTSMRTSTLDSQSMSLSTSTSTSVSDSTSLSDSVSDSTSDSTSTSTSGSMSAS

SEQ ID NO: 1569890 - protein, 222 aa, Staphylococcus aureus
ASMNQSGVDSNSASQSASTSTSTSTSESDSQSTSSYTSQSTSQSESTSTSTSLSDSTSMSRSTSQSGSTSTSASLSGSESESDSQSISTSASDSTSESTSTSLSDSTSTSNSTSESTSKAISTSASASESDSTSTSLSDSQSTSRSTSASGSASTSTSTSDSRSTSASTSTSMRTSTLDSQSMSLSTSTSTSVSDSTSLSDSVSDSTSDSTSTSTSGSMSAS

SEQ ID NO: 1569891 - protein, 169 aa, Staphylococcus aureus
ASMNQSGVDSNSASQSASTSTSTSTSESDSQSTSSYTSQSTSQSESTSTSTSLSDSTSMSRSTSQSGSTSTSASLSGSESESDSQSISTSTSESKSESTSTSLSDSTSISNSGSASTSTSLSNSASASESDSSSTSLSDSTSASMQSSESDSQSTSTSLSNSQSTSTSI

SEQ ID NO: 1569892 - protein, 169 aa, Staphylococcus aureus
ASMNQSGVDSNSASQSASTSTSTSTSESDSQSTSSYTSQSTSQSESTSTSTSLSDSTSMSRSTSQSGSTSTSESLSGSESESDSQSISTSTSESKSESTSTSLSDSTSISNSGSASTSTSLSNSASASESDSSSTSLSDSTSASMQSSESDSQSTSTSLSNSQSTSTSI

SEQ ID NO: 1569893 - protein, 266 aa, Staphylococcus aureus
ASMNQSGVDSNSESQSVSASTSTSTSESDSQSTSSYTSQSGSTSESTSTSTSLSDSTSISKSTSASGSLSTSISSSMSASASTSTSQSTSVSTSLSTSDSISDSTSISISGSQSAVESESTSDSTSISDSESLSTSGSDSTSTSTSDSTSTSESLSTSGSTSGSTSTSTSESLSMSNSGSTSVSESLSTSNSGSTSVSESLSTSGSGSTSVSDSSSTSSSLSTSGSTSESDSTSMSESNSASISMSQSISGSTSGSTSISTSESLS

SEQ ID NO: 1569894 - protein, 17 aa, Staphylococcus aureus
ASRYTKPGDEIAITCDR

SEQ ID NO: 1569895 - protein, 19 aa, Staphylococcus aureus
ASTYNDTNKTVKMTNAGQS

SEQ ID NO: 1569896 - protein, 28 aa, Staphylococcus aureus
ATANAEDGAKTVYGENLPNSADTNGDGW

SEQ ID NO: 1569897 - protein, 6 aa, Staphylococcus aureus
ATEQSR

SEQ ID NO: 1569898 - protein, 7 aa, Staphylococcus aureus
ATFKDTN

SEQ ID NO: 1569899 - protein, 4 aa, Staphylococcus aureus
ATNL

SEQ ID NO: 1569900 - protein, 40 aa, Staphylococcus aureus
ATQDNSGNAVTNTVTGLPSGLTFDSTNNTISGTPTNIGTS

SEQ ID NO: 1569901 - protein, 19 aa, Staphylococcus aureus
ATQDNSGNAVTNTVTRLPS

SEQ ID NO: 1569902 - protein, 11 aa, Staphylococcus aureus
ATQDNSGNVVT

SEQ ID NO: 1569903 - protein, 28 aa, Staphylococcus aureus
ATSDNKDTKQQNQTEEDERQGLNGYRKT

SEQ ID NO: 1569904 - protein, 10 aa, Staphylococcus aureus
ATSTTNNKDI

SEQ ID NO: 1569905 - protein, 9 aa, Staphylococcus aureus
ATSTTNNKN

SEQ ID NO: 1569906 - protein, 55 aa, Staphylococcus aureus
ATTDKQQVPPTKEAAHHSGKEAATNVSASAQGTADDTNSKVTSNAPSNKPSTVVS

SEQ ID NO: 1569907 - protein, 6 aa, Staphylococcus aureus
ATTRDK

SEQ ID NO: 1569908 - protein, 4 aa, Staphylococcus aureus
ATTS

SEQ ID NO: 1569909 - protein, 16 aa, Staphylococcus aureus
ATVGDKGCGNGPNGFR

SEQ ID NO: 1569910 - protein, 18 aa, Staphylococcus aureus
ATVGDKGRGNGPNGFRNE

SEQ ID NO: 1569911 - protein, 16 aa, Staphylococcus aureus
ATVGDKGSGNGPNGFR

SEQ ID NO: 1569912 - protein, 27 aa, Staphylococcus aureus
AVAPTKQKQSKKFELPGTGGEESTNKG

SEQ ID NO: 1569913 - protein, 23 aa, Staphylococcus aureus
AVNPSIKANDIHTKSNKQMAKQQ

SEQ ID NO: 1569914 - protein, 8 aa, Staphylococcus aureus
AVNTSAPR

SEQ ID NO: 1569915 - protein, 5 aa, Staphylococcus aureus
AVPSL

SEQ ID NO: 1569916 - protein, 15 aa, Staphylococcus aureus
AVRQKEEVAKNTEKV

SEQ ID NO: 1569917 - protein, 24 aa, Staphylococcus aureus
AVTAAKKALNGEERLNNRKSEALQ

SEQ ID NO: 1569918 - protein, 24 aa, Staphylococcus aureus
AYTREGDISALGAQKEFKDQEMPG

SEQ ID NO: 1569919 - protein, 12 aa, Staphylococcus aureus
AYVGSGAAQFKN

SEQ ID NO: 1569920 - protein, 5 aa, Staphylococcus aureus
CGAST

SEQ ID NO: 1569921 - protein, 20 aa, Staphylococcus aureus
CGKGNETKEDSKEEQIKKSF

SEQ ID NO: 1569922 - protein, 15 aa, Staphylococcus aureus
CGKGNETKEDSKEIQ

SEQ ID NO: 1569923 - protein, 13 aa, Staphylococcus aureus
CGTEQRTANHFPG

SEQ ID NO: 1569924 - protein, 14 aa, Staphylococcus aureus
CGTGKEAEIKKSFE

SEQ ID NO: 1569925 - protein, 6 aa, Staphylococcus aureus
CKTTNK

SEQ ID NO: 1569926 - protein, 11 aa, Staphylococcus aureus
CPQPKDDYYDV

SEQ ID NO: 1569927 - protein, 4 aa, Staphylococcus aureus
CTGS

SEQ ID NO: 1569928 - protein, 5 aa, Staphylococcus aureus
CTTDP

SEQ ID NO: 1569929 - protein, 12 aa, Staphylococcus aureus
DADLENTSIQSI

SEQ ID NO: 1569930 - protein, 11 aa, Staphylococcus aureus
DAGNELPPNRM

SEQ ID NO: 1569931 - protein, 111 aa, Staphylococcus aureus
DAKKTSKAKKDKQDTEVAVASSNSDNVNYEASATTPATTSSADTDSEDSEKSSKDEDKQNASKSDKSSVEKSESNEETATVEPMPQSKPTTSEAPPSQNIHNEDSMYDAST

SEQ ID NO: 1569932 - protein, 111 aa, Staphylococcus aureus
DAKKTSKAKKDKQDTEVAVASSNSDNVNYEASATTPATTSSADTDSEDSEKSSKDEDKQNSSKSDKSSVEKSESNEETAPVEPMPQSKPTTSEASPSQNIHNEDSMYDAST

SEQ ID NO: 1569933 - protein, 79 aa, Staphylococcus aureus
DAKKTSKAKKDKQDTEVAVASSNSDNVSYEASATTPATTSSADTDSEDSEKSSKDEDKQNASKSDKSSVEKSESNEELL

SEQ ID NO: 1569934 - protein, 111 aa, Staphylococcus aureus
DAKKTSKAKKDKQDTEVAVTSSNSDNVNYEASATTPATTSSADTDSEDSEKSSKDEDKQNASKSDKSSVEKSESNEETAPVEPMPHSKPTTSEAPPSQNIHNENSMYDAST

SEQ ID NO: 1569935 - protein, 111 aa, Staphylococcus aureus
DAKKTSKSKKDKQDTEVAVASSNSDNVNYEASATTPATTSSADTDSEDSEKSSKDEDKQNASKSDKDSVEKSESNEETAPVEPMPQSKPTTSEAPPSQNIHNEDSMYDAST

SEQ ID NO: 1569936 - protein, 6 aa, Staphylococcus aureus
DALKET

SEQ ID NO: 1569937 - protein, 51 aa, Staphylococcus aureus
DANGVNHGGSEMVQNKTGHMSQQDHMNQNTHMNQQPQIQQGHMQSSNHQMM

SEQ ID NO: 1569938 - protein, 38 aa, Staphylococcus aureus
DANGVNHGGSQMVQNKTGHMSQQDHMNQNTHMNQQPHM

SEQ ID NO: 1569939 - protein, 8 aa, Staphylococcus aureus
DANPAKMA

SEQ ID NO: 1569940 - protein, 7 aa, Staphylococcus aureus
DANQTVQ

SEQ ID NO: 1569941 - protein, 8 aa, Staphylococcus aureus
DASGSSNF

SEQ ID NO: 1569942 - protein, 14 aa, Staphylococcus aureus
DASIKDAGKGMGMT

SEQ ID NO: 1569943 - protein, 7 aa, Staphylococcus aureus
DASKNNE

SEQ ID NO: 1569944 - protein, 9 aa, Staphylococcus aureus
DATHGDPHA

SEQ ID NO: 1569945 - protein, 6 aa, Staphylococcus aureus
DATKVN

SEQ ID NO: 1569946 - protein, 10 aa, Staphylococcus aureus
DAVKKQNGVK

SEQ ID NO: 1569947 - protein, 5 aa, Staphylococcus aureus
DAYNY

SEQ ID NO: 1569948 - protein, 8 aa, Staphylococcus aureus
DAYSETTK

SEQ ID NO: 1569949 - protein, 19 aa, Staphylococcus aureus
DDATDTHSSKNKESRGQGI

SEQ ID NO: 1569950 - protein, 18 aa, Staphylococcus aureus
DDATDTYSSKNRESCGQG

SEQ ID NO: 1569951 - protein, 19 aa, Staphylococcus aureus
DDATDTYSSKNRESRGQGI

SEQ ID NO: 1569952 - protein, 8 aa, Staphylococcus aureus
DDDKNIKT

SEQ ID NO: 1569953 - protein, 15 aa, Staphylococcus aureus
DDHEEASSHITDKEA

SEQ ID NO: 1569954 - protein, 6 aa, Staphylococcus aureus
DDKTFT

SEQ ID NO: 1569955 - protein, 10 aa, Staphylococcus aureus
DDLGSASATT

SEQ ID NO: 1569956 - protein, 5 aa, Staphylococcus aureus
DDLLD

SEQ ID NO: 1569957 - protein, 8 aa, Staphylococcus aureus
DDNGRRIQ

SEQ ID NO: 1569958 - protein, 101 aa, Staphylococcus aureus
DDNPDNDINTPSLSKTDDDRKLDEKNHVEDKHKQNADSSETVGYQSQSSASHRSTEKRNIATNDNDKLNGQKPNTKTSANNNQKKATSKLNKGRATNNNYS

SEQ ID NO: 1569959 - protein, 9 aa, Staphylococcus aureus
DDTDSKWYG

SEQ ID NO: 1569960 - protein, 9 aa, Staphylococcus aureus
DDTEGKWYG

SEQ ID NO: 1569961 - protein, 12 aa, Staphylococcus aureus
DDTQISKQRSFA

SEQ ID NO: 1569962 - protein, 16 aa, Staphylococcus aureus
DDTVTAGTSAPLSDGA

SEQ ID NO: 1569963 - protein, 16 aa, Staphylococcus aureus
DDVEAPSDYVFRAEVS

SEQ ID NO: 1569964 - protein, 59 aa, Staphylococcus aureus
DDVSKKQNSLDSVDQDTEKSKYYEQNSEATLSTKSTDKVESSDMRKLSPDKNKVGHEEQ

SEQ ID NO: 1569965 - protein, 59 aa, Staphylococcus aureus
DDVSKKQNSLDSVDQDTEKSKYYEQNSEATLSTKSTDKVESTDMRKLSSDKNKVGHEEQ

SEQ ID NO: 1569966 - protein, 5 aa, Staphylococcus aureus
DEEDL

SEQ ID NO: 1569967 - protein, 11 aa, Staphylococcus aureus
DEESTKDIVTG

SEQ ID NO: 1569968 - protein, 12 aa, Staphylococcus aureus
DEFNEKDQQKKY

SEQ ID NO: 1569969 - protein, 6 aa, Staphylococcus aureus
DEFNNS

SEQ ID NO: 1569970 - protein, 39 aa, Staphylococcus aureus
DEGIDAVNKTAEKAVDSVGNAIGDATKSISNHINPMKWS

SEQ ID NO: 1569971 - protein, 25 aa, Staphylococcus aureus
DEHPSDTYPEDDKSIKDKIVDKLKK

SEQ ID NO: 1569972 - protein, 32 aa, Staphylococcus aureus
DEITTKDQSDDDINTPNVAEDKSQDDLKDDLK

SEQ ID NO: 1569973 - protein, 60 aa, Staphylococcus aureus
DEITTKDQSDDDINTPNVAEDKSQDDLKDDLKEKQQSNNHHQSTQPKTSPSTETNTQQSF

SEQ ID NO: 1569974 - protein, 60 aa, Staphylococcus aureus
DEITTKDQSDDDINTPNVAEDKSQDDLKDDLKEKQQSSNQHQSTQPKTSPSTETNTQQSF

SEQ ID NO: 1569975 - protein, 6 aa, Staphylococcus aureus
DEKDDT

SEQ ID NO: 1569976 - protein, 26 aa, Staphylococcus aureus
DELPESVYANTNDQEKFKDVTNDMSD

SEQ ID NO: 1569977 - protein, 4 aa, Staphylococcus aureus
DELS

SEQ ID NO: 1569978 - protein, 7 aa, Staphylococcus aureus
DEMKPEP

SEQ ID NO: 1569979 - protein, 5 aa, Staphylococcus aureus
DENKE

SEQ ID NO: 1569980 - protein, 4 aa, Staphylococcus aureus
DENN

SEQ ID NO: 1569981 - protein, 7 aa, Staphylococcus aureus
DENSGNI

SEQ ID NO: 1569982 - protein, 20 aa, Staphylococcus aureus
DERAGIATSNQDQETNSSKR

SEQ ID NO: 1569983 - protein, 20 aa, Staphylococcus aureus
DERTEIATSNQDQQTNSSKR

SEQ ID NO: 1569984 - protein, 17 aa, Staphylococcus aureus
DESENELIQSTTTVTVP

SEQ ID NO: 1569985 - protein, 8 aa, Staphylococcus aureus
DESKEQQF

SEQ ID NO: 1569986 - protein, 13 aa, Staphylococcus aureus
DESKVDKDALSNK

SEQ ID NO: 1569987 - protein, 13 aa, Staphylococcus aureus
DESKVDKGALSNN

SEQ ID NO: 1569988 - protein, 25 aa, Staphylococcus aureus
DETGAQEASKDEAKKAAAQKGNPVQ

SEQ ID NO: 1569989 - protein, 25 aa, Staphylococcus aureus
DETGAQEASKDEAKQAAAKKGNPVQ

SEQ ID NO: 1569990 - protein, 5 aa, Staphylococcus aureus
DFAKQ

SEQ ID NO: 1569991 - protein, 40 aa, Staphylococcus aureus
DFDDSGAKDFNSLSSKDREKLEKEIEKNGGKMFESILKKG

SEQ ID NO: 1569992 - protein, 99 aa, Staphylococcus aureus
DFEEDTLPKVSGQNEGQQTIEEDTTPPAPEVPSEPDTPAPPTPEVPSEPGEPTPPTPEVPSEPDTPTPPTPEVPTEPGKPVPPAKEEPKKPSKPVERGK

SEQ ID NO: 1569993 - protein, 141 aa, Staphylococcus aureus
DFEEDTLPKVSGQNEGQQTIEEDTTPPTPEVPSEPETPTPPTPEVPSEPETPTPPTPEVPSEPETPTPPTPEVPSEPETPTPPTPEVPSEPETPTPPTPEVPSEPGTPVPPTPEVPAEPGKPVPPAKEEPKKPSKPVEQGK

SEQ ID NO: 1569994 - protein, 113 aa, Staphylococcus aureus
DFEEDTLPKVSGQNEGQQTIEEDTTPPTPEVPSEPGEPTPPTPEVPSEPETPTPPTPEVPSEPETPTPPTPEVPSEPETPTPPTPEVPAEPGKPVPPAKEEPKKPSKPVEQGK

SEQ ID NO: 1569995 - protein, 71 aa, Staphylococcus aureus
DFEEDTLPKVSGQNEGQQTIEEDTTPPTPEVPSEPGTPVPPTPEVPAEPGKPVPPAKDEPKKPSKPVEQGK

SEQ ID NO: 1569996 - protein, 116 aa, Staphylococcus aureus
DFEEDTLPKVSGQNEGQQTIEEDTTPPTPPAPEVPSEPGEPTPPTPEVPSEPETPTPPTPEVPSEPETPTPPTPEVPSEPETPTPPTPEVPAEPGKPVPPAKEEPKKPSKPVEQGK

SEQ ID NO: 1569997 - protein, 130 aa, Staphylococcus aureus
DFEEDTLPKVSGQNEGQQTIEEDTTPPTPPTPEVPSEPETPMPPTPEVPSEPETPTPPTPEVPSEPETPTPPTPEVPSEPETPTPPTPEVPSEPETPVPPTPEVPSEPGKPVPPAKEEPKKPSKPVEQGK

SEQ ID NO: 1569998 - protein, 116 aa, Staphylococcus aureus
DFEEDTLPKVSGQNEGQQTIEEDTTPPTPPTPEVPSEPETPTPPTPEVPSEPETPTPPTPEVPSEPETPTPPTPEVPSEPETPTPPTPEVPAEPGKPVPPAEEEPKKPSKPVEQGK

SEQ ID NO: 1569999 - protein, 130 aa, Staphylococcus aureus
DFEEDTLPKVSGQNEGQQTIEEDTTPPTPPTPEVPSEPETPTPPTPEVPSEPGEPTPPTPEVPSEPGEPTPPTPEVPSEPKTPTPPTPEVPSEPETPTPPTPEVPAEPGKPLPPAKEEPKKPSKPVEQGK

SEQ ID NO: 1570000 - protein, 88 aa, Staphylococcus aureus
DFEEDTLPQVSGHNEGQQTIEEDTTLPTPPTPEVPSEPETPTPPTPEVPSEPETPTPPTPEVPAEPGKPVPPAKEEPKKPSKPVEQGK

SEQ ID NO: 1570001 - protein, 102 aa, Staphylococcus aureus
DFEEDTLPQVSGHNEGQQTIEEDTTPPTPPTPEVPSEPETPTPPTPEVPSEPETPTPPTPEVPSEPETPTPPTPEVPAEPGKPVPPAKEEPKKPSKPVEQGK

SEQ ID NO: 1570002 - protein, 6 aa, Staphylococcus aureus
DFEQQK

SEQ ID NO: 1570003 - protein, 9 aa, Staphylococcus aureus
DFGSTTSEI

SEQ ID NO: 1570004 - protein, 41 aa, Staphylococcus aureus
DFNDSGAKDFNSLSSKDREKLEKEIEKNGGKMFESILKKAS

SEQ ID NO: 1570005 - protein, 10 aa, Staphylococcus aureus
DGAKNDAESL

SEQ ID NO: 1570006 - protein, 26 aa, Staphylococcus aureus
DGDTVGKASNNPLMPPVDTGESIGLG

SEQ ID NO: 1570007 - protein, 27 aa, Staphylococcus aureus
DGDTVGKTSNNPLMPPVDTGESIGLGA

SEQ ID NO: 1570008 - protein, 9 aa, Staphylococcus aureus
DGGEGGTGA

SEQ ID NO: 1570009 - protein, 10 aa, Staphylococcus aureus
DGLAGFTAGS

SEQ ID NO: 1570010 - protein, 13 aa, Staphylococcus aureus
DGNISLPKAGETI

SEQ ID NO: 1570011 - protein, 24 aa, Staphylococcus aureus
DGQKVSVTYANDNPTQAGELTGAN

SEQ ID NO: 1570012 - protein, 10 aa, Staphylococcus aureus
DGQQSSVTKD

SEQ ID NO: 1570013 - protein, 20 aa, Staphylococcus aureus
DGQRKGNSNDSQEKLSPGKA

SEQ ID NO: 1570014 - protein, 11 aa, Staphylococcus aureus
DGSAKLNNMTS

SEQ ID NO: 1570015 - protein, 6 aa, Staphylococcus aureus
DGSRFQ

SEQ ID NO: 1570016 - protein, 11 aa, Staphylococcus aureus
DGTDDRTGNYE

SEQ ID NO: 1570017 - protein, 16 aa, Staphylococcus aureus
DGTMTAGTSAPLSDGA

SEQ ID NO: 1570018 - protein, 15 aa, Staphylococcus aureus
DGTVKHSTDSSGQDF

SEQ ID NO: 1570019 - protein, 6 aa, Staphylococcus aureus
DHKGRI

SEQ ID NO: 1570020 - protein, 8 aa, Staphylococcus aureus
DHRSSNKQ

SEQ ID NO: 1570021 - protein, 15 aa, Staphylococcus aureus
DHVDKKGGTSANDQY

SEQ ID NO: 1570022 - protein, 16 aa, Staphylococcus aureus
DHVDKKSDTSANDQYH

SEQ ID NO: 1570023 - protein, 16 aa, Staphylococcus aureus
DHVDKKSDTSENDQYH

SEQ ID NO: 1570024 - protein, 9 aa, Staphylococcus aureus
DHYIETQEK

SEQ ID NO: 1570025 - protein, 15 aa, Staphylococcus aureus
DIANKQRDKDELQSN

SEQ ID NO: 1570026 - protein, 8 aa, Staphylococcus aureus
DIEQSQAD

SEQ ID NO: 1570027 - protein, 4 aa, Staphylococcus aureus
DIGR

SEQ ID NO: 1570028 - protein, 9 aa, Staphylococcus aureus
DIKDKKNVD

SEQ ID NO: 1570029 - protein, 59 aa, Staphylococcus aureus
DIKTKDDDTSQNNTSEPLNVQTGQENKVSATDTAENSSTATNPKDASDKADVIEPESDM

SEQ ID NO: 1570030 - protein, 38 aa, Staphylococcus aureus
DINGTTITNKYTPGETSATVTKNWDDNNNQDGKRPTEI

SEQ ID NO: 1570031 - protein, 8 aa, Staphylococcus aureus
DIPSSPVL

SEQ ID NO: 1570032 - protein, 19 aa, Staphylococcus aureus
DIPTPRPEKTLTLGKGNGL

SEQ ID NO: 1570033 - protein, 20 aa, Staphylococcus aureus
DISEERNSSEVKDKKRARIN

SEQ ID NO: 1570034 - protein, 15 aa, Staphylococcus aureus
DISEERNSSEVKKEQ

SEQ ID NO: 1570035 - protein, 10 aa, Staphylococcus aureus
DISNLSNEEI

SEQ ID NO: 1570036 - protein, 7 aa, Staphylococcus aureus
DISTDEI

SEQ ID NO: 1570037 - protein, 8 aa, Staphylococcus aureus
DISTDEIN

SEQ ID NO: 1570038 - protein, 27 aa, Staphylococcus aureus
DISTKRSPKLKLRGSGDLKGSSVGSKE

SEQ ID NO: 1570039 - protein, 9 aa, Staphylococcus aureus
DITKSKQLT

SEQ ID NO: 1570040 - protein, 21 aa, Staphylococcus aureus
DIVGDKNAINRKGQMPPSSNA

SEQ ID NO: 1570041 - protein, 94 aa, Staphylococcus aureus
DKATTDKQQVTPTKEAAHHYGEEAATNVSASAQGTVDDINNKVTSNAPSNKPSTAVSATVNETRDVDTQQASTQKPTRTATYKLSNAKTASLSP

SEQ ID NO: 1570042 - protein, 8 aa, Staphylococcus aureus
DKDGEEVN

SEQ ID NO: 1570043 - protein, 10 aa, Staphylococcus aureus
DKDINKNEGK

SEQ ID NO: 1570044 - protein, 19 aa, Staphylococcus aureus
DKDNDGSTEKGSFDITSDQ

SEQ ID NO: 1570045 - protein, 14 aa, Staphylococcus aureus
DKDTTSQIDSPKSN

SEQ ID NO: 1570046 - protein, 17 aa, Staphylococcus aureus
DKEGYRDDQFDKNDKGT

SEQ ID NO: 1570047 - protein, 17 aa, Staphylococcus aureus
DKEGYRDGEFKKDDKGT

SEQ ID NO: 1570048 - protein, 17 aa, Staphylococcus aureus
DKEGYRDGKFKKGDKGT

SEQ ID NO: 1570049 - protein, 20 aa, Staphylococcus aureus
DKEIQRGPVNHEAPSHENHV

SEQ ID NO: 1570050 - protein, 14 aa, Staphylococcus aureus
DKEKIRHNHKTSLK

SEQ ID NO: 1570051 - protein, 6 aa, Staphylococcus aureus
DKEYPF

SEQ ID NO: 1570052 - protein, 11 aa, Staphylococcus aureus
DKFDKKGYEVN

SEQ ID NO: 1570053 - protein, 6 aa, Staphylococcus aureus
DKFETP

SEQ ID NO: 1570054 - protein, 7 aa, Staphylococcus aureus
DKHIDDN

SEQ ID NO: 1570055 - protein, 31 aa, Staphylococcus aureus
DKHKQNADSSETVGYQSQSSVSHRSTEKRNM

SEQ ID NO: 1570056 - protein, 17 aa, Staphylococcus aureus
DKIEDEKNKKKNAKNIR

SEQ ID NO: 1570057 - protein, 6 aa, Staphylococcus aureus
DKIGKP

SEQ ID NO: 1570058 - protein, 5 aa, Staphylococcus aureus
DKINQ

SEQ ID NO: 1570059 - protein, 8 aa, Staphylococcus aureus
DKKDKKLD

SEQ ID NO: 1570060 - protein, 15 aa, Staphylococcus aureus
DKKGYSRSKEKEYPV

SEQ ID NO: 1570061 - protein, 10 aa, Staphylococcus aureus
DKKIPTGNEY

SEQ ID NO: 1570062 - protein, 8 aa, Staphylococcus aureus
DKKTSDFV

SEQ ID NO: 1570063 - protein, 9 aa, Staphylococcus aureus
DKKVFSSGK

SEQ ID NO: 1570064 - protein, 7 aa, Staphylococcus aureus
DKNEVVA

SEQ ID NO: 1570065 - protein, 12 aa, Staphylococcus aureus
DKNNHNGKAAKL

SEQ ID NO: 1570066 - protein, 8 aa, Staphylococcus aureus
DKPSGKRI

SEQ ID NO: 1570067 - protein, 11 aa, Staphylococcus aureus
DKQERANYEKL

SEQ ID NO: 1570068 - protein, 8 aa, Staphylococcus aureus
DKQNINGK

SEQ ID NO: 1570069 - protein, 9 aa, Staphylococcus aureus
DKQWQDAKK

SEQ ID NO: 1570070 - protein, 19 aa, Staphylococcus aureus
DKSISNYRINQDTDVSYGG

SEQ ID NO: 1570071 - protein, 7 aa, Staphylococcus aureus
DKSLGEG

SEQ ID NO: 1570072 - protein, 10 aa, Staphylococcus aureus
DKSLTQENLA

SEQ ID NO: 1570073 - protein, 6 aa, Staphylococcus aureus
DKSPRF

SEQ ID NO: 1570074 - protein, 7 aa, Staphylococcus aureus
DKVSEYK

SEQ ID NO: 1570075 - protein, 4 aa, Staphylococcus aureus
DKYE

SEQ ID NO: 1570076 - protein, 14 aa, Staphylococcus aureus
DKYIPSTDLKRGQA

SEQ ID NO: 1570077 - protein, 5 aa, Staphylococcus aureus
DKYNA

SEQ ID NO: 1570078 - protein, 8 aa, Staphylococcus aureus
DKYTYAGA

SEQ ID NO: 1570079 - protein, 7 aa, Staphylococcus aureus
DLASNDE

SEQ ID NO: 1570080 - protein, 8 aa, Staphylococcus aureus
DLDNGNYT

SEQ ID NO: 1570081 - protein, 13 aa, Staphylococcus aureus
DLETKGKIDYPDV

SEQ ID NO: 1570082 - protein, 8 aa, Staphylococcus aureus
DLNQQRQQ

SEQ ID NO: 1570083 - protein, 15 aa, Staphylococcus aureus
DLNRQMAKNDKENDL

SEQ ID NO: 1570084 - protein, 14 aa, Staphylococcus aureus
DLQEANTKQTSIQK

SEQ ID NO: 1570085 - protein, 8 aa, Staphylococcus aureus
DLQPKGTF

SEQ ID NO: 1570086 - protein, 4 aa, Staphylococcus aureus
DLSY

SEQ ID NO: 1570087 - protein, 4 aa, Staphylococcus aureus
DMPG

SEQ ID NO: 1570088 - protein, 8 aa, Staphylococcus aureus
DMSGNTHF

SEQ ID NO: 1570089 - protein, 6 aa, Staphylococcus aureus
DNGYVK

SEQ ID NO: 1570090 - protein, 6 aa, Staphylococcus aureus
DNHSNK

SEQ ID NO: 1570091 - protein, 5 aa, Staphylococcus aureus
DNKDI

SEQ ID NO: 1570092 - protein, 12 aa, Staphylococcus aureus
DNKKARERAREE

SEQ ID NO: 1570093 - protein, 9 aa, Staphylococcus aureus
DNKNDVKAT

SEQ ID NO: 1570094 - protein, 6 aa, Staphylococcus aureus
DNKTFT

SEQ ID NO: 1570095 - protein, 4 aa, Staphylococcus aureus
DNKY

SEQ ID NO: 1570096 - protein, 14 aa, Staphylococcus aureus
DNLENEKREDNPKL

SEQ ID NO: 1570097 - protein, 10 aa, Staphylococcus aureus
DNMSQYAEDV

SEQ ID NO: 1570098 - protein, 18 aa, Staphylococcus aureus
DNNGLADQSSLKKGDVIT

SEQ ID NO: 1570099 - protein, 18 aa, Staphylococcus aureus
DNNGLADRSGLKKGDVIT

SEQ ID NO: 1570100 - protein, 24 aa, Staphylococcus aureus
DNNPDNDINTPSLSKIDDDRKLDE

SEQ ID NO: 1570101 - protein, 6 aa, Staphylococcus aureus
DNPEEA

SEQ ID NO: 1570102 - protein, 59 aa, Staphylococcus aureus
DNQTESNHDEDHDITSESVESAESVKHTLQSDDLTNDSNEDEKQSLKEPATYKEDRRSS

SEQ ID NO: 1570103 - protein, 75 aa, Staphylococcus aureus
DNSALRTAKTKLDEEINKSVTTDGMTQSSIQAYENAKRAGQTESTNAQNVINNGDATDQQIAAEKTKVEEKYNSL

SEQ ID NO: 1570104 - protein, 75 aa, Staphylococcus aureus
DNSALRTAKTKLDEEINKSVTTDGMTQSSIQAYENAKRAGQTESTNAQNVINNGDATDQQIAEEKTKVEEKYNSL

SEQ ID NO: 1570105 - protein, 75 aa, Staphylococcus aureus
DNSALRTAKTKLDEEINKSVTTDGMTQSSIQAYENAKRAGQTETTNAQNVINNGDATDQQIAAEKTKVEEKYNSL

SEQ ID NO: 1570106 - protein, 9 aa, Staphylococcus aureus
DNSTPSTNY

SEQ ID NO: 1570107 - protein, 7 aa, Staphylococcus aureus
DNTNGVT

SEQ ID NO: 1570108 - protein, 7 aa, Staphylococcus aureus
DNTTNHL

SEQ ID NO: 1570109 - protein, 5 aa, Staphylococcus aureus
DNVGE

SEQ ID NO: 1570110 - protein, 13 aa, Staphylococcus aureus
DNVKSGLDYTTQY

SEQ ID NO: 1570111 - protein, 8 aa, Staphylococcus aureus
DPAKDGGF

SEQ ID NO: 1570112 - protein, 5 aa, Staphylococcus aureus
DPATR

SEQ ID NO: 1570113 - protein, 51 aa, Staphylococcus aureus
DPTMEPGSPDKVAQKGENGEKTTTTPTTINPLTGEKVGEGEPTTEVTKEPI

SEQ ID NO: 1570114 - protein, 14 aa, Staphylococcus aureus
DPTRLESEVKEPNK

SEQ ID NO: 1570115 - protein, 6 aa, Staphylococcus aureus
DPTTGV

SEQ ID NO: 1570116 - protein, 29 aa, Staphylococcus aureus
DQATQAVNDAKNNLHGDQKLAQDKQHAVT

SEQ ID NO: 1570117 - protein, 5 aa, Staphylococcus aureus
DQEVQ

SEQ ID NO: 1570118 - protein, 6 aa, Staphylococcus aureus
DQGLGD

SEQ ID NO: 1570119 - protein, 9 aa, Staphylococcus aureus
DQIQGGQQL

SEQ ID NO: 1570120 - protein, 18 aa, Staphylococcus aureus
DQITNEKHANKDKINIKN

SEQ ID NO: 1570121 - protein, 4 aa, Staphylococcus aureus
DQNQ

SEQ ID NO: 1570122 - protein, 16 aa, Staphylococcus aureus
DQNQSVRTVANAQTPF

SEQ ID NO: 1570123 - protein, 15 aa, Staphylococcus aureus
DQPAVNEISEATPEQ

SEQ ID NO: 1570124 - protein, 7 aa, Staphylococcus aureus
DQPTIYN

SEQ ID NO: 1570125 - protein, 4 aa, Staphylococcus aureus
DQQS

SEQ ID NO: 1570126 - protein, 7 aa, Staphylococcus aureus
DQRKYRK

SEQ ID NO: 1570127 - protein, 4 aa, Staphylococcus aureus
DQTG

SEQ ID NO: 1570128 - protein, 16 aa, Staphylococcus aureus
DRAKEEGYKVNTKPAV

SEQ ID NO: 1570129 - protein, 4 aa, Staphylococcus aureus
DRFG

SEQ ID NO: 1570130 - protein, 5 aa, Staphylococcus aureus
DRFGR

SEQ ID NO: 1570131 - protein, 21 aa, Staphylococcus aureus
DRFTERHNQRIREKRGKVYAD

SEQ ID NO: 1570132 - protein, 14 aa, Staphylococcus aureus
DRHSGIKNTTITTL

SEQ ID NO: 1570133 - protein, 40 aa, Staphylococcus aureus
DRIPHNHNDSEKMDYKSYAADKAKANKEAHKAKQKNGKLN

SEQ ID NO: 1570134 - protein, 8 aa, Staphylococcus aureus
DRLENSEA

SEQ ID NO: 1570135 - protein, 5 aa, Staphylococcus aureus
DRNTT

SEQ ID NO: 1570136 - protein, 7 aa, Staphylococcus aureus
DRPSIGG

SEQ ID NO: 1570137 - protein, 6 aa, Staphylococcus aureus
DRSAYE

SEQ ID NO: 1570138 - protein, 4 aa, Staphylococcus aureus
DSAD

SEQ ID NO: 1570139 - protein, 178 aa, Staphylococcus aureus
DSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1570140 - protein, 79 aa, Staphylococcus aureus
DSDSDSDSDSDSDSDSDSDSDSDSDSDSDSDSRVTPPNNEQKAPSNPKGEVNHSNKVSKQHKTDALPETGDKSENTNAT

SEQ ID NO: 1570141 - protein, 57 aa, Staphylococcus aureus
DSDSDSDSDSRVTPPNNEQKAPSNPKGEVNHSNKASKQHQTDALPETGDKSENTNAT

SEQ ID NO: 1570142 - protein, 53 aa, Staphylococcus aureus
DSDSDSRVTPPNNEQKAPSNPKGEVNHSNKVSKQHKTDALPETGDKSENTNAT

SEQ ID NO: 1570143 - protein, 96 aa, Staphylococcus aureus
DSESDSDSDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1570144 - protein, 8 aa, Staphylococcus aureus
DSETTRTA

SEQ ID NO: 1570145 - protein, 9 aa, Staphylococcus aureus
DSIGYDDKT

SEQ ID NO: 1570146 - protein, 197 aa, Staphylococcus aureus
DSISTSGSLSASDSKSMSVSSSMSTSQSGSTSESLSDSQSTSDSDSKSLSLSTSQSGSTSTSTSTSASVRTSESQSTSGSMSASQSDSMSISTSFSDSTSDSKSASTASSESISQSASTSTSGSVSTSTSLSTSNSERTSTSMSDSTSLSTSESDSISESMSTSDSISEAISASESTSISLSESNSTSDSESQSASA

SEQ ID NO: 1570147 - protein, 198 aa, Staphylococcus aureus
DSISTSGSLSASDSKSMSVSSSMSTSQSGSTSESLSDSQSTSDSDSKSLSLSTSQSGSTSTSTSTSSSVRTSESQSTSGSMSTSQSDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAF

SEQ ID NO: 1570148 - protein, 7 aa, Staphylococcus aureus
DSKGNII

SEQ ID NO: 1570149 - protein, 5 aa, Staphylococcus aureus
DSKLK

SEQ ID NO: 1570150 - protein, 26 aa, Staphylococcus aureus
DSKSKSGHKQQLKDLPKTGVNNESNT

SEQ ID NO: 1570151 - protein, 14 aa, Staphylococcus aureus
DSLENEKREDNPEL

SEQ ID NO: 1570152 - protein, 5 aa, Staphylococcus aureus
DSLGQ

SEQ ID NO: 1570153 - protein, 36 aa, Staphylococcus aureus
DSMSTSGSLAASDSKSMSVSSSMSTSQSGSTSESLS

SEQ ID NO: 1570154 - protein, 198 aa, Staphylococcus aureus
DSMSTSGSLAASDSKSMSVSSSMSTSQSGSTSESLSDSISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAF

SEQ ID NO: 1570155 - protein, 188 aa, Staphylococcus aureus
DSMSTSGSLAASDSKSMSVSSSMSTSQSGSTSESLSDSQSTSDSDSKSLSLSTSQSGSTSTSTSTSSSVRMSESQSTSGSMSTSQSDSTSDSKSASTASSESISQSVSTSTSDSMSTSTSLSTSNSERTSTSLSDSTSLSTSESDSTSDSTSTSDSISEAISGSESTSISLSESNSTSDSESKSASAF

SEQ ID NO: 1570156 - protein, 204 aa, Staphylococcus aureus
DSMSTSGSLAASDSKSMSVSSSMSTSQSGSTSESLSDSQSTSDSDSKSLSLSTSQSGSTSTSTSTSSSVRMSESQSTSGSMSTSQSDSTSISTSFSDSTSDSKSASTASSESISQSVSTSTSDSMSTSTSLSTSNSERTSTSLSDSTSGSKSNSLSASMSTSDSISTRKSESLSASTSLSGSTSESESGSTSSSESKSDSTSMS

SEQ ID NO: 1570157 - protein, 12 aa, Staphylococcus aureus
DSNIKEAGKSMG

SEQ ID NO: 1570158 - protein, 5 aa, Staphylococcus aureus
DSNKI

SEQ ID NO: 1570159 - protein, 10 aa, Staphylococcus aureus
DSNVKTHQTL

SEQ ID NO: 1570160 - protein, 30 aa, Staphylococcus aureus
DSQQVNAATEATNAPNNQSTQVSQATSQPI

SEQ ID NO: 1570161 - protein, 8 aa, Staphylococcus aureus
DSSRFRRH

SEQ ID NO: 1570162 - protein, 4 aa, Staphylococcus aureus
DSST

SEQ ID NO: 1570163 - protein, 7 aa, Staphylococcus aureus
DSTISNI

SEQ ID NO: 1570164 - protein, 10 aa, Staphylococcus aureus
DTATKVGIKA

SEQ ID NO: 1570165 - protein, 8 aa, Staphylococcus aureus
DTENQKDD

SEQ ID NO: 1570166 - protein, 10 aa, Staphylococcus aureus
DTIKPQKNSA

SEQ ID NO: 1570167 - protein, 10 aa, Staphylococcus aureus
DTLNKEGGKF

SEQ ID NO: 1570168 - protein, 115 aa, Staphylococcus aureus
DTLPKVSGQNEGQQTIEEDTTPPTPPTPPTPEVPSEPETPTPPTPEVPSEPETPTPPTPEVPSEPETPTPPTPEVPSEPETPTPPTPEVPAEPGKPVPPAKEEPKKPSKPVEQGK

SEQ ID NO: 1570169 - protein, 15 aa, Staphylococcus aureus
DTNKDGKQDANEKGI

SEQ ID NO: 1570170 - protein, 16 aa, Staphylococcus aureus
DTQIAKDTNKGVDNSV

SEQ ID NO: 1570171 - protein, 18 aa, Staphylococcus aureus
DTQTSTTGMTQDSINAYN

SEQ ID NO: 1570172 - protein, 8 aa, Staphylococcus aureus
DTRGMTKT

SEQ ID NO: 1570173 - protein, 10 aa, Staphylococcus aureus
DTSKLKDVTN

SEQ ID NO: 1570174 - protein, 18 aa, Staphylococcus aureus
DVDYNSKKTYGKYYNPTE

SEQ ID NO: 1570175 - protein, 5 aa, Staphylococcus aureus
DVEDN

SEQ ID NO: 1570176 - protein, 4 aa, Staphylococcus aureus
DVEK

SEQ ID NO: 1570177 - protein, 7 aa, Staphylococcus aureus
DVGSKKV

SEQ ID NO: 1570178 - protein, 19 aa, Staphylococcus aureus
DVLKSGKLKEVHTKEEIGC

SEQ ID NO: 1570179 - protein, 6 aa, Staphylococcus aureus
DVNTNT

SEQ ID NO: 1570180 - protein, 25 aa, Staphylococcus aureus
DVSETETVNTDNKDTVKQKEAKFEN

SEQ ID NO: 1570181 - protein, 8 aa, Staphylococcus aureus
DVSPNDES

SEQ ID NO: 1570182 - protein, 17 aa, Staphylococcus aureus
DVSTTVNGEVDPVDAET

SEQ ID NO: 1570183 - protein, 18 aa, Staphylococcus aureus
DVSTTVNGEVDPVDAETA

SEQ ID NO: 1570184 - protein, 7 aa, Staphylococcus aureus
DYKEGRL

SEQ ID NO: 1570185 - protein, 13 aa, Staphylococcus aureus
DYKNLDGEKQRNM

SEQ ID NO: 1570186 - protein, 17 aa, Staphylococcus aureus
DYNKAKVYGSKTFGKGV

SEQ ID NO: 1570187 - protein, 6 aa, Staphylococcus aureus
DYNRYH

SEQ ID NO: 1570188 - protein, 6 aa, Staphylococcus aureus
DYQEIR

SEQ ID NO: 1570189 - protein, 12 aa, Staphylococcus aureus
DYQEIRKHTKAK

SEQ ID NO: 1570190 - protein, 44 aa, Staphylococcus aureus
DYTSRDFENKDTALKQSTSENSSLSKLEDVQAKDGDNSKNKGPV

SEQ ID NO: 1570191 - protein, 45 aa, Staphylococcus aureus
DYTSRNFENKDTALKQSTSENSSLSKVEDVQVKDGDNSKNKGPVY

SEQ ID NO: 1570192 - protein, 8 aa, Staphylococcus aureus
EAATQAGG

SEQ ID NO: 1570193 - protein, 14 aa, Staphylococcus aureus
EAGEEVSSETLKNI

SEQ ID NO: 1570194 - protein, 6 aa, Staphylococcus aureus
EANEEM

SEQ ID NO: 1570195 - protein, 7 aa, Staphylococcus aureus
EANEEME

SEQ ID NO: 1570196 - protein, 6 aa, Staphylococcus aureus
EARILK

SEQ ID NO: 1570197 - protein, 15 aa, Staphylococcus aureus
EARPTIGQTDEDEKS

SEQ ID NO: 1570198 - protein, 8 aa, Staphylococcus aureus
EASAANVT

SEQ ID NO: 1570199 - protein, 12 aa, Staphylococcus aureus
EASMDKKIAQNQ

SEQ ID NO: 1570200 - protein, 5 aa, Staphylococcus aureus
EAVTK

SEQ ID NO: 1570201 - protein, 5 aa, Staphylococcus aureus
EAVTS

SEQ ID NO: 1570202 - protein, 4 aa, Staphylococcus aureus
EAVV

SEQ ID NO: 1570203 - protein, 12 aa, Staphylococcus aureus
EDAEKEVKKHKL

SEQ ID NO: 1570204 - protein, 55 aa, Staphylococcus aureus
EDAKNAIKALANAKRDQINSNPDLTPEQKAKALKEIDEAEKRALQNVENAQTIDQ

SEQ ID NO: 1570205 - protein, 9 aa, Staphylococcus aureus
EDENKEYEE

SEQ ID NO: 1570206 - protein, 10 aa, Staphylococcus aureus
EDGLNAGAKN

SEQ ID NO: 1570207 - protein, 11 aa, Staphylococcus aureus
EDGSKKKMSTT

SEQ ID NO: 1570208 - protein, 4 aa, Staphylococcus aureus
EDKN

SEQ ID NO: 1570209 - protein, 8 aa, Staphylococcus aureus
EDKRGTYS

SEQ ID NO: 1570210 - protein, 6 aa, Staphylococcus aureus
EDLKTQ

SEQ ID NO: 1570211 - protein, 14 aa, Staphylococcus aureus
EDLQKELGAKYAPT

SEQ ID NO: 1570212 - protein, 32 aa, Staphylococcus aureus
EDNSEGNAVKSNVRKLEDAKVNDDQKDTLSQL

SEQ ID NO: 1570213 - protein, 4 aa, Staphylococcus aureus
EDPD

SEQ ID NO: 1570214 - protein, 8 aa, Staphylococcus aureus
EDPKLKNK

SEQ ID NO: 1570215 - protein, 7 aa, Staphylococcus aureus
EDPNLKK

SEQ ID NO: 1570216 - protein, 42 aa, Staphylococcus aureus
EDREENLNQHQDKQNIDNTTLKKAEKQIHKDSIDKHERFKNS

SEQ ID NO: 1570217 - protein, 17 aa, Staphylococcus aureus
EDSEGKVYSDERKYPVK

SEQ ID NO: 1570218 - protein, 7 aa, Staphylococcus aureus
EDTNLKK

SEQ ID NO: 1570219 - protein, 9 aa, Staphylococcus aureus
EDTSATSEL

SEQ ID NO: 1570220 - protein, 4 aa, Staphylococcus aureus
EDTY

SEQ ID NO: 1570221 - protein, 4 aa, Staphylococcus aureus
EDVK

SEQ ID NO: 1570222 - protein, 7 aa, Staphylococcus aureus
EDVKPGD

SEQ ID NO: 1570223 - protein, 14 aa, Staphylococcus aureus
EDYYATGGHKSANR

SEQ ID NO: 1570224 - protein, 11 aa, Staphylococcus aureus
EEAQSSKAPIQ

SEQ ID NO: 1570225 - protein, 6 aa, Staphylococcus aureus
EEATDR

SEQ ID NO: 1570226 - protein, 8 aa, Staphylococcus aureus
EEDLASAN

SEQ ID NO: 1570227 - protein, 9 aa, Staphylococcus aureus
EEDLASANS

SEQ ID NO: 1570228 - protein, 14 aa, Staphylococcus aureus
EEDLKKNKNALSDK

SEQ ID NO: 1570229 - protein, 4 aa, Staphylococcus aureus
EEGD

SEQ ID NO: 1570230 - protein, 5 aa, Staphylococcus aureus
EEIAN

SEQ ID NO: 1570231 - protein, 11 aa, Staphylococcus aureus
EEKRNRETRKK

SEQ ID NO: 1570232 - protein, 6 aa, Staphylococcus aureus
EENSHV

SEQ ID NO: 1570233 - protein, 4 aa, Staphylococcus aureus
EENV

SEQ ID NO: 1570234 - protein, 6 aa, Staphylococcus aureus
EEPNYS

SEQ ID NO: 1570235 - protein, 12 aa, Staphylococcus aureus
EEQGARKDFEKD

SEQ ID NO: 1570236 - protein, 30 aa, Staphylococcus aureus
EEQGATKDYDKDIKKAIDDVKQTKKDEFAK

SEQ ID NO: 1570237 - protein, 9 aa, Staphylococcus aureus
EEQKENPLD

SEQ ID NO: 1570238 - protein, 9 aa, Staphylococcus aureus
EESEKLSEE

SEQ ID NO: 1570239 - protein, 10 aa, Staphylococcus aureus
EESNNDEDLR

SEQ ID NO: 1570240 - protein, 44 aa, Staphylococcus aureus
EETQPYNATVTEQPSNATQVTTEEAPKAAVQAPQTAQPANVETV

SEQ ID NO: 1570241 - protein, 43 aa, Staphylococcus aureus
EETQSYNATVTEQPSNATQVTTEEAPKAVQAPQTAQPANVEKV

SEQ ID NO: 1570242 - protein, 64 aa, Staphylococcus aureus
EEVPQGHKDEFDPNLPIDGTEEVPGKPGIKNPETGEVVTPPVDDVTKHGPKAGEPEVTKEEIPF

SEQ ID NO: 1570243 - protein, 27 aa, Staphylococcus aureus
EEVVKEEAKPQVKETTQSQDNSGDQRQ

SEQ ID NO: 1570244 - protein, 5 aa, Staphylococcus aureus
EEYQE

SEQ ID NO: 1570245 - protein, 8 aa, Staphylococcus aureus
EFGEVTDE

SEQ ID NO: 1570246 - protein, 7 aa, Staphylococcus aureus
EFPEEQL

SEQ ID NO: 1570247 - protein, 4 aa, Staphylococcus aureus
EGEQ

SEQ ID NO: 1570248 - protein, 5 aa, Staphylococcus aureus
EGGNS

SEQ ID NO: 1570249 - protein, 7 aa, Staphylococcus aureus
EGIHNPR

SEQ ID NO: 1570250 - protein, 23 aa, Staphylococcus aureus
EGKRYRKKGFRTKREANSAGLDK

SEQ ID NO: 1570251 - protein, 8 aa, Staphylococcus aureus
EGLGPSIG

SEQ ID NO: 1570252 - protein, 19 aa, Staphylococcus aureus
EGQGRLRANREGNVKNPHH

SEQ ID NO: 1570253 - protein, 13 aa, Staphylococcus aureus
EGQGRQRSNIHGE

SEQ ID NO: 1570254 - protein, 23 aa, Staphylococcus aureus
EGQGRQRSNVHGEVKTPKNWGTS

SEQ ID NO: 1570255 - protein, 16 aa, Staphylococcus aureus
EGYKNSDNSIKISSDE

SEQ ID NO: 1570256 - protein, 5 aa, Staphylococcus aureus
EGYNE

SEQ ID NO: 1570257 - protein, 30 aa, Staphylococcus aureus
EHKRNHNELRESHKELKDKQDKVVDENLEQ

SEQ ID NO: 1570258 - protein, 4 aa, Staphylococcus aureus
EHYK

SEQ ID NO: 1570259 - protein, 4 aa, Staphylococcus aureus
EIDK

SEQ ID NO: 1570260 - protein, 10 aa, Staphylococcus aureus
EIEKTPDIAS

SEQ ID NO: 1570261 - protein, 27 aa, Staphylococcus aureus
EIESPEAGEDHHYDESGEEIKASNKSF

SEQ ID NO: 1570262 - protein, 13 aa, Staphylococcus aureus
EIFTGGPKNNPAN

SEQ ID NO: 1570263 - protein, 11 aa, Staphylococcus aureus
EIGGSKDVIEE

SEQ ID NO: 1570264 - protein, 6 aa, Staphylococcus aureus
EIIPKS

SEQ ID NO: 1570265 - protein, 12 aa, Staphylococcus aureus
EIKNPEKKYRKR

SEQ ID NO: 1570266 - protein, 9 aa, Staphylococcus aureus
EISTKEAPK

SEQ ID NO: 1570267 - protein, 8 aa, Staphylococcus aureus
EITNTKDL

SEQ ID NO: 1570268 - protein, 8 aa, Staphylococcus aureus
EITQSQAD

SEQ ID NO: 1570269 - protein, 17 aa, Staphylococcus aureus
EITVDKDGKPSRMNQPY

SEQ ID NO: 1570270 - protein, 9 aa, Staphylococcus aureus
EKDAKDRLN

SEQ ID NO: 1570271 - protein, 13 aa, Staphylococcus aureus
EKDHKNELKPKDI

SEQ ID NO: 1570272 - protein, 7 aa, Staphylococcus aureus
EKDVQAR

SEQ ID NO: 1570273 - protein, 10 aa, Staphylococcus aureus
EKEEEQTDGD

SEQ ID NO: 1570274 - protein, 24 aa, Staphylococcus aureus
EKEENDVEPYGEKEVRKSNVQKFE

SEQ ID NO: 1570275 - protein, 8 aa, Staphylococcus aureus
EKELQKIT

SEQ ID NO: 1570276 - protein, 7 aa, Staphylococcus aureus
EKENLYS

SEQ ID NO: 1570277 - protein, 6 aa, Staphylococcus aureus
EKGAFD

SEQ ID NO: 1570278 - protein, 7 aa, Staphylococcus aureus
EKGMGST

SEQ ID NO: 1570279 - protein, 13 aa, Staphylococcus aureus
EKGNNLSGGERQR

SEQ ID NO: 1570280 - protein, 19 aa, Staphylococcus aureus
EKGNNLSGGERQRISSPGQ

SEQ ID NO: 1570281 - protein, 8 aa, Staphylococcus aureus
EKITQGHK

SEQ ID NO: 1570282 - protein, 7 aa, Staphylococcus aureus
EKKISKQ

SEQ ID NO: 1570283 - protein, 7 aa, Staphylococcus aureus
EKKKLQR

SEQ ID NO: 1570284 - protein, 9 aa, Staphylococcus aureus
EKKYYDEQK

SEQ ID NO: 1570285 - protein, 7 aa, Staphylococcus aureus
EKMKDNS

SEQ ID NO: 1570286 - protein, 18 aa, Staphylococcus aureus
EKNRPKGFNSKVKSINDL

SEQ ID NO: 1570287 - protein, 7 aa, Staphylococcus aureus
EKPLIPA

SEQ ID NO: 1570288 - protein, 4 aa, Staphylococcus aureus
EKRG

SEQ ID NO: 1570289 - protein, 16 aa, Staphylococcus aureus
EKRQSRRNIEKKITNK

SEQ ID NO: 1570290 - protein, 13 aa, Staphylococcus aureus
EKRQSRRNIGKKD

SEQ ID NO: 1570291 - protein, 21 aa, Staphylococcus aureus
EKTDAVSNSAYLDKAKNLDQE

SEQ ID NO: 1570292 - protein, 12 aa, Staphylococcus aureus
EKTGTESKKESY

SEQ ID NO: 1570293 - protein, 13 aa, Staphylococcus aureus
EKTVAKSKFDTKG

SEQ ID NO: 1570294 - protein, 9 aa, Staphylococcus aureus
EKVADTKGQ

SEQ ID NO: 1570295 - protein, 10 aa, Staphylococcus aureus
EKYFSPNGKY

SEQ ID NO: 1570296 - protein, 17 aa, Staphylococcus aureus
EKYNNGEFSYNPEAPIY

SEQ ID NO: 1570297 - protein, 7 aa, Staphylococcus aureus
EKYPNKK

SEQ ID NO: 1570298 - protein, 8 aa, Staphylococcus aureus
ELANETAD

SEQ ID NO: 1570299 - protein, 8 aa, Staphylococcus aureus
ELEEANQK

SEQ ID NO: 1570300 - protein, 11 aa, Staphylococcus aureus
ELGGAATTFSD

SEQ ID NO: 1570301 - protein, 12 aa, Staphylococcus aureus
ELGGAATTFSDT

SEQ ID NO: 1570302 - protein, 16 aa, Staphylococcus aureus
ELGTDNVECMKGVPED

SEQ ID NO: 1570303 - protein, 31 aa, Staphylococcus aureus
ELGYEGGQNNGNQSFEEDTEEDKPKYEQGGN

SEQ ID NO: 1570304 - protein, 31 aa, Staphylococcus aureus
ELGYEGGQNSGDQSFEEDTEEDKPKYEQGGN

SEQ ID NO: 1570305 - protein, 30 aa, Staphylococcus aureus
ELGYEGGQNSGNQSFEEDTEEDKPKYEHGG

SEQ ID NO: 1570306 - protein, 9 aa, Staphylococcus aureus
ELKAGQNIR

SEQ ID NO: 1570307 - protein, 19 aa, Staphylococcus aureus
ELKAGQTIRVENGETIPAD

SEQ ID NO: 1570308 - protein, 51 aa, Staphylococcus aureus
ELKTEVAQKSSTEKNDNCNHDIEGNVEDIAEGRLDEVQNTDSMLNQKNKRI

SEQ ID NO: 1570309 - protein, 11 aa, Staphylococcus aureus
ELKTYNSAGSD

SEQ ID NO: 1570310 - protein, 4 aa, Staphylococcus aureus
ELLP

SEQ ID NO: 1570311 - protein, 10 aa, Staphylococcus aureus
ELPTSDLYDG

SEQ ID NO: 1570312 - protein, 10 aa, Staphylococcus aureus
ELSYHKKKEY

SEQ ID NO: 1570313 - protein, 12 aa, Staphylococcus aureus
ELTETPRTASFG

SEQ ID NO: 1570314 - protein, 6 aa, Staphylococcus aureus
ELTTDE

SEQ ID NO: 1570315 - protein, 20 aa, Staphylococcus aureus
EMEPDAPVDKSEMKSEDALY

SEQ ID NO: 1570316 - protein, 5 aa, Staphylococcus aureus
EMKDD

SEQ ID NO: 1570317 - protein, 12 aa, Staphylococcus aureus
EMPTSDLYDGSG

SEQ ID NO: 1570318 - protein, 8 aa, Staphylococcus aureus
EMSTKDTT

SEQ ID NO: 1570319 - protein, 4 aa, Staphylococcus aureus
ENAI

SEQ ID NO: 1570320 - protein, 9 aa, Staphylococcus aureus
ENGETIPAD

SEQ ID NO: 1570321 - protein, 27 aa, Staphylococcus aureus
ENGKQVDKEYELEQGPQDRLQLIKTSE

SEQ ID NO: 1570322 - protein, 13 aa, Staphylococcus aureus
ENGSDSDRTNSIL

SEQ ID NO: 1570323 - protein, 15 aa, Staphylococcus aureus
ENKKIEDDDNDSGGV

SEQ ID NO: 1570324 - protein, 12 aa, Staphylococcus aureus
ENKTARNRAREE

SEQ ID NO: 1570325 - protein, 33 aa, Staphylococcus aureus
ENPNKSNKVNRSEQVNKSNNHAENPKPKEGVGT

SEQ ID NO: 1570326 - protein, 62 aa, Staphylococcus aureus
ENQKNGNKRREQQESMNGNDVKSASVESNANDYSKQPQKASQQEHQVRETRQRKDIQRSPQV

SEQ ID NO: 1570327 - protein, 62 aa, Staphylococcus aureus
ENQKNGNKRREQQESVNGNDVKSASVESNANNYSKQPQKASQQEHQVRETRQRKDIQRSPQV

SEQ ID NO: 1570328 - protein, 7 aa, Staphylococcus aureus
ENSMDGY

SEQ ID NO: 1570329 - protein, 9 aa, Staphylococcus aureus
ENTVTEPKQ

SEQ ID NO: 1570330 - protein, 83 aa, Staphylococcus aureus
EPASTNETPQPTAIKDQATAAKMQDQTVPQEANSQVDNKTTNDANNIATNSELKNPQTLDLPQSSPQTISNAQGTSKPSVRTR

SEQ ID NO: 1570331 - protein, 12 aa, Staphylococcus aureus
EPGAGGAPPVTG

SEQ ID NO: 1570332 - protein, 9 aa, Staphylococcus aureus
EPGPGPAVT

SEQ ID NO: 1570333 - protein, 5 aa, Staphylococcus aureus
EPINT

SEQ ID NO: 1570334 - protein, 10 aa, Staphylococcus aureus
EPKGKDMETR

SEQ ID NO: 1570335 - protein, 11 aa, Staphylococcus aureus
EPKPKKKSTRK

SEQ ID NO: 1570336 - protein, 5 aa, Staphylococcus aureus
EPLNP

SEQ ID NO: 1570337 - protein, 5 aa, Staphylococcus aureus
EPMSQ

SEQ ID NO: 1570338 - protein, 15 aa, Staphylococcus aureus
EPQQFQSKKPKKEDQ

SEQ ID NO: 1570339 - protein, 19 aa, Staphylococcus aureus
EPRLRRRHTQQSGNEKRGT

SEQ ID NO: 1570340 - protein, 4 aa, Staphylococcus aureus
EPVT

SEQ ID NO: 1570341 - protein, 5 aa, Staphylococcus aureus
EPVTK

SEQ ID NO: 1570342 - protein, 7 aa, Staphylococcus aureus
EQEYSKD

SEQ ID NO: 1570343 - protein, 5 aa, Staphylococcus aureus
EQGYT

SEQ ID NO: 1570344 - protein, 8 aa, Staphylococcus aureus
EQIEYKDD

SEQ ID NO: 1570345 - protein, 10 aa, Staphylococcus aureus
EQKHQTVETI

SEQ ID NO: 1570346 - protein, 8 aa, Staphylococcus aureus
EQKRIKKA

SEQ ID NO: 1570347 - protein, 19 aa, Staphylococcus aureus
EQKRIKKAIASNELTQTQD

SEQ ID NO: 1570348 - protein, 14 aa, Staphylococcus aureus
EQKRIKKAIERNEL

SEQ ID NO: 1570349 - protein, 4 aa, Staphylococcus aureus
EQLK

SEQ ID NO: 1570350 - protein, 7 aa, Staphylococcus aureus
EQRTGIK

SEQ ID NO: 1570351 - protein, 10 aa, Staphylococcus aureus
EQSTLEKQKE

SEQ ID NO: 1570352 - protein, 11 aa, Staphylococcus aureus
EQTLQEQNEDL

SEQ ID NO: 1570353 - protein, 22 aa, Staphylococcus aureus
ERERERERQSRNNYDINEENRR

SEQ ID NO: 1570354 - protein, 10 aa, Staphylococcus aureus
ERKEASNVKN

SEQ ID NO: 1570355 - protein, 79 aa, Staphylococcus aureus
ERPKASGTLKVENSPPTIKKVENNHKEQPKHKDEKSKKEKKKVVEKEKALPAFNRDDDSKNSSQLSSDIKELDEPNHKK

SEQ ID NO: 1570356 - protein, 7 aa, Staphylococcus aureus
ERTSGTL

SEQ ID NO: 1570357 - protein, 29 aa, Staphylococcus aureus
ERTTDLEKTALTNSLSRKISNKELTIDEA

SEQ ID NO: 1570358 - protein, 18 aa, Staphylococcus aureus
ESEWGKGMNATKQKNPLS

SEQ ID NO: 1570359 - protein, 18 aa, Staphylococcus aureus
ESEWGKGPNATKQKNPLS

SEQ ID NO: 1570360 - protein, 18 aa, Staphylococcus aureus
ESEWGRGANATKQKNPLS

SEQ ID NO: 1570361 - protein, 6 aa, Staphylococcus aureus
ESFKDD

SEQ ID NO: 1570362 - protein, 19 aa, Staphylococcus aureus
ESGWGKGENATRQKNPLSV

SEQ ID NO: 1570363 - protein, 21 aa, Staphylococcus aureus
ESLDTNKKIEKHFNQDSEKAQ

SEQ ID NO: 1570364 - protein, 25 aa, Staphylococcus aureus
ESQIRDYESKSKKVKEKAKSYIKEY

SEQ ID NO: 1570365 - protein, 110 aa, Staphylococcus aureus
ESSRTDSDSSMQTEKIKKDSSDGNESSNLKSEVISDKSNTVPKLSESDDEVNNQKPLTLPEEQKLKRQQSQNEQTKTYTYGDSEQNDKSNHENDLSHHTPSKSDDKDNVM

SEQ ID NO: 1570366 - protein, 12 aa, Staphylococcus aureus
ESTHENSKHQAD

SEQ ID NO: 1570367 - protein, 19 aa, Staphylococcus aureus
ESTNKDEVGPLKKKINGTV

SEQ ID NO: 1570368 - protein, 112 aa, Staphylococcus aureus
ESVSESTSESGSTSESTSESDSTSTSLSDSQSTSRSTSASGSASTSTSTSDSRSTSASTSTSMRTSTLDSQSMSLSTSTSTSVSDSTSLSDSVSDSTSDSTSTSTSGSMSAS

SEQ ID NO: 1570369 - protein, 6 aa, Staphylococcus aureus
ETAKFE

SEQ ID NO: 1570370 - protein, 7 aa, Staphylococcus aureus
ETDKSGN

SEQ ID NO: 1570371 - protein, 6 aa, Staphylococcus aureus
ETGLQD

SEQ ID NO: 1570372 - protein, 8 aa, Staphylococcus aureus
ETKLSDNA

SEQ ID NO: 1570373 - protein, 9 aa, Staphylococcus aureus
ETKLSDNEK

SEQ ID NO: 1570374 - protein, 9 aa, Staphylococcus aureus
ETKRKSVIN

SEQ ID NO: 1570375 - protein, 4 aa, Staphylococcus aureus
ETKT

SEQ ID NO: 1570376 - protein, 27 aa, Staphylococcus aureus
ETPAGYTPTVKNTTAEDKDSNGLTTTG

SEQ ID NO: 1570377 - protein, 27 aa, Staphylococcus aureus
ETPTGYLPTKVNGTTDGEKDSNGSSVT

SEQ ID NO: 1570378 - protein, 5 aa, Staphylococcus aureus
ETQEK

SEQ ID NO: 1570379 - protein, 13 aa, Staphylococcus aureus
ETQNSISKLPSNF

SEQ ID NO: 1570380 - protein, 15 aa, Staphylococcus aureus
ETQNSISKLPSNSDV

SEQ ID NO: 1570381 - protein, 4 aa, Staphylococcus aureus
ETRT

SEQ ID NO: 1570382 - protein, 20 aa, Staphylococcus aureus
ETTEDKKGYVHNKDKKYPVK

SEQ ID NO: 1570383 - protein, 5 aa, Staphylococcus aureus
ETTRI

SEQ ID NO: 1570384 - protein, 5 aa, Staphylococcus aureus
ETTTL

SEQ ID NO: 1570385 - protein, 34 aa, Staphylococcus aureus
ETVPNRSYARASANEITSKTVSNVSRTGNNANVT

SEQ ID NO: 1570386 - protein, 35 aa, Staphylococcus aureus
ETVPNRSYARASANEITSKTVSNVSRTGNNANVTV

SEQ ID NO: 1570387 - protein, 12 aa, Staphylococcus aureus
ETYAKQMQSNNY

SEQ ID NO: 1570388 - protein, 5 aa, Staphylococcus aureus
EVEGA

SEQ ID NO: 1570389 - protein, 6 aa, Staphylococcus aureus
EVEKIQ

SEQ ID NO: 1570390 - protein, 12 aa, Staphylococcus aureus
EVKYHDKKIIKL

SEQ ID NO: 1570391 - protein, 12 aa, Staphylococcus aureus
EVKYHNKKLIKL

SEQ ID NO: 1570392 - protein, 8 aa, Staphylococcus aureus
EVNGTSSI

SEQ ID NO: 1570393 - protein, 7 aa, Staphylococcus aureus
EVRETSK

SEQ ID NO: 1570394 - protein, 4 aa, Staphylococcus aureus
EVSV

SEQ ID NO: 1570395 - protein, 11 aa, Staphylococcus aureus
EVTGKSYADNY

SEQ ID NO: 1570396 - protein, 15 aa, Staphylococcus aureus
EVTTNNKSGVGGTGI

SEQ ID NO: 1570397 - protein, 42 aa, Staphylococcus aureus
EVVEETKATGTDVTNKVEVEEGSEIVGHKQDTNVVNPHNAER

SEQ ID NO: 1570398 - protein, 13 aa, Staphylococcus aureus
EVYNSKDPKYKKI

SEQ ID NO: 1570399 - protein, 17 aa, Staphylococcus aureus
EYKANLERAKAQAERFK

SEQ ID NO: 1570400 - protein, 17 aa, Staphylococcus aureus
EYKEDTIKETLKGQYDK

SEQ ID NO: 1570401 - protein, 9 aa, Staphylococcus aureus
EYTNARPKV

SEQ ID NO: 1570402 - protein, 8 aa, Staphylococcus aureus
EYTNVGPK

SEQ ID NO: 1570403 - protein, 12 aa, Staphylococcus aureus
FAARDISSTNVT

SEQ ID NO: 1570404 - protein, 144 aa, Staphylococcus aureus
FAASDAPLTSELNTQSETVGNQNSTTIEASTSTADSTSVTKNSSSVQTSNSDTVSSEKSENVTSTTNSTSNQQEKLTSTSESTFSKNTTSSSDTKSVASTSSTEQPINTSTNQSTASNNTSQSTTPSSANLNKTSTTSTSTAPV

SEQ ID NO: 1570405 - protein, 20 aa, Staphylococcus aureus
FAEGRGKAQAGSLRQAQSNL

SEQ ID NO: 1570406 - protein, 6 aa, Staphylococcus aureus
FAETPF

SEQ ID NO: 1570407 - protein, 4 aa, Staphylococcus aureus
FAQA

SEQ ID NO: 1570408 - protein, 12 aa, Staphylococcus aureus
FASTGDTSSDDI

SEQ ID NO: 1570409 - protein, 4 aa, Staphylococcus aureus
FDPI

SEQ ID NO: 1570410 - protein, 9 aa, Staphylococcus aureus
FDSPKYNSD

SEQ ID NO: 1570411 - protein, 6 aa, Staphylococcus aureus
FDSRQA

SEQ ID NO: 1570412 - protein, 18 aa, Staphylococcus aureus
FDSTNNTISGTPTNIGTS

SEQ ID NO: 1570413 - protein, 4 aa, Staphylococcus aureus
FDVD

SEQ ID NO: 1570414 - protein, 127 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGSENNNSNNGTL

SEQ ID NO: 1570415 - protein, 122 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1570416 - protein, 146 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1570417 - protein, 160 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1570418 - protein, 164 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNAT

SEQ ID NO: 1570419 - protein, 196 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1570420 - protein, 202 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSNSDSDAGKHTPVKPMSATKDHHNKAKALPETGSENNGSNNAT

SEQ ID NO: 1570421 - protein, 206 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDAGKHTPVKPMSTTKDHHNKAKALPETGNENSGSNNAT

SEQ ID NO: 1570422 - protein, 224 aa, Staphylococcus aureus
FEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNAT

SEQ ID NO: 1570423 - protein, 206 aa, Staphylococcus aureus
FEEDTSDSDSDSDSDSDSESDSDSDSESDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1570424 - protein, 170 aa, Staphylococcus aureus
FEEDTSDSDSDSDSDSDSESDSDSDSESDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1570425 - protein, 188 aa, Staphylococcus aureus
FEEDTSDSDSDSESDSDSDSDSDSESDSDSDSDSDSESDSDSDSDSDSDSESDSDSESDSDSDSDSDSDSNSDSDSASDSDSDSDSDSDSDRDSDSDSDSDSDSDSDSDSDSDSDSESDSDSDSDSDSDSDSDSESDSDSDSDSESDSDSDAGKHTPVKPMSTTKDHHNKAKALPETGSENNGSNNAT

SEQ ID NO: 1570426 - protein, 180 aa, Staphylococcus aureus
FEEETSDSDSDSDSDSDSDSDSDSDSDSDSESDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNAT

SEQ ID NO: 1570427 - protein, 234 aa, Staphylococcus aureus
FEEETSDSDSDSDSDSDSDSDSDSDSDSDSESDSDSDSDSDSDSDSDSDSDSESDSDSESDSDSDSDSDSDSDSDSDSDSDSESDSDSDSDSDSDSDSDSDSDSDSDSDSDSDSDSDSDSDSDSDSESDSDSDSDSESDSDSDSDSESDSDSDSDSDSDSDSESDSDSDSDSDSDSDSDSDSDSDSDSDSDSDSDSDSGKHTPVKPMSATKDHHNKAKALPETGSENNGSNNAT

SEQ ID NO: 1570428 - protein, 228 aa, Staphylococcus aureus
FEEETSDSDSDSDSDSDSDSDSDSDSDSDSESDSDSDSDSDSDSDSDSDSDSESDSDSESDSDSDSDSDSDSDSDSDSDSDSESDSDSDSDSDSDSDSDSDSDSDSDSDSDSDSDSDSDSDSDSDSESDSDSDSDSESDSDSDSDSESDSDSDSDSDSDSDSESDSDSDSDSDSDSDSDSDSDSDSDSDSDSGKHTPVKPMSATKDHHNKAKALPETGSENNGSNNAT

SEQ ID NO: 1570429 - protein, 158 aa, Staphylococcus aureus
FEEETSDSDSDSDSDSDSDSDSDSESDSDSDSDSDSDSDSDSDSDSESDSDSDSDSDSDSDSDSDSDSDSESDSDSESDSDSESDSDSDSDSDSDSDSDSDSDSDSDSDSDSDSDSDSDSDAGKHTPVKPMSATKDHHNKAKALPETGSENNGSNNAT

SEQ ID NO: 1570430 - protein, 212 aa, Staphylococcus aureus
FEEETSNSDSDSDSDSDSDSDSDSDSDSDSDSDSDSDSESDSDSDSDSDSDSDSDSDSESDSDSDSDSDSDSDSDSDSDSDSDSDSDSDSDSDSDSDSDSDSDLDSDSDSDSDSDSDSDSDSDSDSDSDSDSDSDSDSDSDSESDSDSDSDSDSDSDSDSDSDSDSDSDSDSDSDSDSDSDSDSDSDSDSDSDSDSDSDSDSDSDSDAGKHT

SEQ ID NO: 1570431 - protein, 7 aa, Staphylococcus aureus
FENDQDY

SEQ ID NO: 1570432 - protein, 41 aa, Staphylococcus aureus
FETPSGYTPTQVGSGTDEGIDSNGTSTTGVIKDKDNDTIDS

SEQ ID NO: 1570433 - protein, 11 aa, Staphylococcus aureus
FGDEDEKAFQE

SEQ ID NO: 1570434 - protein, 67 aa, Staphylococcus aureus
FGGEEVPQGHKDEFDPNLPIDGTEEVPGKPGIKNPETGEVVTPPVDDVTKHGPKAGEPEVTKEEIPF

SEQ ID NO: 1570435 - protein, 69 aa, Staphylococcus aureus
FGGEEVPQGHKDEFDPNLPIDGTEEVPGKPGIKNPETGEVVTPPVDDVTKHGPKAGEPEVTKEEIPYET

SEQ ID NO: 1570436 - protein, 7 aa, Staphylococcus aureus
FGKDGSR

SEQ ID NO: 1570437 - protein, 5 aa, Staphylococcus aureus
FGNPQ

SEQ ID NO: 1570438 - protein, 23 aa, Staphylococcus aureus
FIESDRDRITTKRTVKDDYGKKQ

SEQ ID NO: 1570439 - protein, 4 aa, Staphylococcus aureus
FKAP

SEQ ID NO: 1570440 - protein, 8 aa, Staphylococcus aureus
FKEEEKDT

SEQ ID NO: 1570441 - protein, 10 aa, Staphylococcus aureus
FKGKFDSADI

SEQ ID NO: 1570442 - protein, 33 aa, Staphylococcus aureus
FKHPGEWKNQDLGTGTGNKSVEVTVKGPSMDAI

SEQ ID NO: 1570443 - protein, 86 aa, Staphylococcus aureus
FKKEESNDENNDSASSHANDNNIDDSTDSNIENEDYRYTQEIDDQNESNGIAVDNEQHQSAPNEQNSDSNDEETVTKKERKSKVTQ

SEQ ID NO: 1570444 - protein, 86 aa, Staphylococcus aureus
FKKEQSNEENNDSASSHANDNNIDDSTDSNNENEDYSYNQEIDDQNESNGIAVDNEQPQSAPKEQNSDSNDEETVTKKERKSKVTQ

SEQ ID NO: 1570445 - protein, 7 aa, Staphylococcus aureus
FKKNPMG

SEQ ID NO: 1570446 - protein, 12 aa, Staphylococcus aureus
FKNGAKQAQLQS

SEQ ID NO: 1570447 - protein, 14 aa, Staphylococcus aureus
FKNTTTKNLEGLNE

SEQ ID NO: 1570448 - protein, 6 aa, Staphylococcus aureus
FKPGEL

SEQ ID NO: 1570449 - protein, 7 aa, Staphylococcus aureus
FKPSTIV

SEQ ID NO: 1570450 - protein, 4 aa, Staphylococcus aureus
FKQG

SEQ ID NO: 1570451 - protein, 14 aa, Staphylococcus aureus
FKQTNNKSKNDAIG

SEQ ID NO: 1570452 - protein, 12 aa, Staphylococcus aureus
FKREDNSVETLR

SEQ ID NO: 1570453 - protein, 25 aa, Staphylococcus aureus
FKSATEDLDKESHDTPSKESKQKRE

SEQ ID NO: 1570454 - protein, 14 aa, Staphylococcus aureus
FNEEDKKTTKILES

SEQ ID NO: 1570455 - protein, 8 aa, Staphylococcus aureus
FNETKLEA

SEQ ID NO: 1570456 - protein, 8 aa, Staphylococcus aureus
FNGEEKDT

SEQ ID NO: 1570457 - protein, 188 aa, Staphylococcus aureus
FNNGSGSGDGIDKPVVPEQPDEPGEIEPIPEDSDSDPGSDSGSDSGSDSNSDSGSDSASDSDSASDSDSASDSDSASDSDSASDSDSASDSDSASDSDSASDSDSASDSDSDSDSDSASDSDSDSDSDSSSDSDSESDSNSDSESGSNNNVVPPNSPKNGTNASNKNEAKDSKEPLPDTGSEDEANSS

SEQ ID NO: 1570458 - protein, 419 aa, Staphylococcus aureus
FNNGSGSGDGIDKPVVPEQPDEPGEIEPIPEDSDSDPGSDSGSDSGSDSNSDSGSDSGSDSTSDSDSDSASDSDSTSDSDSASDSDSASDSDSDSDSDSNSDSDSDSDSDSDSDSDSDIDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSASDSDSDSDSDSDSDSDSDSDSDLASDSDSASDSDSASDSDSDSDSDSDSDSDSNSDSDSDSDSDSDSDSDSDSDSDSDSDSDSDSDSDSDNDSDSDSDSDSASDSDSGSDSDSSSDSDSDSDSDSASDSDSDSTSDTGSDNDSDSSSDSDSDSDSDSDSDSESGSNNNVVPPNSPKNGTNASNKNEAKDSKEPLPDTGSEDEANT

SEQ ID NO: 1570459 - protein, 475 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANT

SEQ ID NO: 1570460 - protein, 415 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSASDSDSASDSDSASDSDSTSDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANT

SEQ ID NO: 1570461 - protein, 433 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSASDSDSDSDSDSDSDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDIDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSASDSDSDSDSDSDLDSDSDSDSDSDSDSDSASDSDSDSDSDSDSESDSDSDSDSDSDSDSASDSDSESDSASDSDSDSTSDTGSDNDSDSESDSNSDSDSGSNNNVVPPNSPKSGTNASNKNEAKESKEPLPDTGSEDEANT

SEQ ID NO: 1570462 - protein, 153 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSASDSDSDSTSDTGSDNDSDSESDSNSDSDSGSNNNVVPPNSPKSGTNASNKNEAKESKEPLPDTGSEDEANT

SEQ ID NO: 1570463 - protein, 243 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSASDSDSTSDSDSTSDSDSASDSDSDSDSDSDSDSDSDSDSDSDSDSDSDSDSDSDSDSDSESDSDSDSDSDSDSDSDSDSDSDSDSDSDSASDSDSDSTSDTGSDNDSDSESDSNSDSDSGSNNNVVPPNSPKSGTNASNKNEAKESKEPLPDTGSEDEANT

SEQ ID NO: 1570464 - protein, 439 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSASDSDSTSDSDSTSDSDSASDSDSDSDSDSDSDSDSDSDSDSDSDSDSDSDSDSDSDSDSESDSDSDSDSDSDSDSDSDSDSDSVSDSDSDSDSDSESDSDSDSDSDSDSDSDSESDSDSDSDSDSDSDSDSDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANT

SEQ ID NO: 1570465 - protein, 439 aa, Staphylococcus aureus
FNNGSGSGDGIDKPVVPEQPDEPGEIEPIPEDSDSDPGSDSGSDSGSDSNSDSGSDSGSDSTSDSGSDSASDSDSASDSDSTSDSDSASDSDSDSDSDSDSDSDSDSDSDSDSDSDSDSDSDSDSDSDSDSDSDSDSDSDSESDSDSDSDSDSDSDSDSDSDSDSVSDSDSESDSDSESDSDSDSDSDSDSDSDSESDSDSDSDSDSDSDSESDSDSDSDSDSDSDSDSDSDSDSDSDSDSDSDSDSDSDSESDSDSDSDSDSDSDSDSDSDSDSDSDSDLDSDSDSDSDSDSDSDSDSDSDSDSDSDSDLDSDSDSDSDSDSDSDSASDSDSDSDSDSDSESDSDSDSDSDSDSDSASDSDSDSDSASDSDSDSTSDTGSDNDSDSESDSNSDSDSGSNNNVVPPNSPKSGTNASNKNEAKESKEPLPDTGSEDEANT

SEQ ID NO: 1570466 - protein, 390 aa, Staphylococcus aureus
FNNGSGSGDGIDKPVVPEQPDEPGEIEPIPEDSDSDPGSDSGSDSNSDSGSDSGSDSDSASDSDSASDSDSTSDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSGSDSDSDSDSESDSDSDSDSDSDSASDSDSGSASDSDSDSDSASDSDSGSDSDSASDSDSDSDSDSDSDSDSDSDSDSDSDSDSDSDSDSDSDSDSDSDSDSASDSDSDSTSDTGSDNDSDSDSNSDFESGSNNNVVPPNSPKNGTNASNKNEAKDSKEPLPDTGSEGEAN

SEQ ID NO: 1570467 - protein, 375 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANT

SEQ ID NO: 1570468 - protein, 429 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSASDSESDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANT

SEQ ID NO: 1570469 - protein, 351 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSASDSDSASDSDSASDSDSASDSDSDSDSDSDSDSDSDSDSDSDSDSDSDSDSDSGSDSDSDSDSDSDSDSDSDSDSDSDSDSDSDSDSDSASDSDSDSDSESDSDSDSDSDSDSDSDSDSDSDSESDSDSDSDSDSESDSDSDSDSDSDSASDSDSGSDSDSSSDSDSDSTSDTGSDNDSDSDSNSDSESGSNNNVVPPNSPKNGTNASNKNEAKDSKEPLPDTGSEDEANT

SEQ ID NO: 1570470 - protein, 375 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSNSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1570471 - protein, 434 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSASDSDSASDSDSASDSDSASDSDSTSDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSGSDSDSDSDSESDSDSDSDSDSDSASDSDSGSASDSDSDSDSASDSDSGSDSDSASDSDSDSDSDSDSDSDSDSDSDSDSDSDSDSDSDSDSDSDSDSDSDSASDSDSDSTSDTGSDNDSDSDSNSDFESGSNNNVVPPNSPKNGTNASNKNEAKDSKEPLPDTGSEGEAN

SEQ ID NO: 1570472 - protein, 355 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1570473 - protein, 373 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1570474 - protein, 375 aa, Staphylococcus aureus
FNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSASDSDSGSDSDSSSDSDSESDSNSDSESGSNNNVVPPNSPKNGTNASNKNEAKDSKEPLPDTGSEDEANT

SEQ ID NO: 1570475 - protein, 322 aa, Staphylococcus aureus
FNNGSGSGDGIDKPVVPEQPDEPGEIEPIPENSDSDPGSDSGSDSNSDSGSDSGSDSTSDSDSDSASDSDSASDSDSASDSDSASDSDSASDSDSASDSDSASDSDSDSDSDSDSDSDSDSDSDSDSDSDSDSDSDSDSDSDSDSDSDSDSDSDSDSDSDSDSDSDSDSDSDSASDSDSDSDSDSASDSDSDSDSDSDSDSDSDSDSDSDSDSDSDSDSDSDSDSDSDSDSDSNSDSDSDSASDSASDSDSGSASDSDSDSDSASDSDTDSDSDSDNASDSDSDSDSASDSDSDSTSDTGSDNDSDSESDSNSDSDSGSNNN

SEQ ID NO: 1570476 - protein, 13 aa, Staphylococcus aureus
FNPNTGTKGALEY

SEQ ID NO: 1570477 - protein, 5 aa, Staphylococcus aureus
FPNNN

SEQ ID NO: 1570478 - protein, 8 aa, Staphylococcus aureus
FSEEREDI

SEQ ID NO: 1570479 - protein, 9 aa, Staphylococcus aureus
FSFPSGHAL

SEQ ID NO: 1570480 - protein, 15 aa, Staphylococcus aureus
FSGYNGRLSEKSSGI

SEQ ID NO: 1570481 - protein, 26 aa, Staphylococcus aureus
FSKKPDFAVTNGGGIRASIAKGKVTR

SEQ ID NO: 1570482 - protein, 24 aa, Staphylococcus aureus
FSNEKMNSIRNSEIGSADEKQAAM

SEQ ID NO: 1570483 - protein, 4 aa, Staphylococcus aureus
FSPA

SEQ ID NO: 1570484 - protein, 8 aa, Staphylococcus aureus
FSSSSTYS

SEQ ID NO: 1570485 - protein, 7 aa, Staphylococcus aureus
FSTNEPV

SEQ ID NO: 1570486 - protein, 22 aa, Staphylococcus aureus
FTDADQGKKDAYTNAVTNAQGI

SEQ ID NO: 1570487 - protein, 21 aa, Staphylococcus aureus
FTDADQGKKEAYTNAVTNAQG

SEQ ID NO: 1570488 - protein, 16 aa, Staphylococcus aureus
FTNNNKAKADSHSKQL

SEQ ID NO: 1570489 - protein, 32 aa, Staphylococcus aureus
FTQADQDKQQAYNNAANQAQQIANGTPTPVLA

SEQ ID NO: 1570490 - protein, 10 aa, Staphylococcus aureus
FTTGSNEAVD

SEQ ID NO: 1570491 - protein, 19 aa, Staphylococcus aureus
FTTNADNADTIKKATSANY

SEQ ID NO: 1570492 - protein, 9 aa, Staphylococcus aureus
GAAGQAIQA

SEQ ID NO: 1570493 - protein, 4 aa, Staphylococcus aureus
GAAI

SEQ ID NO: 1570494 - protein, 6 aa, Staphylococcus aureus
GAATSL

SEQ ID NO: 1570495 - protein, 5 aa, Staphylococcus aureus
GAGKS

SEQ ID NO: 1570496 - protein, 5 aa, Staphylococcus aureus
GAITA

SEQ ID NO: 1570497 - protein, 17 aa, Staphylococcus aureus
GAKAGPDLADAIKGGRF

SEQ ID NO: 1570498 - protein, 4 aa, Staphylococcus aureus
GALR

SEQ ID NO: 1570499 - protein, 5 aa, Staphylococcus aureus
GALRS

SEQ ID NO: 1570500 - protein, 23 aa, Staphylococcus aureus
GAMTTDVSTTVNGEVDPVDAETA

SEQ ID NO: 1570501 - protein, 16 aa, Staphylococcus aureus
GAPTIQKDGKTVLTAN

SEQ ID NO: 1570502 - protein, 5 aa, Staphylococcus aureus
GASPE

SEQ ID NO: 1570503 - protein, 7 aa, Staphylococcus aureus
GATLGPG

SEQ ID NO: 1570504 - protein, 7 aa, Staphylococcus aureus
GATPNAI

SEQ ID NO: 1570505 - protein, 15 aa, Staphylococcus aureus
GAVKSELANGVEING

SEQ ID NO: 1570506 - protein, 7 aa, Staphylococcus aureus
GAVSNIK

SEQ ID NO: 1570507 - protein, 14 aa, Staphylococcus aureus
GDAAGGLGGVTAAG

SEQ ID NO: 1570508 - protein, 11 aa, Staphylococcus aureus
GDAAGSLGGVA

SEQ ID NO: 1570509 - protein, 8 aa, Staphylococcus aureus
GDAISSAW

SEQ ID NO: 1570510 - protein, 11 aa, Staphylococcus aureus
GDDDKNQFNGD

SEQ ID NO: 1570511 - protein, 14 aa, Staphylococcus aureus
GDGDLKGSSVGSKE

SEQ ID NO: 1570512 - protein, 14 aa, Staphylococcus aureus
GDGDLKGSSVGSKN

SEQ ID NO: 1570513 - protein, 6 aa, Staphylococcus aureus
GDIIPP

SEQ ID NO: 1570514 - protein, 10 aa, Staphylococcus aureus
GDIKGSSIGY

SEQ ID NO: 1570515 - protein, 9 aa, Staphylococcus aureus
GDSAYKDED

SEQ ID NO: 1570516 - protein, 4 aa, Staphylococcus aureus
GDVT

SEQ ID NO: 1570517 - protein, 10 aa, Staphylococcus aureus
GDYDSNASTL

SEQ ID NO: 1570518 - protein, 49 aa, Staphylococcus aureus
GEAKAAEETGGTITETQPKTEAVASPTTTTEKAPEAKPVANAVSVSNKE

SEQ ID NO: 1570519 - protein, 28 aa, Staphylococcus aureus
GEAKKLNDSQAPKAEAQQNNFNKDQQSA

SEQ ID NO: 1570520 - protein, 88 aa, Staphylococcus aureus
GEAQAAAEETGGTNTEAQPKTEAVASPTTTSEKAPETKPVANAVSVSNKDVEAPTSETKEAKEVKEVKAPKETKEVKPAAKATNNTYP

SEQ ID NO: 1570521 - protein, 72 aa, Staphylococcus aureus
GEAQAAEETGGTNTEAQPKTEAVASPSTTTEKAPEAKSVANAVSVSNKEVEAPTSETKEVKPAAKSDNNTYP

SEQ ID NO: 1570522 - protein, 87 aa, Staphylococcus aureus
GEAQAAEETGGTNTEAQPKTEAVASPTTTSEKAPETKPVANAVSVSNKEVEAPTSETKEAKEVKEVKAPKETKEVKPAAKATNNTYP

SEQ ID NO: 1570523 - protein, 84 aa, Staphylococcus aureus
GEAQAAEETGGTNTEAQPKTEAVASPTTTTEKAPEAKPVANAVSVSNKEVEAPTSETKEAKEVKAPKETKAVKPAAKADNNTYP

SEQ ID NO: 1570524 - protein, 27 aa, Staphylococcus aureus
GEAQKLNDSQAPKADAQQNKFNKDQQS

SEQ ID NO: 1570525 - protein, 28 aa, Staphylococcus aureus
GEAQKLNDSQAPKADAQQNKFNKDRQSA

SEQ ID NO: 1570526 - protein, 15 aa, Staphylococcus aureus
GEDYTTLKDTSNSLE

SEQ ID NO: 1570527 - protein, 9 aa, Staphylococcus aureus
GEEDEDESS

SEQ ID NO: 1570528 - protein, 18 aa, Staphylococcus aureus
GEKLGNPKSGSAALTGSD

SEQ ID NO: 1570529 - protein, 14 aa, Staphylococcus aureus
GEMDKKEKEKLSQQ

SEQ ID NO: 1570530 - protein, 5 aa, Staphylococcus aureus
GEMTA

SEQ ID NO: 1570531 - protein, 6 aa, Staphylococcus aureus
GENGGK

SEQ ID NO: 1570532 - protein, 12 aa, Staphylococcus aureus
GEPESSKASVGQ

SEQ ID NO: 1570533 - protein, 4 aa, Staphylococcus aureus
GESA

SEQ ID NO: 1570534 - protein, 10 aa, Staphylococcus aureus
GESAPQGVAV

SEQ ID NO: 1570535 - protein, 8 aa, Staphylococcus aureus
GESGSGKL

SEQ ID NO: 1570536 - protein, 6 aa, Staphylococcus aureus
GESLKS

SEQ ID NO: 1570537 - protein, 4 aa, Staphylococcus aureus
GETL

SEQ ID NO: 1570538 - protein, 22 aa, Staphylococcus aureus
GFEDKGVENSIPSLKAAAKANV

SEQ ID NO: 1570539 - protein, 7 aa, Staphylococcus aureus
GFEGKKK

SEQ ID NO: 1570540 - protein, 24 aa, Staphylococcus aureus
GFKHPGEWKNQDLGTGAGNKSVEV

SEQ ID NO: 1570541 - protein, 16 aa, Staphylococcus aureus
GFKKTAADQFSDAGAG

SEQ ID NO: 1570542 - protein, 6 aa, Staphylococcus aureus
GGALKS

SEQ ID NO: 1570543 - protein, 8 aa, Staphylococcus aureus
GGDVKDKG

SEQ ID NO: 1570544 - protein, 8 aa, Staphylococcus aureus
GGETTTKG

SEQ ID NO: 1570545 - protein, 14 aa, Staphylococcus aureus
GGGDLKDSSVGQND

SEQ ID NO: 1570546 - protein, 12 aa, Staphylococcus aureus
GGIGGAVTGGIG

SEQ ID NO: 1570547 - protein, 17 aa, Staphylococcus aureus
GGRFTPSEAQYAIDHLD

SEQ ID NO: 1570548 - protein, 4 aa, Staphylococcus aureus
GGSF

SEQ ID NO: 1570549 - protein, 4 aa, Staphylococcus aureus
GGYG

SEQ ID NO: 1570550 - protein, 11 aa, Staphylococcus aureus
GHKATKDNEVL

SEQ ID NO: 1570551 - protein, 22 aa, Staphylococcus aureus
GHKATKDNEVLADETLKNKGFK

SEQ ID NO: 1570552 - protein, 12 aa, Staphylococcus aureus
GHMQSSNNQMMS

SEQ ID NO: 1570553 - protein, 22 aa, Staphylococcus aureus
GHNDINNALTKEEIEQAKAQLA

SEQ ID NO: 1570554 - protein, 23 aa, Staphylococcus aureus
GHNDINNAMTKEEIEQAKDRLAQ

SEQ ID NO: 1570555 - protein, 22 aa, Staphylococcus aureus
GHNDINNAMTKEEIEQAKERLA

SEQ ID NO: 1570556 - protein, 24 aa, Staphylococcus aureus
GHNGINNAMTKEEIEQAKAQLAQA

SEQ ID NO: 1570557 - protein, 7 aa, Staphylococcus aureus
GHVKDKG

SEQ ID NO: 1570558 - protein, 4 aa, Staphylococcus aureus
GIAK

SEQ ID NO: 1570559 - protein, 8 aa, Staphylococcus aureus
GIGGSAAV

SEQ ID NO: 1570560 - protein, 9 aa, Staphylococcus aureus
GIGISEGDL

SEQ ID NO: 1570561 - protein, 13 aa, Staphylococcus aureus
GIGKEAEIKKSFE

SEQ ID NO: 1570562 - protein, 14 aa, Staphylococcus aureus
GIKPDVPIDTPKYQ

SEQ ID NO: 1570563 - protein, 7 aa, Staphylococcus aureus
GIKRREE

SEQ ID NO: 1570564 - protein, 4 aa, Staphylococcus aureus
GINA

SEQ ID NO: 1570565 - protein, 4 aa, Staphylococcus aureus
GIPN

SEQ ID NO: 1570566 - protein, 10 aa, Staphylococcus aureus
GISDEQGEKV

SEQ ID NO: 1570567 - protein, 6 aa, Staphylococcus aureus
GKAESI

SEQ ID NO: 1570568 - protein, 8 aa, Staphylococcus aureus
GKANTRNA

SEQ ID NO: 1570569 - protein, 12 aa, Staphylococcus aureus
GKDDKNKDKDKD

SEQ ID NO: 1570570 - protein, 18 aa, Staphylococcus aureus
GKDNEIKEYSKETQIKNS

SEQ ID NO: 1570571 - protein, 16 aa, Staphylococcus aureus
GKDPSEVQTTKARNTM

SEQ ID NO: 1570572 - protein, 16 aa, Staphylococcus aureus
GKDVNGKDTYKEVGSK

SEQ ID NO: 1570573 - protein, 13 aa, Staphylococcus aureus
GKFEKNVKELSGV

SEQ ID NO: 1570574 - protein, 17 aa, Staphylococcus aureus
GKGNEIKEDSKETQIKK

SEQ ID NO: 1570575 - protein, 5 aa, Staphylococcus aureus
GKIDK

SEQ ID NO: 1570576 - protein, 8 aa, Staphylococcus aureus
GKISKDAR

SEQ ID NO: 1570577 - protein, 7 aa, Staphylococcus aureus
GKKDKYY

SEQ ID NO: 1570578 - protein, 5 aa, Staphylococcus aureus
GKKSL

SEQ ID NO: 1570579 - protein, 9 aa, Staphylococcus aureus
GKLSKDAVN

SEQ ID NO: 1570580 - protein, 6 aa, Staphylococcus aureus
GKNTNN

SEQ ID NO: 1570581 - protein, 7 aa, Staphylococcus aureus
GKRKLNR

SEQ ID NO: 1570582 - protein, 28 aa, Staphylococcus aureus
GKSADSVRNTVGEATKNIGKHINSMKWA

SEQ ID NO: 1570583 - protein, 9 aa, Staphylococcus aureus
GKSKEGLDY

SEQ ID NO: 1570584 - protein, 9 aa, Staphylococcus aureus
GKSYSPKAF

SEQ ID NO: 1570585 - protein, 6 aa, Staphylococcus aureus
GKTNHD

SEQ ID NO: 1570586 - protein, 14 aa, Staphylococcus aureus
GKVFDDTKQPSYSI

SEQ ID NO: 1570587 - protein, 14 aa, Staphylococcus aureus
GKVIGDTKQPSYSI

SEQ ID NO: 1570588 - protein, 7 aa, Staphylococcus aureus
GKVLPKG

SEQ ID NO: 1570589 - protein, 7 aa, Staphylococcus aureus
GKVYKRD

SEQ ID NO: 1570590 - protein, 5 aa, Staphylococcus aureus
GKYNN

SEQ ID NO: 1570591 - protein, 7 aa, Staphylococcus aureus
GLESESG

SEQ ID NO: 1570592 - protein, 8 aa, Staphylococcus aureus
GLESGSGV

SEQ ID NO: 1570593 - protein, 8 aa, Staphylococcus aureus
GLGNGTYS

SEQ ID NO: 1570594 - protein, 5 aa, Staphylococcus aureus
GLNDP

SEQ ID NO: 1570595 - protein, 34 aa, Staphylococcus aureus
GLNNPQRQALESQINNAATRDEVAQKLAEAKALD

SEQ ID NO: 1570596 - protein, 35 aa, Staphylococcus aureus
GLNNPQRQALESQINNAGTRDEVAQKLAEAKALDQ

SEQ ID NO: 1570597 - protein, 13 aa, Staphylococcus aureus
GLRPFRNKSGHAE

SEQ ID NO: 1570598 - protein, 7 aa, Staphylococcus aureus
GLSSGQA

SEQ ID NO: 1570599 - protein, 7 aa, Staphylococcus aureus
GLTADDI

SEQ ID NO: 1570600 - protein, 6 aa, Staphylococcus aureus
GLTDRT

SEQ ID NO: 1570601 - protein, 5 aa, Staphylococcus aureus
GLTGS

SEQ ID NO: 1570602 - protein, 8 aa, Staphylococcus aureus
GLTGSNEV

SEQ ID NO: 1570603 - protein, 25 aa, Staphylococcus aureus
GLTTPDKIGPKYAPVGASNDPSNMN

SEQ ID NO: 1570604 - protein, 25 aa, Staphylococcus aureus
GLTTPEKIGPKYAPVGASNDPDDLN

SEQ ID NO: 1570605 - protein, 25 aa, Staphylococcus aureus
GLTTPEKIGPKYAPVGASNDPNNMN

SEQ ID NO: 1570606 - protein, 25 aa, Staphylococcus aureus
GLTTPEKIGPKYAPVGASNDPTDLN

SEQ ID NO: 1570607 - protein, 7 aa, Staphylococcus aureus
GLYTGNV

SEQ ID NO: 1570608 - protein, 7 aa, Staphylococcus aureus
GMYNKQE

SEQ ID NO: 1570609 - protein, 6 aa, Staphylococcus aureus
GNADNF

SEQ ID NO: 1570610 - protein, 7 aa, Staphylococcus aureus
GNGQDFL

SEQ ID NO: 1570611 - protein, 12 aa, Staphylococcus aureus
GNPLAQNLASSI

SEQ ID NO: 1570612 - protein, 5 aa, Staphylococcus aureus
GNQYK

SEQ ID NO: 1570613 - protein, 4 aa, Staphylococcus aureus
GNVD

SEQ ID NO: 1570614 - protein, 32 aa, Staphylococcus aureus
GNVDQAVKGMKNDDSFNKEDIEKTLKKEKKYE

SEQ ID NO: 1570615 - protein, 21 aa, Staphylococcus aureus
GNVEDIAKGRLDEVQNTESML

SEQ ID NO: 1570616 - protein, 10 aa, Staphylococcus aureus
GNYRESNRVP

SEQ ID NO: 1570617 - protein, 21 aa, Staphylococcus aureus
GPFKKGTNHETVEDLNGKDKV

SEQ ID NO: 1570618 - protein, 8 aa, Staphylococcus aureus
GPGQTYSN

SEQ ID NO: 1570619 - protein, 19 aa, Staphylococcus aureus
GPKTSSPNAIKALTSSEDT

SEQ ID NO: 1570620 - protein, 4 aa, Staphylococcus aureus
GPLP

SEQ ID NO: 1570621 - protein, 4 aa, Staphylococcus aureus
GPRL

SEQ ID NO: 1570622 - protein, 4 aa, Staphylococcus aureus
GQID

SEQ ID NO: 1570623 - protein, 6 aa, Staphylococcus aureus
GQIDYG

SEQ ID NO: 1570624 - protein, 65 aa, Staphylococcus aureus
GQKITKDKVKAADKNKKVVTEPKNTKVENDKVTTSVETKTEKAQDSLNDNTTKTMTSDKPEDNQP

SEQ ID NO: 1570625 - protein, 53 aa, Staphylococcus aureus
GQKITKDKVKTADKDKKVVTEPKNTKVENDKVTTSVETKTEKAQDSLNDNTTK

SEQ ID NO: 1570626 - protein, 65 aa, Staphylococcus aureus
GQKITKDKVKTADKNKKVVTEPKNTKVENDKETTSVETKTEKAQDSLNDNTTKTMTSDKPEDNQP

SEQ ID NO: 1570627 - protein, 12 aa, Staphylococcus aureus
GQKNVEPQFGEN

SEQ ID NO: 1570628 - protein, 8 aa, Staphylococcus aureus
GQKPPGDA

SEQ ID NO: 1570629 - protein, 9 aa, Staphylococcus aureus
GQKPSQKKI

SEQ ID NO: 1570630 - protein, 9 aa, Staphylococcus aureus
GQPKDHGDY

SEQ ID NO: 1570631 - protein, 6 aa, Staphylococcus aureus
GQQAGS

SEQ ID NO: 1570632 - protein, 7 aa, Staphylococcus aureus
GQQAQNV

SEQ ID NO: 1570633 - protein, 9 aa, Staphylococcus aureus
GQSGMSYGA

SEQ ID NO: 1570634 - protein, 8 aa, Staphylococcus aureus
GQTSIDES

SEQ ID NO: 1570635 - protein, 12 aa, Staphylococcus aureus
GQVTGKGKHSEL

SEQ ID NO: 1570636 - protein, 4 aa, Staphylococcus aureus
GRDF

SEQ ID NO: 1570637 - protein, 8 aa, Staphylococcus aureus
GRGINKKD

SEQ ID NO: 1570638 - protein, 5 aa, Staphylococcus aureus
GRPQY

SEQ ID NO: 1570639 - protein, 11 aa, Staphylococcus aureus
GRPVKSVNQNA

SEQ ID NO: 1570640 - protein, 12 aa, Staphylococcus aureus
GSAIATSSGLFE

SEQ ID NO: 1570641 - protein, 5 aa, Staphylococcus aureus
GSEFT

SEQ ID NO: 1570642 - protein, 4 aa, Staphylococcus aureus
GSGL

SEQ ID NO: 1570643 - protein, 14 aa, Staphylococcus aureus
GSIDETARVARSYG

SEQ ID NO: 1570644 - protein, 7 aa, Staphylococcus aureus
GSIETFN

SEQ ID NO: 1570645 - protein, 24 aa, Staphylococcus aureus
GSITESSTYGDNDTPAPPTDELSG

SEQ ID NO: 1570646 - protein, 24 aa, Staphylococcus aureus
GSITESSTYGDNNTPAPPTNELGG

SEQ ID NO: 1570647 - protein, 7 aa, Staphylococcus aureus
GSKDIDN

SEQ ID NO: 1570648 - protein, 12 aa, Staphylococcus aureus
GSLKARKKTEFS

SEQ ID NO: 1570649 - protein, 4 aa, Staphylococcus aureus
GSMG

SEQ ID NO: 1570650 - protein, 27 aa, Staphylococcus aureus
GSMPDLKKPEDKPYSKQRSFEPHEKDD

SEQ ID NO: 1570651 - protein, 13 aa, Staphylococcus aureus
GSPAMATGGMGDT

SEQ ID NO: 1570652 - protein, 14 aa, Staphylococcus aureus
GSPFNDAKLSPDQK

SEQ ID NO: 1570653 - protein, 9 aa, Staphylococcus aureus
GSPREEGIS

SEQ ID NO: 1570654 - protein, 9 aa, Staphylococcus aureus
GSQPPTPEW

SEQ ID NO: 1570655 - protein, 7 aa, Staphylococcus aureus
GSSDSTY

SEQ ID NO: 1570656 - protein, 5 aa, Staphylococcus aureus
GTADL

SEQ ID NO: 1570657 - protein, 5 aa, Staphylococcus aureus
GTAGL

SEQ ID NO: 1570658 - protein, 5 aa, Staphylococcus aureus
GTAGS

SEQ ID NO: 1570659 - protein, 9 aa, Staphylococcus aureus
GTAKTTSYG

SEQ ID NO: 1570660 - protein, 6 aa, Staphylococcus aureus
GTASLA

SEQ ID NO: 1570661 - protein, 4 aa, Staphylococcus aureus
GTGI

SEQ ID NO: 1570662 - protein, 6 aa, Staphylococcus aureus
GTISEV

SEQ ID NO: 1570663 - protein, 4 aa, Staphylococcus aureus
GTLA

SEQ ID NO: 1570664 - protein, 5 aa, Staphylococcus aureus
GTLGG

SEQ ID NO: 1570665 - protein, 21 aa, Staphylococcus aureus
GTLQASSATNEYKKALDGVKS

SEQ ID NO: 1570666 - protein, 18 aa, Staphylococcus aureus
GTNNGITVPAGTFNPADT

SEQ ID NO: 1570667 - protein, 8 aa, Staphylococcus aureus
GTNNVGKG

SEQ ID NO: 1570668 - protein, 12 aa, Staphylococcus aureus
GTPETKAKDVSI

SEQ ID NO: 1570669 - protein, 37 aa, Staphylococcus aureus
GTREEIDPNLPEGETKVIPGKDGLKDPETGEIIEEPQ

SEQ ID NO: 1570670 - protein, 5 aa, Staphylococcus aureus
GTRIP

SEQ ID NO: 1570671 - protein, 6 aa, Staphylococcus aureus
GTRNAI

SEQ ID NO: 1570672 - protein, 4 aa, Staphylococcus aureus
GTSL

SEQ ID NO: 1570673 - protein, 26 aa, Staphylococcus aureus
GVANSKIKRTKEELKSIPNKTRSRLE

SEQ ID NO: 1570674 - protein, 6 aa, Staphylococcus aureus
GVDRND

SEQ ID NO: 1570675 - protein, 7 aa, Staphylococcus aureus
GVDRNDI

SEQ ID NO: 1570676 - protein, 9 aa, Staphylococcus aureus
GVGTAAGPI

SEQ ID NO: 1570677 - protein, 5 aa, Staphylococcus aureus
GWVTG

SEQ ID NO: 1570678 - protein, 5 aa, Staphylococcus aureus
GYATS

SEQ ID NO: 1570679 - protein, 9 aa, Staphylococcus aureus
GYEPTDELK

SEQ ID NO: 1570680 - protein, 15 aa, Staphylococcus aureus
GYSGYNGQRQSNSTG

SEQ ID NO: 1570681 - protein, 14 aa, Staphylococcus aureus
HAAKYGHERYGKTY

SEQ ID NO: 1570682 - protein, 8 aa, Staphylococcus aureus
HAQQQTLT

SEQ ID NO: 1570683 - protein, 19 aa, Staphylococcus aureus
HDITKSKQLTEESYANRPL

SEQ ID NO: 1570684 - protein, 18 aa, Staphylococcus aureus
HDKEEDEKNKEKNAKNIR

SEQ ID NO: 1570685 - protein, 30 aa, Staphylococcus aureus
HDQNTVKQGVNFTDADKAKRDAYTNAVSRA

SEQ ID NO: 1570686 - protein, 18 aa, Staphylococcus aureus
HDRITTKRTVKDGNGKKQ

SEQ ID NO: 1570687 - protein, 123 aa, Staphylococcus aureus
HEAKAAEHTNGELNQSKNETTAPSENKTTEKVDSHQLKDNTQTATADQPKVTMSDSATFKETSSNMQSPQNATASQSTTQTSNVTTNDKSSTTYSNETDKSNLTQAKDVSATPKTTTIKPRTL

SEQ ID NO: 1570688 - protein, 114 aa, Staphylococcus aureus
HEAKAAEHTNGELNQSKNETTAPSENKTTEKVDSHQQNNIEQSTTSNQPKVNESDNTSVKETTEEPQNTTSTQPTKQNNDATANKDNLAAQNISTQANDVSATPKTTTIKPRTL

SEQ ID NO: 1570689 - protein, 123 aa, Staphylococcus aureus
HEAKAAEHTNGELNQSKNETTAPSENKTTEKVDSRQLKDNTQTATADQPKVTMSDSATVKETSSNMQSPQNATASQSTTQTSNVTTNDKSSTTYSNETDKSNLTQAKDVSATPKTTTIKPRTL

SEQ ID NO: 1570690 - protein, 143 aa, Staphylococcus aureus
HEAQASEKIPTTNAAAQKETLNQPGEQGNAITSHQMQSGKQLDDMHKENGKSGTVTEGKDMLQSPKHQSTQNSKIIRTQNDNQVKQDSERQGSKQSHQNNATNKTERQNDQIQNTHHAERNGSQSTTSQSNDVDKSQPSIPAQ

SEQ ID NO: 1570691 - protein, 143 aa, Staphylococcus aureus
HEAQASEKTLTSNAAAQKETLNQPGEQGNAITSHQMQSGKQLDDMHKENSKSGTVTEGKDTLQSSKHQSTQNSKIIRTQNDNQVKQDSERQGSKQSHQNNATNKTERQNDQIQNTHHAERNGPQSTTSQSNDVDKSQPSIPAQ

SEQ ID NO: 1570692 - protein, 143 aa, Staphylococcus aureus
HEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQ

SEQ ID NO: 1570693 - protein, 6 aa, Staphylococcus aureus
HGENIN

SEQ ID NO: 1570694 - protein, 10 aa, Staphylococcus aureus
HGNNQHDSRQ

SEQ ID NO: 1570695 - protein, 5 aa, Staphylococcus aureus
HGPLS

SEQ ID NO: 1570696 - protein, 10 aa, Staphylococcus aureus
HGPNAESTND

SEQ ID NO: 1570697 - protein, 6 aa, Staphylococcus aureus
HGSEDK

SEQ ID NO: 1570698 - protein, 11 aa, Staphylococcus aureus
HHGSKTSTSKE

SEQ ID NO: 1570699 - protein, 10 aa, Staphylococcus aureus
HHKPGKEFEY

SEQ ID NO: 1570700 - protein, 35 aa, Staphylococcus aureus
HHNDSEKIDYKSYAADKAKANKEAHKAKQKNGKLN

SEQ ID NO: 1570701 - protein, 9 aa, Staphylococcus aureus
HHQQFQKPE

SEQ ID NO: 1570702 - protein, 6 aa, Staphylococcus aureus
HHRPDQ

SEQ ID NO: 1570703 - protein, 7 aa, Staphylococcus aureus
HHSDSSV

SEQ ID NO: 1570704 - protein, 4 aa, Staphylococcus aureus
HIEE

SEQ ID NO: 1570705 - protein, 9 aa, Staphylococcus aureus
HKATKDNEV

SEQ ID NO: 1570706 - protein, 26 aa, Staphylococcus aureus
HKEDEEDVKVTNENTDEKVLQDNEHS

SEQ ID NO: 1570707 - protein, 23 aa, Staphylococcus aureus
HKEDVKVTNENTDEKVLQDNEHS

SEQ ID NO: 1570708 - protein, 8 aa, Staphylococcus aureus
HKHAPESK

SEQ ID NO: 1570709 - protein, 4 aa, Staphylococcus aureus
HKIP

SEQ ID NO: 1570710 - protein, 5 aa, Staphylococcus aureus
HKIPP

SEQ ID NO: 1570711 - protein, 10 aa, Staphylococcus aureus
HKKHGKAVIG

SEQ ID NO: 1570712 - protein, 5 aa, Staphylococcus aureus
HKKPW

SEQ ID NO: 1570713 - protein, 8 aa, Staphylococcus aureus
HKQGDYIT

SEQ ID NO: 1570714 - protein, 19 aa, Staphylococcus aureus
HKVSATSTLNDGSIFTIQF

SEQ ID NO: 1570715 - protein, 20 aa, Staphylococcus aureus
HLDKNEYEAEPPLFFFSGRL

SEQ ID NO: 1570716 - protein, 20 aa, Staphylococcus aureus
HLDKSDYEAEPPLFFFSGRP

SEQ ID NO: 1570717 - protein, 15 aa, Staphylococcus aureus
HMSTEQLEISRIQHN

SEQ ID NO: 1570718 - protein, 7 aa, Staphylococcus aureus
HNGTLTG

SEQ ID NO: 1570719 - protein, 7 aa, Staphylococcus aureus
HNKAHVK

SEQ ID NO: 1570720 - protein, 4 aa, Staphylococcus aureus
HNNK

SEQ ID NO: 1570721 - protein, 7 aa, Staphylococcus aureus
HNPKDYN

SEQ ID NO: 1570722 - protein, 31 aa, Staphylococcus aureus
HNQADQQEQLTEQTHNSVESENTIEEAGEVT

SEQ ID NO: 1570723 - protein, 13 aa, Staphylococcus aureus
HNQITTDSNHATQ

SEQ ID NO: 1570724 - protein, 8 aa, Staphylococcus aureus
HPEIKKPL

SEQ ID NO: 1570725 - protein, 13 aa, Staphylococcus aureus
HPKDKKPTTHFKP

SEQ ID NO: 1570726 - protein, 9 aa, Staphylococcus aureus
HPTKTHSDI

SEQ ID NO: 1570727 - protein, 27 aa, Staphylococcus aureus
HQADQQEQLTHNSVESENTIEEAGEVT

SEQ ID NO: 1570728 - protein, 155 aa, Staphylococcus aureus
HQAQASEQSNDTTQSSKNNASADSEKNNMIETPQLNTTANDTSDISANTNSANVDSTAKPMSTQTSNTTTTEPASTNETPQPTAIKDQATAAKMQDQTVPQEANSQVDNKTTNDANSIATNSELKNPQTLDLPQSSPQTISNAQGTSKPSVRTRA

SEQ ID NO: 1570729 - protein, 140 aa, Staphylococcus aureus
HQAQASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQMI

SEQ ID NO: 1570730 - protein, 155 aa, Staphylococcus aureus
HQAQASEQSNDTTQSSKNNASADSEKNNTIETPQLNTTANDTSDISANTNSANVDSTAKPMSTQTSNTTTTEPASTNETPHPTAIKDQATAAKMQDQTVPQEANSQVDNKTTNDANSIATNSELKNPQTLDLPQSSPQTISNAQGTSKPSVRTRA

SEQ ID NO: 1570731 - protein, 155 aa, Staphylococcus aureus
HQAQASEQSNDTTQSSKNNASADSEKNNTIETPQLNTTANDTSDISANTNSANVDSTAKPMSTQTSNTTTTEPASTNETPQPTAIKDQATAAKMQDQTVPQEANSQVDNKTTNDANSIATNSELKNPQSLDLPQSSPQTISNAQGTSKPSVRTRA

SEQ ID NO: 1570732 - protein, 154 aa, Staphylococcus aureus
HQAQASEQSNDTTQSSKNNASADSEKNNTIETPQLNTTANDTSDISANTNSANVDSTAKTMSTQTSNTTTTEPASTNETPQPTAIKDQATAAKMQDQTVPQEANSQVDNKTTNDANNIATNSELKNPQTLDLPQSSPQTISNAQGTSKPSVRTR

SEQ ID NO: 1570733 - protein, 10 aa, Staphylococcus aureus
HQGKENVTHN

SEQ ID NO: 1570734 - protein, 20 aa, Staphylococcus aureus
HQMNQSNKKVLPAAGESMTS

SEQ ID NO: 1570735 - protein, 11 aa, Staphylococcus aureus
HQRAYDAQRDG

SEQ ID NO: 1570736 - protein, 14 aa, Staphylococcus aureus
HQRAYDAQRDGRFN

SEQ ID NO: 1570737 - protein, 4 aa, Staphylococcus aureus
HRGS

SEQ ID NO: 1570738 - protein, 25 aa, Staphylococcus aureus
HRKEEEEDVTVEEKDSLNNGESLDK

SEQ ID NO: 1570739 - protein, 10 aa, Staphylococcus aureus
HRQSTASISN

SEQ ID NO: 1570740 - protein, 6 aa, Staphylococcus aureus
HRSDSR

SEQ ID NO: 1570741 - protein, 10 aa, Staphylococcus aureus
HSLKENNRPI

SEQ ID NO: 1570742 - protein, 59 aa, Staphylococcus aureus
HSNKAKERMLNEQKQEQKEKRQKENAEKERKKKQQEEKEQNELDSQTNQYQQLPQQNQY

SEQ ID NO: 1570743 - protein, 54 aa, Staphylococcus aureus
HSTSTSISTSEATTSTSESQSTLSATSEATKHNGTRAQSEERLPDTGESIKQNG

SEQ ID NO: 1570744 - protein, 16 aa, Staphylococcus aureus
HTGKQSEGASDVVFEF

SEQ ID NO: 1570745 - protein, 4 aa, Staphylococcus aureus
HTKR

SEQ ID NO: 1570746 - protein, 16 aa, Staphylococcus aureus
HVEGENNQQRRSKPRR

SEQ ID NO: 1570747 - protein, 16 aa, Staphylococcus aureus
HVEGQNDQQRRSKPRR

SEQ ID NO: 1570748 - protein, 10 aa, Staphylococcus aureus
HVNTTTGKTE

SEQ ID NO: 1570749 - protein, 14 aa, Staphylococcus aureus
HVPNPNSVSTEKYN

SEQ ID NO: 1570750 - protein, 19 aa, Staphylococcus aureus
HYEQKSDSSNAHTLNSSPA

SEQ ID NO: 1570751 - protein, 8 aa, Staphylococcus aureus
HYIETQEK

SEQ ID NO: 1570752 - protein, 16 aa, Staphylococcus aureus
IADDGSFYGSDAGAGF

SEQ ID NO: 1570753 - protein, 8 aa, Staphylococcus aureus
IADSNTVY

SEQ ID NO: 1570754 - protein, 5 aa, Staphylococcus aureus
IAEAE

SEQ ID NO: 1570755 - protein, 14 aa, Staphylococcus aureus
IAETEAKLSELEKK

SEQ ID NO: 1570756 - protein, 5 aa, Staphylococcus aureus
IAGAA

SEQ ID NO: 1570757 - protein, 52 aa, Staphylococcus aureus
IAKNDTENTVADEPSIHEGTEKTESQHHIDNQTESNHDEDHDITSESVESVE

SEQ ID NO: 1570758 - protein, 7 aa, Staphylococcus aureus
IAMTSRK

SEQ ID NO: 1570759 - protein, 6 aa, Staphylococcus aureus
IAPNNE

SEQ ID NO: 1570760 - protein, 9 aa, Staphylococcus aureus
IAQNTDPNT

SEQ ID NO: 1570761 - protein, 67 aa, Staphylococcus aureus
IAQPSNVSEIKPRMKRSADVTAVSEKEVAEEAKATGTDVTNKVEVTESSLEGHNKDSNIVNPHNAQR

SEQ ID NO: 1570762 - protein, 11 aa, Staphylococcus aureus
IASNELPQTQD

SEQ ID NO: 1570763 - protein, 8 aa, Staphylococcus aureus
IASPPQTC

SEQ ID NO: 1570764 - protein, 10 aa, Staphylococcus aureus
IASSDKEEEI

SEQ ID NO: 1570765 - protein, 7 aa, Staphylococcus aureus
IATANNT

SEQ ID NO: 1570766 - protein, 13 aa, Staphylococcus aureus
IDAATSSESGLDP

SEQ ID NO: 1570767 - protein, 9 aa, Staphylococcus aureus
IDANPDKVH

SEQ ID NO: 1570768 - protein, 10 aa, Staphylococcus aureus
IDDEKVKKEI

SEQ ID NO: 1570769 - protein, 11 aa, Staphylococcus aureus
IDDNQLSNADA

SEQ ID NO: 1570770 - protein, 10 aa, Staphylococcus aureus
IDGEGGYADG

SEQ ID NO: 1570771 - protein, 82 aa, Staphylococcus aureus
IDKATTDRQQVPPTKEAAHHYGEEATANVSASAQGIADDTNNKVTSNAPSNKPTTAVSTTVNETRDVDTQQASTQKSTHTAT

SEQ ID NO: 1570772 - protein, 6 aa, Staphylococcus aureus
IDKSNF

SEQ ID NO: 1570773 - protein, 12 aa, Staphylococcus aureus
IDNNQLSDADAA

SEQ ID NO: 1570774 - protein, 12 aa, Staphylococcus aureus
IDNNQLSDADTA

SEQ ID NO: 1570775 - protein, 7 aa, Staphylococcus aureus
IDPGPME

SEQ ID NO: 1570776 - protein, 83 aa, Staphylococcus aureus
IDQAATDKQLVPPTKEAAHQFGEEAATNVSASAQGTADEINNKVTSNAFSNKPSTAVSTKVNETHDVDTQQASTQKPTQSATF

SEQ ID NO: 1570777 - protein, 4 aa, Staphylococcus aureus
IDRD

SEQ ID NO: 1570778 - protein, 10 aa, Staphylococcus aureus
IDSGELSQSG

SEQ ID NO: 1570779 - protein, 11 aa, Staphylococcus aureus
IDTLNKADGKF

SEQ ID NO: 1570780 - protein, 4 aa, Staphylococcus aureus
IDTP

SEQ ID NO: 1570781 - protein, 8 aa, Staphylococcus aureus
IDTPSTAT

SEQ ID NO: 1570782 - protein, 14 aa, Staphylococcus aureus
IDTPSTESISDSLT

SEQ ID NO: 1570783 - protein, 9 aa, Staphylococcus aureus
IEAGGPVTV

SEQ ID NO: 1570784 - protein, 12 aa, Staphylococcus aureus
IEASNATEQDKL

SEQ ID NO: 1570785 - protein, 15 aa, Staphylococcus aureus
IEDNEAKNFDKKNAN

SEQ ID NO: 1570786 - protein, 14 aa, Staphylococcus aureus
IEEDTNKDKPNYQF

SEQ ID NO: 1570787 - protein, 10 aa, Staphylococcus aureus
IEGSRLKTAY

SEQ ID NO: 1570788 - protein, 4 aa, Staphylococcus aureus
IEKD

SEQ ID NO: 1570789 - protein, 13 aa, Staphylococcus aureus
IEKNENVDLSKEI

SEQ ID NO: 1570790 - protein, 25 aa, Staphylococcus aureus
IEKNENVDLSKEIDKVKTANNRINE

SEQ ID NO: 1570791 - protein, 9 aa, Staphylococcus aureus
IENKSSFVS

SEQ ID NO: 1570792 - protein, 5 aa, Staphylococcus aureus
IEPES

SEQ ID NO: 1570793 - protein, 22 aa, Staphylococcus aureus
IEPESDMVKDADSSVDKDAHHD

SEQ ID NO: 1570794 - protein, 10 aa, Staphylococcus aureus
IESGAKNQNI

SEQ ID NO: 1570795 - protein, 7 aa, Staphylococcus aureus
IGASGVG

SEQ ID NO: 1570796 - protein, 9 aa, Staphylococcus aureus
IGKPDPVRG

SEQ ID NO: 1570797 - protein, 46 aa, Staphylococcus aureus
IGQTSSPTMNAQEINQAKDQVTAKQQALNGQENLTNAQTNAKQHLN

SEQ ID NO: 1570798 - protein, 47 aa, Staphylococcus aureus
IGQTSSPTMNAQEINQAKDQVTAKQQALNGQENLTNAQTNAKQHLNG

SEQ ID NO: 1570799 - protein, 5 aa, Staphylococcus aureus
IGSGK

SEQ ID NO: 1570800 - protein, 8 aa, Staphylococcus aureus
IGYDGDKI

SEQ ID NO: 1570801 - protein, 27 aa, Staphylococcus aureus
IHGQNNGDQSFEEDTEKDKPKYEQGGN

SEQ ID NO: 1570802 - protein, 26 aa, Staphylococcus aureus
IHGQNNGNQSFEEDTEEDKPKYEQGG

SEQ ID NO: 1570803 - protein, 28 aa, Staphylococcus aureus
IHKDEATTKVDSDNTDPPIESKDHVSKK

SEQ ID NO: 1570804 - protein, 16 aa, Staphylococcus aureus
IISKNTAKDERTSEFE

SEQ ID NO: 1570805 - protein, 7 aa, Staphylococcus aureus
IKAERKP

SEQ ID NO: 1570806 - protein, 22 aa, Staphylococcus aureus
IKEVKTNPKEYANRLKNNPKAF

SEQ ID NO: 1570807 - protein, 12 aa, Staphylococcus aureus
IKGYDEKKAHDL

SEQ ID NO: 1570808 - protein, 11 aa, Staphylococcus aureus
IKHTKNGQVAH

SEQ ID NO: 1570809 - protein, 6 aa, Staphylococcus aureus
IKKADK

SEQ ID NO: 1570810 - protein, 19 aa, Staphylococcus aureus
IKKDPKASYSYEDKDAFEQ

SEQ ID NO: 1570811 - protein, 10 aa, Staphylococcus aureus
IKKGSVGSAI

SEQ ID NO: 1570812 - protein, 15 aa, Staphylococcus aureus
IKKVSKNKKRVDAQY

SEQ ID NO: 1570813 - protein, 20 aa, Staphylococcus aureus
IKLDNQEKVDGTKRQDKGKI

SEQ ID NO: 1570814 - protein, 8 aa, Staphylococcus aureus
IKNAKNKG

SEQ ID NO: 1570815 - protein, 11 aa, Staphylococcus aureus
IKNKGKEGLTI

SEQ ID NO: 1570816 - protein, 30 aa, Staphylococcus aureus
IKNNTINKAYEHKDPTNNGEQRDGKVFALI

SEQ ID NO: 1570817 - protein, 30 aa, Staphylococcus aureus
IKNNTINKAYEHKDPTNNSEQREGKVFALI

SEQ ID NO: 1570818 - protein, 12 aa, Staphylococcus aureus
IKPAESVGSNKN

SEQ ID NO: 1570819 - protein, 7 aa, Staphylococcus aureus
IKPESQQ

SEQ ID NO: 1570820 - protein, 13 aa, Staphylococcus aureus
IKPSQGDVRAPFN

SEQ ID NO: 1570821 - protein, 17 aa, Staphylococcus aureus
IKSAPELDKQGKDLTIE

SEQ ID NO: 1570822 - protein, 9 aa, Staphylococcus aureus
IKSGKPIEN

SEQ ID NO: 1570823 - protein, 9 aa, Staphylococcus aureus
IKSKIEKNH

SEQ ID NO: 1570824 - protein, 8 aa, Staphylococcus aureus
IKSNTVDK

SEQ ID NO: 1570825 - protein, 9 aa, Staphylococcus aureus
IKSNTVGKA

SEQ ID NO: 1570826 - protein, 48 aa, Staphylococcus aureus
IKTKDDDTSQNNTSEHLNGQTVQEDKGTATDTATNNSIETTPSEATDK

SEQ ID NO: 1570827 - protein, 48 aa, Staphylococcus aureus
IKTKDDDTSQNNTSEHLNGQTVQEDNVTATDTATNNSIETTPREATDK

SEQ ID NO: 1570828 - protein, 4 aa, Staphylococcus aureus
ILEK

SEQ ID NO: 1570829 - protein, 9 aa, Staphylococcus aureus
IMNPNKERL

SEQ ID NO: 1570830 - protein, 20 aa, Staphylococcus aureus
INAQITKQSLETLTSQNVKV

SEQ ID NO: 1570831 - protein, 11 aa, Staphylococcus aureus
INATKDKLGLN

SEQ ID NO: 1570832 - protein, 5 aa, Staphylococcus aureus
INDPV

SEQ ID NO: 1570833 - protein, 31 aa, Staphylococcus aureus
INDYKDGDISYNPNVPSYSAEYQLSNDDYNV

SEQ ID NO: 1570834 - protein, 31 aa, Staphylococcus aureus
INDYKDGDISYNPNVPSYSAKYQLNNDDYNV

SEQ ID NO: 1570835 - protein, 31 aa, Staphylococcus aureus
INDYKNGDISYNPNVPSYSEKYQLRNDDYNV

SEQ ID NO: 1570836 - protein, 15 aa, Staphylococcus aureus
INEDKPQKDAYQTAV

SEQ ID NO: 1570837 - protein, 7 aa, Staphylococcus aureus
INENKKA

SEQ ID NO: 1570838 - protein, 11 aa, Staphylococcus aureus
INGKLGKMNSE

SEQ ID NO: 1570839 - protein, 27 aa, Staphylococcus aureus
INGLTNPVKVDNEKINKVKDHQAGGNA

SEQ ID NO: 1570840 - protein, 10 aa, Staphylococcus aureus
INGNNSDSVT

SEQ ID NO: 1570841 - protein, 7 aa, Staphylococcus aureus
INGQGDS

SEQ ID NO: 1570842 - protein, 34 aa, Staphylococcus aureus
INGTPNATLTANDVNSATSQVNAAKTALNGDNNL

SEQ ID NO: 1570843 - protein, 10 aa, Staphylococcus aureus
INHKRKRRTT

SEQ ID NO: 1570844 - protein, 10 aa, Staphylococcus aureus
INNAGTVSDV

SEQ ID NO: 1570845 - protein, 9 aa, Staphylococcus aureus
INNATTRDK

SEQ ID NO: 1570846 - protein, 12 aa, Staphylococcus aureus
INNERKVKTIEN

SEQ ID NO: 1570847 - protein, 6 aa, Staphylococcus aureus
INNNEG

SEQ ID NO: 1570848 - protein, 8 aa, Staphylococcus aureus
INPEPSFK

SEQ ID NO: 1570849 - protein, 16 aa, Staphylococcus aureus
INQPTNINSDMSQTTG

SEQ ID NO: 1570850 - protein, 17 aa, Staphylococcus aureus
INQTGNPTLDKAQVEQL

SEQ ID NO: 1570851 - protein, 16 aa, Staphylococcus aureus
INQTGNPTLDKSQVEQ

SEQ ID NO: 1570852 - protein, 17 aa, Staphylococcus aureus
INQTSNPTMEPNTITQV

SEQ ID NO: 1570853 - protein, 70 aa, Staphylococcus aureus
INTKDDDTSQNNTSEPLNVQTGQEDKVADTDVAENSSTATNPKDASDKADVIEPESDMVKDTDSSVDKDA

SEQ ID NO: 1570854 - protein, 73 aa, Staphylococcus aureus
INTKDDDTSQNNTSEPLNVQTGQEDKVADTDVAENSSTATNPKDASDKADVIEPESDMVKDTDSSVDKDVQHD

SEQ ID NO: 1570855 - protein, 22 aa, Staphylococcus aureus
IPAPGVNPAAFDNPQGSQGATE

SEQ ID NO: 1570856 - protein, 22 aa, Staphylococcus aureus
IPDEYAKEVPESARTEALPEGK

SEQ ID NO: 1570857 - protein, 8 aa, Staphylococcus aureus
IPDSQLNK

SEQ ID NO: 1570858 - protein, 8 aa, Staphylococcus aureus
IPKSSIKS

SEQ ID NO: 1570859 - protein, 15 aa, Staphylococcus aureus
IPKWSDSDPGKNNLY

SEQ ID NO: 1570860 - protein, 13 aa, Staphylococcus aureus
IPNAQIDGKVGRQ

SEQ ID NO: 1570861 - protein, 10 aa, Staphylococcus aureus
IPNDSSFNDK

SEQ ID NO: 1570862 - protein, 22 aa, Staphylococcus aureus
IPQAHQSLTNKEWNRNAFKGTE

SEQ ID NO: 1570863 - protein, 5 aa, Staphylococcus aureus
IPQTE

SEQ ID NO: 1570864 - protein, 8 aa, Staphylococcus aureus
IPSNQLKK

SEQ ID NO: 1570865 - protein, 14 aa, Staphylococcus aureus
IPTKEIKDENIKAE

SEQ ID NO: 1570866 - protein, 15 aa, Staphylococcus aureus
IPTKEIKDKNIKKEI

SEQ ID NO: 1570867 - protein, 10 aa, Staphylococcus aureus
IQKEESCDTV

SEQ ID NO: 1570868 - protein, 274 aa, Staphylococcus aureus
ISASESDSMSTSDSSSISGSNSTSTSLSTSDSMSGSVSVSTSTSLSDSISGSTSVSDSSSTSTSTSLSDSMSQSQSTSTSASGSLSTSISTSMSMSASTSTSQSTSVSTSLSTSDSISDSTSISISGSQSTVESESTSDSTSISDSESLSTSDSDSTSTSTSDSTSGSTSTSISESLSTSGSGSTSVSDSASMSESNSSSISMSQDKSDSTSISDSESVSTSTSTSLSTSDSTSTSESLSTSISGSQSISDSTSTSMSGSTSTSESNSMHPSDS

SEQ ID NO: 1570869 - protein, 93 aa, Staphylococcus aureus
ISASESDSVSTSDSSSISGSNSTSTSLSTSDSMSGSVSVSTSTSLSDSISGSISVSDSSSTSTSESLSDSMAQSQSTSTSASGSLSTSISTSM

SEQ ID NO: 1570870 - protein, 9 aa, Staphylococcus aureus
ISDDKDNVM

SEQ ID NO: 1570871 - protein, 4 aa, Staphylococcus aureus
ISEN

SEQ ID NO: 1570872 - protein, 6 aa, Staphylococcus aureus
ISGGQF

SEQ ID NO: 1570873 - protein, 6 aa, Staphylococcus aureus
ISKDGI

SEQ ID NO: 1570874 - protein, 8 aa, Staphylococcus aureus
ISNKSKAL

SEQ ID NO: 1570875 - protein, 16 aa, Staphylococcus aureus
ISNWGKAGKDPREEFK

SEQ ID NO: 1570876 - protein, 4 aa, Staphylococcus aureus
ISQD

SEQ ID NO: 1570877 - protein, 9 aa, Staphylococcus aureus
ISREEYEKL

SEQ ID NO: 1570878 - protein, 11 aa, Staphylococcus aureus
ISSGAGSVRIS

SEQ ID NO: 1570879 - protein, 11 aa, Staphylococcus aureus
ISSPAQKLRRG

SEQ ID NO: 1570880 - protein, 22 aa, Staphylococcus aureus
ISTDANQASHKDTCKKELDSQD

SEQ ID NO: 1570881 - protein, 160 aa, Staphylococcus aureus
ISTSDSDSKSLSLSTSQSGSTSTSTSTSSSVRTSESQSTSGSMSASQFDSTSISTSFSDSTSDSKSASTASSESISQSVSTSTSGSVSTSTSLSTSNSERTSTSMSDSTSLSTSESDSTSDSTSTSDSISEAISGSESTSISLSESNSTSDSESKSASAF

SEQ ID NO: 1570882 - protein, 15 aa, Staphylococcus aureus
ITAHPNSDKGNGGIY

SEQ ID NO: 1570883 - protein, 9 aa, Staphylococcus aureus
ITDGEDRAR

SEQ ID NO: 1570884 - protein, 11 aa, Staphylococcus aureus
ITDGKNIKRIE

SEQ ID NO: 1570885 - protein, 27 aa, Staphylococcus aureus
ITDKENNKTKIKGTNTLEDDKLKTRLR

SEQ ID NO: 1570886 - protein, 20 aa, Staphylococcus aureus
ITGENSKNYRVTADNKTYYI

SEQ ID NO: 1570887 - protein, 6 aa, Staphylococcus aureus
ITGNNQ

SEQ ID NO: 1570888 - protein, 11 aa, Staphylococcus aureus
ITGNPTKGSNT

SEQ ID NO: 1570889 - protein, 15 aa, Staphylococcus aureus
ITGRGIQGNIDGTTY

SEQ ID NO: 1570890 - protein, 25 aa, Staphylococcus aureus
ITQHDTEVDNVDNTAKHSHLNKPSH

SEQ ID NO: 1570891 - protein, 5 aa, Staphylococcus aureus
ITRKQ

SEQ ID NO: 1570892 - protein, 5 aa, Staphylococcus aureus
ITSNK

SEQ ID NO: 1570893 - protein, 197 aa, Staphylococcus aureus
ITSPSVNSEMNNNETGTPHESNQTGNEGTGSNSRDANPDSNNVKPDSNNQNPSTDSKPDPNNQNPSPNPKPDPDNPKPKPDPKPDPDKPKPNPDPKPDPDNPKPNPDPKPDPDKPKPNPDPKPDPDKPKPNPNPKPDPNKPNPNPSPDPDQHGDSNHSGGSKNGGTWNPNASDGSNQGQWQPNGNQGNSQNPTGNDF

SEQ ID NO: 1570894 - protein, 158 aa, Staphylococcus aureus
ITSPSVNSEMNNNETGTPHESNQTGNEGTGSNSRDANPDSNNVKPDSNNQNPSTDSKPDPNNQNPSPNPKPDPDNPKPKPDPKPDPDKPKPNPNPKPDPNKPNPNPSPDPDQPGDSNHSGGSKNGGTWNPNASDGSNQGQWQPNGNQGNSQNPTGNDF

SEQ ID NO: 1570895 - protein, 190 aa, Staphylococcus aureus
ITSPSVNSEMNNNETGTPHESNQTGNEGTGSNSRDANPDSNNVKPDSNNQNPSTDSKPDPNNQNPSPNPKPDPKPDPDKPKPNPDPKPDPDNPKPNPDPKPDPDKPKPNPDPKPDPDKPKPNPNPKPDSDPNKPNPNPSPDPDQPGDSNHSGGSKNGGTWNPNASDGSNQGQWQPNGNQGNSQNPTGNDF

SEQ ID NO: 1570896 - protein, 197 aa, Staphylococcus aureus
ITSPSVNSEMNNNETGTPHESNQTGNEGTGSNSRDANPDSNNVKPDSNNQNPSTDSKPDPNNQNSSPNPKPDPDNPKPKPDPKPDPDKPKPNPDPKPDPDNPKPNPDPKPDPDKPKPNPDPKPDPDKPKPNPNPKPDPNKPNPNPSPDPDQPGDSNHSGGSKNGGTWNPNASDGSNQGQWQPNGNQGNSQNPTGNDF

SEQ ID NO: 1570897 - protein, 15 aa, Staphylococcus aureus
ITSSRDIYPIYFMTK

SEQ ID NO: 1570898 - protein, 4 aa, Staphylococcus aureus
ITTA

SEQ ID NO: 1570899 - protein, 5 aa, Staphylococcus aureus
ITTKQ

SEQ ID NO: 1570900 - protein, 8 aa, Staphylococcus aureus
ITTQDFKG

SEQ ID NO: 1570901 - protein, 29 aa, Staphylococcus aureus
IVRSSKSGVTTYNNNTGVANYKDKNEKYH

SEQ ID NO: 1570902 - protein, 8 aa, Staphylococcus aureus
IYHTGDTG

SEQ ID NO: 1570903 - protein, 19 aa, Staphylococcus aureus
KAANPLAKELAKRKQEAIS

SEQ ID NO: 1570904 - protein, 8 aa, Staphylococcus aureus
KAANTMNN

SEQ ID NO: 1570905 - protein, 30 aa, Staphylococcus aureus
KADASTQKSSSVQDKQLQKVEEVPNNSEKA

SEQ ID NO: 1570906 - protein, 6 aa, Staphylococcus aureus
KAFQPI

SEQ ID NO: 1570907 - protein, 6 aa, Staphylococcus aureus
KAGETM

SEQ ID NO: 1570908 - protein, 17 aa, Staphylococcus aureus
KAHKSTEQLEISHIQHN

SEQ ID NO: 1570909 - protein, 6 aa, Staphylococcus aureus
KAIKQT

SEQ ID NO: 1570910 - protein, 10 aa, Staphylococcus aureus
KAIPNSDSFI

SEQ ID NO: 1570911 - protein, 10 aa, Staphylococcus aureus
KAIPNSDSYI

SEQ ID NO: 1570912 - protein, 58 aa, Staphylococcus aureus
KAKEDAKNKIKALANAKRDQINSNPDLTPEQKAKALKEIDEAEKRALQNVENAQTIDQ

SEQ ID NO: 1570913 - protein, 13 aa, Staphylococcus aureus
KAKEDAKQDVDKR

SEQ ID NO: 1570914 - protein, 13 aa, Staphylococcus aureus
KAKENAKQDVDKR

SEQ ID NO: 1570915 - protein, 43 aa, Staphylococcus aureus
KALDKVKDNKTTVKFERNGKTKSVELTPKKTERKLTKVSSETK

SEQ ID NO: 1570916 - protein, 19 aa, Staphylococcus aureus
KALNGDQNLATAKDKANAF

SEQ ID NO: 1570917 - protein, 18 aa, Staphylococcus aureus
KALPETGSGNDESNNGTL

SEQ ID NO: 1570918 - protein, 18 aa, Staphylococcus aureus
KALPETGTENNNSNNGTL

SEQ ID NO: 1570919 - protein, 5 aa, Staphylococcus aureus
KANHP

SEQ ID NO: 1570920 - protein, 17 aa, Staphylococcus aureus
KANKEAHKAKQKNGKLN

SEQ ID NO: 1570921 - protein, 5 aa, Staphylococcus aureus
KANNR

SEQ ID NO: 1570922 - protein, 4 aa, Staphylococcus aureus
KANY

SEQ ID NO: 1570923 - protein, 7 aa, Staphylococcus aureus
KAPKTDA

SEQ ID NO: 1570924 - protein, 12 aa, Staphylococcus aureus
KAPLENAKNQLQ

SEQ ID NO: 1570925 - protein, 15 aa, Staphylococcus aureus
KAPPTMKAPNKQDIK

SEQ ID NO: 1570926 - protein, 38 aa, Staphylococcus aureus
KAPSNPKGEVNHSNKVSKQHKTDALPETGDKSENTNAT

SEQ ID NO: 1570927 - protein, 4 aa, Staphylococcus aureus
KAQD

SEQ ID NO: 1570928 - protein, 51 aa, Staphylococcus aureus
KAQQAAIKEEASANNLSDTSQEAQEIQEAKKEAQAETDKSAAVSNEEPKAV

SEQ ID NO: 1570929 - protein, 12 aa, Staphylococcus aureus
KARTRKMGGTGL

SEQ ID NO: 1570930 - protein, 5 aa, Staphylococcus aureus
KASAL

SEQ ID NO: 1570931 - protein, 5 aa, Staphylococcus aureus
KASSN

SEQ ID NO: 1570932 - protein, 28 aa, Staphylococcus aureus
KAVAPTKKPQSKKSELPETGGEESTNKG

SEQ ID NO: 1570933 - protein, 11 aa, Staphylococcus aureus
KAVSNSDSYIQ

SEQ ID NO: 1570934 - protein, 6 aa, Staphylococcus aureus
KAYGRN

SEQ ID NO: 1570935 - protein, 5 aa, Staphylococcus aureus
KDALA

SEQ ID NO: 1570936 - protein, 11 aa, Staphylococcus aureus
KDAPKSYEGSI

SEQ ID NO: 1570937 - protein, 19 aa, Staphylococcus aureus
KDDNEVQNNAVKAKKSGIV

SEQ ID NO: 1570938 - protein, 39 aa, Staphylococcus aureus
KDDPSQSANVLGEAKKLNDSQAPKADAQQNNFNKDQQSA

SEQ ID NO: 1570939 - protein, 11 aa, Staphylococcus aureus
KDEHRKESYTY

SEQ ID NO: 1570940 - protein, 11 aa, Staphylococcus aureus
KDEINDKKLTS

SEQ ID NO: 1570941 - protein, 25 aa, Staphylococcus aureus
KDEKTEKEVKDKIDKEVKSYNNTAM

SEQ ID NO: 1570942 - protein, 8 aa, Staphylococcus aureus
KDGSRFQD

SEQ ID NO: 1570943 - protein, 8 aa, Staphylococcus aureus
KDHPRQEV

SEQ ID NO: 1570944 - protein, 14 aa, Staphylococcus aureus
KDIDGTYKPFTAET

SEQ ID NO: 1570945 - protein, 27 aa, Staphylococcus aureus
KDIENKYKKQATLKKTGEIVSNGHQKD

SEQ ID NO: 1570946 - protein, 27 aa, Staphylococcus aureus
KDKDTQGKRDDRVKDEVTKHDNSAMKQ

SEQ ID NO: 1570947 - protein, 5 aa, Staphylococcus aureus
KDKFK

SEQ ID NO: 1570948 - protein, 10 aa, Staphylococcus aureus
KDKLPDRKNY

SEQ ID NO: 1570949 - protein, 4 aa, Staphylococcus aureus
KDKN

SEQ ID NO: 1570950 - protein, 14 aa, Staphylococcus aureus
KDKPSTYISKMATK

SEQ ID NO: 1570951 - protein, 12 aa, Staphylococcus aureus
KDLNNKYSPSKL

SEQ ID NO: 1570952 - protein, 57 aa, Staphylococcus aureus
KDNSTSNQSSKTQLTQKDEDKSENMPEEKSESETDKDLQSTEEVPANENTENNQHEI

SEQ ID NO: 1570953 - protein, 34 aa, Staphylococcus aureus
KDSRDKLKAEYNKYKQDPQSYKDNAKDKATQLGT

SEQ ID NO: 1570954 - protein, 14 aa, Staphylococcus aureus
KDTFESNDSAALTS

SEQ ID NO: 1570955 - protein, 13 aa, Staphylococcus aureus
KDTTSQINSPKSN

SEQ ID NO: 1570956 - protein, 10 aa, Staphylococcus aureus
KDVTDTQRSR

SEQ ID NO: 1570957 - protein, 6 aa, Staphylococcus aureus
KDYEPV

SEQ ID NO: 1570958 - protein, 26 aa, Staphylococcus aureus
KDYIQSDANRKTTKRSVKDKEGKPKT

SEQ ID NO: 1570959 - protein, 30 aa, Staphylococcus aureus
KDYKDGDISYNPNVPSYSANYQLNNDDYNV

SEQ ID NO: 1570960 - protein, 6 aa, Staphylococcus aureus
KDYNNP

SEQ ID NO: 1570961 - protein, 11 aa, Staphylococcus aureus
KEAIEQAKERL

SEQ ID NO: 1570962 - protein, 4 aa, Staphylococcus aureus
KEAR

SEQ ID NO: 1570963 - protein, 7 aa, Staphylococcus aureus
KEATKTN

SEQ ID NO: 1570964 - protein, 4 aa, Staphylococcus aureus
KEDF

SEQ ID NO: 1570965 - protein, 10 aa, Staphylococcus aureus
KEEFPNEGTL

SEQ ID NO: 1570966 - protein, 8 aa, Staphylococcus aureus
KEEVEEEA

SEQ ID NO: 1570967 - protein, 16 aa, Staphylococcus aureus
KEGFRDEEFEKGDKGT

SEQ ID NO: 1570968 - protein, 16 aa, Staphylococcus aureus
KEGFRDQEFDKGDKGT

SEQ ID NO: 1570969 - protein, 16 aa, Staphylococcus aureus
KEGFRDQEFDKRDKGT

SEQ ID NO: 1570970 - protein, 17 aa, Staphylococcus aureus
KEGFRDQEFKKGDKGTW

SEQ ID NO: 1570971 - protein, 9 aa, Staphylococcus aureus
KEGKQNKIR

SEQ ID NO: 1570972 - protein, 13 aa, Staphylococcus aureus
KEIEASNATDQTS

SEQ ID NO: 1570973 - protein, 14 aa, Staphylococcus aureus
KEIEQAEKEMEKKL

SEQ ID NO: 1570974 - protein, 18 aa, Staphylococcus aureus
KEIKRRNQQEEMHGAPNV

SEQ ID NO: 1570975 - protein, 50 aa, Staphylococcus aureus
KEINESGEQKMKEAESTATGACTGGSVDGSGISAFEKNAKGGALEGKGKD

SEQ ID NO: 1570976 - protein, 50 aa, Staphylococcus aureus
KEINESGEQKMKEAESTATGACTGGSVDGSGISTFEKNAKGGALEGKAKD

SEQ ID NO: 1570977 - protein, 10 aa, Staphylococcus aureus
KEKDAKDQLT

SEQ ID NO: 1570978 - protein, 13 aa, Staphylococcus aureus
KEKINNRKMSKDI

SEQ ID NO: 1570979 - protein, 5 aa, Staphylococcus aureus
KEKSR

SEQ ID NO: 1570980 - protein, 9 aa, Staphylococcus aureus
KELEKRKKV

SEQ ID NO: 1570981 - protein, 22 aa, Staphylococcus aureus
KENKLSQSKMLPKTGETTSSQS

SEQ ID NO: 1570982 - protein, 11 aa, Staphylococcus aureus
KENQEQYNEQM

SEQ ID NO: 1570983 - protein, 6 aa, Staphylococcus aureus
KENSKI

SEQ ID NO: 1570984 - protein, 8 aa, Staphylococcus aureus
KEPDTDTT

SEQ ID NO: 1570985 - protein, 61 aa, Staphylococcus aureus
KEPKQDLEAATAQMETTKGKKSSVASKLVSSDKDAEVEANASTEAKTNADVTSTLEDDPEA

SEQ ID NO: 1570986 - protein, 6 aa, Staphylococcus aureus
KEQALQ

SEQ ID NO: 1570987 - protein, 6 aa, Staphylococcus aureus
KEQQES

SEQ ID NO: 1570988 - protein, 6 aa, Staphylococcus aureus
KEQQKQ

SEQ ID NO: 1570989 - protein, 57 aa, Staphylococcus aureus
KESATQTQSVAPNTSEAGMSSAITQSTKTSDIHNESIDKQMDDKAYETAQNTDLKHE

SEQ ID NO: 1570990 - protein, 15 aa, Staphylococcus aureus
KESKETIHKDDEYIY

SEQ ID NO: 1570991 - protein, 6 aa, Staphylococcus aureus
KESKYL

SEQ ID NO: 1570992 - protein, 4 aa, Staphylococcus aureus
KESV

SEQ ID NO: 1570993 - protein, 15 aa, Staphylococcus aureus
KETANKENAQPRATF

SEQ ID NO: 1570994 - protein, 14 aa, Staphylococcus aureus
KETKPPKKDGDREK

SEQ ID NO: 1570995 - protein, 24 aa, Staphylococcus aureus
KEVKAPKEAKEEKPAAKADNNTYP

SEQ ID NO: 1570996 - protein, 4 aa, Staphylococcus aureus
KEVQ

SEQ ID NO: 1570997 - protein, 43 aa, Staphylococcus aureus
KEVVEEAKATGTDVTSKVTVENGSEIVGHKQDTNVVNPHNAER

SEQ ID NO: 1570998 - protein, 45 aa, Staphylococcus aureus
KEVVEKEVKATGTDVTSKVTVEEGSEIVGHNNKETNVVNPHNAER

SEQ ID NO: 1570999 - protein, 78 aa, Staphylococcus aureus
KGEPKEEITKDPINELTEYGPETIAPGHRDEFDPKLPTGEKEEVPGKPGIKNPETGDVVRPPVDSVTKYGPVKGDSIV

SEQ ID NO: 1571000 - protein, 78 aa, Staphylococcus aureus
KGEPKEEITKDPINELTEYGPETIAPGHRDEFDPKLPTGKKEEVPGKPGIKNPETGDVVRPPVDSVTKYGPVKGDSIV

SEQ ID NO: 1571001 - protein, 8 aa, Staphylococcus aureus
KGEQRIND

SEQ ID NO: 1571002 - protein, 21 aa, Staphylococcus aureus
KGETKTKYDAMKKDNVESTNK

SEQ ID NO: 1571003 - protein, 5 aa, Staphylococcus aureus
KGGEK

SEQ ID NO: 1571004 - protein, 9 aa, Staphylococcus aureus
KGIKDGKKR

SEQ ID NO: 1571005 - protein, 10 aa, Staphylococcus aureus
KGIKDGKKSY

SEQ ID NO: 1571006 - protein, 9 aa, Staphylococcus aureus
KGIKDKKNV

SEQ ID NO: 1571007 - protein, 7 aa, Staphylococcus aureus
KGIKYET

SEQ ID NO: 1571008 - protein, 12 aa, Staphylococcus aureus
KGIQINGSTEKI

SEQ ID NO: 1571009 - protein, 9 aa, Staphylococcus aureus
KGKFPDRKN

SEQ ID NO: 1571010 - protein, 39 aa, Staphylococcus aureus
KGKTPEEAALEHDDNNKNHYNENTRYEYDDDSNATHQRT

SEQ ID NO: 1571011 - protein, 39 aa, Staphylococcus aureus
KGKTPEEAALEHDDNNKNHYNENTRYEYDEGTNATHQRT

SEQ ID NO: 1571012 - protein, 39 aa, Staphylococcus aureus
KGKTPEEAALEHDDNNKNHYNENTRYEYDENTNATHQRT

SEQ ID NO: 1571013 - protein, 8 aa, Staphylococcus aureus
KGKVYTSA

SEQ ID NO: 1571014 - protein, 8 aa, Staphylococcus aureus
KGMANASG

SEQ ID NO: 1571015 - protein, 17 aa, Staphylococcus aureus
KGNEIKEDAKEEQIKKS

SEQ ID NO: 1571016 - protein, 4 aa, Staphylococcus aureus
KGNI

SEQ ID NO: 1571017 - protein, 5 aa, Staphylococcus aureus
KGSEF

SEQ ID NO: 1571018 - protein, 5 aa, Staphylococcus aureus
KGSGF

SEQ ID NO: 1571019 - protein, 4 aa, Staphylococcus aureus
KGSY

SEQ ID NO: 1571020 - protein, 9 aa, Staphylococcus aureus
KGVNNDDSM

SEQ ID NO: 1571021 - protein, 6 aa, Staphylococcus aureus
KGVPNK

SEQ ID NO: 1571022 - protein, 6 aa, Staphylococcus aureus
KHENRT

SEQ ID NO: 1571023 - protein, 10 aa, Staphylococcus aureus
KHEQALATDA

SEQ ID NO: 1571024 - protein, 6 aa, Staphylococcus aureus
KHIPES

SEQ ID NO: 1571025 - protein, 5 aa, Staphylococcus aureus
KHMYN

SEQ ID NO: 1571026 - protein, 12 aa, Staphylococcus aureus
KHNLKDYEETYN

SEQ ID NO: 1571027 - protein, 5 aa, Staphylococcus aureus
KHNLY

SEQ ID NO: 1571028 - protein, 32 aa, Staphylococcus aureus
KHPGEWKNQDLGTGAGNKSVEVTVKGPSMDAI

SEQ ID NO: 1571029 - protein, 4 aa, Staphylococcus aureus
KHPI

SEQ ID NO: 1571030 - protein, 12 aa, Staphylococcus aureus
KHQLNSKPQMTN

SEQ ID NO: 1571031 - protein, 12 aa, Staphylococcus aureus
KHRQSSASLSNI

SEQ ID NO: 1571032 - protein, 12 aa, Staphylococcus aureus
KHTLPSDLTDDF

SEQ ID NO: 1571033 - protein, 11 aa, Staphylococcus aureus
KHTSTDTKTNL

SEQ ID NO: 1571034 - protein, 16 aa, Staphylococcus aureus
KIEADANKYSFVWKKV

SEQ ID NO: 1571035 - protein, 9 aa, Staphylococcus aureus
KIEQGGKSG

SEQ ID NO: 1571036 - protein, 8 aa, Staphylococcus aureus
KIGKPTNL

SEQ ID NO: 1571037 - protein, 6 aa, Staphylococcus aureus
KINELE

SEQ ID NO: 1571038 - protein, 7 aa, Staphylococcus aureus
KIPDSIQ

SEQ ID NO: 1571039 - protein, 7 aa, Staphylococcus aureus
KIQQSSK

SEQ ID NO: 1571040 - protein, 7 aa, Staphylococcus aureus
KISQSEF

SEQ ID NO: 1571041 - protein, 17 aa, Staphylococcus aureus
KKAIDDVKETKKDEFAK

SEQ ID NO: 1571042 - protein, 8 aa, Staphylococcus aureus
KKAKKTVV

SEQ ID NO: 1571043 - protein, 7 aa, Staphylococcus aureus
KKAPKTD

SEQ ID NO: 1571044 - protein, 8 aa, Staphylococcus aureus
KKAPKTDA

SEQ ID NO: 1571045 - protein, 73 aa, Staphylococcus aureus
KKAPNNTNNDVTTKPSTSEIQTTPTTPQESTNIENSQPQPTPSKVDNQVTDAINPKEPVNVSKEELKNNPEKL

SEQ ID NO: 1571046 - protein, 78 aa, Staphylococcus aureus
KKAPNNTNNDVTTKPSTSEPSTSEIQTKPTTPQESTNIENSQPQPTPSKVDNQVTDATNPKEPVNVSKEELKKNPEKL

SEQ ID NO: 1571047 - protein, 6 aa, Staphylococcus aureus
KKAQAM

SEQ ID NO: 1571048 - protein, 13 aa, Staphylococcus aureus
KKASANSKKTRHV

SEQ ID NO: 1571049 - protein, 13 aa, Staphylococcus aureus
KKATQNQVAETQV

SEQ ID NO: 1571050 - protein, 17 aa, Staphylococcus aureus
KKDIKRNPQTESFNPTY

SEQ ID NO: 1571051 - protein, 7 aa, Staphylococcus aureus
KKDPPKV

SEQ ID NO: 1571052 - protein, 15 aa, Staphylococcus aureus
KKEESSKDKQIKENL

SEQ ID NO: 1571053 - protein, 11 aa, Staphylococcus aureus
KKEHYIETQEK

SEQ ID NO: 1571054 - protein, 5 aa, Staphylococcus aureus
KKELQ

SEQ ID NO: 1571055 - protein, 8 aa, Staphylococcus aureus
KKGKTRID

SEQ ID NO: 1571056 - protein, 4 aa, Staphylococcus aureus
KKGQ

SEQ ID NO: 1571057 - protein, 10 aa, Staphylococcus aureus
KKGVKDVKGR

SEQ ID NO: 1571058 - protein, 7 aa, Staphylococcus aureus
KKINEVN

SEQ ID NO: 1571059 - protein, 4 aa, Staphylococcus aureus
KKIP

SEQ ID NO: 1571060 - protein, 13 aa, Staphylococcus aureus
KKKIKTNHSDDNP

SEQ ID NO: 1571061 - protein, 12 aa, Staphylococcus aureus
KKLKGVASATGI

SEQ ID NO: 1571062 - protein, 97 aa, Staphylococcus aureus
KKLNDAQAPKEEDNNKPGKEDGNKPGKEDNNKPGKEDGNKPGKEDNKKPGKEDNNKPGKEDGNKPGKEDNKKPGKEDNNKPGKEDGNKPGKEDGNGV

SEQ ID NO: 1571063 - protein, 73 aa, Staphylococcus aureus
KKLNDAQAPKEEDNNKPGKEDNNKPGKEDGNKPGKEDNKKPGKEDGNKPGKEDGNKPGKEDGNKPGKEDGNGV

SEQ ID NO: 1571064 - protein, 22 aa, Staphylococcus aureus
KKLNESQAPKADNNFNKEQQNA

SEQ ID NO: 1571065 - protein, 27 aa, Staphylococcus aureus
KKNDVSESETVNIDNKDTVKQKEAKFE

SEQ ID NO: 1571066 - protein, 28 aa, Staphylococcus aureus
KKNDVSESETVNIDNKDTVKQKEAKFEN

SEQ ID NO: 1571067 - protein, 7 aa, Staphylococcus aureus
KKNKIPP

SEQ ID NO: 1571068 - protein, 6 aa, Staphylococcus aureus
KKNPMG

SEQ ID NO: 1571069 - protein, 31 aa, Staphylococcus aureus
KKNPSTYKNKTIKSDGGNSQGGANANHQGMI

SEQ ID NO: 1571070 - protein, 31 aa, Staphylococcus aureus
KKNPSTYKNKTIKSDGSNSQGGASANHQGMI

SEQ ID NO: 1571071 - protein, 38 aa, Staphylococcus aureus
KKNQKDNQSKDKKSASKNTSKKVTAKKKKKKSKKNNLF

SEQ ID NO: 1571072 - protein, 36 aa, Staphylococcus aureus
KKNQKDNQSKGKKSASKKPSKKVATKKKKKKSKKNK

SEQ ID NO: 1571073 - protein, 21 aa, Staphylococcus aureus
KKNQKDNQSKGKSRHQKNLLK

SEQ ID NO: 1571074 - protein, 12 aa, Staphylococcus aureus
KKQVNKKVVDAQ

SEQ ID NO: 1571075 - protein, 22 aa, Staphylococcus aureus
KKSLDAFSNKNVKAKLDASIQD

SEQ ID NO: 1571076 - protein, 21 aa, Staphylococcus aureus
KKSLDAFSNKQAKAKLDANIQ

SEQ ID NO: 1571077 - protein, 7 aa, Staphylococcus aureus
KKSQFAR

SEQ ID NO: 1571078 - protein, 13 aa, Staphylococcus aureus
KKTKDHYIETQEK

SEQ ID NO: 1571079 - protein, 15 aa, Staphylococcus aureus
KKTLDDFKKDDKHID

SEQ ID NO: 1571080 - protein, 6 aa, Staphylococcus aureus
KKTPMG

SEQ ID NO: 1571081 - protein, 38 aa, Staphylococcus aureus
KKTQKYEEKAGLTPNKLDEKTEKKGDKLAEKNRKEIAK

SEQ ID NO: 1571082 - protein, 8 aa, Staphylococcus aureus
KKTVPNEA

SEQ ID NO: 1571083 - protein, 21 aa, Staphylococcus aureus
KKVKASPTTKYEIASNTKPFT

SEQ ID NO: 1571084 - protein, 7 aa, Staphylococcus aureus
KKYNKNE

SEQ ID NO: 1571085 - protein, 8 aa, Staphylococcus aureus
KKYNKNEI

SEQ ID NO: 1571086 - protein, 26 aa, Staphylococcus aureus
KLDDVNTQVNLTTEKATVEYNPDQHD

SEQ ID NO: 1571087 - protein, 5 aa, Staphylococcus aureus
KLEEV

SEQ ID NO: 1571088 - protein, 23 aa, Staphylococcus aureus
KLGKSEADKLAKDWTNKGLSNRQ

SEQ ID NO: 1571089 - protein, 10 aa, Staphylococcus aureus
KLGLKDKTDW

SEQ ID NO: 1571090 - protein, 6 aa, Staphylococcus aureus
KLKENV

SEQ ID NO: 1571091 - protein, 88 aa, Staphylococcus aureus
KLNDAQAPKEEDGNKPGKEDNKKPGKEDGNKPGKEDNNKPGKEDNNKPGKEDGNKPGKEDNKKPGKEDGNKPGKEDNKKPGKEDGNGV

SEQ ID NO: 1571092 - protein, 64 aa, Staphylococcus aureus
KLNDAQAPKEEDNKKPGKEDGNKPGKEDGNKPGKEDNKKPGKEDGNKPGKEDGNKPGKEDGNGV

SEQ ID NO: 1571093 - protein, 80 aa, Staphylococcus aureus
KLNDAQAPKEEDNKKPGKEDGNKPGKEDGNKPGKEDNKKPGKEDGNKPGKEDGNKPGKEDGNKPGKEDGNKPGKEDGNGV

SEQ ID NO: 1571094 - protein, 64 aa, Staphylococcus aureus
KLNDAQAPKEEDNNKPGKEDGNKPGKEDNNKPGKEDNNKPGKEDNNKPGKEDGNKPGKEDGNGV

SEQ ID NO: 1571095 - protein, 71 aa, Staphylococcus aureus
KLNDAQAPKEEDNNKPGKEDNKPGKEDNKKPGKEDGNKPGKEDNNKPGKEDGNKPGKEDNKKPGKEDGNGV

SEQ ID NO: 1571096 - protein, 64 aa, Staphylococcus aureus
KLNDAQAPKEEDNNKPGKEDNNKPGKEDGNKPGKEDGNKPGKEDGNKPGKEDGNKPGKEDGNGV

SEQ ID NO: 1571097 - protein, 96 aa, Staphylococcus aureus
KLNDAQAPKEEDNNKPGKEDNNKPGKEDNKKPGKEDNKKPGKEDGNKPGKEDNKKPGKEDGNKPGKEDNKKPGKEDGNKPGKEDGNKPGKEDGNGV

SEQ ID NO: 1571098 - protein, 96 aa, Staphylococcus aureus
KLNDAQAPKEEDNNKPGKEDNNKPGKEDNNKPGKEDNKKPGKEDGNKPGKEDNKKPGKEDGNKPGKEDNKKPGKEDGNKPGKEDGNKPGKEDGNGV

SEQ ID NO: 1571099 - protein, 80 aa, Staphylococcus aureus
KLNDAQAPKEEDNNKPGKEDNNKPGKEDNNKPGKEDNNKPGKEDGNKPGKEDNKKPGKEDGNKPGKEDGNKPGKEDGNGV

SEQ ID NO: 1571100 - protein, 104 aa, Staphylococcus aureus
KLNDAQAPKEEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGV

SEQ ID NO: 1571101 - protein, 35 aa, Staphylococcus aureus
KLNGQKLNTKTSANNNQKKATSKLNKGRATNNNYS

SEQ ID NO: 1571102 - protein, 10 aa, Staphylococcus aureus
KLNNSDTNVK

SEQ ID NO: 1571103 - protein, 5 aa, Staphylococcus aureus
KLNVY

SEQ ID NO: 1571104 - protein, 9 aa, Staphylococcus aureus
KLPKTRSGK

SEQ ID NO: 1571105 - protein, 6 aa, Staphylococcus aureus
KLSGET

SEQ ID NO: 1571106 - protein, 9 aa, Staphylococcus aureus
KLTAARNKI

SEQ ID NO: 1571107 - protein, 8 aa, Staphylococcus aureus
KLTEAQAL

SEQ ID NO: 1571108 - protein, 19 aa, Staphylococcus aureus
KLTGNNFKYTEKSTHSYKQ

SEQ ID NO: 1571109 - protein, 12 aa, Staphylococcus aureus
KMDKNNISESIK

SEQ ID NO: 1571110 - protein, 4 aa, Staphylococcus aureus
KMGD

SEQ ID NO: 1571111 - protein, 34 aa, Staphylococcus aureus
KMSERNQEKQLKREEKAKLKEEQKARQNEQPQIK

SEQ ID NO: 1571112 - protein, 10 aa, Staphylococcus aureus
KMSKGYGYQD

SEQ ID NO: 1571113 - protein, 7 aa, Staphylococcus aureus
KNADLAD

SEQ ID NO: 1571114 - protein, 14 aa, Staphylococcus aureus
KNAKGGALDGKGKT

SEQ ID NO: 1571115 - protein, 7 aa, Staphylococcus aureus
KNAKNIR

SEQ ID NO: 1571116 - protein, 7 aa, Staphylococcus aureus
KNAKREL

SEQ ID NO: 1571117 - protein, 9 aa, Staphylococcus aureus
KNATATKTF

SEQ ID NO: 1571118 - protein, 15 aa, Staphylococcus aureus
KNDNDISDKIKDDKL

SEQ ID NO: 1571119 - protein, 7 aa, Staphylococcus aureus
KNDRSAN

SEQ ID NO: 1571120 - protein, 22 aa, Staphylococcus aureus
KNDSSGNSQMVGENIDKSKTNF

SEQ ID NO: 1571121 - protein, 5 aa, Staphylococcus aureus
KNEEN

SEQ ID NO: 1571122 - protein, 6 aa, Staphylococcus aureus
KNEFKT

SEQ ID NO: 1571123 - protein, 9 aa, Staphylococcus aureus
KNENFSNSN

SEQ ID NO: 1571124 - protein, 61 aa, Staphylococcus aureus
KNEQAALKAQQAAIKEEASANNLSDTSLNVSKEESQAERLANAAKQKQAKLTPGSKESQLT

SEQ ID NO: 1571125 - protein, 20 aa, Staphylococcus aureus
KNESQKIANEENKTINTPQG

SEQ ID NO: 1571126 - protein, 12 aa, Staphylococcus aureus
KNFYANNSEISE

SEQ ID NO: 1571127 - protein, 18 aa, Staphylococcus aureus
KNGVSSGGSNESNGNTEL

SEQ ID NO: 1571128 - protein, 9 aa, Staphylococcus aureus
KNHKGDNIV

SEQ ID NO: 1571129 - protein, 10 aa, Staphylococcus aureus
KNIVSTNPAM

SEQ ID NO: 1571130 - protein, 7 aa, Staphylococcus aureus
KNKEHKE

SEQ ID NO: 1571131 - protein, 8 aa, Staphylococcus aureus
KNKGENEK

SEQ ID NO: 1571132 - protein, 6 aa, Staphylococcus aureus
KNKIPP

SEQ ID NO: 1571133 - protein, 8 aa, Staphylococcus aureus
KNKNDEDK

SEQ ID NO: 1571134 - protein, 8 aa, Staphylococcus aureus
KNKPLDET

SEQ ID NO: 1571135 - protein, 10 aa, Staphylococcus aureus
KNNHTGKAAK

SEQ ID NO: 1571136 - protein, 22 aa, Staphylococcus aureus
KNNSQLEKQLKKQVKSKSKVKF

SEQ ID NO: 1571137 - protein, 10 aa, Staphylococcus aureus
KNNTEETTAI

SEQ ID NO: 1571138 - protein, 17 aa, Staphylococcus aureus
KNPKSVSEIKKEQNTSN

SEQ ID NO: 1571139 - protein, 4 aa, Staphylococcus aureus
KNPM

SEQ ID NO: 1571140 - protein, 12 aa, Staphylococcus aureus
KNPTKLELEVKE

SEQ ID NO: 1571141 - protein, 6 aa, Staphylococcus aureus
KNQAND

SEQ ID NO: 1571142 - protein, 17 aa, Staphylococcus aureus
KNTHKITGEYDTTTNDK

SEQ ID NO: 1571143 - protein, 4 aa, Staphylococcus aureus
KNWG

SEQ ID NO: 1571144 - protein, 17 aa, Staphylococcus aureus
KNYKDGDISYNPESPIY

SEQ ID NO: 1571145 - protein, 44 aa, Staphylococcus aureus
KPANKYGESPKYPSSIKKQPVTSETPEKAGTSETPKTPEETDNQ

SEQ ID NO: 1571146 - protein, 35 aa, Staphylococcus aureus
KPANKYGESPKYPSSIKNQPVTSETPKKPEETDNQ

SEQ ID NO: 1571147 - protein, 5 aa, Staphylococcus aureus
KPDGL

SEQ ID NO: 1571148 - protein, 9 aa, Staphylococcus aureus
KPDQYTDAN

SEQ ID NO: 1571149 - protein, 4 aa, Staphylococcus aureus
KPEE

SEQ ID NO: 1571150 - protein, 6 aa, Staphylococcus aureus
KPESQQ

SEQ ID NO: 1571151 - protein, 6 aa, Staphylococcus aureus
KPEVTR

SEQ ID NO: 1571152 - protein, 5 aa, Staphylococcus aureus
KPGEL

SEQ ID NO: 1571153 - protein, 8 aa, Staphylococcus aureus
KPKNNSFS

SEQ ID NO: 1571154 - protein, 7 aa, Staphylococcus aureus
KPKYENS

SEQ ID NO: 1571155 - protein, 8 aa, Staphylococcus aureus
KPNNTHEK

SEQ ID NO: 1571156 - protein, 20 aa, Staphylococcus aureus
KPQGFTEGKRRVYTEQQQQT

SEQ ID NO: 1571157 - protein, 28 aa, Staphylococcus aureus
KPVAPTKQKQSKKSELPETGGEESTNKG

SEQ ID NO: 1571158 - protein, 6 aa, Staphylococcus aureus
KQAPRI

SEQ ID NO: 1571159 - protein, 25 aa, Staphylococcus aureus
KQDYKNKKGDSVDSKRASTGNEYED

SEQ ID NO: 1571160 - protein, 18 aa, Staphylococcus aureus
KQGNAKEVIAESNQTTEL

SEQ ID NO: 1571161 - protein, 8 aa, Staphylococcus aureus
KQHGNQPD

SEQ ID NO: 1571162 - protein, 7 aa, Staphylococcus aureus
KQIDSAV

SEQ ID NO: 1571163 - protein, 12 aa, Staphylococcus aureus
KQINKSGKVTDY

SEQ ID NO: 1571164 - protein, 7 aa, Staphylococcus aureus
KQKQRGV

SEQ ID NO: 1571165 - protein, 28 aa, Staphylococcus aureus
KQLKEEKDNTKDKDKKKEIQKDIEKLEE

SEQ ID NO: 1571166 - protein, 23 aa, Staphylococcus aureus
KQPASSEKGSSGHHGNAAMPQTK

SEQ ID NO: 1571167 - protein, 9 aa, Staphylococcus aureus
KQPISTQQH

SEQ ID NO: 1571168 - protein, 10 aa, Staphylococcus aureus
KQPKGKVMKT

SEQ ID NO: 1571169 - protein, 26 aa, Staphylococcus aureus
KQQKEQPKRQSRSKRQSPGQGDRDFF

SEQ ID NO: 1571170 - protein, 5 aa, Staphylococcus aureus
KQRCD

SEQ ID NO: 1571171 - protein, 5 aa, Staphylococcus aureus
KQRGS

SEQ ID NO: 1571172 - protein, 8 aa, Staphylococcus aureus
KQSQQFSR

SEQ ID NO: 1571173 - protein, 125 aa, Staphylococcus aureus
KQYKDESKDHHSGKKGAAIGAGTAGVAGAMAASKAKKHSNDAQNKSNSGKANNSTEDKASQDKSKEHHNGKKGAAIGAGTAGLAGGAASKSASAASKPHASNNASQNHDEHDHHDRDKERKKGGM

SEQ ID NO: 1571174 - protein, 9 aa, Staphylococcus aureus
KRENGSELN

SEQ ID NO: 1571175 - protein, 38 aa, Staphylococcus aureus
KRERDINRDIDDAEQAKLNAQKLEEENKQKLKETQEEV

SEQ ID NO: 1571176 - protein, 20 aa, Staphylococcus aureus
KRERELDKEMKEKNAKNIKD

SEQ ID NO: 1571177 - protein, 5 aa, Staphylococcus aureus
KRESR

SEQ ID NO: 1571178 - protein, 9 aa, Staphylococcus aureus
KRGDHSPRE

SEQ ID NO: 1571179 - protein, 8 aa, Staphylococcus aureus
KRKRHEKS

SEQ ID NO: 1571180 - protein, 15 aa, Staphylococcus aureus
KRLTGVNKNISESNF

SEQ ID NO: 1571181 - protein, 5 aa, Staphylococcus aureus
KRRGS

SEQ ID NO: 1571182 - protein, 4 aa, Staphylococcus aureus
KRSF

SEQ ID NO: 1571183 - protein, 9 aa, Staphylococcus aureus
KRWAGKTKT

SEQ ID NO: 1571184 - protein, 16 aa, Staphylococcus aureus
KSAPELDKKGKDLTIE

SEQ ID NO: 1571185 - protein, 6 aa, Staphylococcus aureus
KSAVTE

SEQ ID NO: 1571186 - protein, 5 aa, Staphylococcus aureus
KSDSA

SEQ ID NO: 1571187 - protein, 8 aa, Staphylococcus aureus
KSEANNTG

SEQ ID NO: 1571188 - protein, 5 aa, Staphylococcus aureus
KSEQL

SEQ ID NO: 1571189 - protein, 6 aa, Staphylococcus aureus
KSEQLG

SEQ ID NO: 1571190 - protein, 17 aa, Staphylococcus aureus
KSEYEAEPPLFFFSGRL

SEQ ID NO: 1571191 - protein, 5 aa, Staphylococcus aureus
KSFER

SEQ ID NO: 1571192 - protein, 14 aa, Staphylococcus aureus
KSFSKAKKALEEKD

SEQ ID NO: 1571193 - protein, 10 aa, Staphylococcus aureus
KSGANSRLST

SEQ ID NO: 1571194 - protein, 11 aa, Staphylococcus aureus
KSGANSRLSTF

SEQ ID NO: 1571195 - protein, 7 aa, Staphylococcus aureus
KSGTANF

SEQ ID NO: 1571196 - protein, 191 aa, Staphylococcus aureus
KSHPEPIEDNDKHETIKDAENNTEHSTVSDKSEAEQSQQPKPYFATGANQANTSKDKHDDVTVKQDKDESKNHHSGKKGAVIGAGTAGVAGAAGAMGVSKAKKHSNDAQKKSNSGKANNSTEDKASQDKSKDHHNGKKGAAIGAGTAGLAGGAASKSASAASKPHASNNASQNHDEHDHHDRDKERKKGGM

SEQ ID NO: 1571197 - protein, 188 aa, Staphylococcus aureus
KSHPEPIEDNDKHETIKDAENNTEHSTVSDKSEAEQSQQPKPYFATGTNQANTSKDKHDDVTVKQDKDESKDQHSGKKGAAIGAGTAGAAGAMAASKAKKHSNDAQNKSNSGKANNSTEDKASEDKSKEHHNGKKGAAIGAGTAGLAGGAASKSASAASKPHASNNASQSHDEHDHHDRNKERKKGGM

SEQ ID NO: 1571198 - protein, 191 aa, Staphylococcus aureus
KSHPEPIEDNDKHETIKDAENNTEHSTVSDKSEAEQSQQPKPYFATGTNQANTSKDKHDDVTVKQDKDESKDQHSGKKGAAIGAGTAGVAGAAGAMAASKAKKHSNDAQNKSNSGKANNSTEDKASEDKSKEHHNGKKGAAIGAGTAGLAGGAASKSASAASKPHASNNASQSHDEHDHHDRDKERKKGGM

SEQ ID NO: 1571199 - protein, 191 aa, Staphylococcus aureus
KSHPEPIEDNDKHETIKEAENNTEHSTVSDKSEAEQSQQPKPYFATGANQANTSKDKHDDVTVKQDKDESKDHHSGKKGAAIGAGTAGVAGAAGAMGVSKAKKHSNDAQNKSNSDKSNNSTEDKASQDKSKDHHNGKKGAAIGAGTAGLAGGAASKSASAASKPHASNNASQNHDEHDNHDRDKERKKGGM

SEQ ID NO: 1571200 - protein, 62 aa, Staphylococcus aureus
KSHPEPIEDNDKHETVKDAENNTEHSTVSDKSEAEQSQQPKPYFATGANQANTSKDKHDDVT

SEQ ID NO: 1571201 - protein, 8 aa, Staphylococcus aureus
KSHSLTKT

SEQ ID NO: 1571202 - protein, 8 aa, Staphylococcus aureus
KSKAVHTK

SEQ ID NO: 1571203 - protein, 7 aa, Staphylococcus aureus
KSKERLI

SEQ ID NO: 1571204 - protein, 35 aa, Staphylococcus aureus
KSKFTEYDNKTDESIEKGKFDDEGGAAPNNNLRIV

SEQ ID NO: 1571205 - protein, 31 aa, Staphylococcus aureus
KSKFTEYDNKTDESIEKGKFEDEGGAAPNNN

SEQ ID NO: 1571206 - protein, 11 aa, Staphylococcus aureus
KSKKKKPFSTG

SEQ ID NO: 1571207 - protein, 7 aa, Staphylococcus aureus
KSKLTEE

SEQ ID NO: 1571208 - protein, 18 aa, Staphylococcus aureus
KSKNEQAALKAQQAAIKE

SEQ ID NO: 1571209 - protein, 60 aa, Staphylococcus aureus
KSKNEQAALKAQQAAIKEEASANNLSDTSQEAQEIQEAKKEAQAETDKSAAVSNEEPKAV

SEQ ID NO: 1571210 - protein, 61 aa, Staphylococcus aureus
KSKNEQAALKAQQAAIKEEASANNLSDTSQEAQEIQEAKKEAQAETDKSAEVSNKESKAVA

SEQ ID NO: 1571211 - protein, 93 aa, Staphylococcus aureus
KSKNEQAALKAQQAAIKEEASANNLSDTSQEAQEIQEAKREAQAEKDSDTLTKDASAAKVEVSKPESQAERLANAAKQKQAKLTPGSKESQLT

SEQ ID NO: 1571212 - protein, 201 aa, Staphylococcus aureus
KSKNEQAALKAQQAAIKEEASANNLSDTSQEAQEIQEAKREAQAETDKSAEVSNEKSKAAALKAQQAAIKEEASVNNLSDTTQEAQEIQETKKEAQVETDKSAAVSNEESKAAALKAQQAAIKEEASANNLSDTSQEAQEIQEAKKEAQAETDKSAAVSNEELKASTLNVSKEESQAERLANAAKQKQAKLTPGSKESQLT

SEQ ID NO: 1571213 - protein, 147 aa, Staphylococcus aureus
KSKNEQAALKAQQAAIKEEASANNLSDTSQEAQEIQEAKREAQTETDKSAAVSNEESKASALKAQQAAIKEEASANNLSDTSQEAQAIQEAKKEAQAETDKSADVSNEESKASTLNVSKEESQAERLANAAKQKQAKLTPGSKESQL

SEQ ID NO: 1571214 - protein, 63 aa, Staphylococcus aureus
KSKNEQAALKAQQAAIKEEASANNLSDTSQEAQEIQEAKSEAQAEADKSVAVSNEESKASALK

SEQ ID NO: 1571215 - protein, 93 aa, Staphylococcus aureus
KSKNEQAALKAQQAAIKEEASANNLSDTSQEAQEVQEAKKEAQAEKDSDTLTKDASAAKVEVSKPESQAERLANAAKQKQAKLTPGSKESQLT

SEQ ID NO: 1571216 - protein, 166 aa, Staphylococcus aureus
KSKNEQAALKAQQAAIKEEVSANNLSDTSQEAQEIQEAKKEAQAETDKSAAVSNEESKAAALKAQQAAIKEEASANNLSDTSQEAQEIQEAKKEAQAETDKSAAVSNEESKAAALKAQQAAIKEEASANNLSDTSQEAQEIQEAKREAQAETDKSVAVSNEESKAV

SEQ ID NO: 1571217 - protein, 60 aa, Staphylococcus aureus
KSKNEQAALKAQQAAIKEEVSANNLSDTSQEAQEIQEAKREAQAETDKSVAVSNEESKAV

SEQ ID NO: 1571218 - protein, 7 aa, Staphylococcus aureus
KSKSDDM

SEQ ID NO: 1571219 - protein, 15 aa, Staphylococcus aureus
KSKYKISESEYKNNR

SEQ ID NO: 1571220 - protein, 22 aa, Staphylococcus aureus
KSNIDKNKDHNTEYGSITDQYG

SEQ ID NO: 1571221 - protein, 6 aa, Staphylococcus aureus
KSNQSG

SEQ ID NO: 1571222 - protein, 6 aa, Staphylococcus aureus
KSNVAE

SEQ ID NO: 1571223 - protein, 7 aa, Staphylococcus aureus
KSRTEAM

SEQ ID NO: 1571224 - protein, 15 aa, Staphylococcus aureus
KSSDTAEKSKEDSKE

SEQ ID NO: 1571225 - protein, 21 aa, Staphylococcus aureus
KSSDTSEKPKEDSKEAQIKKS

SEQ ID NO: 1571226 - protein, 21 aa, Staphylococcus aureus
KSSDTSEKSKGDSKEAQIKKS

SEQ ID NO: 1571227 - protein, 17 aa, Staphylococcus aureus
KSYAKNPKETKDSYISG

SEQ ID NO: 1571228 - protein, 12 aa, Staphylococcus aureus
KTAHIQSTGCNA

SEQ ID NO: 1571229 - protein, 18 aa, Staphylococcus aureus
KTANEKFEEQIKKETYDN

SEQ ID NO: 1571230 - protein, 7 aa, Staphylococcus aureus
KTEISGQ

SEQ ID NO: 1571231 - protein, 6 aa, Staphylococcus aureus
KTETDY

SEQ ID NO: 1571232 - protein, 5 aa, Staphylococcus aureus
KTETV

SEQ ID NO: 1571233 - protein, 6 aa, Staphylococcus aureus
KTEVTA

SEQ ID NO: 1571234 - protein, 65 aa, Staphylococcus aureus
KTFAEEPQEPKIEKGKNDEFNTMSSNLDKEISRISEKSKQLLSDTQESKTIADSVSGQLNQLDNN

SEQ ID NO: 1571235 - protein, 15 aa, Staphylococcus aureus
KTFPPKKDGDKEKVV

SEQ ID NO: 1571236 - protein, 28 aa, Staphylococcus aureus
KTFTSELGSTLTDGFNDSLTPSVDGHMT

SEQ ID NO: 1571237 - protein, 12 aa, Staphylococcus aureus
KTGENETKNDYK

SEQ ID NO: 1571238 - protein, 12 aa, Staphylococcus aureus
KTGNASQREELA

SEQ ID NO: 1571239 - protein, 9 aa, Staphylococcus aureus
KTGPTMTRP

SEQ ID NO: 1571240 - protein, 18 aa, Staphylococcus aureus
KTGSSGGGKTTKESHAER

SEQ ID NO: 1571241 - protein, 11 aa, Staphylococcus aureus
KTGTESKKESY

SEQ ID NO: 1571242 - protein, 7 aa, Staphylococcus aureus
KTHSIEP

SEQ ID NO: 1571243 - protein, 4 aa, Staphylococcus aureus
KTIH

SEQ ID NO: 1571244 - protein, 7 aa, Staphylococcus aureus
KTKEFQN

SEQ ID NO: 1571245 - protein, 7 aa, Staphylococcus aureus
KTLVGGN

SEQ ID NO: 1571246 - protein, 10 aa, Staphylococcus aureus
KTNGRNAQIK

SEQ ID NO: 1571247 - protein, 14 aa, Staphylococcus aureus
KTNGRNAQIKDTFN

SEQ ID NO: 1571248 - protein, 8 aa, Staphylococcus aureus
KTNNNNVV

SEQ ID NO: 1571249 - protein, 4 aa, Staphylococcus aureus
KTPA

SEQ ID NO: 1571250 - protein, 22 aa, Staphylococcus aureus
KTPGREDKVAAQQVEATERAQT

SEQ ID NO: 1571251 - protein, 13 aa, Staphylococcus aureus
KTPIKQTRKDEIG

SEQ ID NO: 1571252 - protein, 4 aa, Staphylococcus aureus
KTPT

SEQ ID NO: 1571253 - protein, 8 aa, Staphylococcus aureus
KTSEAENN

SEQ ID NO: 1571254 - protein, 25 aa, Staphylococcus aureus
KTSKVTQTDNQQDFSNDSTDEADTS

SEQ ID NO: 1571255 - protein, 25 aa, Staphylococcus aureus
KTSKVTQTDNQQDVSNDSTDEEDTS

SEQ ID NO: 1571256 - protein, 7 aa, Staphylococcus aureus
KTSKYSL

SEQ ID NO: 1571257 - protein, 8 aa, Staphylococcus aureus
KTTKATVE

SEQ ID NO: 1571258 - protein, 9 aa, Staphylococcus aureus
KTTNHDHNG

SEQ ID NO: 1571259 - protein, 15 aa, Staphylococcus aureus
KTVEIGKADTTSNKF

SEQ ID NO: 1571260 - protein, 25 aa, Staphylococcus aureus
KTVQTNGNQTITSTLNGEQTSKELD

SEQ ID NO: 1571261 - protein, 59 aa, Staphylococcus aureus
KVAQSSTTNDEQPASQNVNTKKDSATAATTQPDKEEGKHKQNESQSANKNGNDNRAAHL

SEQ ID NO: 1571262 - protein, 19 aa, Staphylococcus aureus
KVDQQRKKQQQKVGIRRQF

SEQ ID NO: 1571263 - protein, 29 aa, Staphylococcus aureus
KVDQVNTDKAQPNYTEASTDKKEAVDQAL

SEQ ID NO: 1571264 - protein, 12 aa, Staphylococcus aureus
KVDSNSYRNASG

SEQ ID NO: 1571265 - protein, 14 aa, Staphylococcus aureus
KVEPSNDFKTKKGD

SEQ ID NO: 1571266 - protein, 9 aa, Staphylococcus aureus
KVERQTLST

SEQ ID NO: 1571267 - protein, 10 aa, Staphylococcus aureus
KVKKGDTMTI

SEQ ID NO: 1571268 - protein, 103 aa, Staphylococcus aureus
KVKPTVTTTSKVEDNHSTKVVSTDTTKDQTKTQTAHTVKTAQTAQEQNKVQTPVKDVASAKSESNNQAVSDNKSQQTNKVTKQNESPKQASKAKELPKTGLTS

SEQ ID NO: 1571269 - protein, 103 aa, Staphylococcus aureus
KVKPTVTTTSKVEDNHSTKVVSTDTTKDQTKTQTAHTVKTAQTAQEQNKVQTPVKDVATAKSESNNQAVSYNKSQQTNKVTKHNETPKQASKAKELPKTGLTS

SEQ ID NO: 1571270 - protein, 103 aa, Staphylococcus aureus
KVKPTVTTTSKVEDNYSTKVVSTDTTKDQTKTQTAHTVKTAQTAQEQNKVQTPVKDVATAKSESNNQAVSDNKSQQTNKVTKHNETPKQASKAKELPKTGLTS

SEQ ID NO: 1571271 - protein, 13 aa, Staphylococcus aureus
KVMDPAKQTASGK

SEQ ID NO: 1571272 - protein, 45 aa, Staphylococcus aureus
KVQHDDAKEVPSKHQNQENNKDKLKKDIDDKKDSQKSDIKERRTS

SEQ ID NO: 1571273 - protein, 12 aa, Staphylococcus aureus
KVSDKRSKTRGY

SEQ ID NO: 1571274 - protein, 5 aa, Staphylococcus aureus
KVTNT

SEQ ID NO: 1571275 - protein, 79 aa, Staphylococcus aureus
KVVKDEDSEFNDGKFGKSYEEIRKEQLEDGQRDESEDRKEEKDIAEDKKEADKSDEKDEPAHQQAPNIEKPYDPNHPDN

SEQ ID NO: 1571276 - protein, 4 aa, Staphylococcus aureus
KYEA

SEQ ID NO: 1571277 - protein, 13 aa, Staphylococcus aureus
KYEETPDVIGKSV

SEQ ID NO: 1571278 - protein, 9 aa, Staphylococcus aureus
KYEGTPDVI

SEQ ID NO: 1571279 - protein, 12 aa, Staphylococcus aureus
KYFKDNQKESMG

SEQ ID NO: 1571280 - protein, 6 aa, Staphylococcus aureus
KYPLNQ

SEQ ID NO: 1571281 - protein, 11 aa, Staphylococcus aureus
KYTKQTSLEKH

SEQ ID NO: 1571282 - protein, 13 aa, Staphylococcus aureus
KYTPGAEDDLEVQ

SEQ ID NO: 1571283 - protein, 6 aa, Staphylococcus aureus
LADKYG

SEQ ID NO: 1571284 - protein, 48 aa, Staphylococcus aureus
LAEKDNTKRSVNYTDADQPKQQAYDTAVTQAEAITNANGSNANETTVQ

SEQ ID NO: 1571285 - protein, 9 aa, Staphylococcus aureus
LAKKTSNHN

SEQ ID NO: 1571286 - protein, 12 aa, Staphylococcus aureus
LANDDKTVGEAL

SEQ ID NO: 1571287 - protein, 5 aa, Staphylococcus aureus
LANDH

SEQ ID NO: 1571288 - protein, 21 aa, Staphylococcus aureus
LANPSIQAVKEDTKAPKEEKI

SEQ ID NO: 1571289 - protein, 7 aa, Staphylococcus aureus
LAPAGMG

SEQ ID NO: 1571290 - protein, 11 aa, Staphylococcus aureus
LAPIPGGNGSI

SEQ ID NO: 1571291 - protein, 4 aa, Staphylococcus aureus
LASG

SEQ ID NO: 1571292 - protein, 7 aa, Staphylococcus aureus
LATEDNR

SEQ ID NO: 1571293 - protein, 11 aa, Staphylococcus aureus
LDDANKFEDVT

SEQ ID NO: 1571294 - protein, 10 aa, Staphylococcus aureus
LDDGQTNQHA

SEQ ID NO: 1571295 - protein, 11 aa, Staphylococcus aureus
LDEKAKGQQVK

SEQ ID NO: 1571296 - protein, 6 aa, Staphylococcus aureus
LDEKYP

SEQ ID NO: 1571297 - protein, 12 aa, Staphylococcus aureus
LDGSAKLNNMTS

SEQ ID NO: 1571298 - protein, 22 aa, Staphylococcus aureus
LDKDGTAFSVGSTGNYEEQSKR

SEQ ID NO: 1571299 - protein, 19 aa, Staphylococcus aureus
LDKNEYEAEPPLFSFSGSL

SEQ ID NO: 1571300 - protein, 19 aa, Staphylococcus aureus
LDKNEYEAKPPLFFFSGSL

SEQ ID NO: 1571301 - protein, 19 aa, Staphylococcus aureus
LDKSDYEAEPPLFFFSGSM

SEQ ID NO: 1571302 - protein, 8 aa, Staphylococcus aureus
LDKSDYVA

SEQ ID NO: 1571303 - protein, 19 aa, Staphylococcus aureus
LDKSEYEADPPLFFFSGPI

SEQ ID NO: 1571304 - protein, 5 aa, Staphylococcus aureus
LDNDA

SEQ ID NO: 1571305 - protein, 9 aa, Staphylococcus aureus
LDNPQKKDL

SEQ ID NO: 1571306 - protein, 7 aa, Staphylococcus aureus
LDPKSGV

SEQ ID NO: 1571307 - protein, 9 aa, Staphylococcus aureus
LDQTTTSKS

SEQ ID NO: 1571308 - protein, 32 aa, Staphylococcus aureus
LDSSSESDKSDSITDKDEENHEKAKEQTNGNY

SEQ ID NO: 1571309 - protein, 7 aa, Staphylococcus aureus
LDTSRKP

SEQ ID NO: 1571310 - protein, 7 aa, Staphylococcus aureus
LEASKSQ

SEQ ID NO: 1571311 - protein, 4 aa, Staphylococcus aureus
LEGG

SEQ ID NO: 1571312 - protein, 41 aa, Staphylococcus aureus
LEGTAVSSKSGKQLTKMSASKGSGHEKQLPKTGTDQSSSPA

SEQ ID NO: 1571313 - protein, 10 aa, Staphylococcus aureus
LEKETSNTGI

SEQ ID NO: 1571314 - protein, 4 aa, Staphylococcus aureus
LEKG

SEQ ID NO: 1571315 - protein, 17 aa, Staphylococcus aureus
LENYKDGEVTYNPEAPI

SEQ ID NO: 1571316 - protein, 12 aa, Staphylococcus aureus
LETKGKIDYPDV

SEQ ID NO: 1571317 - protein, 4 aa, Staphylococcus aureus
LGAA

SEQ ID NO: 1571318 - protein, 7 aa, Staphylococcus aureus
LGGLSGS

SEQ ID NO: 1571319 - protein, 6 aa, Staphylococcus aureus
LGGQDN

SEQ ID NO: 1571320 - protein, 11 aa, Staphylococcus aureus
LGNPEASDDAV

SEQ ID NO: 1571321 - protein, 15 aa, Staphylococcus aureus
LGNRGNNNKIYADED

SEQ ID NO: 1571322 - protein, 4 aa, Staphylococcus aureus
LGRE

SEQ ID NO: 1571323 - protein, 9 aa, Staphylococcus aureus
LGTDQVAKV

SEQ ID NO: 1571324 - protein, 8 aa, Staphylococcus aureus
LGTQQELD

SEQ ID NO: 1571325 - protein, 22 aa, Staphylococcus aureus
LGTSGHTLGVAPAKELGPVEES

SEQ ID NO: 1571326 - protein, 10 aa, Staphylococcus aureus
LGYSESNSFV

SEQ ID NO: 1571327 - protein, 4 aa, Staphylococcus aureus
LIDD

SEQ ID NO: 1571328 - protein, 9 aa, Staphylococcus aureus
LIEQGTRES

SEQ ID NO: 1571329 - protein, 27 aa, Staphylococcus aureus
LKDGGRNNHAQRTVGGEDRLPDDDGGH

SEQ ID NO: 1571330 - protein, 12 aa, Staphylococcus aureus
LKDSNDVKINDA

SEQ ID NO: 1571331 - protein, 13 aa, Staphylococcus aureus
LKEKNKSINIENQ

SEQ ID NO: 1571332 - protein, 20 aa, Staphylococcus aureus
LKENIGKNGVCSNYSPDYVN

SEQ ID NO: 1571333 - protein, 18 aa, Staphylococcus aureus
LKGDTKLNDSSKKVTIND

SEQ ID NO: 1571334 - protein, 18 aa, Staphylococcus aureus
LKGDTKLSDSSKKVTIND

SEQ ID NO: 1571335 - protein, 5 aa, Staphylococcus aureus
LKGKN

SEQ ID NO: 1571336 - protein, 27 aa, Staphylococcus aureus
LKHQVEQAQNVAGVNGVKDKGNTLNTS

SEQ ID NO: 1571337 - protein, 14 aa, Staphylococcus aureus
LKISDKKSKTRGYA

SEQ ID NO: 1571338 - protein, 8 aa, Staphylococcus aureus
LKKQADNM

SEQ ID NO: 1571339 - protein, 9 aa, Staphylococcus aureus
LKNHAKDAI

SEQ ID NO: 1571340 - protein, 9 aa, Staphylococcus aureus
LKNSDYNVE

SEQ ID NO: 1571341 - protein, 25 aa, Staphylococcus aureus
LKNTVTPTKVEENEAIQEDQVQYEN

SEQ ID NO: 1571342 - protein, 8 aa, Staphylococcus aureus
LKPQHSDV

SEQ ID NO: 1571343 - protein, 6 aa, Staphylococcus aureus
LKQDGK

SEQ ID NO: 1571344 - protein, 8 aa, Staphylococcus aureus
LKSHDRNI

SEQ ID NO: 1571345 - protein, 50 aa, Staphylococcus aureus
LKTEMAQKSSTEQNGNRNHDIEGNVEDIAEGRLDEVQNSDSKLNQKNKRI

SEQ ID NO: 1571346 - protein, 18 aa, Staphylococcus aureus
LKTEVAQKSSTEQNDNCN

SEQ ID NO: 1571347 - protein, 19 aa, Staphylococcus aureus
LKYHNKKKGDSEMKLNEKE

SEQ ID NO: 1571348 - protein, 6 aa, Staphylococcus aureus
LLPKGS

SEQ ID NO: 1571349 - protein, 11 aa, Staphylococcus aureus
LMDGTKDPKVI

SEQ ID NO: 1571350 - protein, 95 aa, Staphylococcus aureus
LNDAQAPKEEDNKKPGKEDGNKPGKEDGNKPGKEDNKKPGKEDGNKPGKEDNNKPGKEDGNKPGKEDNNKPGKEDGNKPGKEDGNKPGKEDGNGV

SEQ ID NO: 1571351 - protein, 87 aa, Staphylococcus aureus
LNDAQAPKEEDNNKPGKEDNNKPGKEDGNKPGKEDNKKPGKEDGNKPGKEDNKKPGKEDGNKPGKEDGNKPGKEDGNKPGKEDGNGV

SEQ ID NO: 1571352 - protein, 95 aa, Staphylococcus aureus
LNDAQAPKEEDNNKPGKEDNNKPGKEDNNKPGKEDNNKPGKEDGNKPGKEDNKKPGKEDGNKPGKEDNKKPGKEDGNKPGKEDGNKPGKEDGNGV

SEQ ID NO: 1571353 - protein, 10 aa, Staphylococcus aureus
LNEDESNKYE

SEQ ID NO: 1571354 - protein, 4 aa, Staphylococcus aureus
LNET

SEQ ID NO: 1571355 - protein, 15 aa, Staphylococcus aureus
LNGTIEESNDSKPID

SEQ ID NO: 1571356 - protein, 7 aa, Staphylococcus aureus
LNGYDEE

SEQ ID NO: 1571357 - protein, 4 aa, Staphylococcus aureus
LNHD

SEQ ID NO: 1571358 - protein, 10 aa, Staphylococcus aureus
LNKKGSGSVL

SEQ ID NO: 1571359 - protein, 13 aa, Staphylococcus aureus
LNLEGTSGRGPIY

SEQ ID NO: 1571360 - protein, 17 aa, Staphylococcus aureus
LNNAQRQNLQSQINGAH

SEQ ID NO: 1571361 - protein, 16 aa, Staphylococcus aureus
LNNAQRQNLQSQINSA

SEQ ID NO: 1571362 - protein, 17 aa, Staphylococcus aureus
LNNAQRQNLQSQINSAH

SEQ ID NO: 1571363 - protein, 13 aa, Staphylococcus aureus
LNNEQKMQSNRLK

SEQ ID NO: 1571364 - protein, 8 aa, Staphylococcus aureus
LNNETNNV

SEQ ID NO: 1571365 - protein, 8 aa, Staphylococcus aureus
LNNKKELT

SEQ ID NO: 1571366 - protein, 6 aa, Staphylococcus aureus
LNNYAN

SEQ ID NO: 1571367 - protein, 11 aa, Staphylococcus aureus
LNQSRNFAQNT

SEQ ID NO: 1571368 - protein, 4 aa, Staphylococcus aureus
LNRA

SEQ ID NO: 1571369 - protein, 8 aa, Staphylococcus aureus
LNSDSRKI

SEQ ID NO: 1571370 - protein, 8 aa, Staphylococcus aureus
LNSDSRKV

SEQ ID NO: 1571371 - protein, 5 aa, Staphylococcus aureus
LNTAS

SEQ ID NO: 1571372 - protein, 21 aa, Staphylococcus aureus
LNTPQKAKLKEQVGQANRLED

SEQ ID NO: 1571373 - protein, 9 aa, Staphylococcus aureus
LNVQPTNNA

SEQ ID NO: 1571374 - protein, 5 aa, Staphylococcus aureus
LPASL

SEQ ID NO: 1571375 - protein, 21 aa, Staphylococcus aureus
LPDSVNGNGDVDYSNSNNTMP

SEQ ID NO: 1571376 - protein, 14 aa, Staphylococcus aureus
LPEEHGQAQGPIEE

SEQ ID NO: 1571377 - protein, 16 aa, Staphylococcus aureus
LPEEHGQAQGPIEEIT

SEQ ID NO: 1571378 - protein, 15 aa, Staphylococcus aureus
LPGQGQTSRANKGQI

SEQ ID NO: 1571379 - protein, 96 aa, Staphylococcus aureus
LPKVSGQNEGQQTIEEDTTPPTPPTPEVPSEPETPTPPTPEVPSEPETPTPPTPEVPSEPETPTPPTPEVPAEPGKPVPPAKEEPKKPSKPVEQGK

SEQ ID NO: 1571380 - protein, 18 aa, Staphylococcus aureus
LPLSDSPKISKSLGTRHR

SEQ ID NO: 1571381 - protein, 45 aa, Staphylococcus aureus
LPNHDKAAPTSTTPPSNDKTAPKSTKAQDATTDKHPNQQDTHQPA

SEQ ID NO: 1571382 - protein, 5 aa, Staphylococcus aureus
LPSKE

SEQ ID NO: 1571383 - protein, 9 aa, Staphylococcus aureus
LPSTPNKAL

SEQ ID NO: 1571384 - protein, 7 aa, Staphylococcus aureus
LQDNEHS

SEQ ID NO: 1571385 - protein, 6 aa, Staphylococcus aureus
LQKTMQ

SEQ ID NO: 1571386 - protein, 6 aa, Staphylococcus aureus
LQNPLA

SEQ ID NO: 1571387 - protein, 7 aa, Staphylococcus aureus
LQPKGTF

SEQ ID NO: 1571388 - protein, 6 aa, Staphylococcus aureus
LQQDKI

SEQ ID NO: 1571389 - protein, 11 aa, Staphylococcus aureus
LREITKDSKIQ

SEQ ID NO: 1571390 - protein, 8 aa, Staphylococcus aureus
LRKTETYI

SEQ ID NO: 1571391 - protein, 7 aa, Staphylococcus aureus
LRTQEKI

SEQ ID NO: 1571392 - protein, 18 aa, Staphylococcus aureus
LSDGDGAVCKSTGGKDIK

SEQ ID NO: 1571393 - protein, 19 aa, Staphylococcus aureus
LSDKDSAVCKSKGGKDIKF

SEQ ID NO: 1571394 - protein, 13 aa, Staphylococcus aureus
LSDRRQLSDDITM

SEQ ID NO: 1571395 - protein, 9 aa, Staphylococcus aureus
LSGNSTFKT

SEQ ID NO: 1571396 - protein, 11 aa, Staphylococcus aureus
LSKETTNDNTL

SEQ ID NO: 1571397 - protein, 15 aa, Staphylococcus aureus
LSKYKDGDISYNPEV

SEQ ID NO: 1571398 - protein, 9 aa, Staphylococcus aureus
LSLSPQKLG

SEQ ID NO: 1571399 - protein, 7 aa, Staphylococcus aureus
LSPSIEG

SEQ ID NO: 1571400 - protein, 60 aa, Staphylococcus aureus
LSQPPKELSRHSQSFNKDIQSSYDKDIEKRRIQTGEDKPYQPRSHENEPTFKRNSQTKHV

SEQ ID NO: 1571401 - protein, 10 aa, Staphylococcus aureus
LSRASERSQT

SEQ ID NO: 1571402 - protein, 7 aa, Staphylococcus aureus
LSRNKSQ

SEQ ID NO: 1571403 - protein, 8 aa, Staphylococcus aureus
LSSGKQQF

SEQ ID NO: 1571404 - protein, 16 aa, Staphylococcus aureus
LSSIENDEKDTHKIYS

SEQ ID NO: 1571405 - protein, 13 aa, Staphylococcus aureus
LSSISDDDSVNLN

SEQ ID NO: 1571406 - protein, 38 aa, Staphylococcus aureus
LSSSANASQTDNGVNRSGYEDPTVYSATSTKKLHKEPA

SEQ ID NO: 1571407 - protein, 7 aa, Staphylococcus aureus
LSTEDNR

SEQ ID NO: 1571408 - protein, 106 aa, Staphylococcus aureus
LSTSVSTSESGSTSESTSESDSTSTSLSDSQSTSRSTSASGSASTSTSTSDSRSTSASTSTSMRTSTSDSQSMSLSTSTSTSVSDSTSLSDSFSDSTSDSTSMSIS

SEQ ID NO: 1571409 - protein, 106 aa, Staphylococcus aureus
LSTSVSTSESGSTSESTSESDSTSTSLSDSQSTSRSTSASGSASTSTSTSDSRSTSASTSTSMRTSTSDSQSMSLSTSTSTSVSDSTSLSDSVSDSTSDSTSMSIS

SEQ ID NO: 1571410 - protein, 14 aa, Staphylococcus aureus
LSTTGGNSGSPVFN

SEQ ID NO: 1571411 - protein, 11 aa, Staphylococcus aureus
LSVQDNGSYSL

SEQ ID NO: 1571412 - protein, 6 aa, Staphylococcus aureus
LSYDAT

SEQ ID NO: 1571413 - protein, 10 aa, Staphylococcus aureus
LSYTGDGGYS

SEQ ID NO: 1571414 - protein, 6 aa, Staphylococcus aureus
LTAPAS

SEQ ID NO: 1571415 - protein, 13 aa, Staphylococcus aureus
LTDDNFKKPLQND

SEQ ID NO: 1571416 - protein, 5 aa, Staphylococcus aureus
LTENN

SEQ ID NO: 1571417 - protein, 36 aa, Staphylococcus aureus
LTIEGQYEAENDYKKWSNENKKSLDNYNHDKVSPYS

SEQ ID NO: 1571418 - protein, 35 aa, Staphylococcus aureus
LTIRDAEDKVKLSGSDIKQGSAKQEFKQETNQPTV

SEQ ID NO: 1571419 - protein, 12 aa, Staphylococcus aureus
LTKSDNKNGSLA

SEQ ID NO: 1571420 - protein, 8 aa, Staphylococcus aureus
LTNDDYNV

SEQ ID NO: 1571421 - protein, 6 aa, Staphylococcus aureus
LTNGKS

SEQ ID NO: 1571422 - protein, 5 aa, Staphylococcus aureus
LTNQN

SEQ ID NO: 1571423 - protein, 7 aa, Staphylococcus aureus
LTPAQQQ

SEQ ID NO: 1571424 - protein, 16 aa, Staphylococcus aureus
LTVSPSKIEDGGKTTV

SEQ ID NO: 1571425 - protein, 105 aa, Staphylococcus aureus
LVKSDTNDAVASNDQSSSDASNQTNTNTSNQNASTTNNTSDQPQATTNMSQPAQPKASANSDQASSQPAHETNSNDNTNDATNASSNQSNGNQQYPPADESLQDA

SEQ ID NO: 1571426 - protein, 106 aa, Staphylococcus aureus
LVKSDTNDAVATNDQSSSDASNQTNTNTSNQNTSTTNNTNDQPQATNNMSQPAQPKASANSDQASSQPAHETNSNDNTNDVTNASSNQSNGNQQYPPADESLQDAI

SEQ ID NO: 1571427 - protein, 106 aa, Staphylococcus aureus
LVKSDTNDAVVTNDQSSSDASNQTNTNTSNQNTSTINNANNQPQATTNMSQPAQPKSSANADQASSQPAHETNSNGNTNDKTNESSNQSDVNQQYPPADESLQDAI

SEQ ID NO: 1571428 - protein, 106 aa, Staphylococcus aureus
LVKSDTNDAVVTNDQSSSDASNQTNTNTSNQNTSTTNNANNQPQATTNMSQPAQPKSSANADQASSQPAHETNSNGNTNDKTNESSNQSDVNQQYPPADESLQDAI

SEQ ID NO: 1571429 - protein, 105 aa, Staphylococcus aureus
LVKSDTNDAVVTNDQSSSNASNQTNTNTSNQNTSTTNNANDQSQATTNMSQPAQPKSSANADQASSQPAHETNSNGNNSDASNTSSNQSNGNQQYPPADESLQDA

SEQ ID NO: 1571430 - protein, 35 aa, Staphylococcus aureus
LVKSDTNDAVVTNDQSSSVASNQTNTNTSNQNTSM

SEQ ID NO: 1571431 - protein, 36 aa, Staphylococcus aureus
LVKSDTNDAVVTNDQSSSVASNQTNTNTSNQNTSMI

SEQ ID NO: 1571432 - protein, 18 aa, Staphylococcus aureus
LVNKRKQAKQQIQATPTH

SEQ ID NO: 1571433 - protein, 11 aa, Staphylococcus aureus
LYGADSEDITR

SEQ ID NO: 1571434 - protein, 6 aa, Staphylococcus aureus
LYQTRN

SEQ ID NO: 1571435 - protein, 14 aa, Staphylococcus aureus
LYRKSTDEDIQTNN

SEQ ID NO: 1571436 - protein, 36 aa, Staphylococcus aureus
MDTQIAKDTDRNVDNSVGMSSNVDTDKDSNKNKDKV

SEQ ID NO: 1571437 - protein, 13 aa, Staphylococcus aureus
MEEQGTTKDFEKD

SEQ ID NO: 1571438 - protein, 26 aa, Staphylococcus aureus
MGAKTGTGTYGAKTYSQYNLPDNAAK

SEQ ID NO: 1571439 - protein, 7 aa, Staphylococcus aureus
MGGQAGG

SEQ ID NO: 1571440 - protein, 5 aa, Staphylococcus aureus
MGGQT

SEQ ID NO: 1571441 - protein, 10 aa, Staphylococcus aureus
MGPNTEAVTN

SEQ ID NO: 1571442 - protein, 8 aa, Staphylococcus aureus
MGPNTENF

SEQ ID NO: 1571443 - protein, 7 aa, Staphylococcus aureus
MHEEKQK

SEQ ID NO: 1571444 - protein, 8 aa, Staphylococcus aureus
MKDNTNKL

SEQ ID NO: 1571445 - protein, 14 aa, Staphylococcus aureus
MKQGETGRQIGWFI

SEQ ID NO: 1571446 - protein, 13 aa, Staphylococcus aureus
MLPKTGETTSSQS

SEQ ID NO: 1571447 - protein, 7 aa, Staphylococcus aureus
MNANGKL

SEQ ID NO: 1571448 - protein, 9 aa, Staphylococcus aureus
MNKPNAAKV

SEQ ID NO: 1571449 - protein, 17 aa, Staphylococcus aureus
MNKSKRIDNKLKGDDEN

SEQ ID NO: 1571450 - protein, 19 aa, Staphylococcus aureus
MNNARKSKGLNTLSSKNAL

SEQ ID NO: 1571451 - protein, 18 aa, Staphylococcus aureus
MNTREKSHGFPHSSDMSQ

SEQ ID NO: 1571452 - protein, 10 aa, Staphylococcus aureus
MPKSQIPNIN

SEQ ID NO: 1571453 - protein, 15 aa, Staphylococcus aureus
MPSKVDAKASTKQGD

SEQ ID NO: 1571454 - protein, 9 aa, Staphylococcus aureus
MQDNSDHNH

SEQ ID NO: 1571455 - protein, 5 aa, Staphylococcus aureus
MQNRY

SEQ ID NO: 1571456 - protein, 7 aa, Staphylococcus aureus
MRTAQRM

SEQ ID NO: 1571457 - protein, 7 aa, Staphylococcus aureus
MSDNALN

SEQ ID NO: 1571458 - protein, 27 aa, Staphylococcus aureus
MSQSTSGSTSTSTSTSLSDSTSTSLSL

SEQ ID NO: 1571459 - protein, 14 aa, Staphylococcus aureus
MSTEQLEVPRTKNN

SEQ ID NO: 1571460 - protein, 11 aa, Staphylococcus aureus
MTDDQVTPTSV

SEQ ID NO: 1571461 - protein, 16 aa, Staphylococcus aureus
MTKEEIEQAKAQLAQA

SEQ ID NO: 1571462 - protein, 21 aa, Staphylococcus aureus
MTREELKGTKEVQEKQKDQMI

SEQ ID NO: 1571463 - protein, 14 aa, Staphylococcus aureus
MYEEQRNKKYKRRN

SEQ ID NO: 1571464 - protein, 4 aa, Staphylococcus aureus
NAAK

SEQ ID NO: 1571465 - protein, 7 aa, Staphylococcus aureus
NAAKQHL

SEQ ID NO: 1571466 - protein, 12 aa, Staphylococcus aureus
NAAPNHAAPNHA

SEQ ID NO: 1571467 - protein, 10 aa, Staphylococcus aureus
NAASQSMSAT

SEQ ID NO: 1571468 - protein, 13 aa, Staphylococcus aureus
NADKNNHTGKAAK

SEQ ID NO: 1571469 - protein, 46 aa, Staphylococcus aureus
NADQASSQPAHETNSNGNTNDKTNESSNQSDVNQQYPPADESLQDA

SEQ ID NO: 1571470 - protein, 47 aa, Staphylococcus aureus
NADQASSQPAHETNSNGNTNDKTNESSNQSDVNQQYPPADESLQDAI

SEQ ID NO: 1571471 - protein, 6 aa, Staphylococcus aureus
NADSRK

SEQ ID NO: 1571472 - protein, 5 aa, Staphylococcus aureus
NAEFR

SEQ ID NO: 1571473 - protein, 6 aa, Staphylococcus aureus
NAGDSN

SEQ ID NO: 1571474 - protein, 10 aa, Staphylococcus aureus
NAIAAPGPLS

SEQ ID NO: 1571475 - protein, 7 aa, Staphylococcus aureus
NAIATKT

SEQ ID NO: 1571476 - protein, 8 aa, Staphylococcus aureus
NAKGQIKE

SEQ ID NO: 1571477 - protein, 19 aa, Staphylococcus aureus
NALNGDQNLANAKDKANAL

SEQ ID NO: 1571478 - protein, 69 aa, Staphylococcus aureus
NANNQPQATTNMSQPAQPKSSTNADQASSQPAHETNSNGNTNDKTNESSNQSDVNQQYPPADESLQDAI

SEQ ID NO: 1571479 - protein, 32 aa, Staphylococcus aureus
NANVTSNNGAVNPSVKANDTHTKSNKQMAKQQ

SEQ ID NO: 1571480 - protein, 16 aa, Staphylococcus aureus
NAPQAKAESNINGSNA

SEQ ID NO: 1571481 - protein, 16 aa, Staphylococcus aureus
NAQQQINSAKTEAQQV

SEQ ID NO: 1571482 - protein, 33 aa, Staphylococcus aureus
NAQRTDLEGQNNQATTVDGVNTVKTNANTLDGA

SEQ ID NO: 1571483 - protein, 13 aa, Staphylococcus aureus
NASVEELEKAGAF

SEQ ID NO: 1571484 - protein, 24 aa, Staphylococcus aureus
NATKQTQKYRDAEQSKKTAYDQAV

SEQ ID NO: 1571485 - protein, 6 aa, Staphylococcus aureus
NAVQAT

SEQ ID NO: 1571486 - protein, 9 aa, Staphylococcus aureus
NAYSQKGAI

SEQ ID NO: 1571487 - protein, 6 aa, Staphylococcus aureus
NDAVRD

SEQ ID NO: 1571488 - protein, 32 aa, Staphylococcus aureus
NDDEETNHTEAEKSSSNIKDVEKTGVATASTI

SEQ ID NO: 1571489 - protein, 61 aa, Staphylococcus aureus
NDDEETNHTRAEKSSSNIKDAEKTGVSTASTVGIAKSDTENTVADEPSIHEGTEKTEPQHH

SEQ ID NO: 1571490 - protein, 9 aa, Staphylococcus aureus
NDDNTTVFK

SEQ ID NO: 1571491 - protein, 7 aa, Staphylococcus aureus
NDDVSKH

SEQ ID NO: 1571492 - protein, 5 aa, Staphylococcus aureus
NDELE

SEQ ID NO: 1571493 - protein, 5 aa, Staphylococcus aureus
NDFSE

SEQ ID NO: 1571494 - protein, 10 aa, Staphylococcus aureus
NDGSPISPQV

SEQ ID NO: 1571495 - protein, 99 aa, Staphylococcus aureus
NDIPVQKDKVQQNSNKKIENERPKASSTLRVENSSPTVKKVENNHKEQPKHKDEKSKKEKKKVVEKEKALPAFNRDDDSKNSSQLSSDIKELDEPNHKK

SEQ ID NO: 1571496 - protein, 4 aa, Staphylococcus aureus
NDIY

SEQ ID NO: 1571497 - protein, 6 aa, Staphylococcus aureus
NDKIAT

SEQ ID NO: 1571498 - protein, 7 aa, Staphylococcus aureus
NDKTNTF

SEQ ID NO: 1571499 - protein, 11 aa, Staphylococcus aureus
NDMSPSLNKGD

SEQ ID NO: 1571500 - protein, 22 aa, Staphylococcus aureus
NDMSQTAATKHGEKDNKNDEAM

SEQ ID NO: 1571501 - protein, 21 aa, Staphylococcus aureus
NDMSQTATTKHGEKDDKNDEV

SEQ ID NO: 1571502 - protein, 10 aa, Staphylococcus aureus
NDNKDSIKRD

SEQ ID NO: 1571503 - protein, 57 aa, Staphylococcus aureus
NDNSTINQSSKTQLTQKDENKNEDKPEEKSETATDEDLQSTEEVPANENTENNQHEI

SEQ ID NO: 1571504 - protein, 47 aa, Staphylococcus aureus
NDQAEAAENNTTQKQDDSSDASKVKGNVQTIEQSSANSNESDIPEQV

SEQ ID NO: 1571505 - protein, 14 aa, Staphylococcus aureus
NDRHQITDTTNGHY

SEQ ID NO: 1571506 - protein, 6 aa, Staphylococcus aureus
NDSVDQ

SEQ ID NO: 1571507 - protein, 116 aa, Staphylococcus aureus
NDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRA

SEQ ID NO: 1571508 - protein, 6 aa, Staphylococcus aureus
NDYNSI

SEQ ID NO: 1571509 - protein, 17 aa, Staphylococcus aureus
NEDKGDTIRGKKVNVGN

SEQ ID NO: 1571510 - protein, 7 aa, Staphylococcus aureus
NEEQRNG

SEQ ID NO: 1571511 - protein, 6 aa, Staphylococcus aureus
NEGISK

SEQ ID NO: 1571512 - protein, 25 aa, Staphylococcus aureus
NEHANVEQTVDYTQADSDKQNAYKQ

SEQ ID NO: 1571513 - protein, 31 aa, Staphylococcus aureus
NEHANVEQTVDYTQADSDKQNAYKQAIADAE

SEQ ID NO: 1571514 - protein, 7 aa, Staphylococcus aureus
NEHEDVN

SEQ ID NO: 1571515 - protein, 18 aa, Staphylococcus aureus
NEIPKAKIDANKDADKQV

SEQ ID NO: 1571516 - protein, 9 aa, Staphylococcus aureus
NEKDGTGYV

SEQ ID NO: 1571517 - protein, 11 aa, Staphylococcus aureus
NELDSKDNKGF

SEQ ID NO: 1571518 - protein, 24 aa, Staphylococcus aureus
NELDSKDNKGSHIEMNGQSDIDSK

SEQ ID NO: 1571519 - protein, 24 aa, Staphylococcus aureus
NELDSKDNKGSQIEMNGRSDIDSK

SEQ ID NO: 1571520 - protein, 15 aa, Staphylococcus aureus
NELGQNLQLKSENAY

SEQ ID NO: 1571521 - protein, 9 aa, Staphylococcus aureus
NENATGPFN

SEQ ID NO: 1571522 - protein, 13 aa, Staphylococcus aureus
NENDDSGGGNMGN

SEQ ID NO: 1571523 - protein, 8 aa, Staphylococcus aureus
NENEKNKV

SEQ ID NO: 1571524 - protein, 8 aa, Staphylococcus aureus
NENSGINK

SEQ ID NO: 1571525 - protein, 7 aa, Staphylococcus aureus
NENYKEE

SEQ ID NO: 1571526 - protein, 8 aa, Staphylococcus aureus
NESSLSDE

SEQ ID NO: 1571527 - protein, 8 aa, Staphylococcus aureus
NETEDELE

SEQ ID NO: 1571528 - protein, 25 aa, Staphylococcus aureus
NETIQEVKNNPKDYAARLKNDPKAF

SEQ ID NO: 1571529 - protein, 13 aa, Staphylococcus aureus
NETYAKQMQSNNY

SEQ ID NO: 1571530 - protein, 20 aa, Staphylococcus aureus
NEVSSKVDGGQQSGEDDLNA

SEQ ID NO: 1571531 - protein, 4 aa, Staphylococcus aureus
NFEE

SEQ ID NO: 1571532 - protein, 4 aa, Staphylococcus aureus
NFGA

SEQ ID NO: 1571533 - protein, 6 aa, Staphylococcus aureus
NFQDTN

SEQ ID NO: 1571534 - protein, 6 aa, Staphylococcus aureus
NFSDNS

SEQ ID NO: 1571535 - protein, 18 aa, Staphylococcus aureus
NFTSEEHNKRPVEQNPNQ

SEQ ID NO: 1571536 - protein, 23 aa, Staphylococcus aureus
NGADGVTNQVGQNALNTKDKPVN

SEQ ID NO: 1571537 - protein, 9 aa, Staphylococcus aureus
NGDKHAGET

SEQ ID NO: 1571538 - protein, 7 aa, Staphylococcus aureus
NGDNQFG

SEQ ID NO: 1571539 - protein, 12 aa, Staphylococcus aureus
NGDSDYQNKADE

SEQ ID NO: 1571540 - protein, 16 aa, Staphylococcus aureus
NGEKVETVDVTSETNW

SEQ ID NO: 1571541 - protein, 7 aa, Staphylococcus aureus
NGEVSNI

SEQ ID NO: 1571542 - protein, 16 aa, Staphylococcus aureus
NGFDDPSLLLKMIEQQ

SEQ ID NO: 1571543 - protein, 5 aa, Staphylococcus aureus
NGFKT

SEQ ID NO: 1571544 - protein, 39 aa, Staphylococcus aureus
NGGDWGDNAKAQGWEVGSKPKAGAGASIKPGNFGAPAPY

SEQ ID NO: 1571545 - protein, 39 aa, Staphylococcus aureus
NGGDWGDNAKAQGWEVGSKPKAGAGASVKPGNFGAPPPY

SEQ ID NO: 1571546 - protein, 30 aa, Staphylococcus aureus
NGINDEAQTKQTQKYLDAEPSKKSAYDQAV

SEQ ID NO: 1571547 - protein, 8 aa, Staphylococcus aureus
NGKNNLSA

SEQ ID NO: 1571548 - protein, 10 aa, Staphylococcus aureus
NGKSIKGKAL

SEQ ID NO: 1571549 - protein, 8 aa, Staphylococcus aureus
NGLNASSA

SEQ ID NO: 1571550 - protein, 12 aa, Staphylococcus aureus
NGLNKTDQANLN

SEQ ID NO: 1571551 - protein, 45 aa, Staphylococcus aureus
NGNAQHPVITPSDVNNALSNVTSKEHALNGEAKLNAAKQEANTAL

SEQ ID NO: 1571552 - protein, 46 aa, Staphylococcus aureus
NGNAQHPVITPSDVNNALSNVTSKEQALNGEAKLNAAKQEANTALG

SEQ ID NO: 1571553 - protein, 54 aa, Staphylococcus aureus
NGPTDVAGANAPGKDDKNSASGSDKGSDGTTTGQSESNSSNKDKVENPQTNAGT

SEQ ID NO: 1571554 - protein, 8 aa, Staphylococcus aureus
NGQNIERI

SEQ ID NO: 1571555 - protein, 10 aa, Staphylococcus aureus
NGQSSSNKQY

SEQ ID NO: 1571556 - protein, 6 aa, Staphylococcus aureus
NGRIDT

SEQ ID NO: 1571557 - protein, 9 aa, Staphylococcus aureus
NGSTTSSHK

SEQ ID NO: 1571558 - protein, 11 aa, Staphylococcus aureus
NGTKAVTSKYK

SEQ ID NO: 1571559 - protein, 7 aa, Staphylococcus aureus
NGTRNAL

SEQ ID NO: 1571560 - protein, 8 aa, Staphylococcus aureus
NGTRNALE

SEQ ID NO: 1571561 - protein, 28 aa, Staphylococcus aureus
NGVANSKIKRTKEEFKSIPNKTRSRLDV

SEQ ID NO: 1571562 - protein, 6 aa, Staphylococcus aureus
NGVKST

SEQ ID NO: 1571563 - protein, 5 aa, Staphylococcus aureus
NGYAN

SEQ ID NO: 1571564 - protein, 41 aa, Staphylococcus aureus
NGYTKGSEKDQEAFTNNKDEEAVAAKNPESEEYKVNEKIKK

SEQ ID NO: 1571565 - protein, 9 aa, Staphylococcus aureus
NHENSYSKN

SEQ ID NO: 1571566 - protein, 18 aa, Staphylococcus aureus
NHNNGTKENKIANTNKNK

SEQ ID NO: 1571567 - protein, 103 aa, Staphylococcus aureus
NHNNGTKENKIANTNKNNADESKDKDTSKDASKDKSKSTDSDKSKEDQDKATKDESDNDQNNANQANNQAQNNQNQQQANQNQQQQQQRQGGGQRHTVDGQEN

SEQ ID NO: 1571568 - protein, 103 aa, Staphylococcus aureus
NHNNGTKENKIANTNKNNADESKDKDTSKDASKDKSKSTDSDKSKEDQDKATKDESDNDQNNANQANNQAQNNQNQQQANQNQQQQQQRQSGGQRHTVNGQEN

SEQ ID NO: 1571569 - protein, 22 aa, Staphylococcus aureus
NHPYNSTTSGHKKKLDQDDEID

SEQ ID NO: 1571570 - protein, 10 aa, Staphylococcus aureus
NHSEREMGKA

SEQ ID NO: 1571571 - protein, 7 aa, Staphylococcus aureus
NHTAIDD

SEQ ID NO: 1571572 - protein, 6 aa, Staphylococcus aureus
NHTNHP

SEQ ID NO: 1571573 - protein, 6 aa, Staphylococcus aureus
NHTPFD

SEQ ID NO: 1571574 - protein, 15 aa, Staphylococcus aureus
NIDAEKRNRRAEMGN

SEQ ID NO: 1571575 - protein, 4 aa, Staphylococcus aureus
NIDT

SEQ ID NO: 1571576 - protein, 7 aa, Staphylococcus aureus
NIEPKQL

SEQ ID NO: 1571577 - protein, 9 aa, Staphylococcus aureus
NIEYTTPTG

SEQ ID NO: 1571578 - protein, 12 aa, Staphylococcus aureus
NIPKNASTKVEL

SEQ ID NO: 1571579 - protein, 12 aa, Staphylococcus aureus
NIPQNASTKVEL

SEQ ID NO: 1571580 - protein, 9 aa, Staphylococcus aureus
NIPTQKAPK

SEQ ID NO: 1571581 - protein, 9 aa, Staphylococcus aureus
NIRSGVEKS

SEQ ID NO: 1571582 - protein, 18 aa, Staphylococcus aureus
NITDSSSGIVNKSEYNAV

SEQ ID NO: 1571583 - protein, 11 aa, Staphylococcus aureus
NKALSAENAEL

SEQ ID NO: 1571584 - protein, 7 aa, Staphylococcus aureus
NKANNRF

SEQ ID NO: 1571585 - protein, 21 aa, Staphylococcus aureus
NKATSNQGVSQVQTAGKQAIE

SEQ ID NO: 1571586 - protein, 22 aa, Staphylococcus aureus
NKDSKEVNDAIAKQKKERQQQI

SEQ ID NO: 1571587 - protein, 9 aa, Staphylococcus aureus
NKDSKEVNY

SEQ ID NO: 1571588 - protein, 6 aa, Staphylococcus aureus
NKEETK

SEQ ID NO: 1571589 - protein, 7 aa, Staphylococcus aureus
NKEKSQK

SEQ ID NO: 1571590 - protein, 10 aa, Staphylococcus aureus
NKEKVAPSKL

SEQ ID NO: 1571591 - protein, 13 aa, Staphylococcus aureus
NKELKSPLDKEQA

SEQ ID NO: 1571592 - protein, 9 aa, Staphylococcus aureus
NKFSDDGRL

SEQ ID NO: 1571593 - protein, 7 aa, Staphylococcus aureus
NKGYAYQ

SEQ ID NO: 1571594 - protein, 7 aa, Staphylococcus aureus
NKISDED

SEQ ID NO: 1571595 - protein, 19 aa, Staphylococcus aureus
NKKEKATAQKLDADNSINH

SEQ ID NO: 1571596 - protein, 8 aa, Staphylococcus aureus
NKKSTDYS

SEQ ID NO: 1571597 - protein, 14 aa, Staphylococcus aureus
NKKVLPAAGESMTS

SEQ ID NO: 1571598 - protein, 7 aa, Staphylococcus aureus
NKKYEFQ

SEQ ID NO: 1571599 - protein, 29 aa, Staphylococcus aureus
NKNDRMNDNNDANAQKYTTTMKNANNTVK

SEQ ID NO: 1571600 - protein, 29 aa, Staphylococcus aureus
NKNDRMNDNNDTDAQKYTTTMKNANNTVK

SEQ ID NO: 1571601 - protein, 6 aa, Staphylococcus aureus
NKNNYK

SEQ ID NO: 1571602 - protein, 6 aa, Staphylococcus aureus
NKNNYL

SEQ ID NO: 1571603 - protein, 10 aa, Staphylococcus aureus
NKNVTEEQKL

SEQ ID NO: 1571604 - protein, 8 aa, Staphylococcus aureus
NKNYGTNM

SEQ ID NO: 1571605 - protein, 7 aa, Staphylococcus aureus
NKQKKDH

SEQ ID NO: 1571606 - protein, 14 aa, Staphylococcus aureus
NKQKKDHYIETQEK

SEQ ID NO: 1571607 - protein, 6 aa, Staphylococcus aureus
NKQLGA

SEQ ID NO: 1571608 - protein, 4 aa, Staphylococcus aureus
NKRE

SEQ ID NO: 1571609 - protein, 13 aa, Staphylococcus aureus
NKRSNMKQQPVKN

SEQ ID NO: 1571610 - protein, 7 aa, Staphylococcus aureus
NKSKKMR

SEQ ID NO: 1571611 - protein, 11 aa, Staphylococcus aureus
NKSKKNAPTYH

SEQ ID NO: 1571612 - protein, 8 aa, Staphylococcus aureus
NKSKTRVA

SEQ ID NO: 1571613 - protein, 23 aa, Staphylococcus aureus
NKTEDSIEEGKFDDEGGAAPNNN

SEQ ID NO: 1571614 - protein, 8 aa, Staphylococcus aureus
NKTTDPTL

SEQ ID NO: 1571615 - protein, 7 aa, Staphylococcus aureus
NKVADTE

SEQ ID NO: 1571616 - protein, 5 aa, Staphylococcus aureus
NKVIN

SEQ ID NO: 1571617 - protein, 8 aa, Staphylococcus aureus
NLAQQGNS

SEQ ID NO: 1571618 - protein, 25 aa, Staphylococcus aureus
NLDALDSKTNNSTTYISKSNIKNSN

SEQ ID NO: 1571619 - protein, 9 aa, Staphylococcus aureus
NLDGDEGMR

SEQ ID NO: 1571620 - protein, 16 aa, Staphylococcus aureus
NLGNKYEGHGNGGDGI

SEQ ID NO: 1571621 - protein, 7 aa, Staphylococcus aureus
NLKKQSK

SEQ ID NO: 1571622 - protein, 10 aa, Staphylococcus aureus
NLKPNTESNA

SEQ ID NO: 1571623 - protein, 19 aa, Staphylococcus aureus
NLNQAQRDEYNKQITQATH

SEQ ID NO: 1571624 - protein, 5 aa, Staphylococcus aureus
NLSSP

SEQ ID NO: 1571625 - protein, 7 aa, Staphylococcus aureus
NLSSSMQ

SEQ ID NO: 1571626 - protein, 17 aa, Staphylococcus aureus
NLTGGFGSEGASTLTQQ

SEQ ID NO: 1571627 - protein, 17 aa, Staphylococcus aureus
NLTTEKATVEYNPDRHD

SEQ ID NO: 1571628 - protein, 4 aa, Staphylococcus aureus
NMAE

SEQ ID NO: 1571629 - protein, 6 aa, Staphylococcus aureus
NMEGKE

SEQ ID NO: 1571630 - protein, 27 aa, Staphylococcus aureus
NMGAKTGTGTYGAETYSQYNLPDNAAK

SEQ ID NO: 1571631 - protein, 5 aa, Staphylococcus aureus
NMSIT

SEQ ID NO: 1571632 - protein, 7 aa, Staphylococcus aureus
NMSRNEA

SEQ ID NO: 1571633 - protein, 70 aa, Staphylococcus aureus
NNANNQPQATTNMSQPAQPKSSTNADQASSQPAHETNSNGNTNDKTNESSNQSDVNQQYPPADESLQDAI

SEQ ID NO: 1571634 - protein, 21 aa, Staphylococcus aureus
NNAQKAAVKSKINAASNIAGV

SEQ ID NO: 1571635 - protein, 33 aa, Staphylococcus aureus
NNAQKQQLQSQITQSSDIAAVNGHKQTAETLNT

SEQ ID NO: 1571636 - protein, 19 aa, Staphylococcus aureus
NNAQQDGFKGRIDQSDDLN

SEQ ID NO: 1571637 - protein, 12 aa, Staphylococcus aureus
NNDMSPSLNKGD

SEQ ID NO: 1571638 - protein, 118 aa, Staphylococcus aureus
NNDNSTNNQSSKTQLTQKDENKNEDKPEEKSETATDEDLQSTEEVPANENTENNQHEIDEITTKDQSDDDINTPNVAEDKSQDDLKDDLKEKQQSSNHHQSTQPKTSPSTETNTQQSF

SEQ ID NO: 1571639 - protein, 119 aa, Staphylococcus aureus
NNDNSTSNQSSKTQLTQKDEDKSENMPEEKSESETDKDLQSTEEVPANENTEKNQHEIDETTTKDQSDDEINTPNVAEDKSQDDLKDDLNEKQQPSDHHQSTQPKTSPSTETNKQQSFA

SEQ ID NO: 1571640 - protein, 118 aa, Staphylococcus aureus
NNDNSTSNQSSKTQLTQKDENKNEDKPEEKSETATDEDLQSTEEVPANENTENNQHEIDEITTKDQSDDDINTPNVAEDKSQDDLKDDLKEKQQSSNQHQSTQPKTSPSTETNTQQSF

SEQ ID NO: 1571641 - protein, 48 aa, Staphylococcus aureus
NNDSDKVSNDPKVSQNYKKQVENQDGQINQQVDNAKENIKNNQNTDGI

SEQ ID NO: 1571642 - protein, 6 aa, Staphylococcus aureus
NNDTLS

SEQ ID NO: 1571643 - protein, 6 aa, Staphylococcus aureus
NNEDIA

SEQ ID NO: 1571644 - protein, 11 aa, Staphylococcus aureus
NNIKKGKHNDK

SEQ ID NO: 1571645 - protein, 5 aa, Staphylococcus aureus
NNKAI

SEQ ID NO: 1571646 - protein, 15 aa, Staphylococcus aureus
NNKDLDYKSKSKEPI

SEQ ID NO: 1571647 - protein, 8 aa, Staphylococcus aureus
NNKDLQDA

SEQ ID NO: 1571648 - protein, 12 aa, Staphylococcus aureus
NNKERDLSNSAP

SEQ ID NO: 1571649 - protein, 4 aa, Staphylococcus aureus
NNKK

SEQ ID NO: 1571650 - protein, 12 aa, Staphylococcus aureus
NNKPEGVNENSN

SEQ ID NO: 1571651 - protein, 9 aa, Staphylococcus aureus
NNKVTGNNA

SEQ ID NO: 1571652 - protein, 18 aa, Staphylococcus aureus
NNNGLADQSGLKKGDVIT

SEQ ID NO: 1571653 - protein, 7 aa, Staphylococcus aureus
NNNMNSL

SEQ ID NO: 1571654 - protein, 5 aa, Staphylococcus aureus
NNPKC

SEQ ID NO: 1571655 - protein, 27 aa, Staphylococcus aureus
NNPTINKGNVSSATQAVTTSKNGLDGV

SEQ ID NO: 1571656 - protein, 14 aa, Staphylococcus aureus
NNQAPTVESKSHEL

SEQ ID NO: 1571657 - protein, 15 aa, Staphylococcus aureus
NNQAPTVESKSHELN

SEQ ID NO: 1571658 - protein, 5 aa, Staphylococcus aureus
NNQGI

SEQ ID NO: 1571659 - protein, 5 aa, Staphylococcus aureus
NNRTV

SEQ ID NO: 1571660 - protein, 9 aa, Staphylococcus aureus
NNSAQNDGL

SEQ ID NO: 1571661 - protein, 6 aa, Staphylococcus aureus
NNSKDI

SEQ ID NO: 1571662 - protein, 7 aa, Staphylococcus aureus
NNTPLKA

SEQ ID NO: 1571663 - protein, 9 aa, Staphylococcus aureus
NNTTQQHEQ

SEQ ID NO: 1571664 - protein, 67 aa, Staphylococcus aureus
NNVNNAKHALNGTQNLNNAKQAAITAINGASDLNQKQKDALKAQANGAQRVSNAQDVQHNATELNTA

SEQ ID NO: 1571665 - protein, 24 aa, Staphylococcus aureus
NNVRKAQRLAKTSVPNNIETDVKA

SEQ ID NO: 1571666 - protein, 9 aa, Staphylococcus aureus
NPDATEEEV

SEQ ID NO: 1571667 - protein, 9 aa, Staphylococcus aureus
NPDATQEEV

SEQ ID NO: 1571668 - protein, 6 aa, Staphylococcus aureus
NPEKYK

SEQ ID NO: 1571669 - protein, 10 aa, Staphylococcus aureus
NPEMYNGKNN

SEQ ID NO: 1571670 - protein, 9 aa, Staphylococcus aureus
NPKTKKTEI

SEQ ID NO: 1571671 - protein, 9 aa, Staphylococcus aureus
NPLESPNGQ

SEQ ID NO: 1571672 - protein, 13 aa, Staphylococcus aureus
NPNNRSIDKIACV

SEQ ID NO: 1571673 - protein, 7 aa, Staphylococcus aureus
NPPNKYK

SEQ ID NO: 1571674 - protein, 6 aa, Staphylococcus aureus
NPQSAQ

SEQ ID NO: 1571675 - protein, 8 aa, Staphylococcus aureus
NPRLSGDK

SEQ ID NO: 1571676 - protein, 12 aa, Staphylococcus aureus
NPVGQPTNAVNA

SEQ ID NO: 1571677 - protein, 11 aa, Staphylococcus aureus
NPYDLTPKGTF

SEQ ID NO: 1571678 - protein, 8 aa, Staphylococcus aureus
NQDSEKAQ

SEQ ID NO: 1571679 - protein, 103 aa, Staphylococcus aureus
NQEAKAAENTSTENAKQDDATTSDNKEVVSETENNSTTENNSTNPIKKETNTDSQPEAKEESTTSSTQQQQNNVTATTETKPQNIEKENVKPSTDKTATEDTS

SEQ ID NO: 1571680 - protein, 8 aa, Staphylococcus aureus
NQFQDTNN

SEQ ID NO: 1571681 - protein, 6 aa, Staphylococcus aureus
NQKFGQ

SEQ ID NO: 1571682 - protein, 18 aa, Staphylococcus aureus
NQKNNSNVSSILESGDLR

SEQ ID NO: 1571683 - protein, 13 aa, Staphylococcus aureus
NQKSNNSDHRTAN

SEQ ID NO: 1571684 - protein, 5 aa, Staphylococcus aureus
NQLKQ

SEQ ID NO: 1571685 - protein, 13 aa, Staphylococcus aureus
NQPEAKDKTELTT

SEQ ID NO: 1571686 - protein, 8 aa, Staphylococcus aureus
NQPLNDAD

SEQ ID NO: 1571687 - protein, 71 aa, Staphylococcus aureus
NQPLNNENHSINRKEQKSVQTAYNTDVQKRQIQNATQNQQSRQSGNRNQPITRNSQSKDRLKEQKDINKHG

SEQ ID NO: 1571688 - protein, 14 aa, Staphylococcus aureus
NQQSALTAKGYNYT

SEQ ID NO: 1571689 - protein, 32 aa, Staphylococcus aureus
NQTTSPTMNPDEVNRATTQVNNTKVALDGDEN

SEQ ID NO: 1571690 - protein, 4 aa, Staphylococcus aureus
NQVS

SEQ ID NO: 1571691 - protein, 13 aa, Staphylococcus aureus
NQVSTTSSELNTA

SEQ ID NO: 1571692 - protein, 10 aa, Staphylococcus aureus
NQYKDDVYQK

SEQ ID NO: 1571693 - protein, 9 aa, Staphylococcus aureus
NREGKDLPI

SEQ ID NO: 1571694 - protein, 7 aa, Staphylococcus aureus
NREVGKE

SEQ ID NO: 1571695 - protein, 11 aa, Staphylococcus aureus
NRGKFSDDTRL

SEQ ID NO: 1571696 - protein, 10 aa, Staphylococcus aureus
NRHGKNIRDV

SEQ ID NO: 1571697 - protein, 7 aa, Staphylococcus aureus
NRKSEQR

SEQ ID NO: 1571698 - protein, 5 aa, Staphylococcus aureus
NRKTQ

SEQ ID NO: 1571699 - protein, 6 aa, Staphylococcus aureus
NRPNPM

SEQ ID NO: 1571700 - protein, 107 aa, Staphylococcus aureus
NRQSIDTNSHQDHTEDVEKDQSELEHQDKTENTEQQFPPRNAQRRKRRRDLATNHNKQHHDESQASDDNAHNEAGTFDDRQVESSAHSSVNQEPSHQDSTPQHEEEY

SEQ ID NO: 1571701 - protein, 107 aa, Staphylococcus aureus
NRQSIDTNSHQDHTEDVEKDQSELEHQDTTENTEQQFPPRNAQRRKRRRDLATNHNKQHHDESQASDDNAHNEAGTFDDRQVESSAHSSVNQEPSHQDSTPQHEEEY

SEQ ID NO: 1571702 - protein, 108 aa, Staphylococcus aureus
NRQSIDTNSHQDHTEDVEKDQSELEHQDTTENTEQQFPPRNAQRRKRRRDLATNHNKQHHDESQASDDNAHNEAGTLDDRQVESSAHSSVNQEPSHQDSTSQHEEEYY

SEQ ID NO: 1571703 - protein, 107 aa, Staphylococcus aureus
NRQSIDTNSHQDHTEEVEKDQSELEHQDTIENTEQQFPPRNAQRRKRRRDLATNHNKQVHNESQTSEDNVQNEAGTIDDHQVESSHSTESQEPSHQDSTPQHEEEYY

SEQ ID NO: 1571704 - protein, 74 aa, Staphylococcus aureus
NSALRTAKTKLDEEINKSVTTDGMTQSSIQAYENAKRAGQTESTNAQNVINNGDATDQQIAEEKTKVEEKYNSL

SEQ ID NO: 1571705 - protein, 9 aa, Staphylococcus aureus
NSARNDGLN

SEQ ID NO: 1571706 - protein, 7 aa, Staphylococcus aureus
NSDEAKV

SEQ ID NO: 1571707 - protein, 8 aa, Staphylococcus aureus
NSETNNTG

SEQ ID NO: 1571708 - protein, 12 aa, Staphylococcus aureus
NSFKTKVQGLND

SEQ ID NO: 1571709 - protein, 8 aa, Staphylococcus aureus
NSFPENEV

SEQ ID NO: 1571710 - protein, 7 aa, Staphylococcus aureus
NSGQSIL

SEQ ID NO: 1571711 - protein, 72 aa, Staphylococcus aureus
NSIANSQSASTSKSDSQSTSISLSTSDSKSMSTSESLSDSTSTSDSVSGSLSVAGSQSVSTSTSDSMSTSEI

SEQ ID NO: 1571712 - protein, 47 aa, Staphylococcus aureus
NSIQDNTATKNGQNYLDATGSNKTNYNNAVDSANGVINATSNPNMDA

SEQ ID NO: 1571713 - protein, 14 aa, Staphylococcus aureus
NSIQDQQQTEAASK

SEQ ID NO: 1571714 - protein, 9 aa, Staphylococcus aureus
NSKEVTPEV

SEQ ID NO: 1571715 - protein, 5 aa, Staphylococcus aureus
NSNKL

SEQ ID NO: 1571716 - protein, 10 aa, Staphylococcus aureus
NSNSSNLKQY

SEQ ID NO: 1571717 - protein, 17 aa, Staphylococcus aureus
NSPANNAAVSALDADKV

SEQ ID NO: 1571718 - protein, 26 aa, Staphylococcus aureus
NSPKSYRESKYEGEPAQHSQLHENEN

SEQ ID NO: 1571719 - protein, 37 aa, Staphylococcus aureus
NSPKSYRESKYEGEPTQHSQLHENENVANELIDFLWK

SEQ ID NO: 1571720 - protein, 5 aa, Staphylococcus aureus
NSRDY

SEQ ID NO: 1571721 - protein, 7 aa, Staphylococcus aureus
NSRTCTG

SEQ ID NO: 1571722 - protein, 11 aa, Staphylococcus aureus
NSSTGKSTAAA

SEQ ID NO: 1571723 - protein, 9 aa, Staphylococcus aureus
NSVKRDKNK

SEQ ID NO: 1571724 - protein, 32 aa, Staphylococcus aureus
NSYEDVNTNTDGSALQINKNTNKQAIKNFLDE

SEQ ID NO: 1571725 - protein, 32 aa, Staphylococcus aureus
NSYEDVNTNTDGSTLQINKNTNKQAIKDFLDE

SEQ ID NO: 1571726 - protein, 23 aa, Staphylococcus aureus
NTDKAQPNYTEASTDKKEAVDQA

SEQ ID NO: 1571727 - protein, 37 aa, Staphylococcus aureus
NTDKNNHTGKAAKLDGVRQNYNNTDKVTDKKTTEHLP

SEQ ID NO: 1571728 - protein, 6 aa, Staphylococcus aureus
NTGNGA

SEQ ID NO: 1571729 - protein, 9 aa, Staphylococcus aureus
NTKENVTAN

SEQ ID NO: 1571730 - protein, 8 aa, Staphylococcus aureus
NTKEPNAI

SEQ ID NO: 1571731 - protein, 8 aa, Staphylococcus aureus
NTKEPNTM

SEQ ID NO: 1571732 - protein, 9 aa, Staphylococcus aureus
NTKKATGYY

SEQ ID NO: 1571733 - protein, 12 aa, Staphylococcus aureus
NTKKLSIRDNGI

SEQ ID NO: 1571734 - protein, 29 aa, Staphylococcus aureus
NTKNGGKYTLESHKELQKNRENVEINTDD

SEQ ID NO: 1571735 - protein, 7 aa, Staphylococcus aureus
NTKRTTG

SEQ ID NO: 1571736 - protein, 7 aa, Staphylococcus aureus
NTPKFDN

SEQ ID NO: 1571737 - protein, 34 aa, Staphylococcus aureus
NTPQKTALKQQVNAAQRVSGVTDLKNSATSLDNA

SEQ ID NO: 1571738 - protein, 15 aa, Staphylococcus aureus
NTQAQQSDYSKIAEK

SEQ ID NO: 1571739 - protein, 6 aa, Staphylococcus aureus
NTRTAK

SEQ ID NO: 1571740 - protein, 7 aa, Staphylococcus aureus
NTRTTKG

SEQ ID NO: 1571741 - protein, 18 aa, Staphylococcus aureus
NTSNSGDTGLDVSPYKEQ

SEQ ID NO: 1571742 - protein, 9 aa, Staphylococcus aureus
NTTKPIQEF

SEQ ID NO: 1571743 - protein, 5 aa, Staphylococcus aureus
NTYRH

SEQ ID NO: 1571744 - protein, 10 aa, Staphylococcus aureus
NVGDGMSDAL

SEQ ID NO: 1571745 - protein, 8 aa, Staphylococcus aureus
NVKGEGVI

SEQ ID NO: 1571746 - protein, 18 aa, Staphylococcus aureus
NVNTHGVSTARKVPDIKN

SEQ ID NO: 1571747 - protein, 55 aa, Staphylococcus aureus
NVPEDLKKDVDKITKIDDVDTSELVETPKESMSLEEKEKREKIKRECEILKMTMN

SEQ ID NO: 1571748 - protein, 9 aa, Staphylococcus aureus
NVQTNGSYS

SEQ ID NO: 1571749 - protein, 7 aa, Staphylococcus aureus
NVSNDAK

SEQ ID NO: 1571750 - protein, 14 aa, Staphylococcus aureus
NVTPNSNKDYLLYW

SEQ ID NO: 1571751 - protein, 211 aa, Staphylococcus aureus
NVTSPSVNSEINNNETGTPHESNQTGNEGTDSNSRDANPDSNNVKPDSNNQNPSPDSKPDPNNPNPGPNPKPDPDNPKPKPDPKPDPDNPKPKPDPKPDPDNPKPKPDPKPDPDKPKPNPDPKPDPDKPKPNPDPKPDPDKPKPNPNPKPDPNKPNPNPSPDPNQPGDSNHSGGSKNGGTWNPNASDGSNQGQWQPNGNQGNSQNPTGNDF

SEQ ID NO: 1571752 - protein, 175 aa, Staphylococcus aureus
NVTSPSVNSEMNNNETGTPHESNQAGNEGTGSNNRDANPDSNNVKPDSNNQNPSPDSKPDPNNPNPGPNPKPDPNKPKPNPEPKPDPDKPKPNPDPKPDPDKPKPNPDPKPDPKPDPKPDPNPSPNPNQPGDSNHSGGSKNGGTWNPNASDGSNQGQWQPNGNPGNSQNPTGNDF

SEQ ID NO: 1571753 - protein, 188 aa, Staphylococcus aureus
NVTSPSVNSEMNNNETGTPHESNQAGNEGTGSNNRDANPDSNNVKPDSNNQNPSPDSKPDPNNPNPGPNPKPDPNKPKPNPEPKPDPDKPKPNPEPKPDPDKPKPNPDPKPDPDKPKPNPDPKPDPKPDPKPDPNPSPNPNQPGDSNHSGGSKNGGTWNPNASDGSNQGQWQPNGNPGNSQNPTGNDF

SEQ ID NO: 1571754 - protein, 180 aa, Staphylococcus aureus
NVTSPSVNSEMNNNETGTPHESNQTGDEGTGSNSRDANPDSNNVKPDSNNPNPGPNPKPDPDKPKPNPNPKPDPDKPKPNPEPKPDPDKPKPNPDPKPDPDKPKPNPEPKPDPNPNPKPDPNKPNPNPSPNPNQPGDSNHSGGSKNGGTWNPNASDGSNQGQWQPNGNQRNLQNPTGNDF

SEQ ID NO: 1571755 - protein, 11 aa, Staphylococcus aureus
NWKDKKLNQKL

SEQ ID NO: 1571756 - protein, 9 aa, Staphylococcus aureus
NYDNTPQNL

SEQ ID NO: 1571757 - protein, 5 aa, Staphylococcus aureus
NYEDI

SEQ ID NO: 1571758 - protein, 12 aa, Staphylococcus aureus
NYGNGKKGDNYV

SEQ ID NO: 1571759 - protein, 23 aa, Staphylococcus aureus
NYINADDNLKANYDNAITNATHE

SEQ ID NO: 1571760 - protein, 18 aa, Staphylococcus aureus
NYKNGNISSTDNVPSYDA

SEQ ID NO: 1571761 - protein, 8 aa, Staphylococcus aureus
NYPGKEDV

SEQ ID NO: 1571762 - protein, 11 aa, Staphylococcus aureus
PADSLKESNPL

SEQ ID NO: 1571763 - protein, 6 aa, Staphylococcus aureus
PADVYY

SEQ ID NO: 1571764 - protein, 19 aa, Staphylococcus aureus
PAHPVEQKQHESNNYSGKK

SEQ ID NO: 1571765 - protein, 14 aa, Staphylococcus aureus
PATMSNNAETQVNQ

SEQ ID NO: 1571766 - protein, 29 aa, Staphylococcus aureus
PAVSEQPAKGQQGSKGSESGKDAQPIGDD

SEQ ID NO: 1571767 - protein, 29 aa, Staphylococcus aureus
PAVSEQPAKGQQGSKGSESGKDAQPIGKD

SEQ ID NO: 1571768 - protein, 18 aa, Staphylococcus aureus
PDGKKAETSKNRQENNTI

SEQ ID NO: 1571769 - protein, 23 aa, Staphylococcus aureus
PDGYDTNVGTVGDELSGGEKQRV

SEQ ID NO: 1571770 - protein, 11 aa, Staphylococcus aureus
PDIKSTDGQVM

SEQ ID NO: 1571771 - protein, 7 aa, Staphylococcus aureus
PDNPQVN

SEQ ID NO: 1571772 - protein, 7 aa, Staphylococcus aureus
PDTVTQA

SEQ ID NO: 1571773 - protein, 10 aa, Staphylococcus aureus
PDVNSDETIG

SEQ ID NO: 1571774 - protein, 12 aa, Staphylococcus aureus
PEEDKQTDGDMS

SEQ ID NO: 1571775 - protein, 14 aa, Staphylococcus aureus
PEEHGQAQGPIEEI

SEQ ID NO: 1571776 - protein, 16 aa, Staphylococcus aureus
PEEHGQAQGPIEEITE

SEQ ID NO: 1571777 - protein, 10 aa, Staphylococcus aureus
PEIKSTDGQV

SEQ ID NO: 1571778 - protein, 27 aa, Staphylococcus aureus
PEKMADNLKKQGSYVPGIRPGEQTQKY

SEQ ID NO: 1571779 - protein, 8 aa, Staphylococcus aureus
PENDKRMD

SEQ ID NO: 1571780 - protein, 7 aa, Staphylococcus aureus
PENKESI

SEQ ID NO: 1571781 - protein, 14 aa, Staphylococcus aureus
PESEGLSVQKGAMW

SEQ ID NO: 1571782 - protein, 7 aa, Staphylococcus aureus
PETTNVQ

SEQ ID NO: 1571783 - protein, 4 aa, Staphylococcus aureus
PGAV

SEQ ID NO: 1571784 - protein, 6 aa, Staphylococcus aureus
PGFQGT

SEQ ID NO: 1571785 - protein, 11 aa, Staphylococcus aureus
PHGKEQGDYTQ

SEQ ID NO: 1571786 - protein, 14 aa, Staphylococcus aureus
PHQRDETNSLAEQL

SEQ ID NO: 1571787 - protein, 6 aa, Staphylococcus aureus
PIDDPK

SEQ ID NO: 1571788 - protein, 5 aa, Staphylococcus aureus
PIDNP

SEQ ID NO: 1571789 - protein, 13 aa, Staphylococcus aureus
PIEPTEALEDSEN

SEQ ID NO: 1571790 - protein, 10 aa, Staphylococcus aureus
PIKAPTNGKV

SEQ ID NO: 1571791 - protein, 9 aa, Staphylococcus aureus
PISDSTGRR

SEQ ID NO: 1571792 - protein, 11 aa, Staphylococcus aureus
PITDDGDKDHI

SEQ ID NO: 1571793 - protein, 13 aa, Staphylococcus aureus
PKAGGSLDGENIP

SEQ ID NO: 1571794 - protein, 13 aa, Staphylococcus aureus
PKDGKAKEERQKA

SEQ ID NO: 1571795 - protein, 7 aa, Staphylococcus aureus
PKEEAVQ

SEQ ID NO: 1571796 - protein, 13 aa, Staphylococcus aureus
PKGGKEKEERQKA

SEQ ID NO: 1571797 - protein, 5 aa, Staphylococcus aureus
PKGTF

SEQ ID NO: 1571798 - protein, 11 aa, Staphylococcus aureus
PKKAAGTTAGL

SEQ ID NO: 1571799 - protein, 8 aa, Staphylococcus aureus
PKKGQKAK

SEQ ID NO: 1571800 - protein, 15 aa, Staphylococcus aureus
PKKSTTSGFQNLSPN

SEQ ID NO: 1571801 - protein, 6 aa, Staphylococcus aureus
PKLDDS

SEQ ID NO: 1571802 - protein, 17 aa, Staphylococcus aureus
PKTFDDNNIKRPKDAIN

SEQ ID NO: 1571803 - protein, 14 aa, Staphylococcus aureus
PKTFEDNKIKRPID

SEQ ID NO: 1571804 - protein, 15 aa, Staphylococcus aureus
PKWSNSDAGKGNLYT

SEQ ID NO: 1571805 - protein, 7 aa, Staphylococcus aureus
PLAESSK

SEQ ID NO: 1571806 - protein, 11 aa, Staphylococcus aureus
PLASSVNHTAI

SEQ ID NO: 1571807 - protein, 8 aa, Staphylococcus aureus
PLTPKTKG

SEQ ID NO: 1571808 - protein, 28 aa, Staphylococcus aureus
PMSTTKDHHNKAKALPETGSENNVSNNA

SEQ ID NO: 1571809 - protein, 24 aa, Staphylococcus aureus
PNAEQTVNYQNADDNAKTNFDDAK

SEQ ID NO: 1571810 - protein, 5 aa, Staphylococcus aureus
PNKHR

SEQ ID NO: 1571811 - protein, 15 aa, Staphylococcus aureus
PNNQNCTPSREHPHE

SEQ ID NO: 1571812 - protein, 27 aa, Staphylococcus aureus
PNNQSLSSVTVTGQVTKRNKPGVNNPT

SEQ ID NO: 1571813 - protein, 28 aa, Staphylococcus aureus
PNNQSLSSVTVTGQVTSGYKQNVKNPTV

SEQ ID NO: 1571814 - protein, 9 aa, Staphylococcus aureus
PNSAVKGDT

SEQ ID NO: 1571815 - protein, 9 aa, Staphylococcus aureus
PNSAVQGDT

SEQ ID NO: 1571816 - protein, 11 aa, Staphylococcus aureus
PNSKGNKIIGE

SEQ ID NO: 1571817 - protein, 34 aa, Staphylococcus aureus
PNSPKNGTNASNKNEAKDSKEPLPDTGSEGEANT

SEQ ID NO: 1571818 - protein, 8 aa, Staphylococcus aureus
PNSVREAS

SEQ ID NO: 1571819 - protein, 13 aa, Staphylococcus aureus
PNSVREASHGLGA

SEQ ID NO: 1571820 - protein, 13 aa, Staphylococcus aureus
PNSVREASYGLGA

SEQ ID NO: 1571821 - protein, 7 aa, Staphylococcus aureus
PNTADEA

SEQ ID NO: 1571822 - protein, 8 aa, Staphylococcus aureus
PPAEDTTF

SEQ ID NO: 1571823 - protein, 5 aa, Staphylococcus aureus
PPFSG

SEQ ID NO: 1571824 - protein, 13 aa, Staphylococcus aureus
PPKGKNDQQKSIR

SEQ ID NO: 1571825 - protein, 16 aa, Staphylococcus aureus
PPKSPKNYRYTKGQIH

SEQ ID NO: 1571826 - protein, 49 aa, Staphylococcus aureus
PPTPPTPEVPSEPETPTPPTPEVPAEPGKPVPPAKEEPKKPSKPVEQGK

SEQ ID NO: 1571827 - protein, 9 aa, Staphylococcus aureus
PQGKRGGAL

SEQ ID NO: 1571828 - protein, 12 aa, Staphylococcus aureus
PQGMTQAQYTEL

SEQ ID NO: 1571829 - protein, 28 aa, Staphylococcus aureus
PQIQGQNIGNQSFEEDTEKDKPKYEHGG

SEQ ID NO: 1571830 - protein, 29 aa, Staphylococcus aureus
PQIQGQNKGDQSFEEDTEKDKPKYEQGGN

SEQ ID NO: 1571831 - protein, 29 aa, Staphylococcus aureus
PQIQGQNNGDQSFEEDTEEDKPKYEQGGN

SEQ ID NO: 1571832 - protein, 8 aa, Staphylococcus aureus
PQTEASSK

SEQ ID NO: 1571833 - protein, 6 aa, Staphylococcus aureus
PRDRQF

SEQ ID NO: 1571834 - protein, 18 aa, Staphylococcus aureus
PRLRRRHTKRQAHEKRGV

SEQ ID NO: 1571835 - protein, 17 aa, Staphylococcus aureus
PSAINQDNYPNGGFTAE

SEQ ID NO: 1571836 - protein, 19 aa, Staphylococcus aureus
PSDYKSPTENTENVERKLN

SEQ ID NO: 1571837 - protein, 19 aa, Staphylococcus aureus
PSDYKTPTENTENVERKLN

SEQ ID NO: 1571838 - protein, 5 aa, Staphylococcus aureus
PSQCL

SEQ ID NO: 1571839 - protein, 5 aa, Staphylococcus aureus
PSSKR

SEQ ID NO: 1571840 - protein, 5 aa, Staphylococcus aureus
PSTSH

SEQ ID NO: 1571841 - protein, 17 aa, Staphylococcus aureus
PSVALGTNKLASSFSSL

SEQ ID NO: 1571842 - protein, 28 aa, Staphylococcus aureus
PSVSEQPAKGQQGSKGSESGKDVQPIGK

SEQ ID NO: 1571843 - protein, 14 aa, Staphylococcus aureus
PTEQINDEKIKKEI

SEQ ID NO: 1571844 - protein, 4 aa, Staphylococcus aureus
PTFP

SEQ ID NO: 1571845 - protein, 14 aa, Staphylococcus aureus
PTKPIDDDKLRKEI

SEQ ID NO: 1571846 - protein, 10 aa, Staphylococcus aureus
PTKPLPNDKL

SEQ ID NO: 1571847 - protein, 37 aa, Staphylococcus aureus
PTLADAAKPNNVKPVQPKPAQTKTPTEQTKPVQPKVE

SEQ ID NO: 1571848 - protein, 9 aa, Staphylococcus aureus
PTLEPGSPD

SEQ ID NO: 1571849 - protein, 11 aa, Staphylococcus aureus
PTTALDKQNSL

SEQ ID NO: 1571850 - protein, 5 aa, Staphylococcus aureus
PTTLQ

SEQ ID NO: 1571851 - protein, 8 aa, Staphylococcus aureus
PTTSPNTP

SEQ ID NO: 1571852 - protein, 10 aa, Staphylococcus aureus
PTYEPERELP

SEQ ID NO: 1571853 - protein, 7 aa, Staphylococcus aureus
PTYIPNK

SEQ ID NO: 1571854 - protein, 4 aa, Staphylococcus aureus
PVAG

SEQ ID NO: 1571855 - protein, 4 aa, Staphylococcus aureus
PVGT

SEQ ID NO: 1571856 - protein, 8 aa, Staphylococcus aureus
PVSIPNTY

SEQ ID NO: 1571857 - protein, 4 aa, Staphylococcus aureus
PVYK

SEQ ID NO: 1571858 - protein, 10 aa, Staphylococcus aureus
PYDNRTSKYN

SEQ ID NO: 1571859 - protein, 10 aa, Staphylococcus aureus
PYQKRKSSPI

SEQ ID NO: 1571860 - protein, 7 aa, Staphylococcus aureus
PYQQSIS

SEQ ID NO: 1571861 - protein, 74 aa, Staphylococcus aureus
QAHAAENTNTSDKISENQNNNATTTQPPKDTNQTQPGTQPANTAKTYPAADESLKDAIKNPAVENKEHDIGPRE

SEQ ID NO: 1571862 - protein, 12 aa, Staphylococcus aureus
QAKEKEASDDLE

SEQ ID NO: 1571863 - protein, 18 aa, Staphylococcus aureus
QAKYEVKNTDKATQQTQK

SEQ ID NO: 1571864 - protein, 19 aa, Staphylococcus aureus
QALNGDQNLATAKDKANAF

SEQ ID NO: 1571865 - protein, 8 aa, Staphylococcus aureus
QALTGDER

SEQ ID NO: 1571866 - protein, 7 aa, Staphylococcus aureus
QANTALN

SEQ ID NO: 1571867 - protein, 8 aa, Staphylococcus aureus
QANTALNG

SEQ ID NO: 1571868 - protein, 6 aa, Staphylococcus aureus
QASGDI

SEQ ID NO: 1571869 - protein, 6 aa, Staphylococcus aureus
QASIDG

SEQ ID NO: 1571870 - protein, 12 aa, Staphylococcus aureus
QATQGAEAFNKA

SEQ ID NO: 1571871 - protein, 26 aa, Staphylococcus aureus
QAVTTAKDNLHGDQKLARDQKQAVTT

SEQ ID NO: 1571872 - protein, 10 aa, Staphylococcus aureus
QDAQQFESKL

SEQ ID NO: 1571873 - protein, 15 aa, Staphylococcus aureus
QDAQQFESKLSQQQI

SEQ ID NO: 1571874 - protein, 6 aa, Staphylococcus aureus
QDAYNY

SEQ ID NO: 1571875 - protein, 34 aa, Staphylococcus aureus
QDDNNKPKRNQQQEVSHSTTPNQNIKRRNQQEEM

SEQ ID NO: 1571876 - protein, 8 aa, Staphylococcus aureus
QDENSEVY

SEQ ID NO: 1571877 - protein, 13 aa, Staphylococcus aureus
QDFRKASDQLKDT

SEQ ID NO: 1571878 - protein, 7 aa, Staphylococcus aureus
QDGINAS

SEQ ID NO: 1571879 - protein, 18 aa, Staphylococcus aureus
QDGKATVKTATLNESNNW

SEQ ID NO: 1571880 - protein, 37 aa, Staphylococcus aureus
QDKEAAASEQKTTTVEENGNSTTDNKVSETQTTTTNV

SEQ ID NO: 1571881 - protein, 83 aa, Staphylococcus aureus
QDKEAATSEQKTTTVEENGNSATDNKVSETQTTTTNVNTIDETQSYSATATEQPSNATQVITEEAPKAVQAPQTAQPANLETV

SEQ ID NO: 1571882 - protein, 80 aa, Staphylococcus aureus
QDLNRRNQQQIPQNSAANNETSNSAPAAGNGVASTPPSAPNGNTAPNNNVTQNTAPNSNNAPVSTTPQSTSGKKDGQSFA

SEQ ID NO: 1571883 - protein, 81 aa, Staphylococcus aureus
QDLNRRNQQQIPQNSAANNETSNSAPAAGNGVTSTPPSAPNGNTTPNNNVTQNTAPNSNNAPVSTTPQSTSGKKDGQSFAD

SEQ ID NO: 1571884 - protein, 6 aa, Staphylococcus aureus
QDQTWE

SEQ ID NO: 1571885 - protein, 6 aa, Staphylococcus aureus
QDVTEI

SEQ ID NO: 1571886 - protein, 5 aa, Staphylococcus aureus
QEEDV

SEQ ID NO: 1571887 - protein, 99 aa, Staphylococcus aureus
QEKEAAASEQNNTTVEESGSSATESKASETQTTTNNVNTIDETQSYSATSTEQPSKSTQVTTEEAPTTVQAPKVETEMKSQEDLPSEKVADKETTGTQV

SEQ ID NO: 1571888 - protein, 4 aa, Staphylococcus aureus
QELA

SEQ ID NO: 1571889 - protein, 10 aa, Staphylococcus aureus
QENNNRQRQY

SEQ ID NO: 1571890 - protein, 7 aa, Staphylococcus aureus
QERHRIG

SEQ ID NO: 1571891 - protein, 5 aa, Staphylococcus aureus
QEWKS

SEQ ID NO: 1571892 - protein, 5 aa, Staphylococcus aureus
QFGGT

SEQ ID NO: 1571893 - protein, 11 aa, Staphylococcus aureus
QFQSKKPKKDY

SEQ ID NO: 1571894 - protein, 24 aa, Staphylococcus aureus
QFYKGQKQIAGKPITKETAEKVEK

SEQ ID NO: 1571895 - protein, 24 aa, Staphylococcus aureus
QFYKGQKQIAGKPMTKDTAEKVEK

SEQ ID NO: 1571896 - protein, 19 aa, Staphylococcus aureus
QGAKTRGGHMEAEKVNEEI

SEQ ID NO: 1571897 - protein, 10 aa, Staphylococcus aureus
QGETSGFSSF

SEQ ID NO: 1571898 - protein, 29 aa, Staphylococcus aureus
QGIADKDQTKASGNFVNADTDKQNAYNNA

SEQ ID NO: 1571899 - protein, 9 aa, Staphylococcus aureus
QGKKDLKAE

SEQ ID NO: 1571900 - protein, 4 aa, Staphylococcus aureus
QGLQ

SEQ ID NO: 1571901 - protein, 10 aa, Staphylococcus aureus
QGMTQAPYTE

SEQ ID NO: 1571902 - protein, 13 aa, Staphylococcus aureus
QGNEQKANNVDAA

SEQ ID NO: 1571903 - protein, 8 aa, Staphylococcus aureus
QGSKPYKL

SEQ ID NO: 1571904 - protein, 9 aa, Staphylococcus aureus
QGSLQSVNT

SEQ ID NO: 1571905 - protein, 7 aa, Staphylococcus aureus
QGVGPKV

SEQ ID NO: 1571906 - protein, 4 aa, Staphylococcus aureus
QIDY

SEQ ID NO: 1571907 - protein, 27 aa, Staphylococcus aureus
QIHGQNKGDQSFEEDTEKDKPKYEHGG

SEQ ID NO: 1571908 - protein, 23 aa, Staphylococcus aureus
QINNAATRGEVAQKLAEAKALDQ

SEQ ID NO: 1571909 - protein, 4 aa, Staphylococcus aureus
QIPK

SEQ ID NO: 1571910 - protein, 20 aa, Staphylococcus aureus
QIRKSKDTSEDQAVSTTDNY

SEQ ID NO: 1571911 - protein, 34 aa, Staphylococcus aureus
QIRKSKDTSKDPAVSTTDNNHEVAKTSNNDGSGH

SEQ ID NO: 1571912 - protein, 24 aa, Staphylococcus aureus
QITQSSDIAAVNGHKQTAESLNTA

SEQ ID NO: 1571913 - protein, 22 aa, Staphylococcus aureus
QITSGNERTSSVNGPPGTGKTT

SEQ ID NO: 1571914 - protein, 17 aa, Staphylococcus aureus
QKAQEKVSDKLDRTLDE

SEQ ID NO: 1571915 - protein, 13 aa, Staphylococcus aureus
QKGAPKLVEKSMK

SEQ ID NO: 1571916 - protein, 38 aa, Staphylococcus aureus
QKGEDGEKTTTTPTKVDPDTGDVVERGEPTTEVTKNPV

SEQ ID NO: 1571917 - protein, 20 aa, Staphylococcus aureus
QKGPMGSYSAKGYINNNKKY

SEQ ID NO: 1571918 - protein, 15 aa, Staphylococcus aureus
QKLDQDKQRATETLN

SEQ ID NO: 1571919 - protein, 16 aa, Staphylococcus aureus
QKMPGDGGDTPHQDMA

SEQ ID NO: 1571920 - protein, 6 aa, Staphylococcus aureus
QKNKAI

SEQ ID NO: 1571921 - protein, 6 aa, Staphylococcus aureus
QKNKRI

SEQ ID NO: 1571922 - protein, 6 aa, Staphylococcus aureus
QKNWQS

SEQ ID NO: 1571923 - protein, 6 aa, Staphylococcus aureus
QKQRNA

SEQ ID NO: 1571924 - protein, 10 aa, Staphylococcus aureus
QKRGIDPKKY

SEQ ID NO: 1571925 - protein, 7 aa, Staphylococcus aureus
QKTQEQV

SEQ ID NO: 1571926 - protein, 26 aa, Staphylococcus aureus
QKYKRTADKTKDVELSANDKKLQKTI

SEQ ID NO: 1571927 - protein, 5 aa, Staphylococcus aureus
QLAQA

SEQ ID NO: 1571928 - protein, 9 aa, Staphylococcus aureus
QLDENNKEI

SEQ ID NO: 1571929 - protein, 10 aa, Staphylococcus aureus
QLIQPRTSQG

SEQ ID NO: 1571930 - protein, 66 aa, Staphylococcus aureus
QLNQAKNDLNGDNKVAQAKESAKRALASYSNLNNAQSTAATSQIDNATTVAGVTAAQNTANELNTA

SEQ ID NO: 1571931 - protein, 5 aa, Staphylococcus aureus
QLRPK

SEQ ID NO: 1571932 - protein, 20 aa, Staphylococcus aureus
QLSASSKAHYKAQLNEAKTA

SEQ ID NO: 1571933 - protein, 7 aa, Staphylococcus aureus
QLSKAQQ

SEQ ID NO: 1571934 - protein, 6 aa, Staphylococcus aureus
QLSSKL

SEQ ID NO: 1571935 - protein, 5 aa, Staphylococcus aureus
QLTES

SEQ ID NO: 1571936 - protein, 12 aa, Staphylococcus aureus
QNAKGGALEGKG

SEQ ID NO: 1571937 - protein, 10 aa, Staphylococcus aureus
QNATGLPTDG

SEQ ID NO: 1571938 - protein, 9 aa, Staphylococcus aureus
QNDTSDELK

SEQ ID NO: 1571939 - protein, 10 aa, Staphylococcus aureus
QNDTSDELKD

SEQ ID NO: 1571940 - protein, 4 aa, Staphylococcus aureus
QNEK

SEQ ID NO: 1571941 - protein, 13 aa, Staphylococcus aureus
QNFRNASDQLKTT

SEQ ID NO: 1571942 - protein, 31 aa, Staphylococcus aureus
QNGINDKANTLASENYHDADSDKKTAYTQAV

SEQ ID NO: 1571943 - protein, 13 aa, Staphylococcus aureus
QNGINDQDTVKQQ

SEQ ID NO: 1571944 - protein, 13 aa, Staphylococcus aureus
QNLDPLQSPNSQH

SEQ ID NO: 1571945 - protein, 17 aa, Staphylococcus aureus
QNLGEKLGNPKSGSAVL

SEQ ID NO: 1571946 - protein, 4 aa, Staphylococcus aureus
QNNN

SEQ ID NO: 1571947 - protein, 6 aa, Staphylococcus aureus
QNNQGT

SEQ ID NO: 1571948 - protein, 9 aa, Staphylococcus aureus
QNNTSGELK

SEQ ID NO: 1571949 - protein, 5 aa, Staphylococcus aureus
QNPLA

SEQ ID NO: 1571950 - protein, 6 aa, Staphylococcus aureus
QNQGKT

SEQ ID NO: 1571951 - protein, 19 aa, Staphylococcus aureus
QNQQNQQYQQYGQKKSKKG

SEQ ID NO: 1571952 - protein, 5 aa, Staphylococcus aureus
QNRHE

SEQ ID NO: 1571953 - protein, 7 aa, Staphylococcus aureus
QNRSLQG

SEQ ID NO: 1571954 - protein, 7 aa, Staphylococcus aureus
QNSQTAQ

SEQ ID NO: 1571955 - protein, 12 aa, Staphylococcus aureus
QNTYEPGSTFKS

SEQ ID NO: 1571956 - protein, 49 aa, Staphylococcus aureus
QNYNNKSEVAGNRSTEHPSSDIHKTVDKTVKTKEKASTPSKENKLGQSK

SEQ ID NO: 1571957 - protein, 19 aa, Staphylococcus aureus
QNYNNTIKVTDKKTTEHLP

SEQ ID NO: 1571958 - protein, 21 aa, Staphylococcus aureus
QPAKQKATSKAEVQRKGQVLE

SEQ ID NO: 1571959 - protein, 9 aa, Staphylococcus aureus
QPKGYDLNN

SEQ ID NO: 1571960 - protein, 15 aa, Staphylococcus aureus
QPKNTDNYYKIYVIN

SEQ ID NO: 1571961 - protein, 6 aa, Staphylococcus aureus
QPVVKE

SEQ ID NO: 1571962 - protein, 6 aa, Staphylococcus aureus
QQAPVE

SEQ ID NO: 1571963 - protein, 7 aa, Staphylococcus aureus
QQASTSL

SEQ ID NO: 1571964 - protein, 8 aa, Staphylococcus aureus
QQIETSGS

SEQ ID NO: 1571965 - protein, 36 aa, Staphylococcus aureus
QQIRKSKDTSKDPEVSTTDNNHEVAKTPNNDDSGHG

SEQ ID NO: 1571966 - protein, 7 aa, Staphylococcus aureus
QQQGDIP

SEQ ID NO: 1571967 - protein, 21 aa, Staphylococcus aureus
QQSHKNLSSTIGEPNANPYAS

SEQ ID NO: 1571968 - protein, 7 aa, Staphylococcus aureus
QQVTHQP

SEQ ID NO: 1571969 - protein, 8 aa, Staphylococcus aureus
QQVTHQPA

SEQ ID NO: 1571970 - protein, 10 aa, Staphylococcus aureus
QREIDGPFEK

SEQ ID NO: 1571971 - protein, 11 aa, Staphylococcus aureus
QRELTRAKSMA

SEQ ID NO: 1571972 - protein, 8 aa, Staphylococcus aureus
QREMDGPF

SEQ ID NO: 1571973 - protein, 35 aa, Staphylococcus aureus
QRGINDEAATKAAQKYTDADRDKQTAYNDAVTAAK

SEQ ID NO: 1571974 - protein, 6 aa, Staphylococcus aureus
QRGSNI

SEQ ID NO: 1571975 - protein, 24 aa, Staphylococcus aureus
QRLQLGNPKNKTNTPLISESSDRH

SEQ ID NO: 1571976 - protein, 5 aa, Staphylococcus aureus
QRTRD

SEQ ID NO: 1571977 - protein, 5 aa, Staphylococcus aureus
QRVHQ

SEQ ID NO: 1571978 - protein, 15 aa, Staphylococcus aureus
QSEKGSQSVSNKNNK

SEQ ID NO: 1571979 - protein, 8 aa, Staphylococcus aureus
QSEKRGST

SEQ ID NO: 1571980 - protein, 35 aa, Staphylococcus aureus
QSGINDEAATKAAQKYTDADRGKQTAYNDAVTAAK

SEQ ID NO: 1571981 - protein, 11 aa, Staphylococcus aureus
QSHKGASKQKI

SEQ ID NO: 1571982 - protein, 12 aa, Staphylococcus aureus
QSHSLTKTLSNN

SEQ ID NO: 1571983 - protein, 34 aa, Staphylococcus aureus
QSIADKDATRASSAYVNAKPNKKQAYDEAVQNAE

SEQ ID NO: 1571984 - protein, 100 aa, Staphylococcus aureus
QSISGSTSGSTSISTSESLSMSGSTHNSTSVSDSDSVSMSNSTSTSMSDSTSVSDSESVSTSASTSLSTSDSTSTSESLSASMSGSQSISDSTSTSMSNS

SEQ ID NO: 1571985 - protein, 107 aa, Staphylococcus aureus
QSISGSTSGSTSISTSESLSMSGSTHNSTSVSDSDSVSMSNSTSTSMSDSTSVSDSESVSTSASTSLSTSESLSASMSGSQSISDSTSTSMSDSTSMSDSESVSMSN

SEQ ID NO: 1571986 - protein, 24 aa, Staphylococcus aureus
QSISGSTSTSTSTSLSDSTSTSLS

SEQ ID NO: 1571987 - protein, 5 aa, Staphylococcus aureus
QSKIG

SEQ ID NO: 1571988 - protein, 6 aa, Staphylococcus aureus
QSKLSD

SEQ ID NO: 1571989 - protein, 8 aa, Staphylococcus aureus
QSMEQASQ

SEQ ID NO: 1571990 - protein, 6 aa, Staphylococcus aureus
QSSSID

SEQ ID NO: 1571991 - protein, 10 aa, Staphylococcus aureus
QSTLEKQKER

SEQ ID NO: 1571992 - protein, 11 aa, Staphylococcus aureus
QSVQTNGQALN

SEQ ID NO: 1571993 - protein, 25 aa, Staphylococcus aureus
QSVTSTENALNGDANLQRAKTEAIQ

SEQ ID NO: 1571994 - protein, 12 aa, Staphylococcus aureus
QTITEGIKDDGV

SEQ ID NO: 1571995 - protein, 7 aa, Staphylococcus aureus
QTLGTNQ

SEQ ID NO: 1571996 - protein, 7 aa, Staphylococcus aureus
QTNNQLR

SEQ ID NO: 1571997 - protein, 24 aa, Staphylococcus aureus
QTSGIPSDITSEDTVTNKNNRLND

SEQ ID NO: 1571998 - protein, 13 aa, Staphylococcus aureus
QTSSKANTDVRGL

SEQ ID NO: 1571999 - protein, 6 aa, Staphylococcus aureus
QTTVTE

SEQ ID NO: 1572000 - protein, 7 aa, Staphylococcus aureus
QVDAKDA

SEQ ID NO: 1572001 - protein, 5 aa, Staphylococcus aureus
QVDIK

SEQ ID NO: 1572002 - protein, 13 aa, Staphylococcus aureus
QVQTNGLYENSKP

SEQ ID NO: 1572003 - protein, 29 aa, Staphylococcus aureus
QVTDAKNGLNGEAKLATEKQNAKDAVSGM

SEQ ID NO: 1572004 - protein, 27 aa, Staphylococcus aureus
QVTSTKEALNGDAKLAEAKAAAKQNLG

SEQ ID NO: 1572005 - protein, 6 aa, Staphylococcus aureus
QYDQSN

SEQ ID NO: 1572006 - protein, 16 aa, Staphylococcus aureus
QYMTTSGNTTYDQSTG

SEQ ID NO: 1572007 - protein, 4 aa, Staphylococcus aureus
QYST

SEQ ID NO: 1572008 - protein, 12 aa, Staphylococcus aureus
QYTPSEDTRYES

SEQ ID NO: 1572009 - protein, 10 aa, Staphylococcus aureus
RAKAPKSGIY

SEQ ID NO: 1572010 - protein, 15 aa, Staphylococcus aureus
RAKDEGYKVNSKPAV

SEQ ID NO: 1572011 - protein, 5 aa, Staphylococcus aureus
RAMPV

SEQ ID NO: 1572012 - protein, 17 aa, Staphylococcus aureus
RANAKRGYTNYNNPVHQ

SEQ ID NO: 1572013 - protein, 5 aa, Staphylococcus aureus
RAQSF

SEQ ID NO: 1572014 - protein, 44 aa, Staphylococcus aureus
RAVTPQNHVTHGPKDSMVRSEGKHSISSHEMKSSKYVESPNYTK

SEQ ID NO: 1572015 - protein, 5 aa, Staphylococcus aureus
RDIEP

SEQ ID NO: 1572016 - protein, 9 aa, Staphylococcus aureus
RDKFGNSNV

SEQ ID NO: 1572017 - protein, 25 aa, Staphylococcus aureus
RDNHNVQTELTGTGMTSTDIGGNSE

SEQ ID NO: 1572018 - protein, 16 aa, Staphylococcus aureus
RDRVKDKASGRKTSPI

SEQ ID NO: 1572019 - protein, 13 aa, Staphylococcus aureus
RDRVKDKVSGRKT

SEQ ID NO: 1572020 - protein, 33 aa, Staphylococcus aureus
RDSIANEATIKAGQNYTDASPNNRNEYDSAVSA

SEQ ID NO: 1572021 - protein, 83 aa, Staphylococcus aureus
RDSIANETTVKASQNYTDASPNNQSTYNSAVSNAKGIINQTNNPTMDASAITQAATQVNNAKNGLNGAENLRNAQNTAKQNLN

SEQ ID NO: 1572022 - protein, 83 aa, Staphylococcus aureus
RDSIANETTVKASQNYTDASPNNQSTYNSAVSNAKGIINQTNNPTMDASAITQATTQVNNAKNGLNGAENLRNAQNTAKQNLN

SEQ ID NO: 1572023 - protein, 5 aa, Staphylococcus aureus
RDSKG

SEQ ID NO: 1572024 - protein, 8 aa, Staphylococcus aureus
REANNEME

SEQ ID NO: 1572025 - protein, 5 aa, Staphylococcus aureus
REFDG

SEQ ID NO: 1572026 - protein, 16 aa, Staphylococcus aureus
REFSKAETQRMQFIYD

SEQ ID NO: 1572027 - protein, 8 aa, Staphylococcus aureus
REGKKKID

SEQ ID NO: 1572028 - protein, 6 aa, Staphylococcus aureus
REHRRK

SEQ ID NO: 1572029 - protein, 4 aa, Staphylococcus aureus
REME

SEQ ID NO: 1572030 - protein, 28 aa, Staphylococcus aureus
RENSHKDRQNQKPPQKTSTDNEPKKGGF

SEQ ID NO: 1572031 - protein, 4 aa, Staphylococcus aureus
RESM

SEQ ID NO: 1572032 - protein, 4 aa, Staphylococcus aureus
REVG

SEQ ID NO: 1572033 - protein, 8 aa, Staphylococcus aureus
REVSNPDL

SEQ ID NO: 1572034 - protein, 4 aa, Staphylococcus aureus
REYE

SEQ ID NO: 1572035 - protein, 12 aa, Staphylococcus aureus
RFASTGDTSSDD

SEQ ID NO: 1572036 - protein, 18 aa, Staphylococcus aureus
RFDVPEEERKALPKYRNH

SEQ ID NO: 1572037 - protein, 6 aa, Staphylococcus aureus
RFGEPE

SEQ ID NO: 1572038 - protein, 5 aa, Staphylococcus aureus
RGAMG

SEQ ID NO: 1572039 - protein, 34 aa, Staphylococcus aureus
RGINDEAATKAAQKYTDADRDKQTAYNDAVTAAK

SEQ ID NO: 1572040 - protein, 7 aa, Staphylococcus aureus
RGNPSIE

SEQ ID NO: 1572041 - protein, 11 aa, Staphylococcus aureus
RGQATHTVQQS

SEQ ID NO: 1572042 - protein, 7 aa, Staphylococcus aureus
RGQNNQW

SEQ ID NO: 1572043 - protein, 4 aa, Staphylococcus aureus
RGSY

SEQ ID NO: 1572044 - protein, 6 aa, Staphylococcus aureus
RGTAMG

SEQ ID NO: 1572045 - protein, 55 aa, Staphylococcus aureus
RGTVSSGREGSDRALEGTAISSMSGKQLANMSAPKGSAHEKQLPKTGTDQSSSPA

SEQ ID NO: 1572046 - protein, 55 aa, Staphylococcus aureus
RGTVSSGREGSGRTLEGTAVSSKSGKQLASMSAPKSSAHKKQLPKTGADQSSSPV

SEQ ID NO: 1572047 - protein, 14 aa, Staphylococcus aureus
RGTVSSGTEGSDCA

SEQ ID NO: 1572048 - protein, 28 aa, Staphylococcus aureus
RGTVSSGTEGSGRTLEGATVSSKSENQL

SEQ ID NO: 1572049 - protein, 11 aa, Staphylococcus aureus
RGVRNKTPEIM

SEQ ID NO: 1572050 - protein, 18 aa, Staphylococcus aureus
RIGTTKRVEVRQGNVQTK

SEQ ID NO: 1572051 - protein, 5 aa, Staphylococcus aureus
RILND

SEQ ID NO: 1572052 - protein, 107 aa, Staphylococcus aureus
RKADEKTTNNTAIDKKSGKQSKKTTPSNKRNASKASTNKTSGQKKQHNKKSAQGAKKQSSSSKSTQKNNQISNKNSKTTNAKSSNASKTSNAKVEKAKSKIEKRTFN

SEQ ID NO: 1572053 - protein, 107 aa, Staphylococcus aureus
RKADEKTTNNTAVDKKSGKQSKKTTPSNKRNASKASTNKTSGQKKQHNKKSSQGAKKQSSSSKSTQKNNQTSNKNSKTTNAKSSNASKKSNAKVEKAKSKIEKRTFN

SEQ ID NO: 1572054 - protein, 78 aa, Staphylococcus aureus
RKAKRQQKEQHFATRQSNQSKFKASDLDKTTDQSSQHTAREEARIDNQDNQNQVSLNKQTEGSEQDQELFNDNKDDVA

SEQ ID NO: 1572055 - protein, 5 aa, Staphylococcus aureus
RKDEY

SEQ ID NO: 1572056 - protein, 37 aa, Staphylococcus aureus
RKFNPDLAPGTEKVTREGQKGEKTITTPTLKNPLTGE

SEQ ID NO: 1572057 - protein, 6 aa, Staphylococcus aureus
RKGDLD

SEQ ID NO: 1572058 - protein, 50 aa, Staphylococcus aureus
RKGQDEFNKRRQKRAEDKKNKRKNQLDNPEPPMINDNPNKPNRNQQSDPI

SEQ ID NO: 1572059 - protein, 10 aa, Staphylococcus aureus
RKITKDSKMQ

SEQ ID NO: 1572060 - protein, 6 aa, Staphylococcus aureus
RKKRTR

SEQ ID NO: 1572061 - protein, 11 aa, Staphylococcus aureus
RKSKNMSQEKL

SEQ ID NO: 1572062 - protein, 11 aa, Staphylococcus aureus
RKSRQNAPAYH

SEQ ID NO: 1572063 - protein, 12 aa, Staphylococcus aureus
RKSTDEDIQTNN

SEQ ID NO: 1572064 - protein, 9 aa, Staphylococcus aureus
RKTDTSPRY

SEQ ID NO: 1572065 - protein, 23 aa, Staphylococcus aureus
RLQLGNPKNRTNTPLISESSDRH

SEQ ID NO: 1572066 - protein, 23 aa, Staphylococcus aureus
RLQLGNPKSKANTPLISESSDRH

SEQ ID NO: 1572067 - protein, 9 aa, Staphylococcus aureus
RLSNKAANV

SEQ ID NO: 1572068 - protein, 26 aa, Staphylococcus aureus
RNDSNTDRSTKPAATAPTSVAPKRVN

SEQ ID NO: 1572069 - protein, 5 aa, Staphylococcus aureus
RNGHW

SEQ ID NO: 1572070 - protein, 6 aa, Staphylococcus aureus
RNGLAD

SEQ ID NO: 1572071 - protein, 4 aa, Staphylococcus aureus
RNRA

SEQ ID NO: 1572072 - protein, 7 aa, Staphylococcus aureus
RNTKTAK

SEQ ID NO: 1572073 - protein, 9 aa, Staphylococcus aureus
RNTKTTKGE

SEQ ID NO: 1572074 - protein, 33 aa, Staphylococcus aureus
RNTSKKRRQRKRSKATHFSNQNKDDTSQQADFD

SEQ ID NO: 1572075 - protein, 32 aa, Staphylococcus aureus
RNTSKKRRQRKRSKATHFSNRNKDDTSQQADF

SEQ ID NO: 1572076 - protein, 32 aa, Staphylococcus aureus
RNTSKKRRQRKRSKTTHFSNQNKDDTSQQADF

SEQ ID NO: 1572077 - protein, 13 aa, Staphylococcus aureus
RNVKDNKGTASVI

SEQ ID NO: 1572078 - protein, 5 aa, Staphylococcus aureus
RPKKL

SEQ ID NO: 1572079 - protein, 5 aa, Staphylococcus aureus
RPNPM

SEQ ID NO: 1572080 - protein, 71 aa, Staphylococcus aureus
RQAKYKQKSTEELGIEDDGYYAESEVDPKELKAQQKREKAEIKAKKKEKRKAYNQRMKERRKNQPSAVSQR

SEQ ID NO: 1572081 - protein, 6 aa, Staphylococcus aureus
RQAQTF

SEQ ID NO: 1572082 - protein, 5 aa, Staphylococcus aureus
RQIDS

SEQ ID NO: 1572083 - protein, 7 aa, Staphylococcus aureus
RQIDSAV

SEQ ID NO: 1572084 - protein, 11 aa, Staphylococcus aureus
RQKNEKTKKQY

SEQ ID NO: 1572085 - protein, 13 aa, Staphylococcus aureus
RQPDANYPGPVSD

SEQ ID NO: 1572086 - protein, 5 aa, Staphylococcus aureus
RQRDG

SEQ ID NO: 1572087 - protein, 14 aa, Staphylococcus aureus
RQRDGLAPIPDGYG

SEQ ID NO: 1572088 - protein, 16 aa, Staphylococcus aureus
RQRDGLAPISGGNGSI

SEQ ID NO: 1572089 - protein, 6 aa, Staphylococcus aureus
RQRPHP

SEQ ID NO: 1572090 - protein, 82 aa, Staphylococcus aureus
RRAQDLNRRNQQQIPQNSAANNETSNSAPAAGNGVAPPSAPSGDTAPNNNVTQNTAPNSNNAPVSTTPQSTSGKKDGQSFAD

SEQ ID NO: 1572091 - protein, 84 aa, Staphylococcus aureus
RRAQDLNRRNQQQIPQNSAANNETSNSAPAAGNGVASTPPSAPSGDTAPNNNVTQNTAPNSNNAPVSTTPQSTSGKKDGQSFAD

SEQ ID NO: 1572092 - protein, 80 aa, Staphylococcus aureus
RRAQDLNRRNQQQIPQNSAANNETSNSAPAAGNGVASTPPSGDTAPNNNVTQNTAPNSNNAPVSTTPQSTSGKKDGQSFA

SEQ ID NO: 1572093 - protein, 84 aa, Staphylococcus aureus
RRAQDLNRRNQQQIPQNSAANNETSNSSPAAGNGVASTPPSAPSGDTAPNNNVTQNTAPNSNNAPVSTTPQSTSGKKDGQSFAD

SEQ ID NO: 1572094 - protein, 9 aa, Staphylococcus aureus
RRDATEPIN

SEQ ID NO: 1572095 - protein, 57 aa, Staphylococcus aureus
RRKAKRQQKEQHFATRQSNQSKFKASDLDRTTDQSSQHTAREEARIDNKDNQNQVSL

SEQ ID NO: 1572096 - protein, 21 aa, Staphylococcus aureus
RRKDKEEDVETTSIESKDEDV

SEQ ID NO: 1572097 - protein, 23 aa, Staphylococcus aureus
RRKDKEVDVETTTSIESNEDDAP

SEQ ID NO: 1572098 - protein, 28 aa, Staphylococcus aureus
RRKEDEEEELEIRDNSKDKKKGSIEGTK

SEQ ID NO: 1572099 - protein, 20 aa, Staphylococcus aureus
RRKEDEENVEVTNEHTDEKV

SEQ ID NO: 1572100 - protein, 57 aa, Staphylococcus aureus
RRKSKRQQKEQQFATRQSNHSKFKASDLDKTTDQSSQHTAREEARIDNQDNQNQVSL

SEQ ID NO: 1572101 - protein, 57 aa, Staphylococcus aureus
RRKSKRQQKEQRFATRQSNHSKFKASDLDKTTDQSSQHTAREEARIDNQDNQNQVSL

SEQ ID NO: 1572102 - protein, 28 aa, Staphylococcus aureus
RRRKEDEEDVEVKNENTDEKVLKDNEHS

SEQ ID NO: 1572103 - protein, 29 aa, Staphylococcus aureus
RRRKEEEEDVEVTNENTDEKVLKDNEHSP

SEQ ID NO: 1572104 - protein, 18 aa, Staphylococcus aureus
RSENEVDDMIEEPKKEKT

SEQ ID NO: 1572105 - protein, 9 aa, Staphylococcus aureus
RSFKENGDW

SEQ ID NO: 1572106 - protein, 9 aa, Staphylococcus aureus
RSLNDGEKA

SEQ ID NO: 1572107 - protein, 7 aa, Staphylococcus aureus
RSNAKRW

SEQ ID NO: 1572108 - protein, 9 aa, Staphylococcus aureus
RSNPPQEIQ

SEQ ID NO: 1572109 - protein, 120 aa, Staphylococcus aureus
RSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFD

SEQ ID NO: 1572110 - protein, 5 aa, Staphylococcus aureus
RSSIT

SEQ ID NO: 1572111 - protein, 6 aa, Staphylococcus aureus
RSTNED

SEQ ID NO: 1572112 - protein, 7 aa, Staphylococcus aureus
RTPNVTP

SEQ ID NO: 1572113 - protein, 13 aa, Staphylococcus aureus
RTQAVRERSRSNE

SEQ ID NO: 1572114 - protein, 14 aa, Staphylococcus aureus
RTSISKTNGKDTVN

SEQ ID NO: 1572115 - protein, 5 aa, Staphylococcus aureus
RTYTT

SEQ ID NO: 1572116 - protein, 5 aa, Staphylococcus aureus
RVGPF

SEQ ID NO: 1572117 - protein, 13 aa, Staphylococcus aureus
RVNNAKDALNGDA

SEQ ID NO: 1572118 - protein, 7 aa, Staphylococcus aureus
RVSHEDL

SEQ ID NO: 1572119 - protein, 6 aa, Staphylococcus aureus
RVTTKS

SEQ ID NO: 1572120 - protein, 154 aa, Staphylococcus aureus
RYGGGSADGDSAVNPKDPTPGPPVAPEPSPDPEPEPTPDPEPSPEPDPEPTPDPEPSPDPDPDSDSDSESDSDSDSGSDSDSDSDSDSDSDSDSGSDSDSDSDSDSESDSDSDSDSDSESDSDSDSDSESDSDSDSDSDSDSDSDNDSDSDSDS

SEQ ID NO: 1572121 - protein, 307 aa, Staphylococcus aureus
RYGGGSADGDSAVNPKDPTPGPPVDPEPEPEPTPDPEPSPDPDPEPTPDPEPSPEPDPDSDSDSDSGSDSDSGSDSDSDSDSNSDSDSDSDSDSDSDSDSDSNSDSDSDSDSDSDSDSDSDSDSDLDSDSESDSDSDSDSDSDSDSDSDSDSDSDSDSDSDSDSDSDSDSDSDSDSDSDSDSDSDSDSDSDSDSDSDSDSDSDSDSDSDSDSDSESDSDSDSDSDSDSDSDSDSDSDSESDSDSDSDSDIDSDSDSDSDSRVTPPNNEQKAPSNPKGEVNHSNKVSKQHKTDALPETGDKSENTNAT

SEQ ID NO: 1572122 - protein, 76 aa, Staphylococcus aureus
RYGGGSADGDSAVNPKDPTPGPPVDPEPSPDPEPEPEPTPDPEPSPDPEPEPSPDPDPDSDSDSDSGSDSDSGSDS

SEQ ID NO: 1572123 - protein, 117 aa, Staphylococcus aureus
RYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSD

SEQ ID NO: 1572124 - protein, 178 aa, Staphylococcus aureus
RYGGGSADGDSAVNPKDPTPGPPVDPEPSPDPEPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDS

SEQ ID NO: 1572125 - protein, 169 aa, Staphylococcus aureus
RYGGGSADGDSAVNPKDPTPGPPVDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDNDSDSDSDSDSDAGKHTPAKPMSTVKDQHKTAKALPETGSENNNSNNGTL

SEQ ID NO: 1572126 - protein, 353 aa, Staphylococcus aureus
RYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSESDSDSDSDSDSDSDSDSDSDSDSDSDSDSDSDSDSESDSDSDSDSDSDSDSDSDSDSDSDSDSDSDSDSDSDSESDSDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNAT

SEQ ID NO: 1572127 - protein, 351 aa, Staphylococcus aureus
RYGGGSADGDSAVNPKDPTPGPPVDPEPSPDPEPEPSPDPDPEPTPDPEPSPDPDPDSDSDSDSGSDSDSDSDSDSDSDSDSGSDSDSDSDSDSESDSESDSDSDSESDSDSDSDSESDSDSDSDSDSDSDSDSDSDSDSDSDSDSDSDSDSDSESDSDSDSDSESDSDSDSDSDSDSDSDSDSDSDSDSDSDSDSDSDSESDSDSDSDSDSDSDSDSDSDSDSDSDSDSDSDSDSDSESDSDSDSDSDSDSDSDSDSDSDSDSDSDSDSDSESDSDSDSDSDSDSDSDSDSDSDSDSDSDSDSRVTPPNNEQKAPSNPKGEVNHSNKVSKQHKTDALPETGDKSENTNAT

SEQ ID NO: 1572128 - protein, 69 aa, Staphylococcus aureus
RYGGGSADGDSAVNPKDPTPGPPVDPEPSPDPEPEPTPDPEPSPDPEPEPSPDPDPDSDSDSDSGSDSD

SEQ ID NO: 1572129 - protein, 120 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSDSDSDSDSDSDSDSDTRFRI

SEQ ID NO: 1572130 - protein, 135 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSD

SEQ ID NO: 1572131 - protein, 197 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSDSDSDSDSDSDSDSRVTPPNNEQKAPSNPKGEVNHSNKVSKQHKTDALPETGDKSENTNAT

SEQ ID NO: 1572132 - protein, 176 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDS

SEQ ID NO: 1572133 - protein, 194 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDS

SEQ ID NO: 1572134 - protein, 234 aa, Staphylococcus aureus
RYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSESDSDSDSDSDSDSDSDSESDSDSESDSESDSDSDSDSDSDSDSDSDSDSDSDSDSDSDSDSDSDSESDSDSDSDSDSDSDSDSDSDSDSDSDSDSDSDSDSDSDSDSDSDSDYRF

SEQ ID NO: 1572135 - protein, 186 aa, Staphylococcus aureus
RYGGGSADGDSAVNPVDPTPGPPVDPEPEPEPKPDPEPSPDPEPEPTPDPEPSPDPEPEPTPDPEPTPDPEPSPDPEPSPDPEPSPDPDPDSDSDSDSDSGSDSDSDSESDSDSDSDSGSDSDSDSESDSDSDSDSDSDSDSDSDSDSDSDSDSDSDSDSDSDSDSDSDSDSDSDSDSDSDSDSDS

SEQ ID NO: 1572136 - protein, 371 aa, Staphylococcus aureus
RYGGGSADGDSAVNPVDPTPGPPVDPEPEPEPTPDPEPSPEPDPEPEPTPDPEPSPDPDPEPTPDPEPSPEPDPDSDSDSDSGSDSDSGSDSDSDSDSDSDSDSDSDSDSDSDSDSDSESDSDSDSDSDSDSDSDSDSDSDSDSDSDSDSDSDSDSDSDSESDSDSDSDSDSDSDSDSDSDSDSNSDSESDSDSDSDSDSDSESDSESDSDSDSESDSDSDSDSESDSDSDSDSDSDSDSDSESDSDSDSDSDSDSESDSESDSDSDSDSDSDSDSDSDSDSDSDSDSDSESDSDSDSDSDSDSDSDSDSDSDSESDSDSDSDSRVTPPNNEQKAPSNPKGEVNHSNKASKQHQTDALPETGDKSENTNAT

SEQ ID NO: 1572137 - protein, 239 aa, Staphylococcus aureus
RYGGGSADGDSAVNPVDPTPGPPVDPEPEPEPTPDPEPSPEPDPEPEPTPDPEPSPDPDPEPTPDPEPSPEPDPDSDSDSDSGSDSDSGSDSDSDSDSDSDSDSDSDSDSDSDSDSDSESDSDSDSDSDSDSDSDSDSDSDSESDSDSDSDSDSDSDSESDSDSDSDSDSDSDSDSDSDSDSESDSDSDSDSRVTPPNNEQKAPSNPKGEVNHSNKASKQHQTDALPETGDKSENTNAT

SEQ ID NO: 1572138 - protein, 305 aa, Staphylococcus aureus
RYGGGSADGDSAVNPVDPTPGPPVDPEPEPEPTPDPEPSPEPEPEPEPTPDPEPSPDPDPEPTPDPEPSPEPDPDSDSDSDSGSDSDSDSDSDSESDSDSDSDSDSDSDSDSDSDSDSESDSDSDSDSDSDSDSDSDSDSDSNSDSESDSDSDSDSDSDSESDSESDSDSDSESDSDSDSDSESDSDSDSDSDSDSDSDSESDSDSDSDSDSDSDSDSDSDSDSESDSDSDSDSDSDSDSDSDSDSDSESDSDSDSDSRVTPPNNEQKAPSNPKGEVNHSNKASKQHQTDALPETGDKSENTNAT

SEQ ID NO: 1572139 - protein, 190 aa, Staphylococcus aureus
RYGGGSADGDSAVNPVDPTPGPPVDPEPEPEPTPDPEPSPEPEPEPEPTPDPEPSPDPDPEPTPDPEPSPEPDPDSDSDSDSGSDSDSGSDSDSDSDSDSDSDSDSDSDSDSDSDSDSESDSDSDSDSDSDSDSDSDSDSDSESDSESDSDSDSDSDSDSDSDSDSDSDSDSESDSDSDSDSDSDSDSDS

SEQ ID NO: 1572140 - protein, 283 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSESDSDSDSDSDSDSDSESDSDSESDSDSDSDSDSDSDSRVTPPNNEQKAPSNPKGEVNHSNKASKQHQTDALPETGDKSENTNAT

SEQ ID NO: 1572141 - protein, 96 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSES

SEQ ID NO: 1572142 - protein, 110 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDS

SEQ ID NO: 1572143 - protein, 152 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDS

SEQ ID NO: 1572144 - protein, 154 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDS

SEQ ID NO: 1572145 - protein, 198 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDS

SEQ ID NO: 1572146 - protein, 285 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESD

SEQ ID NO: 1572147 - protein, 379 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSDSDSDSDSDSESDSDSDSDSNSDSDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSDSDSDSESDSDSESDSDSDSDSDSDSDSRVTPPNNEQKAPSNPKGEVNHSNKASKQHQTDALPETGDKSENTNAT

SEQ ID NO: 1572148 - protein, 331 aa, Staphylococcus aureus
RYGGGSADGDSAVNPVDPTPGPPVDPEPEPEPTPDPEPSPEPEPEPTPDPEPSPEPDPDSDSDSDSGSDSDSGSDSDSDSDSDSDSDSDSNSDSESDSDSDSDSDSDSDSDSDSNSDSESDSDSDSDSDSDSDSDSDSDSDSDSGSDSESDSDSDSDSDSDSDSDSDSDSDSDSDSDSDSDSDSDSDSDSDSESDSDSDSDSDSDSDSDSDSDSDSDSDSDSDSDSDSESDSESDSDSDSESDSDSDSDSDSDSDSDSDSDSESDSDSESDSDSDSDSDSDSDSRVTPPNNEQKAPSNPKGEVNHSNKASKQHQTDALPETGDKSENTNAT

SEQ ID NO: 1572149 - protein, 8 aa, Staphylococcus aureus
RYSEKKDQ

SEQ ID NO: 1572150 - protein, 11 aa, Staphylococcus aureus
RYSNSKIDTEV

SEQ ID NO: 1572151 - protein, 16 aa, Staphylococcus aureus
RYSQNTINGKSNKARN

SEQ ID NO: 1572152 - protein, 4 aa, Staphylococcus aureus
RYST

SEQ ID NO: 1572153 - protein, 5 aa, Staphylococcus aureus
SAAIV

SEQ ID NO: 1572154 - protein, 7 aa, Staphylococcus aureus
SAAKQNT

SEQ ID NO: 1572155 - protein, 4 aa, Staphylococcus aureus
SADD

SEQ ID NO: 1572156 - protein, 28 aa, Staphylococcus aureus
SAEEGYVESAEDINKKLKDDEVEEEINK

SEQ ID NO: 1572157 - protein, 13 aa, Staphylococcus aureus
SAEQINATEEKLG

SEQ ID NO: 1572158 - protein, 7 aa, Staphylococcus aureus
SAGNHQI

SEQ ID NO: 1572159 - protein, 9 aa, Staphylococcus aureus
SAGNSGVYA

SEQ ID NO: 1572160 - protein, 6 aa, Staphylococcus aureus
SAHSEQ

SEQ ID NO: 1572161 - protein, 10 aa, Staphylococcus aureus
SAKGKETSRN

SEQ ID NO: 1572162 - protein, 10 aa, Staphylococcus aureus
SAKNSERRGM

SEQ ID NO: 1572163 - protein, 12 aa, Staphylococcus aureus
SARKLNKNNGNV

SEQ ID NO: 1572164 - protein, 6 aa, Staphylococcus aureus
SASAIE

SEQ ID NO: 1572165 - protein, 4 aa, Staphylococcus aureus
SASS

SEQ ID NO: 1572166 - protein, 17 aa, Staphylococcus aureus
SASTGRNEGLGITTPSA

SEQ ID NO: 1572167 - protein, 23 aa, Staphylococcus aureus
SATALRAAAQDTVTKKGTGNFTA

SEQ ID NO: 1572168 - protein, 47 aa, Staphylococcus aureus
SATNNPEMNPDTINQKASQVNSAKSELNGDEKLAAAKQTAKSDIGRL

SEQ ID NO: 1572169 - protein, 26 aa, Staphylococcus aureus
SAYSAANAATGKNIVTGRKLSKEERI

SEQ ID NO: 1572170 - protein, 117 aa, Staphylococcus aureus
SCSNNDETQESSNNQAQQDNTDQYVQQKDDELKSKVEDTKTSIENSNDDTQSKLQELKDEVNNLKNNANDDKAEKVANDYQDTVNQLDNAQTAKENGNDSKMKEELNKVNSKLDEIK

SEQ ID NO: 1572171 - protein, 10 aa, Staphylococcus aureus
SDAQEGDVIS

SEQ ID NO: 1572172 - protein, 6 aa, Staphylococcus aureus
SDEKIQ

SEQ ID NO: 1572173 - protein, 8 aa, Staphylococcus aureus
SDENSRMS

SEQ ID NO: 1572174 - protein, 17 aa, Staphylococcus aureus
SDHSKHSSNSDGQSNSH

SEQ ID NO: 1572175 - protein, 8 aa, Staphylococcus aureus
SDHTNVND

SEQ ID NO: 1572176 - protein, 15 aa, Staphylococcus aureus
SDHTTIEDTKEYTTE

SEQ ID NO: 1572177 - protein, 4 aa, Staphylococcus aureus
SDIG

SEQ ID NO: 1572178 - protein, 31 aa, Staphylococcus aureus
SDIHNESIDKQMEAKAHETAQNTDLKNEARS

SEQ ID NO: 1572179 - protein, 16 aa, Staphylococcus aureus
SDKEKVRHNHKTSLKP

SEQ ID NO: 1572180 - protein, 16 aa, Staphylococcus aureus
SDKEKVRHNNKTSLKP

SEQ ID NO: 1572181 - protein, 6 aa, Staphylococcus aureus
SDKNEI

SEQ ID NO: 1572182 - protein, 9 aa, Staphylococcus aureus
SDNEGDGTM

SEQ ID NO: 1572183 - protein, 9 aa, Staphylococcus aureus
SDNLTSASA

SEQ ID NO: 1572184 - protein, 5 aa, Staphylococcus aureus
SDNRT

SEQ ID NO: 1572185 - protein, 6 aa, Staphylococcus aureus
SDPVTG

SEQ ID NO: 1572186 - protein, 13 aa, Staphylococcus aureus
SDRDVQGGSTITQ

SEQ ID NO: 1572187 - protein, 60 aa, Staphylococcus aureus
SDSDSDSDSDSDSRVTPPNNEQKAPSNPKGEVNHSNKVSKQHKTDALPETGDKSENTNAT

SEQ ID NO: 1572188 - protein, 148 aa, Staphylococcus aureus
SDSNSMSNSTSTSMSDSTSMSDSESVSTSASTSLSTSNSESASVSISDSTSTSMSNSISMSDSTSSSMSNSMSMSTSESNSIHPSNSMSTSQTHFTSTSISTSESIAPNTNESQSTLSATSVSSKHDAEPAQSEERLPDTGDSIKQNG

SEQ ID NO: 1572189 - protein, 12 aa, Staphylococcus aureus
SDSVSERSLSDK

SEQ ID NO: 1572190 - protein, 8 aa, Staphylococcus aureus
SEENNESV

SEQ ID NO: 1572191 - protein, 5 aa, Staphylococcus aureus
SEKRK

SEQ ID NO: 1572192 - protein, 11 aa, Staphylococcus aureus
SELGKDDPFNP

SEQ ID NO: 1572193 - protein, 11 aa, Staphylococcus aureus
SELRSGKRKVN

SEQ ID NO: 1572194 - protein, 6 aa, Staphylococcus aureus
SELTKS

SEQ ID NO: 1572195 - protein, 7 aa, Staphylococcus aureus
SENEVNA

SEQ ID NO: 1572196 - protein, 8 aa, Staphylococcus aureus
SENNDKKT

SEQ ID NO: 1572197 - protein, 16 aa, Staphylococcus aureus
SENNNRVNKDKEEKYE

SEQ ID NO: 1572198 - protein, 53 aa, Staphylococcus aureus
SEPETPTPPTPEVPSEPETPTPPTPEVPTEPGKPIPPAKEEPKKPSKPVEQGK

SEQ ID NO: 1572199 - protein, 66 aa, Staphylococcus aureus
SESDDEVNNQKPLTLPEEQKLKRQQSQNEQTKTYTYGDSEQNDKSNHENDLSHHTPSISDDKDNVM

SEQ ID NO: 1572200 - protein, 16 aa, Staphylococcus aureus
SESDKSPYIQNKQEKK

SEQ ID NO: 1572201 - protein, 8 aa, Staphylococcus aureus
SESMSGKS

SEQ ID NO: 1572202 - protein, 11 aa, Staphylococcus aureus
SESQLKKYRGK

SEQ ID NO: 1572203 - protein, 9 aa, Staphylococcus aureus
SESSSKGRI

SEQ ID NO: 1572204 - protein, 26 aa, Staphylococcus aureus
SETALTAANKTKLKTEADKGDKKAKG

SEQ ID NO: 1572205 - protein, 5 aa, Staphylococcus aureus
SETGK

SEQ ID NO: 1572206 - protein, 10 aa, Staphylococcus aureus
SETPGYKTPL

SEQ ID NO: 1572207 - protein, 4 aa, Staphylococcus aureus
SETS

SEQ ID NO: 1572208 - protein, 14 aa, Staphylococcus aureus
SEYGNKFSKDDAQY

SEQ ID NO: 1572209 - protein, 12 aa, Staphylococcus aureus
SEYQQVSNNQGV

SEQ ID NO: 1572210 - protein, 9 aa, Staphylococcus aureus
SFESKEPVT

SEQ ID NO: 1572211 - protein, 10 aa, Staphylococcus aureus
SFETKEPVTQ

SEQ ID NO: 1572212 - protein, 24 aa, Staphylococcus aureus
SFGGEEAKCSTESSGGGSDGKGFD

SEQ ID NO: 1572213 - protein, 24 aa, Staphylococcus aureus
SFGGKEAKCSTESSGGGSDGKGFD

SEQ ID NO: 1572214 - protein, 16 aa, Staphylococcus aureus
SFKSSVNKSRIDGKVG

SEQ ID NO: 1572215 - protein, 6 aa, Staphylococcus aureus
SFTHEN

SEQ ID NO: 1572216 - protein, 13 aa, Staphylococcus aureus
SGAEGTRVEDTMT

SEQ ID NO: 1572217 - protein, 14 aa, Staphylococcus aureus
SGAINKPVSIPDTY

SEQ ID NO: 1572218 - protein, 6 aa, Staphylococcus aureus
SGAPPL

SEQ ID NO: 1572219 - protein, 4 aa, Staphylococcus aureus
SGAR

SEQ ID NO: 1572220 - protein, 6 aa, Staphylococcus aureus
SGDKLH

SEQ ID NO: 1572221 - protein, 4 aa, Staphylococcus aureus
SGGI

SEQ ID NO: 1572222 - protein, 10 aa, Staphylococcus aureus
SGGQGPDEPI

SEQ ID NO: 1572223 - protein, 7 aa, Staphylococcus aureus
SGGSDFK

SEQ ID NO: 1572224 - protein, 13 aa, Staphylococcus aureus
SGHGGGSSLGKGL

SEQ ID NO: 1572225 - protein, 7 aa, Staphylococcus aureus
SGITNYK

SEQ ID NO: 1572226 - protein, 6 aa, Staphylococcus aureus
SGKIAR

SEQ ID NO: 1572227 - protein, 5 aa, Staphylococcus aureus
SGKIE

SEQ ID NO: 1572228 - protein, 6 aa, Staphylococcus aureus
SGKVEA

SEQ ID NO: 1572229 - protein, 13 aa, Staphylococcus aureus
SGLNKTDQSNLNK

SEQ ID NO: 1572230 - protein, 12 aa, Staphylococcus aureus
SGNSAGKDNETL

SEQ ID NO: 1572231 - protein, 12 aa, Staphylococcus aureus
SGNSAGKGNETL

SEQ ID NO: 1572232 - protein, 12 aa, Staphylococcus aureus
SGNTAGKGNEAL

SEQ ID NO: 1572233 - protein, 7 aa, Staphylococcus aureus
SGNTPYT

SEQ ID NO: 1572234 - protein, 6 aa, Staphylococcus aureus
SGRILP

SEQ ID NO: 1572235 - protein, 4 aa, Staphylococcus aureus
SGRQ

SEQ ID NO: 1572236 - protein, 4 aa, Staphylococcus aureus
SGSN

SEQ ID NO: 1572237 - protein, 16 aa, Staphylococcus aureus
SGSQTDKNETTKELKG

SEQ ID NO: 1572238 - protein, 9 aa, Staphylococcus aureus
SGSTGQPKG

SEQ ID NO: 1572239 - protein, 15 aa, Staphylococcus aureus
SGTTGLPKAYYRDED

SEQ ID NO: 1572240 - protein, 17 aa, Staphylococcus aureus
SGTVTQGSNPNGEKPTV

SEQ ID NO: 1572241 - protein, 12 aa, Staphylococcus aureus
SGVKPGKGTERY

SEQ ID NO: 1572242 - protein, 9 aa, Staphylococcus aureus
SHKGERRPM

SEQ ID NO: 1572243 - protein, 7 aa, Staphylococcus aureus
SHVDSQK

SEQ ID NO: 1572244 - protein, 6 aa, Staphylococcus aureus
SIAEKM

SEQ ID NO: 1572245 - protein, 10 aa, Staphylococcus aureus
SIDSGSDDQF

SEQ ID NO: 1572246 - protein, 7 aa, Staphylococcus aureus
SIDTTFN

SEQ ID NO: 1572247 - protein, 19 aa, Staphylococcus aureus
SIHDSTYSTIEDGLEAGAK

SEQ ID NO: 1572248 - protein, 9 aa, Staphylococcus aureus
SINEKTNST

SEQ ID NO: 1572249 - protein, 5 aa, Staphylococcus aureus
SINGI

SEQ ID NO: 1572250 - protein, 35 aa, Staphylococcus aureus
SINNAQKDALTRSIDGATTVAGVNQETVKATELNT

SEQ ID NO: 1572251 - protein, 22 aa, Staphylococcus aureus
SINNAQKEALKTQIEGATTVAG

SEQ ID NO: 1572252 - protein, 14 aa, Staphylococcus aureus
SINPEPSFKVDGKK

SEQ ID NO: 1572253 - protein, 18 aa, Staphylococcus aureus
SIPKQQPQTKPEKKNVSR

SEQ ID NO: 1572254 - protein, 31 aa, Staphylococcus aureus
SIQDNAATKANSKYINEDQSEQQNYDQAVQA

SEQ ID NO: 1572255 - protein, 20 aa, Staphylococcus aureus
SIREEGPQNHMKKTGTPTMG

SEQ ID NO: 1572256 - protein, 205 aa, Staphylococcus aureus
SISDSQSMSESVNDSESESESNSESDSKSMSGSTSVSDSGSLSVSTSLRKSESVSESSSLSGSQSMSDSVSTSDSSSLSVSTSLRSSESVSESDSLSDSKSTSGSTSTSTSGSLSTSTSLSGSESVSESTSLSDSISMSDSTSTSDSDSLSGSISLSGSTSLSTSDSLSDSKSLSSSQSMSGSESTSTSVSDSQSSSTSNSQFDS

SEQ ID NO: 1572257 - protein, 79 aa, Staphylococcus aureus
SISDSQSMSESVNDSESVSESNSESDSKSMSGSTSVSDSGSLSVSTSLRKSESVSESSSLSGSQSMSDSVSTSDSSSLS

SEQ ID NO: 1572258 - protein, 156 aa, Staphylococcus aureus
SISDSQSMSESVNDSESVSESNSESDSKSMSGSTSVSDSGSLSVSTSLRKSESVSESSSLSGSQSMSDSVSTSDSSSLSVSTSQRSSESVSESDSLSDSKSTSGSTSTSTSGSLSTSTSLSDSKSLSSSQSMSGSESTSTSVSDSQSSSTSNSQFD

SEQ ID NO: 1572259 - protein, 7 aa, Staphylococcus aureus
SITGRGI

SEQ ID NO: 1572260 - protein, 16 aa, Staphylococcus aureus
SITGRGIQGNIDGTTY

SEQ ID NO: 1572261 - protein, 6 aa, Staphylococcus aureus
SKAELL

SEQ ID NO: 1572262 - protein, 31 aa, Staphylococcus aureus
SKANNESKEAVNKTQEIQKKYEDNAETVQYN

SEQ ID NO: 1572263 - protein, 31 aa, Staphylococcus aureus
SKANNESKQAVNKTEEIQKKYEDNAETVQYN

SEQ ID NO: 1572264 - protein, 9 aa, Staphylococcus aureus
SKDDQKTYL

SEQ ID NO: 1572265 - protein, 31 aa, Staphylococcus aureus
SKDGSTGKNENKKVDIESTENQFESKDKTTK

SEQ ID NO: 1572266 - protein, 13 aa, Staphylococcus aureus
SKDLDDKYSPSKL

SEQ ID NO: 1572267 - protein, 5 aa, Staphylococcus aureus
SKDPF

SEQ ID NO: 1572268 - protein, 12 aa, Staphylococcus aureus
SKDQQASSAATI

SEQ ID NO: 1572269 - protein, 168 aa, Staphylococcus aureus
SKEADASENSVTQSDSASIEIKSSDSSSVNVAPKTDNTNVSDTKTTSNTNNGETSVAQNPAQQETTQSASTNATTEETPVTGETTTATNQANTPATTQSSNTNAEELVNQTSNETTSNDTNTVSSVNSPQNSTNAENVSTTQDTSTEATPSNNESAPQSTDASNKDVV

SEQ ID NO: 1572270 - protein, 168 aa, Staphylococcus aureus
SKEADASENSVTQSDSASNESKSNDSSSVSAAPKTDDTNVSDTKTSSNTNNGETSVAQNPAQQETTQSSLTNATTEETPVTGEATTATNQANTPATTQSSNTNAEELVNQTSNETTSNDTNTVSSVNSPQNSTNAENVSTTQDTSTEATHSNNESAPQSTDASNKDLV

SEQ ID NO: 1572271 - protein, 169 aa, Staphylococcus aureus
SKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTFNDTNTVSSVNSPQNSTNAENVSTTQDTSTEATPSNNESAPQSTDASNKDVV

SEQ ID NO: 1572272 - protein, 180 aa, Staphylococcus aureus
SKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQNTDASNKDVVSQAVNPSTPRM

SEQ ID NO: 1572273 - protein, 169 aa, Staphylococcus aureus
SKEADASENSVTQTENTSNESKSNDSSSVNAAPKTDNTNVSDSNTTTNTNSDETNVAQNPAQQETTQSASTNATTEETPVTGEVTTTATNQANTPATTQSSNTNAEKSVNQTSNETTSNDTNTVSSVNSPQNSTNAENVSTTQDTSTEAKPSNNESAPQSTDASNKDVV

SEQ ID NO: 1572274 - protein, 7 aa, Staphylococcus aureus
SKEDFSE

SEQ ID NO: 1572275 - protein, 7 aa, Staphylococcus aureus
SKEGRDI

SEQ ID NO: 1572276 - protein, 14 aa, Staphylococcus aureus
SKEVDYSEAITDEI

SEQ ID NO: 1572277 - protein, 6 aa, Staphylococcus aureus
SKGSKL

SEQ ID NO: 1572278 - protein, 10 aa, Staphylococcus aureus
SKIKKSATDW

SEQ ID NO: 1572279 - protein, 17 aa, Staphylococcus aureus
SKKEEMQQKMGNQQVEV

SEQ ID NO: 1572280 - protein, 19 aa, Staphylococcus aureus
SKKEEMQQKVASGEIPPQV

SEQ ID NO: 1572281 - protein, 24 aa, Staphylococcus aureus
SKKGKQFDVPEAERKELPKYRNHR

SEQ ID NO: 1572282 - protein, 6 aa, Staphylococcus aureus
SKKIGE

SEQ ID NO: 1572283 - protein, 11 aa, Staphylococcus aureus
SKKTVSAIKNN

SEQ ID NO: 1572284 - protein, 7 aa, Staphylococcus aureus
SKLPGVN

SEQ ID NO: 1572285 - protein, 6 aa, Staphylococcus aureus
SKLPTK

SEQ ID NO: 1572286 - protein, 5 aa, Staphylococcus aureus
SKLSN

SEQ ID NO: 1572287 - protein, 9 aa, Staphylococcus aureus
SKNTMSEEE

SEQ ID NO: 1572288 - protein, 6 aa, Staphylococcus aureus
SKNTSD

SEQ ID NO: 1572289 - protein, 6 aa, Staphylococcus aureus
SKNTSN

SEQ ID NO: 1572290 - protein, 17 aa, Staphylococcus aureus
SKNVSFTNPQDVNNIPG

SEQ ID NO: 1572291 - protein, 36 aa, Staphylococcus aureus
SKPANKYGESPKYPSSIKNQPVTSETPKTPEETDNQ

SEQ ID NO: 1572292 - protein, 109 aa, Staphylococcus aureus
SKPSEHDKETRIDSESSRTDSDSSMQTEKIKKDSSDGNKSSNLKSEVISDKSNTVPKLSESDDEVNNQKPLTLPEEQKLQRQQSQNEQTKTYTYGDSEQNDKSNHENDL

SEQ ID NO: 1572293 - protein, 11 aa, Staphylococcus aureus
SKQAFNASDSL

SEQ ID NO: 1572294 - protein, 15 aa, Staphylococcus aureus
SKQNESTTFTIQFPD

SEQ ID NO: 1572295 - protein, 8 aa, Staphylococcus aureus
SKQPYNVT

SEQ ID NO: 1572296 - protein, 7 aa, Staphylococcus aureus
SKQYDQL

SEQ ID NO: 1572297 - protein, 7 aa, Staphylococcus aureus
SKQYQLG

SEQ ID NO: 1572298 - protein, 4 aa, Staphylococcus aureus
SKRL

SEQ ID NO: 1572299 - protein, 11 aa, Staphylococcus aureus
SKSNKPGEIDD

SEQ ID NO: 1572300 - protein, 10 aa, Staphylococcus aureus
SKSNKPGVID

SEQ ID NO: 1572301 - protein, 14 aa, Staphylococcus aureus
SKSSLEAFNRSKAK

SEQ ID NO: 1572302 - protein, 7 aa, Staphylococcus aureus
SKTHTDP

SEQ ID NO: 1572303 - protein, 7 aa, Staphylococcus aureus
SKTLGAS

SEQ ID NO: 1572304 - protein, 5 aa, Staphylococcus aureus
SKTSG

SEQ ID NO: 1572305 - protein, 6 aa, Staphylococcus aureus
SKTYGS

SEQ ID NO: 1572306 - protein, 9 aa, Staphylococcus aureus
SLAKNDLKE

SEQ ID NO: 1572307 - protein, 25 aa, Staphylococcus aureus
SLDTPKKIGPKYAPVGASNDPNNMN

SEQ ID NO: 1572308 - protein, 4 aa, Staphylococcus aureus
SLEL

SEQ ID NO: 1572309 - protein, 11 aa, Staphylococcus aureus
SLKAYKNKNFS

SEQ ID NO: 1572310 - protein, 9 aa, Staphylococcus aureus
SLKDYGEKM

SEQ ID NO: 1572311 - protein, 10 aa, Staphylococcus aureus
SLKKGQSGFK

SEQ ID NO: 1572312 - protein, 6 aa, Staphylococcus aureus
SLKNDY

SEQ ID NO: 1572313 - protein, 4 aa, Staphylococcus aureus
SLLS

SEQ ID NO: 1572314 - protein, 14 aa, Staphylococcus aureus
SLNKESKKQEFENS

SEQ ID NO: 1572315 - protein, 8 aa, Staphylococcus aureus
SLRDQVAE

SEQ ID NO: 1572316 - protein, 8 aa, Staphylococcus aureus
SLSAENTV

SEQ ID NO: 1572317 - protein, 149 aa, Staphylococcus aureus
SLSESTSESTSESLSGSTSDSTSLSDSNSESGSTSTSLSNSTSGSTSISTSTSGSASTSTVKSESVSTSLSTSTSTSLSDSTSLSTSLSDSTSGSKSNSLSASMSTSDSISTRKSESLSASTSLSGSTSESESGSTSSSASQSDSTSMS

SEQ ID NO: 1572318 - protein, 149 aa, Staphylococcus aureus
SLSESTSESTSESVSSSTSASTSLSDSTSESGSTSTSLSNSTSGSASISTSTSNSESTSTFKSESVSTSLSTSTSTSLSDSTSLSTSISDSTSDSKSDSLSTSMSTSDSISTSKSDSISTSTSLSGSTSESESDSTSSSESKSDSTSMS

SEQ ID NO: 1572319 - protein, 99 aa, Staphylococcus aureus
SLSESTSESTSESVSSSTSESTSLSDSTSESGSTSTSLSNSTSGSKSDSLSTSMSTSDSISTSKSDSISTSTSLSGSTSESESDSTSSSESKSDSTSMS

SEQ ID NO: 1572320 - protein, 149 aa, Staphylococcus aureus
SLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSLS

SEQ ID NO: 1572321 - protein, 139 aa, Staphylococcus aureus
SLSESTSESTSESVSSSTSESTSLSDSTSESGSTSTSLSNSTSGSTSISTSTSISESTSTFKSESVSTSLSMSTSTSLSDSTSLSTSLSDSTSDSKSDSLSTSMSTSDSISTSKSDSISTSTSLSGSTSESKSDSTSMS

SEQ ID NO: 1572322 - protein, 149 aa, Staphylococcus aureus
SLSESTSESTSESVSSSTSESTSLSDSTSESGSTSTSLSSSTSGSTSISTSTSISESTSTFKSESVSTSLSMSTSTSLSDSTSLSTSLSDSTSDSKSDSLSTSMSTSDSISTSKSDSISTSTSLSGSTSESESDSTSSSESKSDSTSMS

SEQ ID NO: 1572323 - protein, 41 aa, Staphylococcus aureus
SLSPQTIGEETIKKGQDEWNKRRKKQSEDKQQKRENQRDKP

SEQ ID NO: 1572324 - protein, 25 aa, Staphylococcus aureus
SLSSSANASQTDNGVNRSGSEYPTV

SEQ ID NO: 1572325 - protein, 39 aa, Staphylococcus aureus
SLSSSANASQTDNGVNRSGSEYPTVYSATSTKKLHKEPA

SEQ ID NO: 1572326 - protein, 39 aa, Staphylococcus aureus
SLSSSANASQTGNGVNRSDSEDPTVYSATSTKKLHKEPA

SEQ ID NO: 1572327 - protein, 12 aa, Staphylococcus aureus
SLTKNNEYISQE

SEQ ID NO: 1572328 - protein, 9 aa, Staphylococcus aureus
SMGKPLPGI

SEQ ID NO: 1572329 - protein, 183 aa, Staphylococcus aureus
SMSASTSTSQSTSVSTSLSTSDSISDSTSISISGSQSAVESESTSDSTSISDSESLSTSDSDSTSTSTSVSTSGSTSTSVSESLSTSGSGSTSVSDSTSMSESDSTSISNSESVSTSTSTSLSTSDSTSTSESLSTSMSGSQSISDSTSTSMSNSTSMSNSTSTSMSGSTSTSESNSMHPSDS

SEQ ID NO: 1572330 - protein, 15 aa, Staphylococcus aureus
SNAQGTSKPSVRTRA

SEQ ID NO: 1572331 - protein, 10 aa, Staphylococcus aureus
SNGKDKEHTF

SEQ ID NO: 1572332 - protein, 11 aa, Staphylococcus aureus
SNGKDKEHTFE

SEQ ID NO: 1572333 - protein, 4 aa, Staphylococcus aureus
SNIH

SEQ ID NO: 1572334 - protein, 4 aa, Staphylococcus aureus
SNII

SEQ ID NO: 1572335 - protein, 4 aa, Staphylococcus aureus
SNIR

SEQ ID NO: 1572336 - protein, 7 aa, Staphylococcus aureus
SNKGKAL

SEQ ID NO: 1572337 - protein, 5 aa, Staphylococcus aureus
SNKSK

SEQ ID NO: 1572338 - protein, 5 aa, Staphylococcus aureus
SNLSS

SEQ ID NO: 1572339 - protein, 19 aa, Staphylococcus aureus
SNNANTNAFRPGGAQQLNE

SEQ ID NO: 1572340 - protein, 24 aa, Staphylococcus aureus
SNNAQGDGKDKPNDPIIEKSEPID

SEQ ID NO: 1572341 - protein, 24 aa, Staphylococcus aureus
SNNAQGDGKDKPNDPIIEKSEPIE

SEQ ID NO: 1572342 - protein, 5 aa, Staphylococcus aureus
SNPIS

SEQ ID NO: 1572343 - protein, 6 aa, Staphylococcus aureus
SNPQTL

SEQ ID NO: 1572344 - protein, 24 aa, Staphylococcus aureus
SNSAQGDGKDKPNDPIIDKSEPIE

SEQ ID NO: 1572345 - protein, 10 aa, Staphylococcus aureus
SNSSNLKQYT

SEQ ID NO: 1572346 - protein, 9 aa, Staphylococcus aureus
SNSTHNASD

SEQ ID NO: 1572347 - protein, 9 aa, Staphylococcus aureus
SNTDRNKGN

SEQ ID NO: 1572348 - protein, 15 aa, Staphylococcus aureus
SNTESLNIGKKRGSL

SEQ ID NO: 1572349 - protein, 19 aa, Staphylococcus aureus
SNTETFTPPKFDNNTNPDL

SEQ ID NO: 1572350 - protein, 17 aa, Staphylococcus aureus
SNVTIDAATSSGAGLDP

SEQ ID NO: 1572351 - protein, 12 aa, Staphylococcus aureus
SNWKDKKLNQEL

SEQ ID NO: 1572352 - protein, 13 aa, Staphylococcus aureus
SPKKYAKISREEF

SEQ ID NO: 1572353 - protein, 9 aa, Staphylococcus aureus
SPLKGNNKK

SEQ ID NO: 1572354 - protein, 10 aa, Staphylococcus aureus
SPNELSNHNN

SEQ ID NO: 1572355 - protein, 9 aa, Staphylococcus aureus
SPNEQNKHI

SEQ ID NO: 1572356 - protein, 12 aa, Staphylococcus aureus
SPPIKYGIATST

SEQ ID NO: 1572357 - protein, 5 aa, Staphylococcus aureus
SPREV

SEQ ID NO: 1572358 - protein, 8 aa, Staphylococcus aureus
SQGMTNTV

SEQ ID NO: 1572359 - protein, 18 aa, Staphylococcus aureus
SQHNSTEQNVTDRNLPSK

SEQ ID NO: 1572360 - protein, 24 aa, Staphylococcus aureus
SQITEYENKSKKVKEKSKSYIKEY

SEQ ID NO: 1572361 - protein, 6 aa, Staphylococcus aureus
SQLPSQ

SEQ ID NO: 1572362 - protein, 7 aa, Staphylococcus aureus
SQNTNNV

SEQ ID NO: 1572363 - protein, 14 aa, Staphylococcus aureus
SQTSLKDDSRDNIK

SEQ ID NO: 1572364 - protein, 28 aa, Staphylococcus aureus
SQVANAKGALNGNHNLEQAKSNANTTIN

SEQ ID NO: 1572365 - protein, 4 aa, Staphylococcus aureus
SRDY

SEQ ID NO: 1572366 - protein, 5 aa, Staphylococcus aureus
SREEF

SEQ ID NO: 1572367 - protein, 17 aa, Staphylococcus aureus
SREFTKEETQRMQFIYD

SEQ ID NO: 1572368 - protein, 16 aa, Staphylococcus aureus
SRKEEGDGGDFGRQQR

SEQ ID NO: 1572369 - protein, 8 aa, Staphylococcus aureus
SRKKDTAI

SEQ ID NO: 1572370 - protein, 6 aa, Staphylococcus aureus
SRLRGM

SEQ ID NO: 1572371 - protein, 4 aa, Staphylococcus aureus
SRNE

SEQ ID NO: 1572372 - protein, 7 aa, Staphylococcus aureus
SRNQEKL

SEQ ID NO: 1572373 - protein, 15 aa, Staphylococcus aureus
SRNTSLQKDDYVDTT

SEQ ID NO: 1572374 - protein, 72 aa, Staphylococcus aureus
SRQAKYKQKSTEELGIEDDGYYAEPEVDPKELKAQQKREKAEIKAKKKEKRKAYNQRMKERRKNQPSAVSQR

SEQ ID NO: 1572375 - protein, 11 aa, Staphylococcus aureus
SRQYKGSQKQV

SEQ ID NO: 1572376 - protein, 10 aa, Staphylococcus aureus
SRSGSTISTG

SEQ ID NO: 1572377 - protein, 23 aa, Staphylococcus aureus
SRSGVDPKGYTKSKQIAQDDGMH

SEQ ID NO: 1572378 - protein, 15 aa, Staphylococcus aureus
SRTYSRHNNEEKSQA

SEQ ID NO: 1572379 - protein, 10 aa, Staphylococcus aureus
SRVGNGVTTP

SEQ ID NO: 1572380 - protein, 48 aa, Staphylococcus aureus
SRVTPPNNEQKAPSNPKGEVNHSNKVSKQHKTDALPETGDKSENTNAT

SEQ ID NO: 1572381 - protein, 9 aa, Staphylococcus aureus
SSATFKDTT

SEQ ID NO: 1572382 - protein, 24 aa, Staphylococcus aureus
SSAVRSGKSYVEKEQWTSPDKAIL

SEQ ID NO: 1572383 - protein, 25 aa, Staphylococcus aureus
SSDKTFEADNTGSMSANQSDNGSIE

SEQ ID NO: 1572384 - protein, 12 aa, Staphylococcus aureus
SSDNSKSASMGN

SEQ ID NO: 1572385 - protein, 6 aa, Staphylococcus aureus
SSDPFR

SEQ ID NO: 1572386 - protein, 11 aa, Staphylococcus aureus
SSELTKARYAN

SEQ ID NO: 1572387 - protein, 5 aa, Staphylococcus aureus
SSFPD

SEQ ID NO: 1572388 - protein, 8 aa, Staphylococcus aureus
SSGASQRA

SEQ ID NO: 1572389 - protein, 4 aa, Staphylococcus aureus
SSHF

SEQ ID NO: 1572390 - protein, 32 aa, Staphylococcus aureus
SSHLEQRKRDVNENKAEESKSNQDSKSAYNRD

SEQ ID NO: 1572391 - protein, 32 aa, Staphylococcus aureus
SSHLEQRNRDVNENKAEESKSNQGSKSTYNRD

SEQ ID NO: 1572392 - protein, 15 aa, Staphylococcus aureus
SSIENDEKDTHKVYS

SEQ ID NO: 1572393 - protein, 7 aa, Staphylococcus aureus
SSKNTPY

SEQ ID NO: 1572394 - protein, 10 aa, Staphylococcus aureus
SSNNDVGHHA

SEQ ID NO: 1572395 - protein, 12 aa, Staphylococcus aureus
SSNNSKSASMGN

SEQ ID NO: 1572396 - protein, 5 aa, Staphylococcus aureus
SSNPV

SEQ ID NO: 1572397 - protein, 133 aa, Staphylococcus aureus
SSNSDGPNTSSRHDLQKSKQSQEDQGLQREVKRNTEIKRNPQQDMSNYSNLSRPPKEISRTSQTPNELSSNTREVQSSYDKDIEKRRIQNHQTHQNQHHSNTNGDQYRRSAQHNNKNEAEKRLKEQKDISKHG

SEQ ID NO: 1572398 - protein, 4 aa, Staphylococcus aureus
SSSE

SEQ ID NO: 1572399 - protein, 6 aa, Staphylococcus aureus
SSSKFD

SEQ ID NO: 1572400 - protein, 44 aa, Staphylococcus aureus
SSSKTYGPYPQNKDITISASGKAKGKTFTTQTKTIKASDLKYNT

SEQ ID NO: 1572401 - protein, 44 aa, Staphylococcus aureus
SSSKTYGPYPQNKDITISASGKAKGKTFTTQTKTIKASDLKYST

SEQ ID NO: 1572402 - protein, 5 aa, Staphylococcus aureus
SSTNM

SEQ ID NO: 1572403 - protein, 81 aa, Staphylococcus aureus
SSVDFEEDTLPQVSGHNEGQQTIEEDTTPPIVPPTPPTPEVPSEPEVPTPPTSEIPSEPGKPVPPAKEEPKKPSKPVEQGK

SEQ ID NO: 1572404 - protein, 9 aa, Staphylococcus aureus
STADKPGLV

SEQ ID NO: 1572405 - protein, 7 aa, Staphylococcus aureus
STDEGTV

SEQ ID NO: 1572406 - protein, 15 aa, Staphylococcus aureus
STEYYNGQEGEQEVA

SEQ ID NO: 1572407 - protein, 17 aa, Staphylococcus aureus
STGKMRAEYAGKTWETS

SEQ ID NO: 1572408 - protein, 10 aa, Staphylococcus aureus
STIGEGRGLG

SEQ ID NO: 1572409 - protein, 11 aa, Staphylococcus aureus
STLERKKQVDF

SEQ ID NO: 1572410 - protein, 29 aa, Staphylococcus aureus
STPAGYTPTTANSGTDDAVDSDGLTTTGV

SEQ ID NO: 1572411 - protein, 13 aa, Staphylococcus aureus
STQIDDGTETNYD

SEQ ID NO: 1572412 - protein, 151 aa, Staphylococcus aureus
STSASSSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSISGSSSTSASLSDSTSNAISTSTSLSDSTSTSGSVSGSLS

SEQ ID NO: 1572413 - protein, 149 aa, Staphylococcus aureus
STSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSKSLSTSTSESSSTSASLSDSTSNAISTSESLSESASTSDSISIS

SEQ ID NO: 1572414 - protein, 149 aa, Staphylococcus aureus
STSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSDSASTSQSVSDSTSNSISTSESLSESASTSDSISIS

SEQ ID NO: 1572415 - protein, 201 aa, Staphylococcus aureus
STSASTSKSTSVSLSDSVSASKSLSTSESNSVSSSTSTSLVNSQSVSSSMSDSASKSTSLSDSISNSSSTEKSESLSTSTSDSLRTSTSLSDSLSMSTSGSLSKSQSLSTSTSESSSTSQSLSDSTSNAISTSESLSESASTSDSISISNSIANSQSASTSKSDSQSTSISLSTSDSKSMSTSESLSDSTSTSGSVSGSLS

SEQ ID NO: 1572416 - protein, 149 aa, Staphylococcus aureus
STSASTSKSTSVSLSDSVSASKSLSTSESNSVSSSTSTSLVNSQSVSSSMSDSASKSTSLSDSISNSSSTEKSESLSTSTSDSLRTSTSLSGSLSMSTSGSLSKSQSLSTSTSESSSTSQSLSDSTSNAISTSESLSESASTSDSISIS

SEQ ID NO: 1572417 - protein, 7 aa, Staphylococcus aureus
STSIPKN

SEQ ID NO: 1572418 - protein, 21 aa, Staphylococcus aureus
STSMSGSTSTSESNSMHPSDS

SEQ ID NO: 1572419 - protein, 7 aa, Staphylococcus aureus
STSSSEA

SEQ ID NO: 1572420 - protein, 18 aa, Staphylococcus aureus
STTDSGGGDGTAKPEEKL

SEQ ID NO: 1572421 - protein, 10 aa, Staphylococcus aureus
STVKDIEQKV

SEQ ID NO: 1572422 - protein, 22 aa, Staphylococcus aureus
SVANQEKKRAELPKTGLESTQK

SEQ ID NO: 1572423 - protein, 22 aa, Staphylococcus aureus
SVATGTAWGSASTAGIALISIG

SEQ ID NO: 1572424 - protein, 14 aa, Staphylococcus aureus
SVATGTAWGSVSTA

SEQ ID NO: 1572425 - protein, 20 aa, Staphylococcus aureus
SVEKGVQSIDKEEIASTSTY

SEQ ID NO: 1572426 - protein, 7 aa, Staphylococcus aureus
SVGHSKQ

SEQ ID NO: 1572427 - protein, 11 aa, Staphylococcus aureus
SVGNGSALRGY

SEQ ID NO: 1572428 - protein, 12 aa, Staphylococcus aureus
SVGPSLAPTNAK

SEQ ID NO: 1572429 - protein, 6 aa, Staphylococcus aureus
SVGVSG

SEQ ID NO: 1572430 - protein, 5 aa, Staphylococcus aureus
SVKKN

SEQ ID NO: 1572431 - protein, 5 aa, Staphylococcus aureus
SVRPS

SEQ ID NO: 1572432 - protein, 13 aa, Staphylococcus aureus
SVSHSNPGEVSKA

SEQ ID NO: 1572433 - protein, 13 aa, Staphylococcus aureus
SVSSNARTTNVNY

SEQ ID NO: 1572434 - protein, 86 aa, Staphylococcus aureus
SVSTSESTSESVSSSTSASTSLSDSTSESGSASTSLSNSTSGSASISTSTSNSESTSTFKSESVSTSLSTSTSTSLSDSTSTSLSL

SEQ ID NO: 1572435 - protein, 5 aa, Staphylococcus aureus
SVYGT

SEQ ID NO: 1572436 - protein, 12 aa, Staphylococcus aureus
SYAKNPKETKDS

SEQ ID NO: 1572437 - protein, 18 aa, Staphylococcus aureus
TADAVANPVGKPTNAVDA

SEQ ID NO: 1572438 - protein, 12 aa, Staphylococcus aureus
TADKETSKNVNV

SEQ ID NO: 1572439 - protein, 6 aa, Staphylococcus aureus
TAGDTW

SEQ ID NO: 1572440 - protein, 7 aa, Staphylococcus aureus
TAGGQAE

SEQ ID NO: 1572441 - protein, 26 aa, Staphylococcus aureus
TAGKSLKGSYPNVDNEQDRSYYAEHP

SEQ ID NO: 1572442 - protein, 25 aa, Staphylococcus aureus
TAGKSLKGSYPNVDNKQDRAYYAEH

SEQ ID NO: 1572443 - protein, 10 aa, Staphylococcus aureus
TAGQFGVPSL

SEQ ID NO: 1572444 - protein, 32 aa, Staphylococcus aureus
TAGVTGNLGGNSSKEANKTHKIGETVKNDDLE

SEQ ID NO: 1572445 - protein, 32 aa, Staphylococcus aureus
TAGVTGNLGGNSSKEANKTHKIGETVKNGDLE

SEQ ID NO: 1572446 - protein, 11 aa, Staphylococcus aureus
TAHAEQDQTWD

SEQ ID NO: 1572447 - protein, 43 aa, Staphylococcus aureus
TAINGASDLNQKQKDALKAQANGAQRVSNAQDVQHNATELNTA

SEQ ID NO: 1572448 - protein, 23 aa, Staphylococcus aureus
TAKKKTTSKKRTNSRKKKNDNPI

SEQ ID NO: 1572449 - protein, 18 aa, Staphylococcus aureus
TAQKTNLTNQINSGTTVA

SEQ ID NO: 1572450 - protein, 5 aa, Staphylococcus aureus
TAQQA

SEQ ID NO: 1572451 - protein, 5 aa, Staphylococcus aureus
TASDE

SEQ ID NO: 1572452 - protein, 6 aa, Staphylococcus aureus
TASTPV

SEQ ID NO: 1572453 - protein, 16 aa, Staphylococcus aureus
TAVGKKEEVAKNTEKV

SEQ ID NO: 1572454 - protein, 16 aa, Staphylococcus aureus
TAVGQKKEVAKNTEKV

SEQ ID NO: 1572455 - protein, 7 aa, Staphylococcus aureus
TAVSGAI

SEQ ID NO: 1572456 - protein, 4 aa, Staphylococcus aureus
TDDF

SEQ ID NO: 1572457 - protein, 17 aa, Staphylococcus aureus
TDDSNGRPKDDEKRYPV

SEQ ID NO: 1572458 - protein, 6 aa, Staphylococcus aureus
TDDYGR

SEQ ID NO: 1572459 - protein, 11 aa, Staphylococcus aureus
TDEGPGISLEE

SEQ ID NO: 1572460 - protein, 13 aa, Staphylococcus aureus
TDEKAKSLSITKA

SEQ ID NO: 1572461 - protein, 5 aa, Staphylococcus aureus
TDGIA

SEQ ID NO: 1572462 - protein, 44 aa, Staphylococcus aureus
TDHAKGSEQDQGLFNDNKDDEAFAAKNPESEEYKVNEKIKKEHK

SEQ ID NO: 1572463 - protein, 13 aa, Staphylococcus aureus
TDLGRNFSGTVSG

SEQ ID NO: 1572464 - protein, 6 aa, Staphylococcus aureus
TDMNNN

SEQ ID NO: 1572465 - protein, 7 aa, Staphylococcus aureus
TDNHQFE

SEQ ID NO: 1572466 - protein, 16 aa, Staphylococcus aureus
TDNSAKAESKKDDTDL

SEQ ID NO: 1572467 - protein, 8 aa, Staphylococcus aureus
TDPARRND

SEQ ID NO: 1572468 - protein, 12 aa, Staphylococcus aureus
TDSNIDKDAHHD

SEQ ID NO: 1572469 - protein, 21 aa, Staphylococcus aureus
TDSTGVASTYTSSSTADNAAK
